United States Patent 9,487,797 (GENOMIC PLANT SEQUENCES AND USES THEREOF) - sequence listing, part 48

SEQ ID NO: 66140 - DNA, 66545 bp, Oryza sativa
ccaccatcgccctatcggtatcatcattcatctccaccctttgcaggttcactgacatatataagtgctatccgctctattagcctcatgatctacgacatagcatctacgcacattcttgctcatctgacccattatgttagccatcaacttataaaataaaaagaataggttcagttgtacattgcaagtctaaaccgtggatggtgcgtgagtgtgcacacctgcgctgtgtgcttttgggttttttcttctttttttttttggctttctccccagttttcaacctgtaaatttgctctgcatggtggtgcttgtaaggccctctaattttcacagtggtcttatgtgttgttgactgtgtttgctctgccaaaaccggcaaggtttaaccccagaaatgaaaggctgaactaagagtggttggatggttgctatgctactgaaacgttgtctatcatctgtatcttgttccatgaattgcctactttctttgtgcattttttgttgagctttactttctgatattaaattgctggtgttatgttttcctgacgtagtggtcatctgtattgctgctgtgaatcattgtataatttgttcctatatacctgttctatcatgatgctatcagtgtttctcgtattcaaggctgcgtcagttttgcactccaggtgttgtgttttcccacgtcaacactctgtttaagatatggaaatcactcattgtctttctgttattttattgtatacagaaaccagtcattatctgttcgctctcttgcttttgtaattaacaaggagccctcattgtcttatcatctgtcatccaccatgttactccattcctaattctaaagatgccgactctgatgcagcactatgataaatgtttggtctcatcagtcgggacactgataacaaacagcactttagagtgctaaaatacagtaaccatagattccccttaatctttcaactgaaaacttcagtctaactaaccataatttaaaccaaattaattagcggttatttttctgactctataaccatgcatatactgtctgaagtagattcagagatggttttagaattaaggcaaaagattgttaagcgtatggccacctgtctgttagtataatgctgcagtaaagagtagtaataagcatatatagacaacagtggtagtcattttcagtcactaaaatacatacactcttattgtactgtaattcatggttcccttgagccatggtcatcgtcaccatcatcactcgcacttgcgtcgaaggagtgattaggagatggttatcgtgtgtgacgtggatcaagccagataagcatttcaatgtttttatttttgagagagagcagggataagcatttcaattagcaaatgaaaggtgtctgctatagctttttctgcaaggacaataattaatgaatctgaaagtgtgtcgtccttggaaggaagatggaaaggaagaaccactcattaatcaaacaagtgtcacaaattggatcactgactgcctgactggacaggaatgttggtgcattatcatgttataactaaaagatgcgtgaaaatcagtgagcaatcatagaaaaatcatcaagtgcactgttccattgttgacaagaaaggtttttcctcacaaaataattaaaaccgtatccttccaagttccaacatacaggacaatctctgtgggatgtgacttggttaattatccagttacatctagagagttagcgaaaatcggctgtgcatgacaagatcacaaattaatttggagaacaaagaatgaattaaactaagttcataaaaagaaaaataatcgtgcatatcaaaatattcagaagagcgaaaaatacaaggatcagatgcgaaaagggccaaggttgcattgcaaaccatattagtttgctggtgtcctggtgatatatgcaactttagagagccagcaaatgacgtatctctacctaaagaaagatattcccctttggtattgacacaaaggaacatcaatcgctctcatttaactggcacgcacaacggttgcttcatcttcaactgctaattaactttctgaaacgctgatgctttttaatcctcttcttccccggcccatgcatattctctctgctttaatggtgtgaaatttcagaacaagaatctagtttccgcatacagagttccagaaatttccgactgttcatctcatcgatcatccgcgattctttttttagtttttgatggtgatcagccacaccgctagctagttgacacatgtatgcagtagcaatatttgttagctgaaaaggaagcaaggaggaaagcagcaaatcagctttgttgccaagctgcttggcaggtcacatttttcatttccgagttgattaatttgcaaccatcatgcatcaatacaattactatttaagcatattagtaaaattgtgtgaagttttttttttcaattaagccatgtcatgtgtgggggcgttaccttgcagactatataaatatgagtgaaattgacttgaggcgtcgagttgccttattgccaaacaatagtactattcattagtagtatatctgacccaaaacccaaccatttttccccctttgcgttgcatctcagtgttcttccattctttccagagagacaaagtaattgaccatggcaaaagatcctcatgtctccatctctctcaccggcctcgccatggtcgtcctcctcatcttcagctcctccttcctccaggccgcccaaggtacgtacacaccttcatcttcgcctgcttcatcatgcatcttggtgatccttcaagtcggttctgacttctcaattgatattcatgcatgcaggatcagacaagaagatggcaatgaagtacgacgtgccggtgaagaggctggtgtaccggccgtcggcgatgcaggcggcggtgatcggcacggaggcggcggcgtacgagccgttcgagctgtgcatgggctgccggtgctgcgcgtcgtcgaacgcgagcagctgcgtggacacgagatgctgctacgccatcgactgcaacatccccggcaagcccttcggcgtctgcgccttctctccccacacctgcgactgtggtgccaccaactgcaccagccaacagcagccatgaccacacacctcttgctgctgctaattcaattcgatctcttccatgatcaatatacttatgcgcctgaatcattcaactgttttctgatgcgattgcaaacgtattaagttttttcagagattcttgggacttagatatcctgacatgagcatgttgatctgaaagtttaactgcatatagaatcttcagaaagggattaattcttgatctaccagttccacaaacaatttattcgtgctttaaatctggatttgcattctctcttatcagagagtaattaatttgagggtctgatctgattaattgctgtagaacccactttgatgtatggatatggctgtgctgcctgtgcagactactagctagactgtagagaaaaggcggctgttttgtttgactattgcaggactagcacctaacactgttgttgtttgtatcctgttcttccttttcaaagcctacgtgccaaatacatgatcagcattcagcaaggtggatggtctagaaatcaagttgggcagtcacaggccggcacacgcttgatttgacaatcacttgttaggtggaaatgcaaatgaattgtaggtacaaacccacaatgttagtagcttaattagctcatcagctaaacgcctaaacctactctgaattaacttgaagtctgaaacgtacgtgatcgagggtactcatttcagcacgattaagcacacagcaatcaaggtgcttatatataagatgaagatactctgtctgcctgtctgtaagtgccagacatgcaactcgatcatcgccctagaaaacacatctctgtcaggcctgagcaaccactgttgttttgcaaataaaaatttcagattctcctttctccgatgatgcagcattggtttcactgatctgaaactagctacgaggaatggttagctttgtctaacaacttccttctgtttgagctttgggtttgcagacaatcatgtattctatggtcgccgggatcgccacggatcaaccggtgcagtgctctacgtacagcacactatatatattgcaaaatggatacggcgtttgttggaaaaatattttgtagaaaacacatatatagtaaaaatttggaaactaccgttaaaactaaaactgaacacctgagatttatacacatcatcgagagtaaaattttactcccagacaatttttttactctcgataacgcggacaaatattatgcgcctatttcataattcaacggtagcttataggttttcactatatttctagtttgtattacatattttcaacccgatggtgagttgttccaagctgctcctctgctttttactactccctgtcaataggttaattaagagagacataactcaatgtcaaaacaagcttaccaacctcaataacaactaggaaaaagtacaccaaaggtccctcaacttgtcatcgagttacagaatcatcacctaaccagatatatgatatctctaacttagaaaactgttcactttaggttcttcgatggttttgaccccggttttatccgacgtggcagctgagtcagcgtggacccatgtgggccccacatgtcagggtgtccacgtcacctttctttcccttctctcccttctttcttccgtctctcttgctcttctcactcgcgccgaacacgttgtgggaggcgcggccgggggcgacgccgaaaggcgaaagaggactccgcagaggcgagggtggactcgacgtcatcgacgcggccagcgccgaagagcgcggagaggagcgccgagagggagacgttggagcaggcaacgggcgcggagtcggagaacgcgcggagggcgttgttggggcccgagaagagggagatggcgcgggtgagaagaccaggggacgccagggcggagtcgaggagggcgcagaggagcgagacggcgaggtctaggcggcggaggcgcgggagacaggacacggcgagggaaaagagcgggcgggagccgtggaggcacgggtaatcgtcggggcgggagagcgtggtggcgacgagggagtggatgcgggccagatcggcctcgccgcagacggcgagctggaggtcgaggatggaggagcacgtgaggcgggggtgggggtccaggtgggcagcggcgggtgatcgacatcggggagcgcggagaagcgacggaggaggtgggcggggacgctagcggcgaggagcgggttgggatgccggcgaaggagggagaccatggttgagacttgagaggaatgggggtttgggaattgggatctcccctcttttttctcccttctctaggggaactcgtcaaggagggcgaggccatggtggcagtcacctcctccccttctcctgtcgttggccgccgacgccctcctccgcaactgccgtctccccttctcccgcgtcgccgccaccgccggtcgcccgtcgtcggccgtcgacaccctcctgctctcccgcctcaccccgcggcctcctctccactcgccgtccggcctgcagaatcccagtgagaagagtgaggagagagaggaagggagagaagaggagaaagagggagggtgatgacgtggacaccctgacttgtggggctcacatggtttactcagccgtaacgttggataaaattgggtcaaaatcactaaagaatctaaaataaaataaatggtttcgtagttgaggggtatcgtatatagttttgtggttagaggatgattttgcaactcgatgacaagttaagggacattcggtgtactttttcctaactgctatagtagggagcttttagcccatctgcatatagtggcctggcccacgttaggcctgtccattagtatgggccttagcccttcctctttaccgaaagcttcaccttttgaattgagcccatatgaacaataagacactatccatgttatttccttaaagataatagaattcattttagtctttacttttttaaaagaaactataaccaattatatagaggttacagaacgaacgatcatgaattacgaaattatagcttgatttaaaggaataattaaaatcgcaccattgatgtctatacatttcaatctttaatttctcggcacagtcgcatgcactcgcgttgcctcccaaaaagctcaaacagtttttgatttcgacatgcatagatacaagttgtggacaacttattcaggtacagtgcttacgtagttcaagatttctttatgacctgctttttttcttgttaattatggccttaatttgatactagtatatatcaagtggttcgcaacgcaagcaaactaaagttgcaatcacgcgggaaaagcagcaatgctgaaatagctagctagttagctttcacaattctgaaactattttctcctcttcttctgttcataatgtacggacacgactgtgagtgtcagagtgtcggcacaacaatttgattaatgatgcataggagaatgttttatgttgagcatgtaaattgttgaatacttccagtcggagaatgtttgatgttgagcatgtaaattgttgaatacttccacattaatatgcacgtagtatgggattaaaagcaacacaatggaaaacaaatttcggtatggtatatccttccccatatgtcttgagaatatgagataagtttagttaattaattaatttggttttacagatggaataaaatgaaaatatacgttaatatttgcatgcatgggttatatttgaattataacctgtgaaacagaaaaataacttttttttaagtacataataataggatctactatgggtttaatggattcgtgccggccggtttgcgcaaaccggcccagttgcccccgggtagcctacgcgttgtaggcttgcaactttttgcgagttggactaaaaaattggcttacagcttttaccccacctggcccatatccagcacacatacctttaaaaatttctatatataaagtttttatacagaaactaagtttctactaaaacgtcgtagctaaatcagaattggatgtgcccgcgtacgtgcattttgaaaatgtttctcaaggaaaactttgtgtataataaagtttctatgtgaaaaaatgtttttgtgtataataagaaatgtaaatacgtgctcctgatagattcacttaagtgacatgcccacgcattagacttttactaatagagtgcgtatgacacgatagtcattaagtcttttttaaaaattcttttattcagttttatctacaactaaaatctaatgctgactttcctcggaaaacaatcgagacttttcagttttgctgttctggagttgtacgcttcctctacaaacgaaatggagccaattcttctgcctgttttctttttcgcgaacgctgcctgttttttttactagcccctaaaatggatgatcaatcgtaccaacaaaataatacttcccccgtttcagaatataagtcattttagcattttctacatacatattgatgttaatgaatctaaacatatatatctatttagattcactaacatcaatatgaatgtgaataatgctagaatgacttacattgtgcaacggagggagtaaaccctaaggcacgttattgcatcatcgacaattaatcattattatattatgtccgactcgttacatacgacagatgatgtgattaattagaactgcaatttgcaaaataacaattaccacatctttaacgtattcttccatttaagtagcttagttcactaattgtaattaagcgctaactaaccatttggccagtgtactggtaattactaaattaaggagattatgatcaagttgtaaaaggatccaataaaacgattacttattagaactctaattaacctgttcaacctaaccttgtcattattttggtttggagtttgtgttgtctagcgtgattaatcacgcgtgtaatgtgcgagagctgcaacttaacgaatcttgtctcgttgtcattggccagagtcagaattaaacacagacgtgcatttgggtttttgctgtgttaatttgtcataagattcaccaaatggttcaattctcacttttgctctgttcacgagtctgtctcttccatagctcatgaatgccagggcggcagggcatcttcatctcattcatcaactgacgaaagtagtacgtatgatcagtcgaccaaattgtttgcaaatcttaatttgggggtaatgtagttcatgcctatacctatattcgcttttcactagatatttcagagagagagagagagagagtgatttagagggaggggcattcctctatacattttttaaaaaaggaaattgtgattgtgttggggattgaacacgggaccgtagtgttgaaactacatactccttaccactgcactgccaattgcatctcattggatatttctgttattcagagatggaatacagaattgtgtcactagtatcatttgcatatcaaattatcaatgccaagttgcagtgccaacttttgtatgtgcaagcaacagatcttggcataaatcatcacgaggaagataatattccaagtttcgcattctgaaacctagatatataaatgtctgtaacttactagcttaggccggtggttgtcgaataaattaattctttgttgagcatcgcaagggagtgtgtggggtatgatgaaatcaaattcatggctaggaatatataggacttaggaggatccttccatggccaaattgtgcattgtcaggacatgcttttcatagctgtagatggagctttcatccatgtttttcaaagagcaattagcaagcaagacaggatccaagaccacagaattggattaagctacggccactagcgaattggccatgcattcatatgccaaaagccagcgttttgttgactgctgttgagatattgtgagcaattaaccagatcgatgttgcgcatgcgtgactgtgacctttctagtaggaactccacttcacccacccactaaagcaaaattacttctttttttggtttagcagaatcttgggctttaacaattgcacgagtaattattccaagcggttactgattactgggcaaggagatatcagcagcgtgcttggggaaataatgagatgtatgctaagatggacacagaaatggagagtagcctagtgcaaatgagtgacattggactatttatataaaacaaatgttcttgtaggaagatgaaatggatggtaggaatcgcaagaaattaaacttacgacatctggaaagattaattggaagtttccgacactcaattgcaccctacataacagttagtgtagaatggaatggggagaacaccacacacccaatgggaggggtggccatgtattaatataggaagcacatgtacaggatcctcaattagaggagaatacaaggaaagaaacaatacaatacaatctgtacatatatggcaaagtattcctaatacccgcccgcagtcacagcgggaggatcacggatgcaaaggctggatcgaaaatctgtaaataactgcacaggcaagcccttggtcatgatatcggcgaactgatgcgtagatggaacatggagcacacggacctgtcccagagccaccttttcccgaacaaagtggatgtcgatctcaatgtgcttggtgcggcggtggcgaaccgggttggcggtcatgtagatagcactgacgttgttgcaaaagacaatggtcgtggtggagatgggagcatgcaactcctggattagctagcggagccaacagcactcgacaaccgcgtgagcaacgacacgatactccgctttagcactggagcgggagatcgtcgtctgtcgcttggaggaccaagacaccaggttatcaccgaggaagatgcagtagcctgaggtggagcgacgagagtcggggcagccggcccagtctgcgtcggagtaggcggtcagagacccgaccggaccggtgccgatgtggaggccggcggagagtgagcccttgatgtagcgcaggatgcgtttaaccaaggcgagttgaggctcgcgagggtcatgcataaaaagacacttgttgaacggcataggcgatcttaggacgggtgagggtgagatactggagggcaccggcgaggctcttgtactcagtaggatcggcaacgggggcaccctccgaggcggagagcttggcgcgagtatcgactggggtggcggtggggtggcattcagacatgccggctcgctgcaggagatcgacggcgtactgtagctgggacaggaagaggccgtcgggtgtgcgacagacggagatgccgaggaagaagtggaggtcaccaagatccgtcatggcgaactcggtgtgcaaccgagccgtgatgtggcgaagaagctcagcggaggaggccgtgaggatgatgtcgtcgacgtagagcagcaggtaggcgaggcgatcaccgtcccggaggatgaagagcgatgtgtcggaggccgatggcgtgaaacccagctgacgaatgtatgtagcgtagcgaaccattggtaccaagctcgaggcgcttgcttgaggccgtagagggagcgctggaggaggcccacagcatcgggagcaacggggtcgatgaagccggacggctactggcaatacaccgtctcgtcgagggtgccgtggaggaaagcgttcttcacatcaagttgatgaatcggccaggagcgggaggtggcgatgctgaggacgacacgaatggtagagggcttgacgatggggctgaaggtctcgtcgtagtcgatgccatgttgttgggagtagccacgaacaacccaacgtgccttgtgacgggcgagcgagccatcggagtggaacttgtgcttgaagatccacttgccggtaatgacgtttgcaccaggtgggcgagggacgagccgccacgtgccgttgttgatcaaagccttgaactctttggccatggctgcacgccagttggggttggcgagggtagagcggtagttggccggcagtggagaaatggccgagagcacgactcgatccactggcttgagagaactggtcttggagcgtgtcaccatggtgtggacctgtgggggaggtgtgggtgcagccggagcgacaacttggggcggaggagtcggcgccggtcatcgttggtagtggtacgggaatggcgccactgtgccggctggtcatgaagaagacgtggacggccggatagctggtgacgacggtgccctgcttgaggaagatggagacatggcagccggctgtgtggaacttgccgtcgtcccgcccgtagtgtgatgcggctgcacgtagtagggcaggtgctcgtcctcagccaagggagcacccgtgggcagccactgctcgacgttcacagggaatggagcgtgcggcaggtgcggctgctcaacaccagctagtggtggagcgaccacagagggagcaggagcatcctgcagtagaaaatccaaagaggaagcatcgacgagatctcccgaaaatggaaactgtgtctcatcaaaaatgacatggcgcgaaataatgatgcggcaggtggatatgttgaggcagcgataacctttgtgcgaggaggggtagcccaaaaagacgcaagcagcggagcggggtgcaagtttgtgggcagcggtggcactaaggttaggatagcataaacacccaaacgctcgtaacatggaataattgggaatcttgcgatgaagaagctggaatgggattgagttgtttaccgaggacgagggtcgacagttcaggaggtatgtggcggtggctagaccttcggcccaataggagggtggcatggaggcttgtaggaggagggtacggacggagttgttgagggtgcgaatcatgcgttcggccttgccgttctgcggggaagtatatggacaggagagccgtaacagggaacctctaccagcgagaaaggaggtggtgttgtgattaacaaactcggtaccgttgtcggcttggagacacttgaggcggtggccgaactatgtgtgggtatactcaacgaactcaacaatatggcgatgaacatcggatttgtggcaaagaggaaacgtctagcaaaaatgagtaaaatcatcaaccaacactaaataaaatttgaagcctgaaatgctcataacgggagaagtccatacatcacagtgcacaagttcaaaaggagaagaggtactggaggtggacttattaaaaggaagacgagtgtgtttccctaactgacaagcatggcaaagggaattatttgtcttggagcgaggtatggcggataaatgttggagagtggtgacggcggttggacccggatgaccgaggcggcgatgccataacgtggaggaggtggcgaggttgcagtgcgctgcaatggaaggtgcagcggtcgggagggtgtagagctcgccatggctattgcaatgaagaatcacgcgccgggtccgagggtccttaatagaaaaaccaaactcgtcaaactcaatggaacatttattgccacgagtaaattggcgaacggagagtaaattgcgaaccaaagagggagcaacaagaacatgacgaaggtcaaatctagtggtgccaatagggagaaaggaagtgccacggcaaacaaccggaatggagtgaccattactaacggtaatataagtttgtgagttggggaggcgagtaacgagtataccgtcggtggaggacatgtgcgaagtggcacccgtgtcgagaacccacgagttggggttgtgaagcgttattccattgagagcggcgacaaggctggcttggtcccaagccggctggacagaccctgcagacggtggcgaggagtatggcccggcgaaggtagtgtgagcctgaggatacggcccaagtatctcggcgctgggagcacgccagggttgctgctgtcctgcctagggcgagaagcacacccatggtgcagcttggcatggagcaggggcagagaaagtgctggtgccaaagctgttgctgccgttgttctgtccaccagggcgtccgccgaatccaccgccgccgttgccgccggagttgcggttgttgttgtggccgccgttcttgcccttgttcttgccgctgttgccgccgccggcgcagttctgctgctgcccaccgctgccagaggagtggcaagtgcccccggtgcagttggagtgggcgttgttggctgcgacgagggcagtctcggactggacttgtaccgagttggcgttgcgaagctccttgagaactagtgtgttcctcgcagaggcgaaggacggcaagacaggggcgctcgcgatgttgtcggccgtgctggtgaagcgcgagttgacgccgcggaggaggttgaggacgagctgggactcggtgacggggtggccgacgtcgtggagggcatcagccaccgtcttcatgcgctgacaatagtcggcgacggagagatcgccttgggtcatggagtggaactcgtgatgcagatagatcgcgcgaggctccttgttggcttgaaagaggttgtcgatggtgatccacaagtcctgggccgattgattaggctccatggcgaggtcgaggacatcgtcggcgacggagccgaagagctagctgcagaggcagcaatcggcctgttcccaggcggcgtcggggttggtgggaggagcagcgtcaagatgatcgaggagaccgaatttcccacgcatcgagcggaagaaggccttccacttgttgtagttggggttacgaagctcgagggagatcggaacatgggacttgacggcgatggtcacatacgggttgacgaaaaccggggcgacggtagaggtggaagatgacaccgtagcggagtcggtggcagcggaagtagccgaggaagtggatatggtgagggaagtggggcgcggcagccagggaggcggcgatgctcggtggacgcagcgaccagagaggaagcagcactagagcagcggaagaggagaagaaaacttagaatctgataccatgtagaatggaatggggagaacaccacacacccaatgggaggggtgaccatgtattaatataggaaggacatgtacaggatcctcaattagaggagaatacaaggaaagaaacaatacaatacaatctgtacatatatggcaaagtattcctaatagtttgtactgaccaaatcaagtcagtgtggtcatatgcatgcaggcatgttggagtaaaaaagaaattaattgtcagtataacagcgtgtgcattgactgagtagttgcaatttacccaagtattgtcacattgtgacaatcacaagtagtaatgactaattaacagtggaccaaattaaaccgtgttccgcggctcattccttaatctgaagctagctaggtaaggttgttcttcctttgcaggcaggcagaggaatatatggcacattcagaaaggtgagatcgatgccacgcattcatgcagacacatcaatagatagatagatagatgtacacgcacgatcgactcacacacacggttcaaagaggcacatccattcatcagtcgaagtctgaaaaggaatcatcagtcgttgctgcatcatatcatatcatcggttattcagagaccagaggagtatatataagcaggtgaggccggcaatgacgtggtcagcactgacgagtcgagcactacatctctcgtccaacgccaaactctctctctctctctctctctctctctgcagatagataggtagatccgatcgcggcgaggaagatcgatgagtcggatacacccttcgtatcaacgccaagatgccgccgccgccgccgcctcaacggcagcgccgcgagcggcggtgtacacggtgtggaagaggtccagcatggggttccagggcaccgacggcttctccgtctacgacgacgccggcagcctcgccttccgtgttgacaactactcgcgccgccgcaagctcttctccggcgacctgctgctcatggatggacatggctcgcctctcctcgccctcaccccacaggtacacttgtctctgatcttctagtcattcatgattcatccactgcaaaaatcttgcatttgcatctcagattaattaattaattaattaattacctcctataggctatattcatgcatctttgtctttgtgattgtatactagtattacctaacacctgacaatcagtataatatttacgtacggtttcggtcgatatattgagttagctattagcattcatgaacgatcgtcgatcgatcatcaattcttcatacattcaaccagcaatcgtttatattctgctcgtcaatcatcctcatccgaatgtagacttcattttacatatcttctctcaagatatagaacgatcaccaagtttgcttccaaaacttcactgaagacttctaaatactgcaaatcctgctttgccgagagccccgagactagtgtttcgtccatctacccgatctttcatcttctcgatttttttaaaaaatgtatctccaggctttcactgtttcctcaaaatattcaccaaatcacaagtatatatgtttgtcttgtctatttgtctcacaaatactaaaagataccatagctcaccaaaaagatttaaggcaaattatcatgcatgccgacggtttttaggcaaatgctatcaactacctccactaatacatctagctaggaaaataattagtctaaacacttgcagacaaaatcagctgaccaaagattaaaattcattgctttcatcgttccagcctcggttattttgatgctgttctgctttaatttgcccaaaatcccatacagagttaaaaacaaaacttaaaaaatggagaagttacatacagagtttgatttatccgctagttcattctactttccgactgaagttcttttacctcttgttacaagtgcagcagatgggccaaaagaacagaaaccattaatagaacccatggggagtaagtaagaactaagatttttattttcctttctgctgttgcaacagattatcagcatgcatgaccaatggaattgttacagagcgtcagaagaaggccaaggcaagagggcaagatcacaacaactcttctcaatgagaaaatgctcagttatgcaaagcagtcatgaagcagaagtgcacatgtcaggatgtacccatgcgtcgtcagatcgtactggccatgttcccgccttctcaatcgagggcagtttcaagagaagaagctgcaagatccgcaacagcggcggtgaggaggtcgcaaggataacgaggaagaaagctggagcagcatcattgtcactgactcttgctgaagatgttttcagtcttgaggtccaaccgaatgtagattgtgcgatgatcatggctttcgtcattgttctggatcggatctgctggaagccatacacacctatgatctgttcttcatagttcaaggtgatgagctctatttgacatgtaggaaatagatgtttcaattcaagtgaaatcgacgaattaactcaagaagctagtatgagactgtagtcactaattgtactgtcgattgactgggactaacataacatgtaacttgttctaaatttgactacttatgaaaggaagatcgaattagcagattgaatcaaaatctcttgcttcctcctactgcaacttgaaatgtatgtttcttttcccatgtggttctttcaatccacttgttaccaactgtgagctgttaccaactgtttgggcagtatcattttaatgctatccacctagaagcaccataagaacaaagcactattcatgcccaggacaatgcaaaggacaaaagtgaccaaagtttgttgaatcctaaaagagaaatgctcaaaataatagaatcaagatataagcaatgacttcagctacctttagcagtataaagcaagttgggtatactcacactgaagaagaggcaaaactagtgtcctccacgaagagagagccggagaaggagatggtgggtatccatgcttacgtgttactcaatttcttcaaaccagcacttcgtgtttcatttgcattgtacttgtgcttaagatttgcagtccctctcagaaagattcgaaagatattgacaatatactgcaataagacagcgttagtttactaagaaagttttgtttataccaaatattagaacaataaatagtatggacaaatcccaaggaatattacaaacaacttatttgtcttatactcaccagtctttatttatttaagccacttttgatttgtttgctagatgcataaacaaacaaagcatgaaagcaatatggtaataacacatatatatggttattaatacggagttgacagaaggaataaaatggtttctcatcagcaaggaacaacttaacagctaagtatataaattgaaattaatagtttgaacaaggtggaacaaattttagcaactctgcagaaatcattgtttgacttttgcaaaatctaagtcttctatctaacttctgatcactaaagacggaaccgcgacaaaaaagttaaggatgcacggaaggcccattggtatattcacaagttcacataatgcattctggaagcgacatgcacaggatacattctccaccatgagaaaatcccctgtgtacccttgaaagttcacctaatcccttctgtacccctgaattttgctcaatcccttacatacccctgaattttagtttggatctcttccataccctttccactagttgaccgttagttgaccgttaaattcttatgaaaaagtccattttgccctttggtataaagaagcatataaattaatagagtatattgttggagcatagaaatttgttatatgagactattatgtttatgagatagttatgcaccatattatttgcgataaatatacttttagatatgacataaaaaattaatacttatttattagttattaaaagattttttttagcatgtgttttgaagtaataaacaaatctgttgtattactatgaaaacacatatgctacataaaagaacttttaataactaataataaataagtatcaactttttatatcatatgtaaaagtaaatttgtcacaaataatatggtgcatcacatactcataaatataatagtcccatccaataaatttttacattccaacaatatacttcattaatttattatgtttcttcatagcaaagggcaaaatggactttttcaaaagaatttaacggtcaactaacggtcaactagcggaaagggcatggaagggatccaaactaaaattcaggggtatgtaagggattgagcaaaattcaggggtatagaagggattaggtgaactttcatgggtgcacaggatacattctccaccatttaagggttcctttggaagacagaaactattcaggaactttacatgaagcaattcatttcccgcatggatcaggaaataaagtcccatgttgcagtggtcatctcaacaaaaaaaaaatccataatacctcgtattatacccccaaaagctacataaacagtactgacacagcttttactcatatgcattatattctgacatgatatatttcagatttcaaaagaatgcccttcgaatagggctggtgtgatccgtactacttggtttatcatttacagaagtgttctttgtacctaatacattgagcatctacaaaggaataaacatattatctggcagtaaaatatgtacacaatgcaaaataaatgagatgaaaataaggagttcaatattactaagtaacggctacacatatattacaacagaatatcaggtagtatgcacaatacgattagtatgatcatctgatataaaaacacaacaaatcagtgtaatatgtaaaatgcagctgtgaagctagctgaatgctagaggaatagtgaaatccacacaaagttaagtagtatacatagacattttctaggagaaaagagcacgatattctttggcttcttgggccatttcttccatcgttctatcttttctttcaatatccaggtctaatgtctcgttttttgcattcatctgttatgaacagagagattattcagatttatttgatggagtatcagatgaagtgagagttgttccaagcagcatcactaaccatgccattattgttatcattgttctcaaaatcttccttccttcggggaacgatgtgaacgtgaacatgtggaactgtttggccagagtgaggtccgtcctgataagtagcaatatttattcaacttcatatcatacacaatagaagataaagttagttttcattagcttttacaacttttcattaaaaaatgttacgaacatactaaattgtgatctgaaaccacaattttgtgagcaacatcatacttgtcatgctcacacgaattttagctataatatttcttaaattcaaagtgaaagacctcacaggtacaagataaatcgaacctgaattgtgaatgtgagcgaagaagccctctggtactgctcaacacgtacaccaatatcctttgccatgatccacaaatcacgagtctcatcagggctaagatcagcaaatagtttcacaagactctttgggcatataagaacatgtataatttaagttaaggaagggggtgggggggggagttaaaagtcttaggctgtcaaaaatgcagtgccacatacaatccatcataggacaaaggcaacaagagctgagttgccagttgtcaccagggattaactgaagtaattagcacgaccagaaattaacaaggtaaagcaggtagtattaattgtcttgaaatagaaagcacaataacccttctgaaggcaaaaacaagtgagcactgtgatgtacaccactaccatttttcaatgaaccgatatcgtacattacttatgtagttcagtgcagagtctttctttctttcctttttttttctttttgaaacagaggcacatttcattgatgaatagcaagagaagttttttttttttgcaaataataataataataataataataataataataataataataataataataataataataataataataataataataaagtatgagaagttgagagcagataataccgcaatgtgaagtagatactagaaggcactaaattagagagaggagtagagcagctgtgcatacacataattggcagaaataaaggatatgacctgcagggacaagattggaatagaatgatgaacaaacaaagaaggagagagcaatcaggaatgatagatttgttctgaggagaggagaggagaggagaggagaggaaatagctaggtaccagggcgggtgggtcggaggttgacgatggcgaaggagaggggcgaggtgcggaacacctgccgctcggctatctcgtgcggaccaaacctgtacctgcttcccgcgaccggatccatctccttttcccctcttcttggacggcgacggcgatggagagggagaagaggaagcagcagagaagcagctgagttgcgttgggtctaattaattgtcaatggttgtggaactgaggggccgggtcaagtcaagtcaatgatcttgatgggctcccctcccacggtagaagccaggcaagcccatcagaaatactacgtactattcaaatcaggcccattaattgttgtcactttctctatctgaattggtcagcctgcttgtgctttgaataagtagtagggcgatgcatgcatgccagctccttcacgctaagccaaatcccaatccaacgtgccctgcactatctgtccacaccttcactcccattcgttcctacttgcaaaattaagctgcatgtccttttttttcgccggcccatttcagctgctctcactctcacgcattaataattaacccaatctgcagactgcagtgcaggcaaagctaggcagccacgtacgtccatacgttgcgttgctcatcgattgatcgatcgattagccatctaattggcaaaaccaaatcttgattatttgctagcttcccctagctaacataagctatagcctatagcttcctccctccctctcaaactagcttagttacttccaccagcctcatcaagctatagctagcatgagaaggatacagatacacccctcacatggcggcggcggcggcaccggcggccgtgcacgtcgtcaggcggcagatcagccggtggtgtacacggtgtggaagaggtccagcataggctttcagggcaccgacggcttctccgtctacgactccgccggcaagctcgccttccgtgtcgacaactactcccgccgccgcaaagctttcgccggcgacctgctgctcatggatggccacggcacgcctcttctctctctcaggccacaggtcgatcaccttctcattcacttcattacttcttctctagctctactcgtatacgtatattatatcgctttagcagcgacctgtttactgatcgatcagtttagtttgctagtttggaatcatgtatatatcttaagataggttgggacttgggactagcgcgtctttaattctctttcattcatttctcactttaagtctttcctatcataatctatagacgatggccgtgtgcttactgcttctgctttgctttcagtccaaaaatttagggtacttagataaagaaatttcagggtatacttattagctgcaagatttatataatctatcaaactaacaagatccctattatatacatgcgcatcaagtttaaattctcaacttaaaagattcagtcttattatttgttgctttgatcaaagctttgctgttatattaatcatgcagccaaacatgcattacctattcgaggctggaatccaaccgttggatttacttttgcttaatctcctatgtataaaattatcgctttgcttccttgtttccgttctctgatgatttgattaaaaaaatccagttgtttgagtactccaagtctcaaccgacaaattctactgtactcataatcgtcctaattaactcttaaaaatcttttatgatagatattgaccagtcaaaacaaaggaaaaaaaatctatactagtatgttccatgcgtcattctctataataattgaaagatattgtactactgataaaaacatttaattaattttagtctattgagtaggccgacatgtccaagcaaaatgtaaccaaatccaaaaacaagcaaacaaaatgcttgtatcataataacatgttatatattgtttttcaacctttatgtgcttcacattagatctctccatttgcaacttgcaattttcagttaagtgacaaagaagtaataaaagaaacatgatctgcatgattcgttgtcaacttttcttcagccgctatttttgaactaagcaatgtaaaaaacagataatcagcgtaaattaaaaactaatcttcattgctctaatgtgacagattctcagcctgcacaatcgatggaactgttacagagcacaagaggaagaaggcttggacagcacaagttctccttcagtgtcacagcagcaagtcttctccatgaggaagagctcagctctgcagagcaacgatgaagcagaagttttcatgtcaacaagaacaagtggtgacagccaacctgatgcttctcccagccccagcttcagaatcgacggctgcttctccatgaggagctgcaagatccgcggcagcaacggcgaggaggcggcgcggatcacgaggaagaacgccggcgtgatgtccagaccggtcagtctcggcgacgacgtgttcaccctcgtcgtcaggccaggcgtcgatgttgcggtcgtcatggctatggtcgttgtcatggaccgtatctgccggaggccctacacaccaatggcgtgttcatcatctggaaattcagtagttcatagtggagaaatcatcaaatccaaggaaaaataccatctaaaccgcagtagtagtagtttgctgtaaattttatatattgcagctgagatgtaactaaggttgtgctaaattttgtgtatttgcaactatttcacatgaagaaaatttgcgaaaagttcaggctttataaagagtacataatgtgagtatgtgacctcagagtgcacatttctagcaagagaacgacaagcacttgctattctgagtggatacctgaggcactatattttttgccgaaagaactacttttgcatttgcagatgagaatctcctgctgatggagatgaagcatgcatactacctaggagtatatattccagcgaatatttgcaacaacgtactcaacacaacaatagcctctaagcagcagagacaaccagtggttggtatgcaagccaagcaaaccaggtcacacgactacgacagaagcttacttggtgttgattacctagtacaccggcaacaatcccagccaacaagtgaggggctccagatagcttaccgttaccaaatcctcaggtctggtgcaacagtcacatcccacttcagaacacaaccagccaaattgccaatcaaattgttctttaccacttgtcaaaggtagctacaggcgtatcaaaattgcaacttatggcatatatgcataatcaataattctgttcagtgcatcttatcatctcaatggccctcttgatagcaagcatgatgcaaagatgaaaatgaccaaaagtgctcaagtcccagaaaaaaaatcagcaaaaagagattaagatctaaccagttatttgagctatcttccagaatgtatatgcgtaaagcaagcacaagagttaacaatggagactaatcaaaatcagagcctcttatgttctaataacattagattaaatgggattgatggaacagtcccttaaccaaagaaaagttcacaggaggcaaaaacaagcagcaaaaagggtaaaaaccatggttcatgtttttcagaaacataaagactacactacacaatgatacaaaattaaagtagtattttcatggttcaatcagatcattaaagttttcatgatcttatcagaaaagtgcgccagaatgatataaagtttagccaggattacagccattggccacaaattgccagaattattgtattaatgagtcaggttaacttttcgaatgttggctagatgcatagactaacagtaatggtagatttcatggacagtcggcagaaggaataaaaactttgagtcggcacaaagagctagatagaaagttgagtcatgatccatcctgtctaacaaactttcagctactatgccttgtcgaatttctggcttttctcacaacaaaacatgccaaaaacagaatttatcgcagcaatctgcataagcataagagaacaaactttctaactagcatgatcaaaggaacaaaatactgtgtctgaataactaaagagcaacggaaatctcaagaaaagtcaatttttcagctgaaactaaatgcaatgggttgatagcatggattgcaactctgtttgatccaaaagaccaaaagaatgatccttctttcttttaagcaggctttcaaataggtactgaaaggttatacgatgggttttgttactatttgtagattgtgaaaccatagtatgacccaaccagctactgataatatatggctgtgtaatttcatgtggtacagggacatctgtcataaaaatataaattttccaacaaacaactactgccacacggtggcataactagttccaaagataaagatttataagtaagaacacattttacaacaaacaagtatcacaccaaattagataatttcataatattattcgaagacttgaattcccatgatggatgacaaacagttacaaaaataatttctggagaagagagtgcaatttagagacagtttacaagaaagttatcgcaaaaatacatctaagagaagagagcacggtactcattggcctcatgagccatttcttccatggttctatcttttctctctatgtccagatcaagtttctccttcaattccctctctttgacatcaatctattagaaagcaaacaagtaagaattttgtggtaaatattgggttgaagtattggataaaaggaggtcgattgagaaaaatgccacaaaccgcatcatatatctcatcatttttctcaaaatctcctttctttctagggatgacatggatgtggacatgtgaaacagtttgaccagcttctggaccatcctgtaagcactggaactaatgagtaaatagcttaatattattatataagaaaataattcaagacagacatgcaaagttatatctagggtaaatgataaaaaggaagttaagaatacttgtatggggaaacgaattcttttttattctacacacaataagatcatcatatttaggacgcaataagcaaaacccatatggtactcctcttgatggtatgattaaacattgaaataattaaaatacaaactcctgctaaccgcagtggcataaatacatagaccttacctgaatagcaaatgtaagtgaagacgctttgtggtactgctcaagccgtacaccaacttcctttgcggtaacccataagtcactagtctcattagaacttagatcagcaaatcgtttcacttcacgcttggggcacactagaacatttatatattgttaagggaaaacaacatataagatatatcatattctcaatataccacagtagaaatcaaaagaagatggttaaccaataaatttatggaagatttgctcgacacggcagtacaattgacagttactccatatcaatcacaaccaagtagcagataaatactacatatggacatcatctcatggtaaagatgacatcctctaagatgatcaatcaagtaagatgacatgtggcaaaataaacacctacatcacctcttcagccaatccacaaaattgtccttaagccagacttgatatttgtcaagtatagaagaagggtaaaccaacacaatcctttcatgaataaataaattccacaggtccatttatttactattaatttgaatgcattgatgaaactttacccaaacacaagccagcaaaagcaagctcattttatcgacgaccccaacagaactagctagcagtgcatgcacgtgaaagaaatcaactgtgattctgtaaatatctccaaaacagcgttttgcagaaaaagtagcagtctcttttggtgcaattgaaggatatgacctgcacaataaggaacggtatggttaagaaagaatagcagaatatgaaccaaccaatatatagcaataggaattaaatgcatgcagcaacagcaaggtcaaagttgacggaatcgcatatggtatagtggtgaaatggtactgtattaaggtgaatctgttaggtagaagaagagatcaattgcagaaaaacactactatatgtgaacagactactccctccgtttcacaatgtaagttattctagcatttctcacatttatattgatgttaatgaatttagacatatatacctatctagattcattaacatcaatatgaatgtgggaaatactaaaaatgacttacattgtgaaacggaggaagtagctagtatctgcgtgtacattgtgcttgttaagcgtgttcaagaaaacaaaaacgtgcttgttagcatttggcaggtaccgtatgattcgcgaactggtcatcaaacaaattagcaatggcaagctacaaaacccgtctctgtaatttccgctacaaattttgggactgtactatggtactactcctactgagcaaggggaacggaggcggctggagggaataaagcgatcaagtggtaaaactgggcaaggggaagtgaggaggttattaccagggaggagtgggcggaggttgaccatggcgtaggagagcggggtggagtggaacacctccctcgcgtcgatcttgtacggcccgaacttgtaagccgcctccatctcctggaccggcggcggcgaggaagaggaggagatggctcgcggcagaagcagtggacgacggcgaagaagggtaggaggcggaggcggagcgagagggagagggagaagggagaagggagtgggcgcgcggcggaggacggcggagagcgccggaagcatcagctgccgtctcgtcggcgaacgaatcgacggaggagaggaaagcaatgtagagttgttctgggcctaaaattaaggtgggcctgcatttttacggcccatctgagcccatgttgttgtctggaccggtccaaagctgagtggtgctaatactcctactttagccctctttgtttagacttagacttattggattagacttttaagtcagcttattggcttatatgatttataagccggtggatttaatgtcctaagtttagtggtagagtcatacatcaacctcacataagccaaaaaagcttctccaacctagcatttggcttaatagtgttagagtggcttatggcttcaaaaaaaccaaacaaataagctgcttgtttgtttaggcttacaccttttggcttataagttgacctataagcctaaacaaatagggccttcaaataggctcacccaaaaaaaaatgcaccgtgatgaaaatgtaatcatgtcaggttgacttgctgaaaaaagtgaagtggatagagtgatgagagtggatgaactaaataatcattttgacttttgctctgaccaaaatcattaaactaagagtatacatatatggagctagccagcatccactgcctgaacgaataggagttgtcatgcaaatccactgcaaatttaagtgaagtgatgatcgatcatgtgcgtactttctaaagtagtttgtgtcatggatatgaatatgatgcatgcacctgtgaccgaaaagctaccttcactttgcaggcatatattggcattgtttggtgacttgacattaaacaagttgctgcatgctcatcagctttgaaggagtaagagataagtcaatctacaaaggtgtttatacatatatttttgtttatcttcaattgttcatggtagtgcttgctgcgtaggttttgcaatgatcgcctgattattattaatctatctatgtactctctctctctctctctcactacctacttgcacggatcaatcgctgtttgacttcatttgatgagataatactaatgaactagtgcaagatagtgttcagtcaacagcaatggagataatactatttttatgaccttgttcaaaggtttgtaattttccattaagctagtgtttacaaagcaaaccactatatatgtgcacttgttacttagagcaatctagctagctagtgttatcatatcatattccaaaatccttaaatcaggttagatacaacagaaacaaaaacaaattcagaaagctgccagcacaacaaccacaattattttttactagctacgatcagttgtgttatccaaaccaaagtactagtataacatttcaggctttcagcatatatatgcttgctacacctgtatccccatttttgccctgaaacaaacaggaagtactaaacatgatagtatggcttctagcctaattgcactgtaatcggaatgataggggtgaactgtgcaagcacatgtacgtagcatgtagtagcaatataacctgaaagttgtggaaaagctatatattgggacattgcagcttcactgccactactgatcgatcatcacaaccgaaaaagaaaagattttgctggatatttaactatatacactcagctaagctggagtgaccacatgggccagtttggatggtgtgcttttgatgatgttatgtattccctcccaaacctgcaagctgcatgcatgcctattctgtgtcttaagcaccttggacaagcaactaattgaacagctcgcacagagcaatcggcaattgcaacattccaaattaggcctggtttagttccaactttttctttaaactttcaactttttcatcacatcaaaacttttctacatacacaaacttccaacttttccgtcacatcattccaattttaactaaacttctaattttgacgtgaactaaacacacccatatcaacaatgaatcaaagttgtccatatgcatgcatgacctagaaaatgccaagatctctgcaagagacagcccccgtgcagtccaaaatcaatctagctttaagctacagttagagtttgggttaatttgtttggtagcgaaatatcattcgaccatgacatgcatgtggcgaaccatgcatatgcagtttgcaaaaaagatagctacatagcgtggatggaatacttcaaaagcatatcaaaacgatacgatatgcatggtgtttcagtactacaatctttcaagaggaaaaacaaaaacttcatgtgggggcagggagctgcagatgcgtgcctcttcacttccagagaaaactaatggtatgtcagttttaggagctaatacacactgccattacatgtgttatgataaggattttaagccgtttgcgaagacaatttaggtactgctccctctaggttaatactaatacttattgttttgagagaaaaacacggtctaaaacacaacttcagtcactgttttatattataatctatatagaaaaattattaaatatatgattttatatatgatgttattataatatacctagtcttcatatttataagataaatattttaaaaattatttatagttaaaaaaatttataatttgataccaaactcattcaaaacaataaatatcactctctccgtcctaaaatataagaatctagtatcagatataatattttctagtactacgaatctatattagaaaatatcccatctagttttacgtttttttatattttgagataaagggagtatcaacgagagatgtatgcttagcaaagcacatgacttgagtgatcagacacacatgaacgaaattgttaggtaactgtctccatctttgccttcaacacaggcatgcagccagtgtatagaaggagaagaaccctgcttttgccccccttgcagaggaacaagctatccaggatatactattgtcgaactccattccaatgtctacccactagtatatgttaactggatcatatcgagaaggcaattagttaacatactgccaagagttgcacatgcatacttcatatatacaccttctggttacttcatgtgtctgagttctctgaatttgcttaacccatacatatcattggactccggttaattacctcgaactttgtagccaccccaccccttgcatcgatccgcatctggtatttataagatttagggtttattcggatcagagtaatttcacaggatttttggaggaatactgtacataggaattttttccttttttttattcggatcatgaaaactggttgtaagaaatccaaagtaaagtttcctttgatgctgatttcacaggaaaagtacaggaaaaatccatccaccttgagctcattttttgcttcctgcatgcaaatcctaggcaatcaatttcctgtgatccgaatgctatcaacttttgtattcctttgttattcattcctctgttttacacttagggcctctttgaatcgcatgattgagaaaacgtaggaataggaaaaacgtaggattttgataggaatgtaagtgtaaaacagaggattgtaaaacacaggaaaaacacaggaattggatgagagatatagactcaaaggaaaattagcaagaggttgaagctcttgttaaatttcctccaaaatctctataggattgtccattctataggaatttcaaaggattagataggattcaatcctttgattcaaagggcttcataggaaattttcctataggattgaaatcctctaaaattcgtatgtttttcctccaaatcaaaggggcccttagattcctttcatattcctatacttttcctatctatgtttttcctatcctataatccgaacaagcccttaatgtctatacatacaaaatgagtatatatgttgcaccgatcaagcatgtaaggcatatattgtaaaatcaaaggtgttttttattattattttgtgatgaacaattggcattggagattatcagtttagatatttggaatttatttgcgaagtggttttggagatgattggatttcataggtgatatacaggtactgtgctggattgggtacggtcacaccgggcacgggttgccggtcagaccggcgtgtatctcgcggtcagaccggcgtagcccacggtatgaccggccgactctgtgtcagtttcggtttcgggttgtttgtttggatatccgtgattgtttcatgattatgacttctagacggatattatgtgtatgaatattatcgtttgctactaatgagtcaagttggggatagcttggtctcggaatatggtttctttctttgttctatgtgtaggtgactcgagatgtcgggagagtatttgcggtgatggaccgggagtcggcttggggataagacgacgtccgtagtggtcagagatcatgcgggatactaaggctagagttcaatacacgtggttggtgaagattccatatggcatacgatggaggtattgtgtgtgaatgggatgcagagtcgaatttggaaggagtccaaatttggtatgattggttatgtaaagtttgtttcttgtactagagggtttcctagggtgattaggacttctagtatgagtttggttcgtggctttaggctgcctatctcgggtataaatagagggggagtgtgaggcttcccagtatcgcttttgagagcaattgagttgatagttgagttagggtttcgagtttagtcgaaatttttataaggagtgttgttggtgcactttgtaaacccagagagaatcgataaagtcgtcatccactttaagagttcttcgatttgtgtttcaccgggtttcggcgatctaaccggcggcgcaccggcggtcagaccagcggcattgcgccggttagaccggcgtctacgacaggcgacaggagctgatctcggcggtcaaaccggagatacaatctcggtcagactgacggcaaccaggcgatcagaccggcacatctacttcggtcatatcgcgatccgttgaatttgaggtaacttttatttccgagtttcggtttttgggtataccaaccattcaccactctctggttggcttagttgttctgattcgatatatatatatatatatatatatatatgctcatagcaacagcgacagatgctagtgaccatagtatatctcacacgaacaaattagtaaggtatatacgggcaaacatactcaaccgattaacgctagtggaaatataggcatcagcagtttataaagaagaataaataattgtacgcgttattttactatctatattctcaggaatagatgaatagtacatgatagaatagttctcatttgcccaccagtactgcaagtgactctgactacacaatatgtcaattgtcaatattcttccaaatgcatgtaatagtctttagaggttttctttcgtccttgagaggtatatacctctcattgtctgagagctaaaaaaaaataaaccattaaaaagcaagtttatgattggcaataccaataattttcttttatcgtcaccttatagtatatttgttcataggtcagagatatatgagtaattttacggtccttgagaagatacctagatggagtcatagagtatatagtgaaaagcaagtaggctatgttcgatttagatgttagagcaattatagccctatggcttaccggagaagacactccattactgcataattaatatatatagacatttaaaatatattgtttttacaaaaaaaataaagaataaaaagttttttaaaagaaaatcgtactcccttcatctcattttaagtacagccatgattttccgtgtacaattttacccgtccgtcttatttgaaatttttttaaaaaaaataagattcatgttttatcatctcataacagtaaaaatactaattataaaaaaattaaataagacgaataatcaaagttaaacacgaaaatttattattgcactttgaataggatggagagagtactatttagcatttaaaaacgtgcatgtctacgataatatggtagttcagaagcgaaaagaacatatatggctggttggctggctggctagcttattaaccatacgtacgtgtttcgtggacaatatccataaggctcacatggttattttagatgtagaatattctgatctagtagctacttgtgtgaactattcaattgttccaaagtataggatgtccccggcatatctccctgaatcatttcatctgaatcaaagtgaattattttgccagcatatgccggaccagctgctagctgatcatgaagcatttgttctagctagctccaccgtgcatcttccaagatttattttgtgcgcatcttagccaaagaattaggatgaatgtcgtttgttgcaaggacttggatacatccgaaagaatagttacaccttttccccacctacaaatcttgacgagctaatcatattttgggaaaaaaagaagcgttgatcacttgggaatatctgtttttagtttccagtactctagcttcatccatatcaattttcatgtgaaaatactacctcacacgtgtgatttaagagaataaatcacgttaatgtctaattaactttcaaatcaatccgtttcaagatttgtgcttcacaaccttttgcagcaccagcaaactctaacgagctaattggaggtgttcccttgcttagataaatatcctgtataatggcagctcactagtgtgggccagtttgggcccgctgacaatgagggaagctctcgccgtctttcgagtggttaggaggtgtggtgacggatccggcagcgggaacgacgaaggaggatgaagatacgatcaatgaagtccgagaatatggaagatgagggttaggagagagaatggaaggtgaaggcggattttgtggctccataagggtggttgcatgggaacaccagctgatgatgatggagaagatggcagaggggtgacttattatttttcttaagaagggagagggattacgcaatgtatagattgttcttttttttttatccatgttttactgtacatatatacatacaagtcttatcataagtctacgtcacattaataaaacttgggtatagagcatagatcagtatatttattgaaagaaaaacattcgaaaatacaactatataatcagtgctaccaaaatttgtctagatgggtttaaatataaacatatcctatatatacaagtcgtcatatgtacataccatgcatatcaactaataaatatcataaaaaattatacatgcatgtaatttcaatataatatatagtattacatctacgtgtaaattcccatctttaaattcatcgtacatagagaacagcaaaataaacaaaactgacatatttagtcttaaaaatatcagaatttttaatcatggctaaaatataatgaatttaagattaagactttagatgtaacactattgaagtatttcttctttattttttgacatttgttagttagtttacacgtgaaactaatatacacatgatgtgtttccggtttaaatatggtcatttgtacaaataaaggtagatcttaatcggcaacgagaatgaagattagaaggtctaaatataaattagtacaaattatgtgcttagcgaatagcaattaattaagagaaatcaacatgttatcagaatatagcaatatatttgtaaaggcttaaaagattatatttaattagagatgtcgaattgagtacgtagtatgtgggagatgtagtttgacaagccggtgctttggtatttttggcagtaggtcattcaattattatagctttacatgctctttaacaccttagaagactgtgggggaataactttgagttgattgtagaagtaaaagtggattaagtcggtgtgtggctaagtcttagctaggcatgcaaagaatatgttcgtccaccgccgcctatgacgcatatatccatcctgatcttgccgctgccccatgcgtccaaccgagaaaaccggctccttaaaccttaaacaaaagattaaaaaccggtagagatatgcaaataaaatcatcagtcagagaaaaaaatttgtgctagtcaagtgtggtgatgaggttagtttgtcgtgaccgcaagacttctatcgtgacttcgatacattttgatcttgtttctgggagatagaatatacgtgtaaaactgctaaaaaattagtgtacgtttccgggtaaaaagttttaaatataaatataatatactgtaatgtaattacaatataactacattgtaatctctaatgaataaaattatatatttttcagtacttacatacaaacaagttacttcgtatattataagttaattatatactatagaattatcattccgatccctaattaccacgatccattcagatcctacgtggcgctcgcgcgttgcatgccacatggaaacaacagtttatatataaacttcaaacaatatgtttttatttgatattgttaaaaatagattattacaaattttaaaaatagattgattgatattttaaattaactttatatacaagctaaaatctgcatctgatgtacacgcagatgaagatgcgccggcacccaatcccaccacagcgaattaagcggatccaaagctaataatactcgatccgctgttagtgttagccgcgggcgcagcatttgtctgcatcgttcgatcggtttcggcttcattcattcatgtgctcccccctccccgcccacgcactagcggctgccgtccacgcacaaaccacgtaagcacgcaccacctcgcgcggtataaattccccgcgccctccactcattccattccccaaccccaaccattcctatttctaaacaacacacctcctctgcacttgctccttctcttcttctgtccatcgaatcgacaagaagaaatttacaagcaagaatggccgccaaggtgcatcctaacgtcgccgccgcgccacagccaccctgcattagcagcatcgtctcccaacaacaagaagaagaggagcccccggtggtgctcacggtgtggcgcaagtctctcctcttcaactgccacggcttcaccgtcttcgacgccaagggcaacctcgccttccgcctcgactgctacgactccaccagctcaaggcgcgccgacctcgtcctcatggacgccgccggcaagccgctcctcaccatccgccgcaagaggatgagcctctccgacagctggatcatctacgacggcgacggcgccgccacctccaccgccacgccgctcctctccgtgcgccgccgccgcgtcggcctccgcgcctccaagtccaaggccatcgcgcacgtcacgccgctctcctcctccctgccgctcccggaggcctacgtggtggagggctcgtacgggcgccggagctgcgcggtgcgcgacgcccgcggggacgccgtggcggaggtgaggcggaaggagtcggtcggggacgacgtgttccgcctcgtggcgcagccccgcctgggcgcgccgctcgccatggccatcgtcatcgccatcgacgagatgctccgcggcggcagctcatcgctgctgcggaggacatgctccgcgtaagtccaaaattcttccttctgtacagtagagacattgagctcgctgcaaggggatcagaagctcggggtcccacctgtcagcgactcagaagcagtgttcccgcagcagagtctagctagatgcagggcactaaacacccagaaaagaaaagcacaggaattatgacaaacttattagagttggtgctgtatgctacaatcaagttttagctagctgctgggttacttaagcatcatccatgttgataggaaattaagcaggactgatacagtcaggcttgtgaaagtaaagcacaagtaggacaatacatatagatacagcctagtacaggggagttctttttttttcttccccggatgtaatattacaaaagattattgtttattattatatggagaaatggaactgcttctccttttccttcctttttttttagtgatctgtgtacacggctagcccatacagcagcatgttcagtgtgtgcgtgcttgaccgtctatccgagcgacgagagaccatttctgtgttaatcagatgtgagtagtaaacagatcctatctccagcaatattttattttgtttagaagtgagaatccttattattaggcgattcttctgctagtatcatattgctacccactctttgatatgacacagatcgatgatggatggagcagagcttagcttggaagtgcacaacccttgacagagatgagtaacacacattataaacaacagaacattattcagctgaacatacaagatgttagcagctaacatgcacttgacctgctactgttagtcccagacttgtgccagctgatatttcttgaaattaatcccagtttgttaatttgtttcaggtctcattcactgtgttgtactgtagagccactcgatctgccttgttcatctcgcggtggagctagtactaccaaccgatctagagtatctatcacgttttaatcaccattcattcttgtttgagacgatgaaagagagaaaaggcagtagatgcctcaaggacgacggatcgaggacatccttgtcgatgctctgtcccaactagagtagcttatagctcgatgaagacacatgcatctttcttccggccgtgtggtgtggatgtggtccttgatttgtttgcgctagaaattcatcgcttccgcgtaatacagtagtactacagtatgagagctagatggaaaattagacgaaataattttgtctatagactgtgcatgcagctgagaaaatcaaactcaacatcgtcatcatctcatcgtacagagagaaaaacaaacgcatgcagtgtccccgcccccttgcaaaacacaaaacacatggacacgatgcagactggtttaacacagagttatccctggatatataaaaaaaaaaaggttggacccaaagaaggacttagagtcaatggttttagtaaggaagaggtaaatatttcctgtggtgagcgcgctcgacaagggtcgaacccgggccagcggggtgcatgccagcgaccctgcccttgcgctaatagcgcatctctatccctggatatatcagtctttcaagtgtaacttttgctgactgcagatcgagggtgcttaatttcttcatatcattaaagggtaatttcatgtgtaactttttctggacatgtgcacttcttttattcaagggaaagggaaggaactcagccattcaatataattacaggaggtgaaaagagcttagaacactagaggaaaacacattattacaagctgaacagccaagaagctgatggagcagctagcacaactaatttgacgagtgctccaaagtgattactctggggctggtgcttgtcgtgcttcttctctcgcttataacaaacttctttgccaaatttgctacatcttcaaccgtaccatagacactgttgaatatcctgccatttcgttgcaaccaaatgctccagatcgtttcttgtgcactttttcagacgataaacagagaactctgcactttctcagcgctttctacatgacgatgaacagaggatcgtgcactttttcagcgttcgactacttggtttagttctcgatccattcgtttgatacatatacgtatgttgtggagattatggataccacatgtccacacggcatgtatattcgactgggtatggtggtaccatatgtagatagaatatatttaaggggctcgagttatattcttaacctgtgtatcaaggaaatactcgagattctagtcggttatgattgtattttatctttacttgcctattttgctaggaatatgggctgtatgttataatacggactcctctcactatataaggaggggtccgggtgcctcttggggcataacttttcccccagatcatacgatcaataatacacttggtggatcaatccctgtacatgagtagggtattacttctcattgagagggcctaaacctgtataaaattcatcgtctccaaacccatccacttttcatgcttgatagccacccctttttgtattgccgaaatcttgtttcgacatatgttgacttgattgggatactgatctggactactaattcacaggtcaggcttcagagggagtgccattccaagtttccaacaagccaacaattaccactgatcatacataaacagaggcaggaaatgacggatttgagcgacggctagcccagctttttcatgctgaaaattttaggcggattcatcgaagtacttgctgtacagaaacataatggatgcatgaatggctgctagacttaaatttctgtctgctcattcaatccaatattgatcagagtgtcattttcagtcctgctcctgcatgcgccactgtacgtgcatctgacctttggcgaacttttgcgcttttagccgccgaaattgcccaactctttgagagaaaaagttcggttgcaatacgttttaaggaggggccaaagtcatcttcttgttatactcgatctgctcatttcatgtgcatgattagaacaaaagcacgcgaactgaacaatcaaggaagctgccatacaaatacgtactacggtactagtacgcgcccttctgtaactccattctgagtttcaagtcttcaaaaaattaaagtggcttataatatgaaacgaagggagagtactagttaccatattcatgtttacatcttcactgataatatatttacatgcttctcccttcgtttcacaatgtaagttattttagcattttccatatttatattgatgttaatgaatctagacatgtgagaaatgctaaaatgacttacattgtaaaatagaggaagtagatgctacgtacgaagtactcctaagtaaaaatcatcatgctagagaaatacgtgatgtcggtaatcctggtggtgatattctcaaaccagacatgtacagtaaactcaatagtcaatactatgggtaaggtatggattgagatccggtaaggtatgcatattctcgaacatgatcagtcactgcatattcgatcgatctcctaatcaagatgcattaacaagataggttcgaagaccatttgctgaaaacctaagctagattggtccttcttgcatgatgatatcttgagaaatactccctctgtttcgaaatgtttgacaccgttgactttttagcacatgtttgaccattcgtcttattcaaaaacttttgtgagatatgtaaaattatatgcctacataaaaatatatttaacaacgaatcaaatgataggaaaagaattaataattaattaaattttttaaataagacaaatggtaaaacatgtgataaaaagtcaacggcggtcaaacatttcaaaacggagggagtactaataatcgtaaccatccttttcccttgtgttttttgctgactggttgtgctctttaattatcactttatgcgcacttttctttgacgccttccacaattaacatgcgcgcgcgatgggtggttttgtttatatagtactccacactattgtacccgtatgatggcaatactagtctgactagtgtttgctcttcatctagaattgttgtgtttctgtacagtagtatgcatggaaagcaaagaagttgtggaaatgcggtcatatgcttggctaggaactgaagagatagcaattgggatggttggtttggcgtctaaataaaccacagcgtcctggaattgtgagtcatgcgtgatgcgtgattcctccagtacagaggagagagctgatcaaggaagataactcgagacaagccagtcagctaggatacctaatattccctcttggggctcctacaacgtatggaggaggagaaaaacgtgtcttgtgatcttaattgcgcagaggaagaacaaattcacctccgcctccgccgccgcgccgtgtcgagggatcccgatttatggatgcaaatcgctttttcggatcgtgattaatggtacggtggcccaaagcattccaggccctactagatagtggactcaacatgggccgaaatatcgggggggcctccgaaagcccatatacaattgccttacctgtccccacctgtcacatgcctcacgcagcagagctcaactcaagtcaaggcggcatttcgaaattcgaaaacaccaacggtttcaaatcctcctcacatcttctcttcccccaaatccctcctccccatcgcggctcctcctccggcagccagccatggccacggtcacgccgggggtgctgctcaagctgctccaggcgatgcacaccgacgaccgcgtcgccggcgaccaccgctcccccgtcctccaggtcaccgccgtcgtccccgcccttaccggcttcaccggcgacttcctctggccctccaacggcttcctcctccagctcttcgacggcctccactccacctacgtccagccctcctccgccgacgccgacgccctcgtctccgcgcgcccgcaactcgtcggccacctcgtccacctcgaccgcctccgcttcgcccgcccggtgccccgcgccgtcgggatccgccccgtcccgtcctctcgcagcgtctccttcgtcggcaacccggagccgctcgtcgcccgccccgccgcgtgctcccgcggctacgtcatccagcccgggtcccactccgacgccgcgccgccgctcatgccatccagttccggcaatgcggcgcagtccgatgcaacgaatgccatcaataggacggttctcgcgcacaagaacgtccccgaggccgcgccgccgcccgccgtttcagccgccaagaggcggttctcgtctccggcgccgtccaagcagcgagatccgtcgccttcggtcaagggcggcgcgtcacggccttcgtcgccctcggtgaagggcgcctcccgagcgtcctcacctgcggtcaggggcacgcccagggcgacgtcaccagcgccgtccaaatgcgtggtgcccagccttgttgcggccaaggaggagaatcgccgcacggcgagggagccggcgattatcgtgccatcaaggtacaggcagccgtcaccagtaggagggaggagaggggcggggtcgcccgcacccggtgggaggcgcgcgtcactgtcgcctagctcccggaggctgtccggggaaggtagcagcaagaagaaggtcggggtgttggtggctggtatctccaagatgacggatttgacgaatgggtcggctgttaagccggggaggaagagctgggacaatacctcaatcgcagcagcggctggctctgtgatgaaatcgaaggtcaaggtggataagagtactattctgaggacacaggtcaggatcatgtttcatttgtgttgcaattgcaatcttggaattgcacttgctatgctactattgctatatagttgtacatgcactgcacatttatcttgttgtagtgaacagacaaatagtacaactctactttgaacaggctaatcgtagtgaaaacagtggttacttcaaatgcttgattcagtacatatgtgaaaaatggcatggttttcttgcagttacttaaaatgtttataagtttattgaggaaagagagaattgaaaacactgttatttattttctttccagatacaatggcagctagtttgtaatctttgaatttgactcatggacatgcccttccctaccatcatcacattgttgtgttactgcaggaagcaatggcaagacgactgagtgatgttacaacagaactatccagtaacgatgatgattcatctgtagatgagaagccaaagccacggaagaagatagagtcacctgcagtaaagacgaaagcaatggctccaaaaattatgcttcatgatcctaaatggaccgatggaagcattccattggatggagtttctgatgtgctttcaaagatgggaaaggtaagcactcccaattcatctttgttagcaatgatcaagtcgcagttcattgatccttgaaacaccacatcttctctgaatttgcaggaagccactgaacgaagagacgcagcagcaattgctgcagctgatgctctgcaggaggcattaatcactgaatccgtaatcaggaacctaaggtaattaaaagccgacttgtgtccccggaatttcattcagcacaaaagtggtttttcctaacactcagcttgctattgtccacagtaaattttctgaactaacttcagcatcgaagacctccaatccccttccaacagttgatatcttccttgctgtctatgaggatactctcaaatggaagaaaattgctgagtctatatccaccaatagaactgaaactgcatcatgggagaattcagttactcattgggttgaagcagcattggcaactgatcttgaagtcctaaagttgatgaataaggcacctgaatcgctctctcggaaaaggggtgctgataagccaaaggctcccttggtggtagaagctccaagaacaaccatatccaagaggcaatcacatgggacttctgcaaaggtccagtcaaaggtcttaccgacctcttcagcgagctgcgcatggaacaaaactcagggcgtgaatgagacggctgagcttgccacgaccttgtgctgtgagatgcatacgtggttcctgaaatttgtggacgaggcaatggatttaggtttccacctttttgaagatcagaatgttgcaagtaggggaaagcagagcagccacataacaatggtactgtcccagttcaagaagatcagtgactggttggatggagtaggcaagattgcagaagaggctacaactaaggataaggttgagcagttgaagtgcaagatttatgggttcgtcatcaatcacatgggatctgcatttgatagctcggtctcgatttcatcaaggaattgaggaatgcttaaagtaagcctttaagtttcttctcttgtatttttgttcattggggatgggatcaaagctacataattctatgacgagaggtctgctacagtttgtagaagctactccttcagttattacctttggttttgccttgtgaataagttgtttgtgaaatggttcttgttttatcggttacaattatgtacacttgatagtttagcttgctgtagtctgagtgaatgactgacttgttaaagctacaagatatcattcttacatccttgcaaatattgtgctaggattaatggtatgttaatttgattggtgcccaatcttttcataacaaaggttaggcaaatgcctgacatgccacaaaaactgtagctagtacaatatgtgccaagtatatttggaatgccgacacattttgctagccgaagaaggaaaacaaatcttcagttgctagaggtccttccatgttgctaatttgctataaatgctggtgaaccatttggtcagaatacatgaagctgtagaattccctttcttgtcgaaacattgatgaaggataggtctagctcctgaacctttcagctgactggtcctaatgattagttgggtcactaatgtcaaagagatgctgcacctgattatggtagtatacaggaggtattggtgccaattcatcttttcaattgaaatttgaaagggacccatagaacttgacaaaaatattttatttgatgcgcttgacgcttgggaggctgtagggtgaagtaaaatcaaacacctacagagaactccctttgagatatgttattgtaaactgattgactgaggcagaaatgccaaattgtctaccggagttgaaaaggagttttatccaaactagtattactatgatactactagactagaattattgaactaacagtcctcaccaaattgaagtctgtagcagttgtttctgttcctttgttttccttgatgtggttggaacttggaaagctgatttgcttgaacatgaagagctgaacaaagacagccctgtttgtaacaaactagtaatcagataattcagccgattactacgacaattcagctgtttggttgtgcagaaggtatattgaccatgcagggtaattcggctgattgcatgaacttgtttggtaaaaactattgtgtataaatcgtgctccaaactcttgagcggatgctattagtgggtgtttttgattggacaatctgagcggcgagtagtgcagtactatgttgtgaagaaacactagtgctgggtgctgctgagttgctaaaaagtatgatatggaagggaagtatggatgtggttggggcagctactgtcccatgatggtttgtgctaatgaaggatggggagttgattgcgggagggatgagtgtggacgcaggcaggcgttcatagttagtgctggatggtgacaggaaacggaacaggaggacttgagagctgggcctaatgtgtggtttgggccgactaaaatgctaaagcactcccttctgatcgtacttgtgattgtagtaattatgtactagtaacgaaaattctgtttagccttttcgattaaaaaagaagaagaattaaactgatagcggacgcactggccgcatcttgtattcttaccaaaaaaaattccatgtcgttgttgtttaaccgccagcagtggactacttttaccaccggtgcacaagccaaattctgagacgcaatgcaacgacgtcatgctatgcttgcagagttgcaggctggtttgtgctgcgcattcgcgtcaacactcccatttattatgccaactaattccaaacaccagcaatactctcctcattaacttcttccgcgggacgagagagggagagagagccaaccgcgcactacttgtacttcctcatcttcctcttgctattaatcgaatcaaattactactagtctcccttccacgccacgcacacgcacccaatcccctatcgatcgagagacatggcctccaccaccgccaccgccgccggcaacggcagcggcagcatcctccccacccacaccaccacggcgccacccttcagagcccataaggacgccgacctggaatccacgacgcggcggcgccggcgacgctgcctgtgctgctgcctgctcgtcacccttgtggtgctcctcgtccttgccatcaccctcctggtcctcttcctcacggtgctccgcgtccgcgaccccaccacccacctcgtctccacccgcctcaccggcctctccccgcgcctctccttcccggccacgtcggtccagctcaacgtcacgctgctcatcaccgtggcggtgcacaaccccaacccggcctccttcacctacgccacggggggccacaccgacctcacctacaggggcgcacacgtcggcgacgccgagatcgacccgggccgaatcccgagccgtggggacgccaacgtcaccatggcgctcaccctgcaggccgaccgcttcgccggcgacctcacgcagctcgtctccgacgtgatgggcgggtcggtggcgctggacgcgagcactcggatccccgggagggtggccatcctgggcgtgttcaagcgccacgcggtggcgtactcggattgccatttcgtgttcggcgtcacggagatggccgtgcgtagccagcagtgcagcgaccgcaccaagctctgattgatcatgtgattccaacttaatttgcaagtttccaagcacgcaacgtaaggtgggcatgccgcatcgcgacgtgggacaagacgagaagccgtatgatatgctgctttgttacgcaggtgcactgcactagtagtacatagtagagtattatattctacacgggcggcacattagttcgttacagatagtatcagatcaggaattcaggattcagtgctacgattttcttcaatatttcttactgcgtgttgggattgatttgattcatgtatataacacggtgtcagtttggatatatatacagtaatttcactattctctatttcttcaacgtatgcgcccatgatgtttactagcgactgattcaaaaattcctaatccaagcgccaaacttcagttaaacagacctttctcgacagcatgcccacagcttcaagctgccaagtgccaacactcacagaaaactcggcccggtgcaaaaaaaaaaaaggagcatatcctgacttctttcactagcaaatactgagttactaggatttaggaccctcacatggtcaaacaacaaacatactaaacattgttacaggtttcaaaacatataatgaagccacatgtataaaccaaacggccatttccagcggttttctgtttaacctcaccactaacagtcacatcaagcaagcagcactttacattatcaatcatgattttcactactccgctgcattcatcacataaatgaaaacatttaagcacggcacaccatctcacagttcttgtgaaagaaaaatgaactactattgagcagcattcagacgatccacatcatgaacctgcaacagactcactagttcaaccagacacagctatccattttaagacttacaaaaggtacgtggtcacagaccacaactcctaattgtatatgactaacccacccaaaaggaagactgattaaagcttacatatataacttattaaactgcctcctactcctttagcatcactacctacatgtttcagttagcaaagttaccatattggcacagggcaactgaaattggtagccaaaaactgccccaaaatgttgttcctgggcagatcaaaagggtgtcaagatatcacttattctctttaacgaataaacaccttggactgactgaatcaaagtcgagctttcgacaaatgcttgggctgagctgtactgctttaagaggtcgcctcagtggcgcatctgggcaggtgtatgcaatgcttgtaagtagaggctctgaagaagaggtctcacagcttccaagtgaattagaacctatcagatcctttccagtcgtctctagtgcttgatttgagacaatcagatcaataaacatcttgcagatcctttcaagaaactgatcatcctcctcagcatcatcgaattcaaaacttaaccttttaacagggtaatcacctgaatcaaaacttagctgccttcgcggaggaagttctggtgccttgatcacattcttctttggtgcacaagctaactcctttggtcctggagcaaaaggatcaaagatgctttcacgcggtgtctgacagccatacaaaggatcttcatctgcaacatttattgagctagatgattcaattgcttccttctctagtgtaatcacctcagcaacaccactcttgttattttcatgatcacataccatgccaagggatcttgtgtccttattttcgaaggaagattgcacagaaacttcttcatccacacacttttccaacttttttacaacagggaaatcacagtttgaaactagcgaattatcagtaacattcttatccacgccttgatccatttgggagtaatgtggactcaacctctcctgtaacttgcaaaatgaaaacctacaatgaaataaggaatagaaaatttaaataccacaaactaaccaggacataacagaaaatgatcaccgaaacaaacaagggacacccaagaagagtccaaaaggtttctaggagaaaataaggcaaaaagggtcataggagaaactaaagcaaaattaagtggttatcgacaaaacactagccccaaatgtaactgcaactgctatgaatgtaaaatgtgttctaaaagactatgcaaggcgccaaggtagtcgtcagccactaataagcagaacccagcttcaactcttgttagaagccgagtgaaatcactggcatcatctgatctaatataaccgaagccgtttttgtcgataaccgtttttttggccacatttcaaactgttcaaccatcactctgagtccaagtatgtatacaacaattatatatatttctttacttctgcaaaaagaaatcaattaaccatcaacatctattttataaagcaccgtctaattgtaaaatgggaaaactaaaaggtaaaatgctttctatgcatagctccttggaagaccttcacccacactttttacctactatatatgtatcaagggtttatatgcagctatggcagatacataaaagattaaaaatattctctatagccagtgttaaactgaacaccatagcgaaatactcaaagttgctattagtggtaccaatctagagtaataggcgcccaaatgccaaatatgtgtggtctctacaccgagacctattgtagccctattgggtgtcttgcctgagacaaatcttgcgcgcgccgccgctgaacaaaaccataaaccttgtccgagcgctctctcgacggcagcgtggtgcggctaaaaagtttggatttgatccctcacactacaatcaaaggagacaagtctacaacagatatctaatgaagcaaaatagagttacttaccaacaaaagaagaaatcaatccaatccaatccaagcccgggcggatcttccagtccaacccaatagatgagaaggggagcaaaccggatgcgtgttccttgttggcgcacctggaaatcagaatcacatggcaaaagaagcagatttagggctttaagaggtgagaaaagccgaaaaatcacaggaaaaagagataaagctcgctagaaccctaacatgtgaaaaaccataaaaaaatccatacaaagaagaggagctttttggatctgtgtgagagaaagattgagaagtagaaatggttaagaaaatgggaagaaagaaaatacctcgcagcagctctggattggggcgcgagattggtttgggcggcgccgaccgggattgggatgaggcatcccgccgccaaaacaatcccccctattaaaataaaacaaagttttcacaaaacaccccatagaatgtattatttgctaattctattcctttgtacaacatccagcgagctcagctggaccactgaggaatatatgtgaaaaataaagaatcagtgggttgaagagtaaaatgcaccaaaaggagggaaaactaatttgggcgggcaaccttggcgcacgtgtagcaatatagcatatccttcccgcggaataggtgtgcctatacatatcatcatttaggtgaaaaatgagttcttttttaggaaaaaaaataatggttgtgatcactcagaaatctataggtgcaaataatcataaactgagtgggtttgatgtgtatactacgttgagggcttgaggccagtttgcaggttatcgaagaccataatgattaagagacagttaattttctatttttcttgtttactggaatttatctattgcaagcaaaatacccaagtttcacgacgggtgaagatcacaattataactttacataccttgttccgccatttatctcttcgtatgaaacacgtcaatgaggccaaagaataaacatacgtttgttctgtcatttatctcttcatatgaaacacacaagtgaggttaaagaataatcctgtgagattttgatacctaattctaccagtataaagaagtttatgtgaaatacatataaactcgagggcaggcataaaaataattgaatgaataacttttcgtaatattaacaaaatgaaagggttaaaatgaaagattgacgatgaatccgagatattttatcatctaatacacatagatggaatccgtccggtgatggtggaggcattatccagcctctctcattgcaactcgcgagggacggtggcggtgctcccgtagccaaccaacccccttgggcacgatagacgtcctcccttagcgcgtggtagcagtgctcacctggccctaggcagcgagggcagcggtgctcccctgtccttagtagacgacaatggtgacgccagcagcctccataggcggtgaggacggcagtgctccccgtcctccctattcggcgatggcaagtgtatgaggtggcttgctaagatacaagtgtactatactttcttgtgtgttattgagttgttcgaatttttggtattttattatgaagttctcgtcttctactatggtgaaaagctcatataactggatagcgtttgcagcttcatctattcttgttgccgatttttggtcatgttcctccaattttgaaggttttggattggcaaccatgtggacatgtttgttttcctcgaactctgaaggttttaagctggccacgaacgaattggaagcatttgagccggccacgaatggattggaagcagtagcggacatattgcgcttgccgtgggaacattgcggactcttcgcgatccggacgtacacggggaagaagggaatctgacaaaaatacatgcacgggaacaaaagctagacgacgggcaaaaaaaattcctggaagctttaagtattttttatgcaggtataaatatcctcatcaggattttgatatatgtcatttccttatttctgttgtcaacatgtttttattagaatacacttaagccaaattacatgacgaatagatggaactgtatctatcataggctatgcctagtgcttcacctaggcgccttttgctcgctcaaaactattggtagtgtaactagttcaatttccaccttatcttcatccacctttgccagtcctcctatgaagtccccgtgagtcttcacacgtatctacaagtcttcctcccctctccttagcgttcacccatctccaccagtcttagcctatcttgttgggtctttgtcttttttcgttggtttatgcccatcttgctagtgcaaaaacttccgaaaatgtattgcacataatttccttaataaatagagaatattcgtgagtagtacgtagttatggactagttaaaacataataagttattgcctacaatattatcacgagtataccattcattagaaacttccaaatattccatttgtcacaaacttccaaaatacactcaagcaaatatccttcaaaacaaataaaaatatgcacatatcaccattagctagttcaaattggtgaagaaaagtgtgacaaacgctttttatcagttttgtttagataaattgacactaaaaatcgctatcgactactaaacgagaaagttatcaaatgagatccaagaaatatgggcaacatagcacgaagcgttcacggcatctatgtttcgaggtcttgatccttgcagcctttgctctcggctctgatcggtagatttggaattgggatgactagatgagatagggttaatggaaatttggaaagatttaatttcacctccttttcaataattacataatctttttaataaaataaatagttaaacgtatgtctaaaagtcaacaaataaaacaaatggccaaacgtaaataaccgtgcataatacataaatactatttcaatcgtaaacataaacgaagggcaatgcacgtaggtttatcagtccatgaatgaatattatattaaaaaaatatatataatgtcagaagtgggatttgaacccacgccctcgttagaggaccagaacttgagtctggcgccttagaccactcggccatcctgacctcacagttttttttcacctgatgttgtctaaaccattaattgacagacgagaagtaaaagtttcattccacaaataagtaacacttcaatcggtgtacagaattgcatactgtagaatatactactgtttacactcgagttgcagcattgttgcaaacacataccaaacaaatataacaaggggaaaagggaaacatttatataaccttcaagaatctcaagtcagagctctctaaaaattaatggaacacctttcccaggctcgatggtcagtctgaacgcagggcaatgcacatagtttggagaaagcttgaattcaaacttggacagcaggagtgacagaacaaccttgagctcaaccatggctagattctggccggcacatgtccggaccccaacgccgaagggcatgtacatatgagggggtttgcaggcccctgctatgccgttggcgaacctgtccggatcgaatttgtcggcactaggaccccatactgaaggatcccggtgagccatcgcgatcgggatccagatgttagttcctttcggtatgtcgatgccgccaagtttcatgtcattcagagcttcccgggcgacgaaggaggctggtgggtacaatcggagtgtctcctggatcaccattgtcagctgcacaagtatcaacagcacaccattgttagctgtaatctaatgaacggattgttttcatctcttctgttactggaagaggatgagaggacaaaacatacctttttcaacttccgtagaatgtcaaaatctagtggtctcccttgacaaatgtcaagggattccacccgggcacgggactgccattcatggtgtgaagctagaagcatcaaacaccaagcagccgtggtcgaagttgtctcatgccctgcgaagtagatgtttttgcagttgtcgacgatgaaatcctcgggcgtgcatgaagcaaagggaccatccttagaaccttgaataatggagtgcaggagatccttgtttactgaggtcgatgaatcatgttcatatttctttgatatgtttaaaatgagggtacggatgctactatccagattccagatccctctattgctccttgttggtaaatacctagtcggcccagcacaaaaataaaggaaaatccttaaatgattaaccaattacaataagatgataaaacatgagaagccacttattttcatataattattctcatgcaatggtatggattggaaaatacatgttatgatactcttggatctactgtagtatctcacggattctagataaaatattattttttaggccttatatccatttagaatgatatgtaggaattgcaggtagatcagaccaaaatgggacatgtaagttagcccagacaaaatagaagctgtatatttctccaaaaggttattctgatactgctgcaaaccaaaacagtaacacattatctgaattatagtgatttcagaagttgaatctgggcagctacttgggtattgaaatcattcaaactaagcattatctaaaaaaagagctcaacagaggattttgagcagttcaaagacagcattcttttgagttttaaattgtctcaaattgaaatatgtgccacagtagtacatgtgtagtttctgaaatatacctacttccaggaacaccaatgagcatactttgttttgccattgctttctgaagttgtcgtatttttatgaaaatctccttgccttcactaaagctgcttccaaaacaagcccttgatatgacatcagctgaaaaggttctcaagaactcatcaaccacaatctctgcactgcctcctctgtcctcaacttcatttttccatgagttcaacattgacattgcagcctccatcatcaaattcaccattccctatggatgtcattttaacaataaattgagttttagtatatgctacatgtagtgtactagaaagttgctccaagaaaaatattgttttttgacagagagatccatggcccaatacaagtgcctgcagataattaccttaaccctttccatgaatagttcaggtgcaatcacttttctctggtgtacccatagatcaccatttgatgtcagaattcccataccaagaagagctccacgctctttttgcaagtagcaaggttttccaagatccaaagatttgcagttggctagctccttcaccatgtttggatcagtaacatttaaaacttgtatgcttccagtggaatacaggtagatggaacctaacacaacatcaatgtttcaggaacttatcagctttaattttaaatatgaaatgcacaaggcatccgtcgatgttctaaaaataaatctattaggacatggttacagaacatacaacaaaagaatttacagtaatttaaatagcttatatgtaatgagggtaacaatgagactggtcgacaagatgagacagtatatggtacaccatcagaacgtatatgaaaccatgagctatccataaacaggccccaatcaaagaaattatgtttcgatggttgcagagcgaactaccatccaaaatacaaaggtacctaaaactctctgaattcaagtttgcatcaccccaaaataaaaacaatcctgttatgtgggacaataaaaagagaaattttagagaaaaaataagtcaatatcaaaacattcctcttaacaaaattccaatgaattacatttaacatcgaatataaagatgaattaataaactttattttactgaaactattatgcactacaagtttcttaacgtaccataaaccctgctccagtggaggaagtaagggaaaagagttgccacataatttgatgaaaacatgtcggtactccctgcttcttgttcatgtgctgacttggccaattgctggattctcctcatctctggtatgtttccaaagagaaaagaaggcttgggacccctcactccttggctcctcagtttctgcctcaaccgctctggtcttagccatagaatgatatacacataggagaacagaaggatacagaggatgatcggaggtagaagtgctagccattgctgtgatgagaatagctccatttttgtgtgtacgtatctgggtgtgtgtgtgagagaagagggagactacatgttcatagcatatccatatactgtatactgcatatttgctgggtgatccatctccatgtgaagcttggagctgaaaaggacataaagccgcaaagaagcgcctcactcactctgagcagttagcatgtaacgatcatacaacactgcaaatttacaacatagaaaagaaatccaaggttagtggtaggaaaacttaatttaacatgcatttttttaaggaaaccagggtctgttatgaccaaattattcacatggcataaaaaggaacaatttgggggtttcatatatcttcaacagattatgaggttgggcaataaccttgtagtaaagagctttcaacaaacaataaattaagacttttcggcatgatgttgtatgatagtttagccccattaatttggcaagaaattgcacaagatatagacatatagtagcctagaggctgctagaatatagagagataacatcaattggttgcttgaataaaaaactacgggcctctgctaagagtagaggactcaattcattccccacacaagttattaaaggaagtgttagcctgcactaagaaaataaatgagatgagatgagtgagggcacgcaccgtggcatttcgagctcaacaattgggctctgtgactctgcagctagcagctccatgcgaagaccatgctgatgagttgattgattacaagtatcagcgcgagggcgcggaggatgcaaagaggatgaggaaactgactgattaagaagaatctgcggtccagatagatgcagtctccagaaacagccctgtctgtctacttgctaagttttgtcactttgttagactcccatcaatcaacgcttggacccaaacgtcagtggcaaaccagacaaatgcctttttttttttcatacaaaagggagtgatggcctctcttactttttcaacccaaaagaatggatcgcaacaatgttctccatcataaaaccctttgattgggttcaacgagcttagagtgcttaacaacttcatctcaaaaaaggagctttattataacaagcattgctgtctgtggccagcaattataactggagctgtcatgaatcgactgggtgggtgtgagtaacagggctgctagctcatggcagctttgtcaccatgagtggcaagccgaacccgggttcaatggtcagcctgaacgccggcgagtgacggtacctcggcgacggcgagaaggcgaactttgtcagcagcctggccaacaccaccttcagctccgccattgccaggttctgcccgatgcacgtcctgggcccgtgcccgaacggcacgtacatgtgcgccgccctgcacgccgccgtcacgccgttcgcgaaccggtccggccggaactcgtcggcgtcggcgccccaggcttccttgtccaggtgcagcatcagcctgggcacctgcacgatggtgccgcgaggcacctcgatgttgccaagcttcacgtccgtcagggcctcctgcatcatcaccgacgccggcgggtacagccgaagcgtctcctggatcaccatcgtcacctgcatcatttcgacatcgttgtcattcatcatcagtaaacagccattgttaatttctacgatgaacaatgcggtttaagatgttaatttctcacaatctttaaccggcgaagggcgtccacgtccaatgtcgaccttccccggcaaacctccattgcctcagagtgcgtggcgagtagcatcaggcaccagatggcggtgaccgccgtgctctcgtgacctccgaagtagatggtcttacagtttccgacgataaagtcctcagcctctgcagcgctgcgaccatcctgcgcaccatcaatgatggcgttgacaagactgttgtgtgagtcttggtagtggtgttgttcctttgcgacatccaggatcagtaagcggacttgttcatccagcatctgtatttcttggttgctcttggttggcaggtatttcctacaacagcaatatagcatgaaccatctaaattagcatacctgatcacttatagctgtgattgtgacatgtaagtctagtttatgccatgcttgaattataatactttaagcatgtgctgtttgaaaacagtttacggcgaggttttctacctatttgtctctactgaatgacaggacttgttacctactaatctcaaattaataaggagtatacaaaagactatttcttggttaatatcatgatacacacgtgaaggttctcatttcattgcaactaatttcattgacttaccacagtgcagacagaccaacaaacgaatcttgctgagcaattactttttggagctgcctaagcttgcaaaatatttcttctccttttgtgaagctactcccaaagcaagccctggcaattacatctgctgacaagttccgcaagtaatcatcgacaactatttccctacaccctcccacatcgtcaatcatatcctcccatgcttctaacactgtaacagttgcatcctcaatcagctggatcataccctgcatgcatatataaataacaactgcaatcacgcgtgatacgagttctagttttcagtccatgaaacctacaagcaatcacaatttaatggtaccttaatcttatccatgaagaactctggtgcaattatcttcctctgataggcccattcatcaccattctctgtaaataaacctcctccaaagagggccttgcgagatttctttagataattaggcttaccaagctctgatggtgtccaccggcctatatccttcaccatatctgggtgagaaacttgtagtatctccagagctccagttgagtatagaaacactgggcctggtcaaaatacacatgtaaattaacttcattaagaagaactcaacatggacattccctcaaatttgacatgaatatagggaaaatgagatgaaaagcataatctattctaagattgaaatcatttgtcaaacttgcatttttcggagcaaaggaaatgataaatatgattgttattgtattagaattctcactaccaaagtagatcagatcctgcttaatctacaagtagttgggaaatttttagttattcaacacaaaactcgagataacatataaaatgggtgtatgaaaattttaattgatggtcaactactgagtcctttatatgactgtcaagagttgaatggctattatattaagctgtaaaagggtcccacagtctaaataaactattcatcaataattatgatcctgacaaacttgtttaataatactcagtactagcatctgagcttgtttagagtctgaaacagaaacttcgtaggatggtaaatagcatccaaaatggacaaaataaaattacaaaacaaaggattagatatatatttaaaaatgtgtgatggcaccatttcgctgaaaagtgtctgatctgtttatataatttgatatcctactaaaagttgaaaaacagtaaaaagaggagagattaaaaaaattatgattgccctccaactccctactaaatgatcaattcaggcttataaactagattttaatagcaaggatactttgggatcctgcttctccatggtaattcattaattcacttcaacagttgtaggtgactaattttctccaagacatgtcattaataaacttcaggatcctatcatcaatctgatctactcatgagccatgaacatatgagtgcaagagccaatcatggacaaagtcacaacactagcatatgcataccataagtttcccgacagaggagaaagtgtgggaagagggtggagatgaagttgttggtgccttgcttctgtgaaaatttgagttcttgtcggattcttttgatctcctttgtgttgccgtacagaaaagtaggcttgggaccccttatgccttgcctcctcaacttcttccttatcttcacagccctcagccataggatgttgcacaagtagaacagagctaagctaagaagtatgacaagaacaacaatgagtgcaagcaatttctccatgaagcatagggaaccagagaagcaaagtatttctgtcaaatcttcagtacattaggtctttcgtgcgctagctttatatatttgtttaacacctcaagcatgtgaattcttttgtttgaccttttcttcaacaactgattgttttgtaggttgctttcacatcttgggatcaacttacaatcagttagaccttccagttcatgatgaggtgaattcaacagactaaattactgcaagaaaatcattttgatcccctgttttacctgatgacgatctaagaaccagccttaagttctgtgctagcatactgcattatgcacaacctactttagctaccagaagcatttcatgagagaaacaatataccaagaattaacatatagaaaaaaattgagaggcacaaaccaatgaagcctagacgtgagcttcaaacaagagacgaattacctctccactggacactgggtagaattctgacagaagcactgaacgcaaatggagtcttctcttccatggtgatttttaaatgtggcaacaacagaaggaagcataggacatccaatgacacatatatgttaaacaaatagcaagtatcaatacacactttgcttgactgagcaaagtagcagaagaaagtaggcatgtgaattcttttacaaccggtggcatgtgaattcttttacaacactccgaccggtaactgcagcaactacaacgtttgaaaattttaaaataaaactattctaaagaaacaatcacacaccaccatatagtcattttgttatcagatgtaccaacggaacattctagaacatagaccaccaactctttttggtgtccacatgtacttcagtggcacttggggatctacagtacagttgccttctaccactcctagcgggatttgtaaagcataaaactagagcgaaaccgatgaggcttacaactggagcagcagcaataaaaagccatccactgcgcctgcgtgcactgtttggttgctcatcaacacgaacattgtgttcacttgtattagtctcttcgatcacaccagcagccatctgacgagttacctggacctcttgttcatcagaaatttcttccacaacctgaatgtctcttacattggttgtggcttgcttggacctttcatactctgcatcatctgtaggaagctcatatcggcagacaggacatgtatttctagaactaagccatggcaagatgcacgatgaatgataaagatgcatgcatggtagctgttttgctctagctctggtaggaattgggtctttgcagactggacaaataacatcaccatttgtctgatggcttgcagagataatcacggaggggagattttcaataaaggatgtcgctgctggtggagctcctcttctggaatcgttgtcctcagcaaattgctcaaggagcatctcaaactgccttgcatcaacatagtcatctggattcccgacaaaagttgtcctcatttctggctcttccatgtcatctagcaagttggtcacatttgctctttgacgtacactcacactccaattccatacaccatcttcagattcgtcctcactcaatccacttagctgaatatcatgtgattgctgctggtgctgggtcatggtgttgactatttcatcaaaaccagactcttccacatcttcctggtcatctgaatcccactgatccagtctagcattcatgggatcaatatcagtatctgtgttcatgtagctgtcattgtcaagttgaatggaaatcctcctccttgtcatcacgctatgttcctctatggaggtatctgaatctccaccatagtcaccaagactgatggcagattcaatttcaccaaacacagaatcaacataattaaggccatcgctctcatcatctgaagcatgccatctttgagattggcttggtgttgaattaaacgatgcatgttgcggcgcgaccgacgaagaatcaatatccgtttcacgaccttgtcttcttgctaagtcgatcagctgagaaaactcctgcaagaatgcgtcctccaggaaatcaatgcttgcagtcctggatatctgcctcctccgtgtgttctgccgataagtgctggttatttcatctctttcatcatcattgagtactgtcatcttgcagtccctgcatatggctaaagcttcaaaggtatcggtcacctgagcatccaaagtaaacggccttgtgcaaactaggcactgaacatctggttggctggcaactggatgacagtcgctcgcgtgtgttcgatggtcagacatggatatcctgatgaactgaacagggcacactgaatttggtcagcagttcgctattggacaaagtagacctgcggaacaaaacataaaaaaagaaagaaagaatgtgattagcgccagttctgcagtgaagtagtagcaaaatgcttataggatatatgctcaacaagacgaataccattaccagctagagattgcggagaagaagtgatgagagatcgcagcgcgaaacaacgggacccccgccttgtcaattaagcgctactgcagcagagcagaggaagcatccccctcatttgaatttgaatcaagagaaattgaagagttgaggtatactagtcggggatggcagtagatttgatgggggaggcctaaactagggctggtggtggtgggcaggaggaaccaactgccatatgcagagaccgattgacgacaatcttgagtggaatcaatcagtggagcaacaccaaatatggattttgaggggggtttgaagatggggattattggaggttgaggtaaaggaggtagggagacgaagaagacgacgagagggaaggggaaagggaaagccggctgcctctgccaagtgtggcccaccagtcagtgcacacggtgaatttagagccctcgtaagccaaagctaaatccaaaatttaaatattgccgttaaagttgctaaaacacacacacacacacacacacacacacacacacacacacacacacacacacagatatatatatatatatatatatatatatatatatatatatatatatatatatatatatataaataagttttacttggaggagattcacgaccacacatccgtcacaacgaccctcgacgacaaagcaactattgccccgctaagctccaactcccgccatggcaccttggtgtggcggatggcgagccagcgccagatcggtggttcaatgagttccctcatcacctgtcgtcgccacgcttctattagttcctctctaatcatgaaaacgagagtggccacgacaaggaagatagagcgaaagacgaccgcaacaaggaggatcgctccgacaatggccgtaggagccacgggatggatgtccgcgaaggcgaccgttgcggccgtgataatgagagctgcagcgacctgttgaagcagtacaacaaagaccatccttttatgggctagtgtcacgcccagaaatttagcctaaattttcagactattttgtgtattaaatctctgtccaggaccagccagggtacacaaaatgacaagtaataaacagttccaaacgtaaataaagcgtaaaatacttacaggagaggcacttagtcctcacaccgaaacaaaagcagcggcagcggaaaagacgatcctagcggggcttcagctccactccacaggcaaaactcaactggggtctgagccttggtcctctaacttcgtcttcagctcagaagcactacacttctgaaaagggggaataatagcaagactgagtacaaccaccatactcagcaagccacaccaacgatgcagacgtgcaatgggacacaaggacggtttgtggctatttgcataaaggctgttgtaaaacattttattgagcaaaacaataaaactgttgagtaattaaagtaacattaaatctccactgatcaatgctacaccacgttgaacaggcccaaccaacccacctgaactacagtgcattgagtcgatttattaaggtgggactaatcacggtgaataaccacgggcacggctattcgaatagttttactctgatcagaggtgtacaactgtacccacaagacacagccccacgacacgtttccgtgcgccgacatgccaccacgacataccggaaagaggccgtgacaggacccttcgcataactccctctagccaagcacaccacacctcaggtttcacccccactcctcgcaaggcagcgggcagtcccctctcgtgcctaggtgaatccggaagctgcataggccgtcgcagggcccatccaaactccatcacgcccacccttgcctggatgcgtcagctagaggaaagctacactacaagcccagccgttgcccacgctggcttgtggtaagcacgataaattcttccagggtttcccgcgaaccggtccttaattgccatgggcacgactagcaaaaccatgcacccacagcccaccatgaagtcacattttagttggataattacgacgatgaagcatggccagatgtctcgagcacgcagctcattctgatactaaaaaggtctaatattgtaattatcccatcaactaagctagtggtaattaagaatggctaagcatatagctctagctaggtcacataagtaacatgacctagtcgatttattacccaaggttgacaaaggacatatatcaagtaaatatggcacaagcaagcagataggtaatacccggatcccatgtaattagcaaaacatgcatatttatttgcaaacggtaaaaacatttataaattgggatcaacatgctaaaggggaatgcgtgacttgccttgcgcgaccgcggacttccgaaacgacggattctacacgctggcacgcaaaatgaggaaaaactctaataaaaaccaagaaaacagtacataaaaagtaaacaaacatgtagatctcaattttagatgaattttgcaagttaaatggctcaattcggagttctaatgaattagatatgaattttagaagttttgagccatttaaatgaatttctagaattattaacgaattattgcgcaattattaaatatttttccaaaggaaatgataagcgctgacgtcaacaaggggaagggcgccgacaggtgggccccacatggcagtgactctgggagggcggtccacggcggaccgggtccacagaccggggaggagcggcgcaccacgtggtgcacacgtggcgccgacgcggcgcacacgcagcgaccacgcggcggccacacggcagccgaaccgatggccccgatctacccggtagatcggacggcggcgggagctcgcggccggcgtgcgcgggcacggcgcaaaccggcccggcggccatggcgcacgacggcacggcgcgcatgcggcagcggcgcgagacggcggccggcgacggagagcggcggcgtcgcggcgaagcggcggctacgcggctaagcagcggcgcgacggctaaacggtgcgggagagagagaggaagaggaggagaggcatcaccgacgacgatcgatgacggcgagcgacggaggacgatggcgacggcgggacgagctccggaacctcctaacgaacaaaaggagaggggttagagggagagaggagagtgcgagagggcgagggcgccggccgaaggcgacggccatggcgtcactcaccggcgcacgacggggatggggctcgcggcaacctgacggaggaggggtggacgaggtggacctcgaccacacgaacccaacggcggtagcggtgcggtgctgcgacgaacctagcagcggttagaggcggccggagtagtgggagcagcagttagaggcggccgcgtgcacggtgcgggagcgatggagagctcgggagaggccggcggaaaaaggaaaagaggggaggaggatgcggggatggattttataggggcggggaggtcgggaacggccgggagtggcccgatttcgccggccaacgtggggaggtggaggtggagagagaggcgggattcgaatttcgaatcccggccgtctcgggcacaggtgcgggcgagcgggagggagagtgggtgcgggaggtgcggcgcatgcgcgggcgtggccgacgtggcccggaggaggcgggagcatgggcgcggcgg

SEQ ID NO: 66141 - DNA, 18119 bp, Oryza sativa
tatggcgcatgagacctctgtacccgcagcttcttggcggcgagcgcctcgatggccgcctccagctcccccatcgtcgtccccgccgccgccgggaccggaagtgggggtggcgccggcggcgagggggttggttggggtttcggggaatcggacaccaccattgcgggtggcgggtgcggagatcagcgtgcgacctgggatgggccttggggtccaaatgagaggggaatggaatagccgggttggttcggttgggtcgggtgggtgagactgcttcatatatagtcgtagtagcctcgtaggaggttaatgctgctgccgccgctggtaggtggggccgccgtctaaatggccaaaactgggtttttctcatgaatccagcgtgactcacgctaatgatcatcctaaaatattacataattcttaacgtttaagataatattaaaatcaaacttttatagctttgattataaataactttaaaattattcaatttaaagacactagaataacatatatagatttatcttataaaatactataataaaagtaaacatacattttgtgtatatatcttaactaattaaaatattcgtatttttcctttcgtcacatgcgtccgtcattacgttttcgtccgtccctccaaaacttttggttcgttcgtttgagttcgagtctgtctaaaaaaatccccgagctagatccccaattccccaaatcgatcaatcaaccagaaccaaaaataacacgaaaataccaataccaaatttaatctcgacctcatgaatttgatccccacaagaaacctaattccatgtattacctccctcccaatccgattcatctgagcgacaatacagaaacgatagaacattgaatcacaaatccactaaatcacgaaatcacaaatccatcaacaaatcatcctagaaaattaaatcacaaatccaacaacaaatcatcgcaggccgaggacattgctgccccgaggccgtggtacaaaggcagcaagaggcacgtcgggttgcaggcgacgtgcggcggtggaagtgcttggcgcagtcgtcgggcttgtggatgagctcgacgtgggccggcggcagggacggcatccgtccttgcggaggggagacggcttccttcttgggcgtcagttgaaggccagcagtcttgaggccagcgtcggcggtgcactcatcgtaggtcctgaggggagacggcgcttcaagagatctcgtgggcggcggcggcatcgaggagaccagcgcattaggtggcgcgcggaggacggtgaggcggcgcacactgtgttggaggaagcaccaatctaaggacgtttgtcactcgaagcgtccggcgcacgagcgcatgaacatacatatattacagaccgcgcgagaaatcaaacgaccgaggagaaatcgatgaaaactatcagttgggaattttgagtggaatcacgagttgctcttatctataccaaattttattggaaatacgattgacatagggtttattaggataggattttcccctctctggtatgattatattgtttttgttcgcaggcgacaagttccaaagagtaaggctttcggttatgattcatatagaataatatatcgagtcagaaattcagatgaatgaacgaattgatcgaacatgcaatacatttacatccaattctgatatctgaccgatggatttgatttcgtcgtcatcacgatgcagttgagactaaggatgaactcttctatgatcggttatggaggaacgcgttgtgctcgtgcaggatcggatcttgaaggcgccgagcaacgaggccagcggcgatgacgacggctccggcagcgccaccattggcaggccttgccggaggcagcggtcgtagctctccagcacggacacgatctgtttgaactcgggacgcctcgctggttcggtggaccagcacctcttgatgaggctgttgatggccggcgggcacgacggcgagagcggcggcctggcgtccctgtcgcagacggagtaggcgacctgcacggggctcaagttctggaacggcacgaggcaggtggtgagctcccacagcacgaggccgaagctgtacacgtccaccttgcggttgcagcgcttgtcgtggatcatctccggcgccatccaccggaacgtgcccgccttggaggagcacttgtcgccgcggcaggtggcctcgaggcaggacgtgcccaggtcggcgaccttgacgcgcccgccgccgtcgagcatcaggttctccggcttgaggtcgcggtggacgacgccacgcgcgtggaggtactccatgccacgggcgacgtcaagcgcgaggcggacgatggtctccggcggcagcgagtagggctcccgcccgtgcaggtacgcgctgagcgtgccgcgtcgcatgagctcggtgatgatccagtacacctccggctcccggcacacgccgacgagccgcacgacgttggggtggcgcagccgcgacaggagggacacctcggcgtcgaactgcgcctccatctcacgccggacctgcacgtcgtcgtcgtcgtcgcccactggcgcgtgcatgatcttcacggccactggttgctccccgtacatgccgcggtggatgcggctgttggaccccgacgcgatcttgggcccgaggagcagcttcgaccggtccgccgcccacgtctcgacgatcgccgccgacctcgccggcttcttgggcccgaggagcagcttaagccacgcgctgtgcttcttcattatctcctggtccatctctcacggctgcgtcgacgtcgacggcgacggccggccgccggcccggaagggcgaaaccacgcaagaggaggaccaggaacaagaagtggttgatgcgggcgaacaagggatcaggcggtcacagtttatatcccgggaatcttggtacaaatcggactccagcaacaaaagaatcctgctacaaatcggactccagcaacaaatcggactcagcaacaaaacaaatcggcgaccatatgctcagagttgttgtttgcatgccgagtgctcttttattttcttccgaacatccactaatcagcagaatccgaaattgaaccaagcagctgaatccgagtctagaccttctgttgtacgcctggtatatataagattgatccgatttagtcatgtatataagatcgtaaaatctaaatcgagagcatctcgttttagtcgtaaccagtgacggaacatcacagactggaagtatgaaagtatctacttaactagagtactactagttataatagaaaaacataatcaaagatatattttagagatcgtgtcatcgtccaaaacgtcaagaattataaaaccgaaaggagtaacaacttaaaactgaatgggacatatcctagtccaatgaatttgaaccacttatacagatttattggactaagatgtgtcccatctagttccaaattattatattttgtgatggagggagtacgcgatttccaataaaaaaaattataagtagaattcagcaaaagaattagggataacaatgtgatgattatttacgttgttatccctaattcaattctttgtgtatacctccatcccacaaaagttgatgttctagtaattatgagataaattagctcacagttataagtaccaatgtgccctccagtcgttagtgtgtttaagtgcttgagaaataaaaaagaattaatatgtatgcactcagttcaaatgaatggaccagaatcacccgggagaagtagtaatggcatcacagaactgcagcgacaatctttacaggatatttagcaattggtaaaacgactacttttatgggacggaggaggtactatataattttgaagcccatactagcgtatgcaacctaaggccatctctaatgcatgagataatcaaaccatgccacatccaaccaaaccaattcacatagtgaccgatcgccaaatcatcacacgaggcaaaaatcgaaccatcgtattatttcctctagtactaccactgcaggaagcaaaccaaaattatcacaaaggcaaaggaataaggttgatcctttctttctgttggtggatctcgtaattgaattacactctgaaactagattagtagaatcactacttaaaaaaaggtttatccatacagttaggatagaattttgggcgatcctggctttagctccattgtcggcctagcagcggcaagtcacgcatagaggtgatcggtccggtgcaagccttcgcccggatatgtgttctggtgttgtcggtgcgtggggcggtggctttttttcttcgtttttctggttacaacctcccagggttttaatcttgtaattttttttatgctctatcaatatgaacttcacgttgtctggtgcaagtcgttcaacaaaaaaaagatctttgtaggcggatagatggcccgtccacacgcaggtatttgcgaaaatcagtattttcgcatgcgggcggcccaaccacatgcgataatcgattttcgcaagcggacctcttaatgtggcccatgcgataatctatttttgcaagcggatgagttgtgcagtccgcctaaaaagatattttttccatacgctgcattaagacgcacgcacgcgataacacatttcagcaaaaaatgtaaaataaaagaattatgaaaccctaagatatgcatccacatgacacaacattcatagatccatccacatctacacgccacaaacaaattgtacaaagaacattaagcaaagattcatccacaaacatagactacaaacaaacaagaacaaacatgaacaactagaatttcatccaaaacatagtacatgcagcaatagatccgagtccagcggaggagatgaggcgagcgaaggagactaagaggcttaggagaggagacacggggaaggagacgaagaggaggaggaaagaaggccggcgattcatacccggggcacacgacaacgattaagaagtagaggagaataagcaccggatcccgtcctcctgaggtcgcccgtgccgatgccgtccatcccatgcccactggcacaatgaagcaagagagggaagccttcccccatgccggcttatgggggctggtctggcctcccgaccacccaattcgtcttcccaaccgatcgatgacttacccaaggtcgtaggtgctagattcgcccgccattcggtcaacggcattggatccaccgcctcaccgtcgtcagtgatgaatctgcctgcccagtggtcgccgacgatggatccaccagtcccgctgtcatcgatgctagatccaccctcgcacgatcgatcgtcgatgatggatccgacggctactcctgtcgtcgctgccgctcccggtcaatttgagcagggatgttacgttagagagagggaggggagcagtggagaaggtgggggggactaggagagtaggggagggagatgtaagtgaggagagagtggggagaggataaggatgggtggctgtagtggggttgaggatcatttgctctccatgttaatcacatgcatgtggcctttaagaggccgcatggaaaaataaatcttcacatgttgcccttgaaccactcgccccgaaatgatttctgtgtgcaggagttatggttcgtctacaacatactagggtcttgtacagaaaaattaaatatgcaatgcagtagtgaatcaaaccatgcatcgtggaccccatgtcttggtgaactattcaattgtcggttcaattagcttatagtgcaaggatgtgtaataaataatgatgatggcagttattcacactaatgttattattaggggtgctatcgtatcacaactgctaatcaagaaataacctaaaaaaagtacgaagttgagtaaatactaagtcatactataccgttgctttctaaagtgttgtcataaataggtagatggacatatgaaacttcagttaatctacctacatggagcataaccatagtaaaaaagacgagactgacggttgtatcgtaaaaaacagaaccacaatccttcttactaggtcggtttgctacaaagaccggatatgcattctgtgtgaatcggacggttttacgtggaaaaccgatgacccgccttctgttggtgaaaatgggccatcctataaaggctcatgatgcttactaaccaacccaatacgctttagagcaggtacaatagcaggctataagccagctgaaaatatattttaagataaataaggagagagaatagtagcgggctacagatttacagccagctgtagcacgggctccaagatatagtgtgtgtatgactggtgggactaggtattaatagtgtagtatgtaactattgtatgaatgagctattagattagctgtagataaattggagctagtagttggctatactattgaacttgctcttattgcagaacggccgtaggaagggattaaacgctgtctacctagttcaaaacttggcgtcactaccaaacagctagcttagaggagatatgcatggtaaataaactttccagttcagcacctagctagaccggacgaatcttgtggaaaatcctgtggaattcctacttccgaaaggatacccaagttttcaattgaatacacagttattggacccaaaaaaaaaagaaatgaagggcgtattccaaacagaaataaaaaaaaccatcttttctaaggaaaatccttaaagtcgggcgaccggtgcgggggagccggatcagacgctccccccgcgcgcccctcctccacgtgcgcacctgttgggcctacccacctctctctcctctttttctacaaaagatgtttcacctagtgtacttacagtattttactatttataaatctaatgttgtagtgaattaaaatactcttttgcaacaaaaaacccacatattttggaaactctctattaagggaatttggtttattttttgttccacaagaaatgtttcactatgtatacatctaatgttacggtgaacgaaacattccattgcaaaaaaaaaacccacatattttggaaaccccctattaagagaatttggtttattttttgttctaccgaaaaatgttttacctagtgtactcacaatgtttcactatatatatagatctaatgctgcagtgaacagaaacattctgtcggtatttgctgaaacattatttttatataaggtgaaacaacacccgagttaaacgagtgaaacattttcgatctacttagtgaaacaattccaatatacctggtggaatattgtgcaacatttaaaaataattcaataataagcttttttttttcgttggaatatatccatgtgtagtcttcttttgaatatttaattgcaacgaatttaatggtgcaatcggatcatgatttggataagtaatttaagagaaaaatcagtttaaagtagttttgcacgtaaatcgggtgctgacgtcatgcttatgtcagcgcccgattttaatctcctcccatcggccgcccgagcgggagtcacgtcctctttctaagcccaattcacgcaagtttagtggctcatttcaataattagcgcatggtagatattaggcttttggctgttacattttcgatacacaacttcaaaaccctgggtctgcacctgaaaggatgtcattactcattatatttccgcagccaacttgcttgatttggtgcttgttccgctctatggccagtcaaattctcctataacacatttagcatgatagcatatttgtctcttcttgctacatttgttcatgcgtacgcgttgccggcgtgcacgccggcccactaaggcccatgcacgcacgcgcttgttagggatggcaacggggcggggcggggccgggttggacaggaacggccctggccccgacccccgactttatcctccgcccccggccccggtaccatcttcgggtgaaaagcttcccccgcccccgacctctacgggtccccgaccccgaccgaggccccacaagctatagagaaaagaggacaaaaccaggattgtagcagctaagatgaagtggctcatcgagaaggctagcatcgcggagatttggcggaggtgcagaagccggcgacgcgcgacgaagacaaaggcgaagcagccggcgacacgcggcggagttgcagcagtcggagacgcagcgaaagtgcaacggccggcgacccgcggccgagacggaggcgcagcagccggcctgggcagaggcgcagcctcgcagggagctgacgaggcgcagcagcttgcaacgactgcggtagcgccgatgcagtcgctactcgttgactgtatctttctttttttattcttttgatttgaaaggtcattgactcgatctggatggatggctccgtaactgtatgtatggctggggtagataagatgggataggaaaagttatttcacaacatgggcttgtttgggccacatttttaatttgcaatctacgcatgtaccatatttccgggtccccatgggtcacccgcgggtggaaacctagacccgcccccgtccccgcatattttcggggccccgccccgctgcacccgcggggccaaatatagccccgaccccggccccgtagggtcgggtccccggcgggtacccgtccccgtcggggaaattgacatccctagcgcttgtgtttctctcttttttttccttttttttccctgtttgttattcccgccgtacggatagattagtttcctatttttactaatgattagtttactagtaatttttaaatcttaactttaaaattttcaaatctcgagttgaaagttttcaaatctcaagttgaaagttttcaaaactttcaaatctggacttgaaagtttttgaatcgagtcgaaagttttcaaatcttgagttgaaaattttcaaatctcaagttgaaagttttcaaaattttcaaatctggacctgaaagttttcaaatctcgagttgaaagttttcaaatctgagttaaaagttttcaaatctcaagttgaaagttttaaactttcaaatctggacttgaaagtttttgaatctgagttgaacgttttcaaatctcgagttgaaagttttcaaaactgagtggaaagttttcaaaatttgactttaaaatttaaatcttaaatcaaaagttttcaaatctgacttaaaaattttcaatctgttagtaaaaaaatctcccgaaaaaagaaaaaaaatcttgagaatcttccataattactcgttattagtgttaagtgggtgttaactaatactatagagtagttagggaggtaatactataaagtagttagggaggtgctcgctgctggcgcgcacgcgctagctagcagctaacaaggccggtggggattaaacagataaggggctactaagtaagtttagtggaagcggaaatccttgccacgaagcaatttaggagctatatgaaccccttattaagttgcatgaaccgactaaacaaaataaaaaaaacttaagctaataattgaggaagatgctcaatcaactattttaacactttaccctcacgtgagcctattaatgttagacgtggaatatttattagtataataaatatcaaattgaatgcacaagctagtttaacgcaaaagcattcgagaatgctgcgcgttgggcgcccgatggcatggaaaaaatcggacgcctcgtggcgcccgcgcctcctaccgctccttttaaaacgatttttctcttaaactaattatccaatctacgatccaatcacattgttgtattcgttgtaattaaatctttacaacaagatcacacatgattatatttcgataaaaaaatattttagcttttctattgatatttttttttgaatattgcatatgatctctttcgatgtttcaactattagttttatgatgtttcagctagtgtacttacgatgtttcactatgtacggatcaaatgttgtagtggattttgatattatggaacgcgccgttgtaacaaatcacccatatattttggaaaccccctattaagggaatttggtttatttttttgttccaccaaaaatatttcacctagtgtactcacaatgttttactatgtatagatctaatgttgcagtgaactgaaatatttcattgaaaaaaaacccacatattttagaaaccccctattaaggaaattcgttttatttattgttccccaaaaaaatatttcacgtagtgtacttataatgtttcactatgtatggattaaatgttgcagtgaactgaaacattatttcgctatttgctgaaacattatttttatataaggtgaaacaacacccgatttaaacaagtgaaacattttcgatctatttagtcaaacaattccgatatacctggtggaacatcgtgcaacatttagaaataattcaataataagctaaaaaaattttgttaaaatatatccatgtgtggtcttgttttgaagatttaattgcaacgaatttaatggtgcaatcaaatcatgatttggataagtaatttaagagaaaaatcagtttaaaatagtttttcacgtaaatcaggcgttgacgtcatgtcatgctgacgtcagcacccgatttttccccaaacattcggacgtccgaaacggagttgcctccaaaagcattaaactgaaattcatttgtgcttcgagacatgttgaacagaaaccgcaccatcatacctccacgcctttgcatataatcctcaaacgtccacacttaaaataacaaacgaaacaaggagcatgtcaactgtcagttaaatcgacaagctgcaccttcaaagggcagaactattgaaaagctattacaacaaagagaatggccaaaattgtatatacatgttaatgtaaataaatgtccaacacaacatgaggcaattgagccaacacaattcaagaggaaaactcctgtaagcatctatatctttctctagtttactcaacaacccattgcagcaagtgctacctgggatagaacggtggatgacggtagaagggataattaggctgttggggattaaacatacccataaattgagaaactccaacattttgtgcaaatgcagcgctctgatttccaggccaacctagttgggcagcataagtgtgagatataggcattgcagcatatggtgaatgcccaacagaatcaacctgcacaatatgcggaaccataggtgatatggaagcagggatagatggtgttggcagcttggtggtgcatggccttgggcgtttctcttgtggcttactttgctgttgttgttgttgctgctgctgttttttctgtggcttcttatgctgttgttcttgaggcctatttgtcttttgttgctgctgctgctcttctggcttagtttgctccttccccatcttctcttgcggcttaatttgttgcttctgctgctgctgttgttgttgctcttgaggcttatttgtgtttagctgttgttgcttcttctgttctggcttagtttgctgctgccccttcttcccttgtggtttaatctgttgcttctgctgctggatctcttgtcccctgtgctgttgctgctcgagctgctctctcttgcgcttcttgtttgtatgcttttgctgctgctgctgctgctgctctgaatttgaagttgaggcagaacaagcatcccctgaacttcgcttcgttgcatattgatctaataatttcttcatttctgccagcataccactgcgcacgttgaaatcagtgatctgctgttgaactatgttctgtgcaaccattagactatccacctccttcgttataagtggactctgctcacaagtaaatgtgccatcatcaaatatttaaaccatcaaaaaataaatagctcgaggagagaacaaatttttgtaacataaacatctaccagactactactacaagaatgtcttatttccaatttcttaatttttgcaaggtaaaagatcactctaatagtccatgcataacaatatttcaagtttctatttactcttatgatttatgacatcgatcggtgccagatcacgttgcagtataaattagaaaagtactaccccaacatttaatcatttcctatggagtagtcaataccagagacttgcgtggagaattcatattaattatatccagagcattctgttttgccctttcaacatatcccttcagaagagaaagtggagtatatttgtctatcaaattaaaagcttgtgttaacagtaaggcttcgagttgttgaccatttccaatcaaataatcaattaagtctgcaaaaacatgacaacaagaaaaatgtcagcagacattgctccagcaaaataaaaattatcaaagagataaatgtctacaattatgttgaaatgtatatataaaaaggaaataactagttaactacaagtagcacagcatcatagtatcaaaaattgaaatttcatcagctagttactacagagtatacattgcaccaagcaattaccaggtatatctgtgatgtatcaatatcagatgataaactatcctacatgagcttatattaacaggtctatcaaataaacaaaaatgtcatttggtcgcagcgtctacaaacactgaagaaactccattatggaattaacatttttttttactgtgaatcaggaaaaagtacctcgtgcaaaaacagggcctcaaggtgcacaagtggagcaactaagcaagtgaataataattgaaactttgttctcaagactagcatgccaattagaaaggatttttattttatcgttcaaattattggtcagctgtcacttgtatatactgccaatagcccttcaatgcctggagatacatggaatatgcaaaatggttcaagatgttcaaaatgattgactgatttagaccatcagaagaggaacacatccctaaaaagctcaacatatctatatgtattcatcgaacaaataccacaaaaaataacgcttattaggaactcaaatgaaataagcaagttattaatctagatttttttttcttgaacacgcaagagaattgtgtgtcatttctttaagaagagaagaagaaaaaacaggggaggaaacgatccctccccaagagttaaaaaaaaaaaacaacgcatgcttaaaaaggctatcgaccaaaacccacgcttaatctagatttcaagtggattttcaatgtacaacatgatatagtcacaggctcacagcataaggatcacaatgattgagatccactgcctggggaactccaagctgcttctccaaatgaaaattgatgtatcttgaaatcaaataatgtgcagccagtacattttgaataaaacagtccattaagacatgttttcatgttgatcgtttaagtaattaattttaaatcataaacatctatacagttacattacaagagttggagactagaagagttaataatcaatcaggtattgttcagcagccacggttaaattggttatgaaaagcagtgagatatatgccagaacagagaagcaaatacaagagatcgagttgtgccatctagttctctatgttgtgcagtggttttcctataggattcaatgattaattgcccctgaacatctgaggtatgttgaaaatgtggcaaaagatgaagcagaatagtagaatttgaccagttgaccttcagttttagtttttttattgtactcccaaaattctcttttgtagtgtgaaaaaaccacgctttatcataagagaatattctgggttaaacgatggtgaacagatattagattagaagattatttttactacactatgagttcgacatgtttcactccgactactatacaagcacaacctgcttgcatgcaacatttcttgctaccaggaaaaggagtactctacctatgcatctcttattggatgattcactattgatgattatcttaaaggctagcagcattatatgcagtgcacatgttcactgttcagtggtggctatgaaatttggcagtaatgaaatgggtcgaacagacctagatgaaatactgtaaactatagcataatgtgcatggacagagtggctgcaattgaaagagagaattacacatttcgatgagtgtttgcagggtgccagataaaggctagcagcattatatgaagtgcacatgtttactgttcagtggtggcaatgaaaatttatggcattaacatactatcattgagcacaaaagtgcaggaacgcatatgatccttgagtgaagagagagtcatccataccagtgatcctattgacaagcccaagacctttgcagagttcgatgcagttctttttctgttgtttgcgtgaaagagtaccaaagatacagaagatctcatcaacagaaaactccgatacaatgttgtaagaaatgagaaaatacaggaggccccaggaggacaggttcaaaacgtccctgctgcttccagtgctgtcaatcatctccttccaatccttcgccagctgcttggcctgcttcattgtgtctgaggacagcgaggcattcactgcaggtaagcaccgaatcagcccaacacagttaccccaaaccttggtggtcttcatcttcttgctgagaaggaaaccctggacgacttggaggacaagggcagcagcatctggggcatggcgcatcaccacggggtactcatgccagaggcaaatgctctggttcttacacaccaatttcaacagccccctgacgtccatgccagcacacactcccctaagatgatcgctgcaacttggaagagctcgattgccttgttctcgagacgctttctcgtcgccctcctcgatgtcatgctccatagatgtcaccttagcctcattttgctcctccgatttggcctccattgtctcaccgtcagccacctgctgaaccccttgggcatccacatccccattctccccaatgtcgtgttcttgagaggccagcttgtccccatgttgctcctcatctttggcctcaattatctccttctctgcctcatcctcttcctgtttctgcactggaatcgcactcttggaagactcatcagcatcttctttggacttctgcatctcctcgttggctccctgctgctcctcgtcgacctcctccccggcctcctgaacctcttctctgacttcctcttcctcctcctcaatctcctcttcttcctcctcaatctcctcctcgacctcttcctcctcaatctcctcctcttcctcaacttcttcctcctcaacctcttcctcctcctcctctttctcctcctcgtcgctgtcctcttcctgcttcccgcccttctcgccgtcgcttgtggaggcggcggcgggacctgcaagcgcggggcgggccgcctcgaggacccggagctggccgaaccgccggtcgatcgacgactggagcgaggagatgtaggagtcgaggtcgccccaggcgaaggggagcgggaagggcgagcaggcggcgaggacgtcgaaggcctcgcgcagcgcctccttcttcgcggggagggcggcgatggcggcctccatctcccccgtcgtcatctccaccggcaggccgtgcagcgccggtgcggaaggggccgcatcagattttggaccggcgccgccgccggcggcggcagcggcggcggggtccatcgcgacgccgtcacgccgcgccgacggcgagacgagaacggcgtgagggattccttcctctctcgtgttgcggcaaagcggatcgagccaaaccgaaaagactcggaggaggagagattagaacgtggtttagttgggctcggactcggactgcgcagtgatttacttgggcttttctctttggaataagttcactttaggtccctctatttgtcggtcagtccgattttcatcccttaaccgtaaaaccggatacgacccgtccctcaacttacgaaaaccagacaaacgagatccctcggcagtatggagggtggttttggccgatgtggcgcctacatggctcttttgactatgtcttcatcccacgtggcattgacgtggcggtgacgtggcaactcaatatgaaaaatattaaaccccgtgggacccacatgtcagttttagacacaaagtaataaaaaaaatggtgggggtccacgtgggctccacatgtcactcccccctacctcttcttcctcccctctccccatctccccatctcccctctccggccacggtcacggctgtgcccgggcagagacggatttagcgtattagcagtgggggccctggaccccactcaaattttacatatattacacatacccctaatcatattaccaataggcccccactgcacctgacaagaaggcccccactcttctggtttccttcctttgcaatctttgtgcgtgcggtgaggacagtattgaggactcgaaccgtccgctccccttccctggatcccaatctacaaatcgtaattaccggagctattgaggccatcaaaatctggtgcttcccgcagttcgccgtttcccacagcctgcaagtgccggcgccgaaggaggccgtcgcgaccactgcctggaggcttcacgagagccacggatggcgggatgtcggcgtccttccatcgctatctgcccaacaatgcatctcccgtgccaatcgcgtcacgccgcaagtcgtggacagtctctatgggctatggccacggcccatgcggccatgtcggcaagcctcacccggtgcacctgcagcctgaaaccctctctagttgcccttggtaagtagccacggtatgtttttatgtttacattagcaattttgtctttcaaaattttgagccgtactcctctagtttgtggtagcactaatatcgtaatgcaacatctcatcaatgatttggtaggaaaagataatgacatatatttgtaataaaaaacaacagcaataatgaacactaatggaaggaatctagtgtaaatgcatcaaaaccaataactagacaaaattttgcaatgcctcaagcccctcaacctactgaagtactgattcagacaagcttccttggagtaatataatatgtcatagtcatttttatgtaggatctgcaaaataagtgaatttacttgggttttctaacttgctatatataagttataaagttaagttagataatttacataccacagatgcccccagtcaatttttatcctgcgtccggcacccctggtgccggggactaccacctcaagaagactccacccgcacgtccgcccgtcgcggccccagtccgtcgcgtcggcttcgcgctgccgtccaccccccgctccgccccgccccgccccgccggcttcgcaccgctgcgcacctgaaagacgtcgacgacgaggctggcgccctccgcttggctccgccgcccgccgagtcgcagccgcacgcggacgggagctcgacgcagcccgcccccgccgccgcggaggaggaggagaacacggcgctcaagactctacaagttccatctagctttgcaaggcccatcaaccgcagcatcatcggttcttcttcttcgtagtcgtcgtctcagaattctctgcggatggaatattcagacctgtggatcggacaaagtatactcgtttgaatcattgatcatagctggagaaaaaacctaggagctggggataactgatatgatatatatggaaaagggatagacatgctattttatctctaacaatgaaagatgtgatcatctcaactaacaatccatggcagcaacctgcacggctgcgtggacgagggcgccgcggcaggagcaggcggcggagatccccatcgtgctgttcccgtcagtggtcttccccggcgcgacggtgcagctccaggcgttcgagttcaggtaccggaccatggtgcacacgcggctccaggttcggcgtcgtgtactccggcgggcggcggcgccgcggcggagtgggaggcggggtggcggccggcgaggtggggtgcgtcggcggcgaccggttccgc

SEQ ID NO: 66142 - DNA, 70316 bp, Oryza sativa
  unsure (1)..(70316): unsure at all n locations
tcattgattagtagtgattataacaaggtaggacgactagttgggtgtatgtgaaaccgagagccgttttcgacgagattgcaaaagggatctcgagttcgagatcgcgtactaaaaagcagcggtcggtggcagaaagtccaaaccaaacccccgccttttctccatcctcgtttatcgatagccaccaccgccgtgggcatattcccgggccttttcgggttggctgccgcgctcccgcgtgatctgctcgcgggcgacagaggggaaaacggcatatccgggcggtgccgcggccgtgcgcgcggcatatccgcccaccgtggccgtggcgtgcggggccaggtcaggtcaggtcacggcgcgtgatctgggcccgggccccgcggatgggggaactgatccggtggtggcgcccccgcgcgcggctggtgctaattccggggggcgcgtcacgacacggcgccgcgtcagcgtgcgggcgcgcgtgcatggcttgcttggttggttgttcggtttcgcttgctcacgttttcctccttgcgcttttcggattgtgacgggcgacttccccggaccggccgtccggccccatcatccttcttctcgggcctgttgtttaatggacagacgatttgcgtcctactgtacaatcccgtttactaatatataaaaagtgctccatttcaactagtatggtggtgtttgaatcttacgaagataaagacgaagataaaaattaagtgtttcacgtaaaacgaggtggtaataacatataattaattgagttttaattattataaacttgaaaaatggattaatctgatattatagaacaactttcatatagaaaattttcgcacgaaacacactgtttatcagtttgaaaagcgtaccacgaaaatccaaaactttatccactgcttgtagtggaaacgaacttataagagcaggtacaatagcatactattagccatattttaatgagataaaagatgagagagaaggcagtgggctatagatttgtagccagctgcagcacggactccaagacgcagtgtgtgtatgacaggtgggaccatatattaatagtatagtaagtaactattgtattaattggctattacattggctatagatgaattggagctaatagtgggctatactattaaacttactctaaggctgtgttcagaatactcttctactccctcgttttgtgtgcgtgttttcccaattgctaagaggtggaataatatgtttttttaaaaaaggtctatagaaaagatgctttgaaaaatcatattgattcatttttatttttaacttatacgtaactagttaccctctccgtttaaaaaaaaaacaaaccttgaacaggatgtgacacatcctaccactagaatactccctgcattctataatataagacacaactacttttaaaaattgttttcataatataagacatgcatgcatgcatgtcattaactagcacacattttccactaaaatattattatttaaatcctccaccatcaagatctctaattttattaggtgcatgcgttctatttattaggtaatctaaacgatgaggtgataataattatttcttgatctttaggttaagggtggttatgtcttatattttgaaatagaggaagtatgtcacaacatgttctagttttagttttgtttttcatgagacggaggaagtatatgctgattatttttttaaaaaaatacataattttttaaaataagatggatggccaaacgttagataaaaacccaaaaaataaaatctttatgggaagaaaggagtaattaggctgcgttcaggaggaggggctgggaacccctcctctttggcacgcaaaacgatgttcacattaacacgtgattaattaagtattagctatttttttttaaaaaaagatcaatataattttttaagcaactttcgtatagaaacttttttgtaaaataaaatttgaaaagcgtgcatgcagaaaacgatggtggggagttgggagttcccagcaaagaacgcagccaaaagttatcttgttctctatgcgggatgaatgtgttaggttcacatgcatgcaactagcaagacccgtacgatcgaccggcaatccggcatggacaacaacaagcttgatggacagtgaggcatcaaagcttgatggaccgtgatgcgagctgcatgatcgatcaataataggaccaaaaaacacacgctgaataatgtttttccacgaggagatgagacagccttcgtaaccgtgaaggaaagagccaaccgcgaatccgcaatgtgctgcgtgtcagagaggccactgggatcgaattatggacaagaacgctttttctatggccctagctacggatggagcttgcaccacaagttctgcaccgacaaatgagatctccacttctccggccactacacttggcagttggcacctttctcctgtccccacgcccagaaaagcaagtgcaagtccttccctgtattaacaattatagactttggggtaatcaatgtgcacgaataatttgttatgattaataacctatcctaagagcacccgcaatggtaaagtaagttgctatctataaaacatgtacatctcagcaatagactagattaatagtaaaccacttcaatggtatgtctacaacggtatctatagctctctaatccattgtctcgtttttctctatagactatctccaggttagtagatagttttgctctctctcttcatttaatctcttccaagtagaaaaatatgctgacatggatctcttgtagagagcctatagataatcattgcgggtgccctaaacagttaacactttttatggctaaaccaaatgtgttagtaaaataattggttggtttgagggccttttatagggtggtcacttaactcaaaaaggcctagtattaattaattagaacactctgattaagactgatcctgatttgcatatatactagaatattgtaatagtggagatcagtatatcatcactgacataaattacaacaaccatgtataggtgctattacaaaagattgctagttggacatacgaagattagcatttgttctctgccgatgaagcatctatgttccactcaacaaaaggtagaacatttagattaagaatattggaattggacatctttaattggaaaggatatagagcttaattgcaattgtacatagaagtgaattccacctcaacaagggtgaggatgtgcgcatccatatgaactaccaactattcctctctttttttcccctccctgtccacgtacccaagcactcatctatctctccaacatcccatcaggcgttcacaatttcatgagatctcactcaaattttacatatttcgagcatctcaagcaagtttggaatgagatcttgaggttcatttcaaatgtttttgttcagaattttgtggggttctttttcgaaattagcaaaaacaaattaatgtcttgttgaggctccatattctcaagtttcgaataaaaatctggatggtttgaggagatgtagattcttgaagaagctatagctgatagaaactctctcaaacagggctatatacctaactttattcttcttaacagatcttttatacatagtacatttgtggtattcacatctcttaaaggtgcaactgctacaagctcccacagtgttatatactaacttcattctctttaatagaacctcttcaattagcattttatacatggtatgtgagtggtttaagccactgctatgtcccttgaccatctactactcaaatgccaactttacactttattatttttgaatgtctacttttgatatttccattcttcaattctgtttgtaagcatatatttgcaaagttgtttatcaccaccataaaatcctgtaacaatgcgtggggtatcaatctagtttatcttacagtaatgaacccaacgactcatggatacatctatattgaataaatacacgaatcttttaaaaaggggtcttttatccaatatgatttctcattctccttaataaggtggtgtttacatccagggacttaactttagtccctatctttagacactaatttagagtattaaatatagactacttacaaaactaattacataaataaaagctaattcacgagacaaattttttaagcataattaatctataattagagaatgtttactgtagcatcacataggctaatcatggattaattaggctcattagattcgtctcgcaaattagtccaagattatggatgggttttattaatagtctacgtttaatatttataattaattttcaaacatccgatatgatagggacttaaaagttttagtcccatctaaacagggcctaagccttttattggcgcgtgatatgttgtagtgtactacgtgagaagctggcaagatcaacagccccaaacgttccacttatttgggaaataagctaaacaacatatttgtaattatatgtgttcgtaatgtctaaaagcaaaggcttaaaaaataaacttcgataaaaacaacctcaaaatcaactccaaatttaagattaaaaatttaaattttagctgataagcataagaaaaagatgagaggctgcaatactacaggtcgctgctatcagcatcacatcgattaatttgcacattccctgaccggagcagacgttcgacattcttcagtcggccaaccaatgttctccaaccaaatcaattggttttgcagaaataaacattaatttactgaacagggaattgtgcgtcaaaattccaacaacgtagcatcatctttccagctccacccattccaaaatcaatcaaaattcaagaccgcaaataacgcgctatcattttcaagtaaggccacagaaattgcacaaacttaagtcatcttataagttacgcttgatatctttgcagcgagattaactgtttgcttaactgaccaccaatgttctccaaaaataaagtacaataggacatggaaacctcacatgcacaattaaaacaaaattataagtttccttcaaatcctccatctcgagggccaattgaaatcctctcagtcagcattcagtctgctttaatctgcagcatagaagtacagttagcacaatggcatttgacaaagggcgggcaaaattctacagttgagggatattccagtcttttccttccaaaatctacagatgcatgacaaaaaaactttacagtacttgttcttttggaacgagatactgtgaaatgtttcacataccattcaatagacaaacttgcatcctaaatcatgtccaatgcaaatatagtttctcccaaccaaacattgacataatggtatgttgaaatagtgaggcacatttcattcatttatgaccatagttcgacacaacccccaaccaaacattgacataatggtatgttgaaaatagtgaggcacatttcattcatttatgaccatagttcgacacaattgaatcagtgctgattgaataagcgcatgaaaccctgagctttacaaagttctgttatacgcataatgctacattgctactagccctaaaaaagtgcatggtttttattattgtcctggatatttaacattttagagaacatgtacaatatgaaaattcataaatgcttaaaagggcaaaaaacataaagaattactttgtgatatagaagtatatggacgtacccttctgacaggttcctgctttgtggacatatctaatcttgaggcttcatagccgggaatagaagaacttcctgaatttgcatcaaaagagcattttaaatacctcaactgaataaagaccaaataaaaaatgccaggaacaaaagtacaaatgaagaaataattagaccttgatattctgagaatcagtcagcaacattgtaaggcgatcaattcccaatccccaaccaccagtcggtggtaggccatactcaagggctgtgcagaatgtttcatccaatgccatagcttcatcatcaccagattgacgatcctggcacataatatacgtaagaacatgtacagtttttcagcaagccacataggaagctagggaaacaccatgcaacaataaatctgccactggtgtaagggtccatactctgtttgtctgtttgacacttcatatcccacccttccaatgacttaccactacttttaacaatgcaaacacaagtgtgtgtatatatatgatggatccaaaactcccaagcataatgagtacgctggttaaaatgatggaccaaaatataccacatatgggagtaggttggtttccaacaattatatactatgcaaagctatttagatgttccaaaataccaaaaataactcgaagcttgggagcaggctggtaccaaagaaaaatatacaatttgcaaatgttcacaaaatctaacaagtacctttagttgttcctcaaaccgttgcctctgaacaacaggatcatttaactctgtatatgcattgcacacctaaaaaatggatttcataacactgtaaggaaacagaaaggaggacaagtatgaaagtatcaatgaagacttagtatatacctcatgcttgttaacaaagagctcaaacctctcagtcaatccaggtcgagacctatgccactttgccaatggactcattatctctggatggttgataataaacgtgggattcacacatgtctcctccaagaaatggccaactagctgttagagcagagcatataccttattaatttggctaaggaataccaaaagggaaacaaaagcaaaaggtatattaaaatttaagcaaatagcttcaggttggattttgcaatataccccagatcttttatttgtttgtgagctaatgtgaaaatgttcagaaatgtactgtacattatggaagcaacaaaaaggattacaccggacattcttcttcatatcaaagtggctagcttatcatatatgtaaataagatattataagatagcaaaatcacctaacgaaaatcatatcaaaatacagtgtaaaaagaatgtgtagtgggtaaagaaacaaccttatcaagcaaccgtgttgtagtctggggaggtgggcatttgacatcatatttggcacaggcatctatcaaatacttgtttgcttcatcacttgagagatctttaggtatattgagtttagccatagcctctaattcttcaatcatgtctatctttctgcagcaaggtaaaggcaaagtaacattgtagcaactgaacattaccagttaaaagtgcatatagagcaatacatgtaatccaaatacatcccaatgtctctacctgaagggaggtgtgaaatcaatctctattggtggtttctcaactccgttagcatgatatttaatcttgtagccacctgtcaactccttaaccatacctgtcaaccataaaatcagatcattagataaaatgaacaggctgcttcatgttgatttcagtaaaaacaagataggacggcaaaaaaatgatatgacagaacaatagcaaatcatgaattgcctacggaacaaggaaaatgcatttaggtcattttgcagttgcatacaaaattgacatgaagatactattacttcctaaaataaaaagaaaaaaaagatgtttcagagacatcaagagataatcaccagataacatggtttcagtaagctctatcaagtcattgtaatctgcatatgccatataaaattcacatgttgtgaattcaggattgtgcgtcaggtcaattccttcattcctgaactgcttcccaatttcataaacacgatccagccccccaacaaccaattccttcagatagagctcaggagcaatacgcatataaagcctcatgtttaactcattatgatgtgtgacaaaaggccttgcagctgctccacctgcaatcatgttcatcattggagtctccacctagaaaagacatagaatattcagatttgaaggactggaagaatatacaaaagaagaataacagaatagattgcacaggcccacctctaaaaagtcaagaccatcaagaaatttccgaataaaagagacaacttttgatcttgtcttgaaaatatgcctcacttcatggtttaccatgagatcaagatatcgttgacgatatcgggtttcctgatatcacaagacaaacaattgataatcaaatcgctactaagcaccaaaggcaacaagacagatatataattgataatcactgagtgatcaagctacttaaagcaacctgcaccaaatttatgatttgctcatgtaaattagaaatgcagatttttaaatagaatgaatgcatgagatagtcaataaaattggacagatttctattagcatgccaaatatggcattcatgtcagcaaatgagttcactaattttaagaacattgcaaatctctcttaatggactagacatgcgccacctatccacttgttcagatagaatctgatcccatgattagttcatccacctgaatctaactttgcactaaattgcatagctgcctcaatctaaatttaaatgattttgttgtgcatacaacaaagcggatcacatatgcacatccagaaccttaaaatccgcctagatatttgttaattatgattaatcacactaccgacaatgtatttacttgctgacaaagaactcacagtaattagcatttacatagacaagagaggtcaatcaataattatacggagaatgaacaaacctggtccctcaaaacatacttttcgatgttcctacccattcctggagcccatggagtgggaacagcacttccctcactcttctgtaaagatgtatacaatacatgtaaatgatcatgtagactacatttcaacaaatataattagcataagaacttggaaggaaagcaaagggtcaatggttgggtgtacacgaaatattttgatatctcagaagcttggcatgctggactcagcagttgggtgttttgcagttcaatcgtgcatgcaaaatgccaacgttcaatcctagcatcaagtcaagcaagcatggctcactatatactacacacatgcaagtgcaggacacgcccatactccatgaggtgatggacaaattatgcatttatctatgcctctactagtcctagaatgcgtagcacgtaacaaatgcataaacaggtgtgagtgagtgtctgtattgcattgcacttgagaaaagaagctaggcaaatatgaggtgcatttgtgggtttaatcaaatgacctgtctggggtctgcaaaccagaataatggctgttgtgctttcttgtgctgctaatgtgtatgtgacacccagaaaaagagaaggcatcgctacgcaaaatgtctttagtttcagtcataattatttgggtcaagtccgatttaccccctcaactatcacagaagtacgacttaccccccttaactacgaaaccagatattggacacccctaaactattcaatccggatacttaacccccctggggctcttttttaggtggtttcgatctaaagctatcacacatgacagtccaatatgagggaggaggtgcatcatcagcaacatgcttctccctctccatgggacccagcaatcagtggcatgcacttcttcctctatcctttctgttccaatctctacccaagcctgtgtaagcactagctcacctgcagccctcaagatccacaagacggttgttgtcatacgtacatgtaatcaagctagatagttctgaaaaatcactctttgaaaaaaaaaaactccaagaaatcaaagctgctctctcattcgcacatgtaatgaagcggaggtggtctgtgacgaccatgagacagccggggaggacaagctgccgtccccggcgtccccgctccacggccttcggagccagagtgtctccgtccttgctggtgcttcagctccctggcagtggcggctagctgcacctgctgctgtgcagctgccatggtggcatactccggcaggggcaaacatatgctccccacaaccaccacgaactgttgcacgggcacactgatggaggcgaggcggtgccagcgctgctatgtcccgtcgagcactcaagctcggccgtctcaagcaggccggagcactgctttgaggcgcttgtccatggacttcctccgaagcaaggagcactgagactaacgaggcaaaggatctggcagtttgcagcccatgcctaatgtgagaaatgggagaatgggcggaagaagacaactaggtggatgacaatgtgggctaacatattttttcctaaaaacaattgattgtttttctgactgggttgccacatggtcagattattgccacctgtctgccacataggacaaaaccacctagattatgtttaggaaggtaattcgtacggttccaaaattttaggggtgtcaaatgtccggttctatagttagagagagagaggggggatgggggtaaatcagacttaactctagttattttatggtctctatgttagtatgtacagatttaaatataaaagttcagattaatatgaagtaaattgctctgagatattaggtatatcatctggaaacatctcttcctaaaaaaatctgattctcacctgtcgaggcatcatatgaaggcatggggagagcacaacaattttctttgggaatatactgagctcccctctcttgctctttcctggtattcatcaaaattgagaagtcgtcattatcagacacagtaaaacaatataagaatttccagtaaccatcaaactatttatactcctaattgttttaaaacaaacaaactgtacaatcaagtatgggcataagctacaaataaagtttaagttatttattaaataaaattacaaactcaatcagataaggatccatgtactcaaaatgtcctattggcattccaactgaaagaatataagtacctacttaattttgatgttggaacatctgactatgtaataatttcaaaatgaacttgaatagatgcttacaaacctggataaccacatacaccaacaatatcacctcgtttcagagtagagtgaaacttaatgaattcattatcttccaactctgaggtcctatatcaggtaaaatcagttaaatcattagtttactttttatgagaccgacaacagtaggcagtaaccggcgtagtacttaaacatgagcgaaatgatagccactagataacaacgatagccacagaaccgttagtcaaaataacaaaaaagaatgcacctttttgtttgtttaaacattataactaatagaaaattgcaagtcagcaagcccccagactttatgagatatggattgtatgcaacctcgtgtattttacacttttactatgtacaagcatacatactgttatgtgcataatcatgaagcatattacccaagttgggaaagcatgcaaaaataacaagaagaaaaattctaagcattaacatgtacaaaacaagaagaaaacccaactatgtaaaagaaggggggttttgtgcataatgtgattattgccaatacggaccacacataagtagccagctatgccaagcatgagtagcacccggcgtactattgacacatttgcaggaagataataagctacagaaaccttgctctaaatctatgacattcatcacaatccatggcctagcatatgtttataaagttgcagtgagaattctttggcaataaactttatgaaattcaccaatgttgaaaaatatatttaactgatacaaactttatgaaattcaccaacattaaaaaatagatttaactgatatgaaaattaaccaaaggatgcattttagtcaggcatatctgcacatagtgagattttagtgaaatgctgaaagtgtctgggaacaaaccagctaaatggcataaaaggtaagcaatacagttgaacagacaaagttttacctggcatcagcaaaaacttgaactttctcaccaccaccataaagatcataaaataagagcttggaagattgcgctctcttggtcatgatcctccctttaataaaaaataataataaatacaaatcccacccaaatgtatctctaatcaactacactatcatatctagtcaaagagaacgaaaaatacctgctaggcactcggtgacgtcaacaagcttatccccaacattcatgctcttgtatttctcaatataatcggctacggtaatattagccaggaacttatggggataggggtttacacccgtggccttgagtgaatcaagtgccttgaggcgattctcataatattgctgcagcaagaaacacatgtctgaattttcctaaacaaaagaattcaatacaacaaatagcacagcagcaccaaaggggcatcaatatcacatacagtgggatccatttcctcatcgtcggcggcagattccttcgggggctctccactagcagctgctgttgcagcggcctacaaaattttttttaaaaaagggtgtatatatatttagagcttagcaatcatgatatggaaaactctttctcacaccctagctgcagaggtatatccgtatctaacaagagcaaagagtgttgcttgtcacattggcatcatctacaaatgaacgcatccaaaactcgctccataaaaacaacactggaaaaaaatcggcaaaggttaagaagttcaaactgcttcaccttcttcttcttctcttcctccttcaaccggcgctcctcctcctgcttcttccttttctcctccctcttcttggcactgcacccgccacaaaactcatattaaacaaaagccacactacggaggaaaaaaaaacaataagaagaaatgccggctgcgtgcgcgatgagaaagcgcacttcttcgagagctgctgcggctcctcgccgcagcccgcggagagacccgccagcttctcctccaggcccgacgagcccgactccgccatgccgcgccggtctcctaggttttccactgaatcgaaagagatcgaggagatgaggctcgcgaagcggaggcgcaagggagaaggggggtttagctagggttaggcgacgctgccgccgccgccgccgcgacgtcacggaataaaaagccctggattctcactttctcacatggactaggcccacgaaacctgctttaaatgggcctggattagactacgcgggcctggcccatgaaatgcgctttgcttgggcgaatcgcaaggcgattacgccgtggacgagacgagtgagaggaggagagcggccatggcggggcggagtggcggcggcggcggcgggagctccgggaagagcgggacggggaggatggtgtcgctgcaggagttcgtctcgtccatggcgcctctcatagacctggagaaggttccgtactccgatcccccatcgcttttctttcgctgtttggttcggaaggtggaacggatggtagtggtggtgggtggtgacgcgtctgtggtgtggttgcgcaggcggcggagatatcggcggagtcggcgacgagctcgaagaccctcgagaggaggggttgcgtcatggccaacctcaagtgcaccgacgcccaggttgatttgcttccattttgctgcttgcttgcttgcccatcggtgccaatgtgtcatcgaggcgtggtgctaatcttgttctggccttgttggacctgcttggtgcgtagagtagacggggctgatggggaagacgctcctggagttccaacccaacaagggcgacgtgcttccacctcacaaggtgaggttacctttgccctcctgtcgtattgttgttattgctcgctgtgataaaattctggttaggaatttatttgtggtatgtgagagcggtttgtttcagaacaattgtcgcttcaggtattgccgtcgaaactcacacttgcagtatttctgccatttgtttagtaattgtgaacaagtaatgttgttgttaactgatagtttcagtgaaatattagattcgtttgtaaagttcattatgaattgcatcacgtgtattattgattttgttgagattggcaggagttgatacatgaaaagctcatgcatgtttcttaatttaccggacactgattcaaagaaatttgtattttacttcaccattgctaatgcccacttatgtttttcttctctagtttggaacacacgatgtggttgctctgaagccaaataaggcagatgctggatctgctgctcttgggcaaggtgtagtttatcgcttgaaggtacctaactatcatctaagggctgttgactatttaaagtctttgcttctgaattaggagaaatgactgtaatttgaacaaacaggattcttccattactgttgcctttgatgacattcctgaagatggattaaatagccctctccgccttgaaaagcttgcaaatgaggtatattttccatgctgttttcattactatttgcaaatgacattccattactgttttcttctctactatattttccatgctctctcttacaactttctgattagaaattttatagcctccaagtaaccataatagtataattgtatcataattcctctttgctttttttttatctccatgtatgtatttctatatatcttcattattgccccttgtcctccagcattgccttacaattcattggaccctaaattttgcatcttaatgctcttctaggtgacataccgcaggatgaaggatgcactagttcaacttagtaagggcattcaaacaggcccttcagcaaaccttattcctgttttgtttggagaaaacccacctatgagttccaaggatgttgcgaagttcagtccatttaacaagaatttggatgagtcacaggttacaatttgatttatttttttcaactgcttttttttggcttgttgcataattatgtttcagttaagttcttatctaaataaggagaagagaagccataagtacttggggcctggagaaatttatcagaacagtatgatctacaatagaattttccagtgcaatcactttgttctgctgatactatttcaagtatcagtagaatttgtatttttaacttattaagtaccagaggaagatctgaaatttattgaatggcagacactcatgattttaagaaaataaaagaacatatggaactaggcaaataacgctaacaccagcacctgcagtttcagactgtggacattccatcacttttggcattacaacttacaaccaaatgtgtcaacaccgtcatcgattacatataattcttgcacctgctaatactggctttggaagacctcatcctgagtagtagcatatatttgcaatacttctgttaatggtgttgcttttgcttcggtgaactccacagctaattatgctggcactggtgtttggcctccacattttttattttctttgctagaaattgattgtttaataaaaataaaaaaattacaattgatgccttttgtctttaccatgtatatctacttgttatgttcttttttgtatcgccttcaaataccagtttcaatatgtattcaaatgaaataaatttcctttttgtggggcccatatctttgttctgcagaaagatgctatctcgaaggccctcaggtcaagggatgttttcttgcttcatggacctcctggcactgggaagacaacaactatcattgagataatattgcaggaggtgaaacgtggatcaaagattcttgcttgtgctgcttctaacatcgccgtggataacattgttgagcgactctcccgatataggttgctaacaaaattttgaaatacctttttaactcgaactttctattcccccatctatcttggtaatgttgaccatttacctcattcaaccaataataactgagaaaattctccctatcctgtcaaaataaaagatgtgatattggttaatgtgacatgttgttattgacatttttctagaaccaaattggtgaggttaggccatcctgctcgattactaccccaagtgttggacagtgctcttgacgcacaggtatagcttactctgagtgcttccttttctcctctactgaggattattaggataaatattcatgaaggttatgttccataattatttcatcagagttgctttgtctctttcaattttcaactgttatatttattcaaataccttgttaaagtgtacccgcctacgccttatgtgacatctgtaacatctgcatgacattctctttatgcccaagttaaaatgggatagattttcttatgaattacagttccacctgtattatctatgatccattcatgcattcacataacttaactgtacttaatctgcttactatttctaatgaaccaggtattgcgagcagataacagcagcttagcaggagatattcgcaaagaaatgaaggtaatcatttactacataattcttaggttcctattattaaatggcaagaccctgctttacatggcatattattttggcatttcaggaaccatctaattagaagctgtcatgtttagatgatagtaatgaaactgcaatttcaataatgttttccattgtagttaaatgtttcttgatttgttctcttttcatcttttaggtgcttaatagcaaattgctgaaagctaaggataagaatacaaaaagggacatcaggaaagagctcagaacccttgccaaagaagagagaaaacgacaacagcttgctgttgctgatgtgataaaaaatgcagatgttgtactgtcgactttgactggtgcatcttccaaaaagctagatggtattacatttgatttggtcattattgatgaagctgctcaggcacttgagatggcatgttggatagccttattgaaggttaatactaacttatgactagttttttttttcatgttgctgcacgttttgagaatgatgattgctgtaaacagtcatcaaaggttctcgtattatttatgcttttttgagtagcacaataaagatagcatgtactgtttcacaaactcccacctttaactttaagcttaaaatatgtcttaaccaagccagcagttgagcatgatcacacgggttcaattttaaaagtgcatggtataatgagaacgagatgctgcattaggtgtccattttagagcaaaaggaaggattatgagagaagttgggaaaactaaatgatttccttggaagatagctaaacttaatttcaataggtggttacacgtacttgaattcattctatcaatcttgtatggatgtatgtaaactctaacaagttctcatgacccctgtggggctccttcacactccacaagttggcttctctgattatgccagtgaacaatttcatcacctatttgattgcttgtgtttgtcatgattcagcatgcacagcgcgtaggttaaatggtcatcatactgtacttattgagatctgtcatagggctcctcagttcttttgtttttgtatgcagggtccaagatgtgtgcttgctggagaccatcttcaacttcctccgactatccaaagtgctgaggctgagaagaaggggatgggaaagacactctttgaacgccttactgaagcttatggagatcaaattacatccatgctcactatccagtacagaatgcatgagctcataatgaattggtcatctaaagaactttataataacaaggtgcacttcccattggtgtttttacactagccacctattagtaacttgttttcactagccacctattagtaacttgttttcagcctctctctttagtccataactttcctcatgttgttatttctttgtttcttgtacttagatcaaagctcataacttttctcatgttgttatttctttgtttcttgtacttagatcaaagctcattctagtgttgctgatcatatgctctatgacattgaagaagtgaaaagatcttcttccacagagccgactatcatactaattgacactactgggttagtattctccaatgcttggcctattcaatgtgttcattcttttagtcatttatgggttgaacttgaaccttggcaattttgcttccctcgttgctttctttccctcactcaatagtgttggcttcctctataaaagagtgtcggcttcctctatatttccctcactcaatagtgttggcttcctctataaaagagtgttggcttcctctataaaagataggactaccgaattcacttcaaagggttatctcatacttgaagacaataattgggcagaagtaatacttcaaatttgtagccatcatttgactgatgaataaaagatatctgtttttttaaaagaaatgatgtgatgaccaacatcaatgtttgttagatacacttctaacagtctcaagtaatcatttaggtgtgacatggaagaagtaaaagatgaggaggagagcactatgaatgagggtgaggctgcagtatccattgctcatgccaagctgcttgttgagagtggtgtccgtgcatctgatattggaataattacaccttatgctgcacaggtttgctcctatatgctctgaatattatcaaatcaatatacagtgatgagcttaataaaacaaaacaaaataaacgtttataggacttatgggttggctccttcatgatgttgaagtttataggactgactcattgaatggtgtaatcccgtaggtaacctgtctgaagatgatgagaaacaaagatactaaactgaaggacttggagatatcgacagttgatgggttccagggtagggagaaagaagccatcatcatttcaatggtcagatccaactcaaagaaagaggtaagctcccttccatgatcctccttggtgagtggatatcctatgtaaaatattcagctttacaaacatgaatattatacatggatgaggatttgattgctgctgcacagttgatccatcaaattagcatctggggagacttcaacttattttagaaaaatgtttaatagaatagagcgaatcagtatcgatatgatgtgaacgatctgtagatatatgtgcatgccatgcaaaatatctcattattgacataaggacgaaatatcatttttaaaataaaaggactgtctgattgaactactgaaataagaattcacaattatattacctggatactaaggaaaccttatctatttgcaaatttcaggtcggattcttaagtgatcatagacgaatgaatgttgctgtaacacgagccagaaggcagtgctgcctagtgtgcgatgtagagaccgtaagcaacgacaaattcttgaaacgcttggttgagtactttgaggagaacggggagtacttgagtgcatcagaataccagagctgatgacttggggtgttaacccttaaccgtgatagcccgtgcttatcgcaaagatagtgaagagatatatccaaacgatgcttgtgataggaacatcgtgcacttcaaactggtgcaatatggccaatggagatactgtcattcgacttttatagattggaaacagatcgctgtgagactgaacagataattagctcaggagtggatcaatttcgtcttgactggccctgttctggtctcttcttctgtggcttatggaaatgaaacctcagttatgtgtttttatatgtccgttctttcagctgatgtacaatgatagaagactaattttattcatccatgtgcaaatctaccatagttttttgcatggagttttgaaacttgggtccacaaaaatagtaataataggataggaggttgactgtactgaacttcgcatgataattaatctgtatctcatccatcttgcttattttcacaatgtcgcccaaaataccaaatggcatctcttcagcatagatttagtttgtgccatatccataccattgtggatgtcttgagaaaagcgatgatttatcgatggagcaagtagaagagaaccgcatgcgatgcccattctaaagttaaactggtaaagtaacatcatggaatggagggagtactgaaggaacaagagaatatgcctagtgtcaggtgtgtagaaggattcctgctttgagggaagattcgcaagaagatacctatgcaaagcacaatccgtgaaataaagcgcagcgccaaaccttttctccttttcttttttctttctttttggcagttttagtttccagaaatgttttagatggtgaactccaggaattaccggtttggtaccaaaataaaaactttttttggtgtaccaaaaatctctaacttaagataaaatttaagataaacgatgatggtgagtctcgagcctacacatgactaaaattacccatatatgctatcgtagtctacacatcactaatgttgtgttcgtttcgtatagttgggaacacatgtcctccgcacggaaaacggagcagtccattaacgcgtaattaatataagtattagctttttttaaaaaaaaatggatcaatatgattttctttaagcaactttcatatagaaattttttttcaaaaaaaacgcatcatttagcagtttgaaaagcatgcgtgcggaaaatgagggagatgggttgggaacactgataaacgaactcagcataaattgaccactcttattctcgacattgtcatcatcaccagctctatcaccgatatttcgaatgtaaaagaatttatgtttttaactcgagacaccacatagttcacatcaatcatgggcgtataacttgtttttatcatgcgactgctattttctattatttaatgaaaatccagaaaggaatagaggccattatatccttcatcgtctgttgccactgcctgcagtagagctttcttaattgcgactctttcaaccttggcttcatgccctatatgggcaagcaatgagactacgctaaaccgacgatgcagcaagaatggattagtgcacacatcaatacaatcaaggaacttctaagttatcggtgtaggcacggaatagagactcattgaaaaaggtgtgggccaccattggttggcatatgctgttgcatatcagcacaaccaggctgatgcttatcagcataagcttttctatcatctcatgctacagtccaaggagccaaccgatgaggtcagtcgtgacaatgggaaggtggcgagagagagaggaagcggggaacaatatttataattttgatgaaattcggtctggattacactggattgaaaacataaaccgtttggtttataaaccgtttggtttatcggtcaaataaaaaaatcaaactaaaattttagataagattttgttcaaattttatcggtttttgttggaactatgatgagggcataatcgtctattcctttccagattttgattccaagagaactgaaaaataggctggaaagagctttctcttccagaaataccccaagctcaattttcttctctacacaaccgaaaggtggagcgttggcgaaggaccaaccaatttcctctctctaatcgccgcggcgggggatagattgggagtgagcgcgtatggcggaggagcagttcctcgccgtcgcggtggacgccgccaagaacgccggcgaggtatgccctctcctgaaccactcgattcctcccttgccccctcctccctgtgcacgattcctcgtgtttttctttttccttgtccgttcttgatttcctggtgcttctccgcagatcatccgcaagggcttctaccagaccaagaacgtggagcacaagggccaggtctctcttccttcttccacggttccaccgatctcatcgcattccttttccccatagctgatggagtttggtttgccctggattggaatttggggtttcttggtgaccgtggctgcattgcaactgcaggtggatttggtgacggagacggacaaggcctgcgaggacctcatcttcaaccacctccggaagcactacccggaccacaagttcatcggcgaggagacgtccgcggcgctcggcgccaccgcggacctcaccgacgacccgacctggatcgtcgaccccctcgatggcaccaccaatttcgtccatgggtaattattagcttctgtttctatccccattataccaccttctttcttttttttaatgaacattgggtatgtcaatcacattgcagcttcccttttgtttgcgtctcgatcggtctcaccgtcgggaaaattcctactgttggagttgtgtacaaccccatcatgaatgaggtaaaagtgacatgtgaagcatttacatcgcaattggattgaaggacataggctatttccttctatgtaccaatatgtaaaaatcacagcttatttgtctctataggatttatattcttattgttcatatgccgacttagttttgtagtctaatttcatgttaccttttcatttagcttttcacagctgttcgtggaaaaggtgccttcctcaatggttctccaatcaaaagtaagtgctatattttggttaattgggtcctgatgtgttgacattcaatagaagcaacatattgaacttagacagtttccttctctgctgagcagcttcatctcaaaacgagctggtgaaggctcttctggtaacagaggtaagtgataccatcaagagtcaattttattacatgtaaagaaatttaatttgtattgatgatgcatatgcgtagaaaaatcaataggatttcatctcaaccatgttgttctaaattattttgttgcttcatttcactaatcagtataagccgtcttctgaatagcttaagatttggccgctactgtctttcctagaaaacatcatcgaacaatgtttgatcgtgttaacgtgcactttgcttgttgaatggtgatatttcacaactacttttctagcagatgtatagcttatgctttactgatgcaaatactgacagcatgtacatgaccatgcatacactcttttgaactagcatggagatttcatctagatatttggaacccccacacctgcatacagacccgaaagaaattcttgaaaatattattattttctgaactttaaagagtttggacacaatctaaccaaaagttaactccatgtgactcaatgtttttgggatttgtgatccattccaacttgatttaattcaatattccacactcaagtaattatgttggttgagatgaccataaccttatcgattaaatactaatctaatcatgtcaactggattttgtggaataccacattatctcttaaaacaatagttgaaatatttatggtaacatattaattgattcttaaacattggctaagttgcccatttcgggcttcctgttggagtgtgatattcttttttttcctggggctgtccaattcatattgatatatcaatatgaatgtataacacatgctacactggatgcaattagtttcttgtgagcctctttcgtacttgatcaatcatcagtgacaaacttcattgattctgaaacttgatttacttacaatggaaatgagagttctagtttctatttcttgaatcattttcatataaaagttttacatcataatattagtgaaaatatttgatcaataaccttgtgccaattgagcaggttggaaccaaaagagataaggccactctggatgatacaacaaacagaatcaacaagttactattcaaggtaagccttataagttatacaccaatattttcatgacatacaattatagttcaacagatcggtgcactaaaatggtatatttcattatttcagattagatctatacggatgtgtggctcgttggccttgaacatgtgtggagttgcctgtggtaggcttgatttgtgttatgagattggatttggtggcccctggtatgattaatttaattactacaaatgcagtgtcttatgaaaaatataaactatctaaacatattttattgtcaattcttcactctagggatgtggccgctggagctctgattcttcgggaagctggtggttttgtttttgatccgtaagttacactgtttagtcaatgtcatagtagaatcaggcagcgtgagtatctattattaattgtttgttccattctggcttgtaggagtggtggggagtttgatctgatggcacgaagaatggcaggatcaaacagctatctgaaggatcaattcatcaaagaattgggagatacaagttgaacaacatattcctcaacatgaagtagaataagaatataagatcgccctgccaattttattggggcaaattttctttctagtggttctgcataaacagcatgcctgttgcggaaaagttttggacgcagtatggcattgtattgtttgaaacttttttttttttggcactactatccggtgttacttcggaaactagtgcatcgaagattcgaagtagcttaatcagaattttgaaccgaatgttcagatggattgtgcaatgtgcatttcccccatgatttcgtctcctatgcacattatgtggaagatgttccaaaataatattatcagttataaccaggggcatgtgtataaacaaatgtgtttcaaaaaaatcctggctataacaaggtagcatgtccaaattcgtagtattaaattcgtagtattaggaaatgttttattttgttcagttttttatattttgggatgtaggaagtagcacagtagtatgatcctaccgatcctagtcttgatgggaattgggaaataatggaatttggttgcaacttgtaagaacgaaggatgctaactaagtactcttgatgggaaatattggaattcggttgcaactaggaagaatgaaggatcgtatacctctgtggcagtggatccagttgacggttgcaagaggaagatgcttagctgtgtggcaaactggcaatggatgctagtagctctgtagcattggttacaattgctcacttttcactagatgttggcagtaccaacagccaagcaaagggaggcaaagttgccagcgttggggatcaggcgtacggtttcttcaaggggccatggcggctgcggcgccgagttcggtggtagccggactcgtgtccgggctagggctggcgcgctcctcgttaacgcccagcgacggccgctctccttccctctcgcccctgcatccgccatggcccgcggccccgcggctcgtctgtaggagcagcggagcccggccccccagggagagagccgtggccgccgccgccgccgccgcaaattctccgcggcagcagcagcagctaggagagcatgagcatgaggaggctgtggcagcggcggccatggagccggagaggagcagtccccatgaggtcaccgtcctttctttctccttggtttggcgattgattgattggttggtcccgtgcaggtgagggaggagatagcgaggtgcttcgatctcgtgcgccgcctcggccgtggcgccgtctacctcggctcctccagggtgccgcccacccatccccattacctccatgccgccgagctctcaagggaggcaagcactttgctagctgttcctcttcctttactgtctcttgcaagttacaccaccctaatcttttcagctcacacattaagcttgtgttacatcttatcttattcatgcatattttcacggccttttcgccagaaacacactaatgtaaattggtcaacaaactggtagataaacatcacgctgcactagatttcgtgcgattgctatgaccatctgtatgtctaagtgatgctgaactttcatcacattacaacagatagctaggctgctggactgcaccacatggtccggagctggtccaggtttcatggatgctgccacccaaggcgctcttgaggcgggcaaaccggtcggtggcttcaagattggcaaggaggcgggtgaatggacaacctccaattttcatccttacctgccatcagagtcatatctcacctgcaggtagctggatcgcggtcgcttaacttcagattgatttgagtgtgtgtcatcgatgcatcatgcatgggaatcaatttgggctattctcctggatttcaggttcttctctgcaaggaagcatgggttagttgatgccgcggtgcggaactgccctaccgatagaactgccatcattgcattacctggtgggatagggacgctggatgagcttttcgagatgatggcgctaattcaactggagcggatcggttccacgcttccagtcccattcttgctcctcaattatgattcttactactccaaactattggactttctgaatgactgcgaggagtggggaaccgttgctccgggagaagtagcatctctttggaaggtttgcaatgggaatcatgaagctttggagtacctggcacagttctacaatgtacctcttgctgaaagaaattactgcatatcaccacagttgaagcagcaggcaacttcataggccacaagttgacgattcaggtttttctcaagaaatcttggagcaaacttattccgtttagttgatcattgtagtaccccctaccattttaaattgaattagcaaacgtcaaatacaaaaaacagagggagtacaaccttttcaccccagttcttgaaataaacttgtacagttgaatttcagtctgaatatctgatgaacatcaaggatgatgcaatcaaagtttcagttactcagtgaattcaaatctcatattggttctcaagaagttttatttcttctcttgctcagcactttctacaatataatccttaacctgctacacaagtgtttgttatctcacagggcacaacacacaacgtatgcaaccataagagaatcaacaagtatgcaaactcaatgagatacaaatgacaaaaaaagtacaattctcatacaacagttattggttcaaatattacccaaccagaagggcatttgaataacaatcatatattcgtattggtgtacctgaacaaacataagaaatagaccaaagaaaagcgcgtttcctaattgtcaaccaggctcaattgacagatcctcgagcgaagcaatcattcagactcattcatatgcagatgtaaacgcagcacgccaagattgatcatcgtcgcatgtagaagtggcatggttgttgtactccggtacatcctcgctctcctgccggtagaatccccccagtgctgactccggcagccggctgtccgcaaggaagtgcttcatcgtctccatctccatctcgtgcttcttcttcatcttctccagctgcttcttgagcttgtcgttctcctgctgcatcgctgcactcctctcctgcaaatccaaagcgagcaaatcaaattgttatctgtgtacttgtagtgttcagcagaacatagtttaagcaagcaaattgaattgttatctgtgtctttgaacaaaccttttcttgtgtggatgcctcctctgcctctctcaatcttacaagaagttctccagcagcatggacagcttcagctgtgtcgcgaagctgaatgcggagccttctgttctgctctttcagctgcgctctttccttttcacggtcaatcctcactgtggacagctctgctgcaagggcagcagcgaaagccgtcccgcagcccttcctgcctgccttggcagctgccctcttcacctctgagataccttccatcacacggcggtgcctctcaagaagatcattgtacatctcctggagctcggcgtaatgttcaattatcctggcgtggccgtagatggctcgttggagggcatcatccagttctgcagtgcacttcttttcattgctaagctccatctctgttttctctgcaagcatccgatttgattcaagatcaactctcagctcttcagttaggcatatccatttgctttcagactccatccatttctccctttctctgtctagctcatattcttggtctgtgctgccattcctcaaatgttccagaaggctgacatttgtggattcacctgcttgttgtttcagttgatccttcaacctctgaatttcactaagaagttcttccctgtcattcacattcagctcaccatgttgttcaccaaccttggcttcatccactagttcttttgtaggttccgtaccatctgaattttgagcatcttctgaacacttcttatattggtcaacctgcaatgtaacattgaaaatgtcaggaaatggtatcatgcctgaagcatactattccttagttcaccatgcttcgtaccaaattgctcagctccttgatcttatcggcctgttcttcacataaagcttcaagttcagtctgtctctttgaagcaattgttgatgcggtgatgtcgtcctggatgaagaaaatgttttagtacatggaaaaacaagaatatgggtagaagtttgccatcacgtaatataccttaacttctggtaccacactggtggctattacaatctgcttttctgcatttatattatctttttggttcccatcagtgtcgatcgcttttttgcaggatgaacaaagagcagaagatgttgctcctttcctctctggtgatgccagaactcctgaactgacttttgcaactgattgacgggggttcagtgcaaaatgatcaaatgaaaggccaacaaatgattttcttgggccttggttctgttcatggtactccataatgtgcaagccccgttggagacttgcagccagtgaatcagttgggctaagcttgcttgactgtaaagaagaacgaactgcactttttctggacacttcatcaccgggacaatcagatacactaagtttgcttggtgacagccctggtgaggtaatgctttttctagccttgttgtgaatctttggagaagaacataacgtagggtcttgcattggtgacaggtgcggggaggcactaactgatagaaaagatttcctgtcagacacaaggtcttgatcaacttttgtactggacaacacttcatgctcttcctgaatcgggtcttcacaatcatctattacaggctgatcatcttcctcacttgtttttggattccccttagagcaaggagtgtcatcaccactctctgcatccatgaagtcatcgaaagtgtcttcagatgaggaatgaagctttcttatttggtcacgcagttcttgtacatcctcttcatccacatccatctcttcctctgaatcaacttctatgtgaggcaagattagagagcgattgagactgactcgcaaattatgcaggctttcacgggcattctgtgcactgaaatacccattcttgcagggttcagtgtctccagattttgttcgtatgagctcgtcctgcaagtgatagaacaattagcaagtgtctgtaaattgttgccacttttatctgctgctgaggaaataccttcaactgacgtatttgatcgctcaaaccattaacatcatcttctgatatctcatttactacagccttgtttgacatgagcttcgctctctcaccgaaccgtagcgtgcttaaagttgtagttctgcacctgcatttgccagtcacaggactctatgtcaacttaagagaatgtaaatggcatagtgaagtacataaggtaatgaacagaaaatacctgtgttctgaagaaatggaacacaagaatgtaacccttgaatttccacctagtgtatccttcagcacatgcgtcaaacaggattgcttgtggggagagtcatctttctgggtctctggtgcttctgatagaatattgacgagtttcctgaagtaacaatgtaagtcagtcttctgctttactacatgtttttattcttatcactatatgtttataatatatttctccaaagaaagcaattatcactatatgcaaacagattatgagggagaaatcggtgaacatgaaaaagaaacattgaagaaattttactgatgaattttcatgagacatcaaaattcctgccaaacaagccatcttataaatttacatacccaagctttgacaaggacttcttaacatatctttcttctcttgtacagtgcttgttgccaccatcaagttcatcattatcaggaccagcaagatcaacgaaggtaattctgctggtccgtgagctgctgaagccatttgagaaaccctgtaatttggttgaacaaagtaaattcccaatataatgacaacatgtatatttgctgatcaattagtgaacttaaaaaacagaatagaatagaccaaagagcagactgattttctaaatgctataatactgacattattattgcaataatagaagttaaatatagctggctatgaggtctccaaataacagaagaaataagagaggtttaatttaccttgctccatgcttcaatgacacaactgaatatcacatgagaacgtgaactcttcaagttcatactcgtagtaccaacttttctgtttgaaaggccctgtaaagaaaagcaagctcagacaagcaatcaataattctggaggagaaggtagtggggttcagttgttagaagtacaacatgaaacaaatagttttgagtgagcatgatacaagtactaatatatgcgatctaaacaagctcaagcagaagtcctggttgtgatactcatctatgcagaggtgaaatgaaaagcaaagaaaccctaattttaaaagcaaaatagaatggacaatttctttctgctgctgatgtgaagcaacatagatcaaaattgtcccactgatttgaagtatagtagaagcaatttcttgggttggttttattggataactccgtgccataaaagaataaagatgattttcggaacaacttgaccagtgcccataagttagcaccagctaagcaaaatgttttggatcttaacgaaacaatcatgtaaatagctgtaaataacttccaacattttttcacataatgctgacttcaagctacaaatccctagctatgttttctgacagaaatctgcaaattagtgcagcaacttcctgaacaaatctgtaaagcatcacagtctacaagtagacagataatgcagtgaggtggaagtcattttgatcataccttcatcaagatctgattgacgtcctcaaccgttgacacatactcatcggtcaagttctcaacatggataccattgccagcattctctcttatctaaaataacggagttggataagtttactgcaatccataagcatacgccaaatgcagagttagtttcttgctcaagattagaatatacctgaaggttacgctgagatggatccaacaggtcattaatctgctcattatgtacctggaaagcatagagcaaaatttgcaccatgtcagatctggaaacatagtttaaaagctgaacttcagggaaaacaaaaacacgcatctatagatgcatttttcagttcaattgagaacgagcagatgagtcactactcacctcaagaaatgagcaccggcattggtagcttgtctgcttctccggtgagctctcttgcctctgcaccaggaaagaacagcattgagaccacaaggaaatcacaggtttaatcaaatttctacaaaaccagacggcagaaaatgccttacgccttggatttgagcgaagaggttctggaagacgcgaggaacgacgcccctgtcggcgtggtctgagctgctgtcaaccatggccgcgagggcaccgaacatggtgtacgtcttccctgtgccgctctaaccacaattccaacacacaaaagcaaagtttcagaagcagtaacgcagaaagaagaaaaaaaaaacataactccaaactgaacaggaaggatgaatcagaggaggtacctggccgtagcacacgagggaggagttgaatccagcgagggcgctctcgatcatgggcacgccaatcagatcgaaagcatccgcctgccagggaacaccaagattcatcacaggattcgttcaagagcacctggaattggaggaatgggaataatgcaaacctgagaggctctgtcgtcgaggaagccatcgacggcgaacgaccgatcgccgacggcgacggagcagggggaggtcttgcggacgaagaacagatccttgccgtccaccggccggctcaccgtcggccgcacccggaccaccacctgcacacgacctctcgcgcatcaggagaggctcacaacttggtaggaaagggatttccggcgagccggcgaactttaccttcacggcgggtgcctcgttggcgggcgcagaagcctgctccccctcggcggcggccttcgagggaggagcagcgctggtcgggacgggcttcgacgaccgcggcgacgcgcccggcgccgccgaggagttcttggcggcgggggacatcggcggcgaggcggcggccaggtttgggtggaggttctcctggtcggcgtcggcggcggcgacagcgcctgcccgcggcgaggacacggcgaaggcggagagtgaccgcgacgcctgccgcttcaggttccgcctcagcatctccattgctcctctgctgcttcacggcgagatcgaaatcaaaatggttgaggggagagagagagatcgaagaagaggaaggagacaagtgagaggagaggagaccacggcgaggaggcggccgcgcggtggcttgtagtaggatgcagatgcgatgattggtttgcccgttgggattcaaaataatttgaaaccggatgcccggggggggggggggggggggatgcgctcgatcacgggatggacggttagatgattgccgcgtcagtgggggctgcctcttctagcgtggacactggacagcgcgtccaaactagccgttggggagcgggggtaaaaaaaaaaaaaggccaaaccggctatgcgtccgaggtaaggaaagataggcgcccaatcataggcgattatttggtttagaaattacggttaattgtgtcatcataatcataaatttacaggtttgaaaaaaatcaatactatttacaaaattatacaatgccattataatttaacaggtcttcgagatataccatcgatttccccttcaccgtaatttctaaatttttcaaatcaaattgacatcgtcttcttcctcccctcttttcttcctcctacccatttctcttttcatctcacccctcctctctcttccactggaatggttgcactatcctctccaccgacgagcaccattgggggacggagatggaaacatttctctcgctcgagttccccatcgatgagccccatagattcggtgtaacatccttaaattttaaactaaaatttgacagcatcatgctggcttttgactagattagtaaaatttaaaagtttatttgaatttcttttgatctttattttggttcaagtattacttctttagaaccctattaacttaccctaattaattccccttatcctagaccttggtgaatttgagcaaattttctcaaatttcaaactttagattatttctttagtttacccttgtattagtgagagtttgctatactctaaaaccctagtgaaacccttccaaacttatgattaaattcattctcttctaggagaaatattcaaaatttcttaaaaacactgttcacaaatcctttgcaaagtctagatttggtccttggggaccacaacccactcaaaaaccatggttcactttgccttctcctctcctttgattgcgctaccctggcatccgacttcgccgcatgccgagccgccgcgcgtcggcttcggggccgttcgcgcgtgcctgaccgccttggcgcgccgctagccgttcgacgccctcagaccaccgccgccgcaccaatcgtgatgaagacgaagttaggacgacctccgccgcaagttaccgccgctcgacgccgtgcacgcccgtccaaagccgccgccgagtccgagtttgcttctacccggggtgaatcgcgccaagtcttgccgcacggttagattgaagataaacgacggcttcccctatcacaattcaaaccaaccatcgccgtgccgaccattttaaccctcgccgccgccgcgcgtcgagctcggattggcgccaacacgtcgccagccgttttcacccgcggtcaagtcaatccttcgccagtaagaattcgaacatggcctcccgccactcaaattaatcttgccctccctctcacagccctctgccacccctgccatgcctaatttctgagctcattaatggcgttgatggcgcccgagctcatccgcttcccctggccctataaataggaccccaatccctttcttgtccatcatcgatcatcatcaaccataaccccacaaccccgaagctctactttgccaatccataccatcaaccacttccgctcgtcggtgaacaccttgtgcgcgatcgacttcatgcccctccatccaccctccaccctaactaattcatagaacacctatattcaatcatgttctagcatactaaaccctaaccgaagctttgcatcgagtttcacctcgtcgcactgagccgagcaccgccgcccctgctctgctctattcttcgccgccaagaagttttttcgaccgtaatccgttgtttcaaccgatctcggtgagttcttccgttttaaccatctacatactccctagagtccatttttgcaatcggtttgcactgccatacttccctcttggctgccaacgtgagctcgaccgccgccaatggaggcgctcgtcggcagatgccttccacaccttgccgaaggtcggcaagctacctaaacccttctaagtacctcttagatgctctaggaaccctccttgagctatgcctaactcttaccaccccgatcaccttcacggcctatctatgtcaccgccgccctagccgctagcccacccacacatcaaaataacccctccaccgctactcgccgtcgccggagaaccctagctacctcccctcctcggccgcaacccctttccccctctatcaccgccgaaatccctaaccctagcgcaaccggctgtatttggggaacggctggaggttgaagaagagaagagagagagagactgacatgtgggacccgctcacagtgccatttcatatttagtttgattttcaaactttagaagtccatatcttttaaaatatagatccaattccaatgaaacttggaccaaaattcttctaaaatcattctttatcttttgagacacttttgttatttttctattttattttatttttcctatttttggattttatttgaatccattttgaatttgaattttatatgtctaaccctaggtgttgaggattcttctgacacactagataataccagtcaatctcaagacatcaagcaagtcaagttactatttaccttttgatcatttaagcctgtattttacaaattatttatttatagctcttctattcaacactctattttatatgcataatttaattatagaaacccagataatttagtattgcttattttgcttacaatctagttaaaatatcttacacttagattgggacaatacgttagaattggatgatttccaggtggatagtactatctcgatcgatatagttactaccaggtacttatgtcaaacgaacgggtacgaccgcagtttctagaatgggaacagacctagttattatgttatttagcaatgcggtacctctatatagtggttcttatttttatttttaagtcctcgagcaggaggcaactatagccgcgaagggaaaatttcaccattaccatgtacatgtaaatggtttgtgatactcgagtataattataagtataatgttaattctaaaccctgatcgagatgacgtggtgtcatatgatcagttccccttaaataccccgggaacgccagaactcctctcgctgctgttaacgtcacattcagagcgtatgaggatataagttcatggaacaggtaccacaattgttaataacctaatactgggccatgactaagctaatgaatattggcaagtcgtggactgcgggtaaagcgtacatctgctgcagtagaatatttatgaaactattcgaatagctgtactcgcggaattgagtaccgggactcatatggtaccctggttagaaacctaaagtctacatatttacaaacttttgctttaatacttccagattgtttattattgccttttgcaaagaactctactctataccaatgcataacatgtttccatggtaacttgctgggtattgtgaatactcacccttctcttataacccctttttcagatttgggtcaagaggaggacccctatgattattactatgatgaccctgataacttagaaaatcccgagaggttatacctccctagttagaatgtataaaaacttccgctgtgtaatagtcttacttatgtttaattatgtgagtacctattattgtaaaacccttagtattgtaaactttaacgtatgcaatgaagaaccagctatattgtatgtatcaatatttactgatccagggattgatacattaatctcagtcggatccaagtcattagttttgggacccgatattcggtcttcgaggtagcctgggattcgagtgatgaggaccgatggagggcaacgggatccgtggagaggcagaggtggatgacaacggggaaggaaccgtgggagatggtgccctagcgacggtgacatcaaagatgagtcatcccatgggaggagcaaccatggagggcgacgacaacattgactagcacggagccgatggaatgtcatcgagagaccaggggacggagtcatcgtggactcgtggtgcacatccccttcgaagaccagccccgttgctggtgccctggagttcagctcgagccgaggaacctcaactcactccagtcattgcttctctttcacgttctccccgcgcgtctctcttttggatcctagcctgccgccctccacccaacaccctccggtgaggaggttgagttcgccgtggccaacgacggtgcgatgcacattgcctgcactgccgtcacacgccctgatgccgtgcgagacaacgtggtgataggagagagagagaaaggagaagaagatgatgtaggaagaagatgagggcaatttagtcagaaaatggaaatttcaacgaaggggtaagcaatggtacatctcaaaggtatgttaaattgtaatgacatgcattcaattttatgaatagtaatggtatttttccaaacctgcaattttataatgccatagatccaattaacctttgaaaataatagaagaaaaatcaagagtaaattgcactaacggtccttaaacttgtaagcatgtttcacctaggtccatgaacttaaaaatcgcgcattgagatcctctaacttggttcattgtatgtatcattccggtctaaaacctcgtttgaccgtggtcttgcccatgcgtgtcatgccacgtggacgatgacttggcaaaatatcccctttccccattcttttctcttcttccaccactcctccaccactggatatatcagcggcgatggcaggcaagcagcagcgagagagatggcgctagccaccaccggtggcggggttggcccgacagcggagtgaaggctcgaggctggagctgacgatgacaaccgcgagctccctgctctctcccatcgttgttgacgagaccgtgtcggcggtcaaggaggctgccgtcgccgttgcttcttcaaatccgacggcccccacttcaaatctactcaagtggcatcagcgctcgttcgaggtgtggggctagcgatgaggacgagatggagccgtggcgggctagcctcttgaggtggagcggcagcgtggcctcgagatcctcaccgccggcttcctctcccctcttcccgcaccatggaggccatcgaggaggccgtgggcatcccaagctgctgacactggccgagattggtgatgtgagcgaataggaatgcagccgtgttcctctgcggagatagcggatcgatggggacggccgcgccatggcctcgtcggctgcggtcccccacgacgatgacaagcggaagggtggggcttgggaggaggctgagctcaggaggctcctcaagcagctggggatcctctcttcccctcctctccggtaggccggtgagctcctcccgccactggctcccgatgagcaaggccgctgtcacgagcggtctcagtggcggacccggctgcggcaacaggaggtggtgtgccctcttgtgcagacactggctaacgggtgacggtggttgtgtgctggaggcaaatggtcgccgtcgccatcggtagagcagataagaaaggaaggggaacgaaggaggaagaagataaaaggaggggaaggaaaaaaaaaggtgaaaagggaaaattttgctatgttattgtccacgtggcataccacgtgggtaagaccatggtcaaataagtctttggacctgaatgatacaataaactaagttaaaggatctcaatgcgtgatttgtaagttcatggaactaggtaaaacccacttacaagtttaaagaccgttggtgcaatttactcaaaaatcaactatgctaggttagagttcccgattggtagccgtagacaactgaacaaatcatggatacaactttaattcatggagtagtagtctaaaagctaatgttacaaatagactatgctagcttaaccggttaggtttcttgtgatgaaaaccatttcacctgatatgggtgcttatatttacgggtaattatttttctagtagtagctagtaggtgatacacgtgtagttagggaggcacctatagtgatttcgtcaatcttaaaatattctagcacaatttgtcggaggtgctcaccgatggtgacttccttaatcgtcttttatatgtgttcataggggtaggatgtgcatgtgtataggtaaatgtggtcaaaattcatttgcaaaatatcaagaatttagcaaattaaatattccacgggccaggtccaaccgagctaatccaaagggaaaaagtatatcgaaggtcctttatgttgtcatcggattataaaatcgtcctccaaatacaaaactaatatatggcatccctaatcttacaaaaccgaatcactttaggcagttttaactccggttccgacgtggcagctgagtaaacatcagacccacgtggaccccacatgtcagcctcttctcttcccccctttttcttttctttcttctcttttttttttctcttttctcctttgttgcttgcgtgttttgaccgagggagagaggaccaccggggattgaagggaaaacgacgtgcaacagggagcggcgcggctggcggccggcagggtagggcagcggcatagcatgtccacgatcttgcgcctcccgcccaccaccatgcttcggattgtctctgatacgaggccgacgaaggaaaagccatcgtagaggataaagagggccgagggcggggaaggcgatggaggcggccctggggcaaaagtcagcgaagtggggcagcccttgaggaggatgtggcacgcggccgggaagtggagcacgctggggacgcagcaaagaggtttcggatggctccgcgaagtttcccatcgccgccgtaagttgctcataggtgaacacccccttgaccggaaatggtggggctgcgctgctgctatggggattcgactgcgtcggtcgaggcatctcctccggcggcgacaccgacctcgatctggcggtgacatcgactcgacgccggcggctaaggtgtggagggcgtctcgacctcaatcaagccgacgccaatctccgccgctccttcctcgtcggccgcgctgacatcttccccaccacatcgatgatgccaccgccgccgcatcggccctcatctctgccgcgctcctcccccgccaatcgttggccgcaccggccctcccctccgccgtgctgcccgcaccaccgtgcgtcgccgcctcaccccgatgacgacacgtgatcacggcaatggtgccgcacggcacacggaggaggagggaaggtagacgaccgccgcggccatccgcgcgacggcagctatcggcaacgccgtttgtcgcatgtacctcctcttcgccgcgctcctcccccgccagccgccggccacgccgaccctcctccccaccgcatcaaagacgctgtcgccatgacgaaatgtgatgtactttttccaatccaaaatccgggctgaaatgtagcctgccagaccaatcgtgggaagcggcccagaaaggcctaggcccagtcaaggcagctgatccttcaaatcaaatctaatccaccacaaacgactccaattctaatcgtgatgaattgtgccctaatcctgatcctatccgcctcggactgttcgcggccgcgtgcgtatatataaaccgcgtcggcttcccaccggccgcagcaagaatcgatcgcgatggagattatgcaacagctcgccgccgccgccaccgccaccgccaccgccacggcaacgcccctgtgccttcctgaaccccctccgacggcgatgacgacggcgcaggtggaggccgccatcgcgacgctgcacggcaagaagcagggcctccgcgaggcctacgacagcctcgtcctccactcgcccatccccctccccttccgctggtccgacctcgactcccacctctcctccctccagtcctccatccacgcccgcttcagccagctgcaggccctccaggcttcccgccccgcgccccccgccgccgccgccgcgagccacgacgaggacgtcgagatggaggacgtccaggaacagggagaggacgaggtgatggcgcctccgtctacggtgcaggtcaaggaggagcctgtggaggcggcggcatgcgcgtcgaataccgccggcgagcgtgccggtgtcgggcaagatgggttcgttcgacccggcgggatggcggcggcgaagatggcgtctccgtcaaaggtgcaggtcaaggaggaacccgtggaggtgagtccatctcctccggccggcgccacgggtcttacggcggcggcatgcgcgagcatggacgccccgagactaaccgacgtctgcaagcgcgccggcggtggcggcggccaaggtttgtgcgcgcgaaacggtagtggtacagcgcagtcacccccgatccctagttgccctgtgctccagcagcagcacacggccggcgccccgaacggcagccaccctgtgctacggcaacacgccgctaacgccatgaacgccggccactcggccgcgttccggccgcagcagcacatgggtaaaccccgggacacgtgtgacttgcggaaggccgccgcaccgaacaccggagatcgcctgccgctgcaatggcggcagcagcgcgtgcacgctaatctcacgtgccccttgccgccaccggtggtcgcgggctcctcctcctcgccgccacagcagcgcgtgggcgtgttcccctcgccaacgccgcagatcgtgggctcctcgccgccgccgccatcacaggcgcgcgtgggagaggctaatgtaacgaacccatcgcggcagcagttcacagctagcgcgccacacgcgggcgatggccagctccagaagcggccgccgtggcagcggctgcagcgcgtgggcgtggctaatcccatgaacgccggtgacctgccgccccagaagccgcacttcacggccaacgcaagaaacgccggagaacacccgttccaggagcagcagcagccgccgcccgtggccaaacccacggacgccgccgccggtgacctgcttcctcagcagaagcagttgatggccaacgcaccaaacgccggagaacacttgctcccggagcaacagaagcagcagcccgtgacagctgcaaaacccgcgaacgcgccgcctctgcagcacgcggcgaacgccaccaacccagccgttctccggcggcagcggcagcggcagtgggttcgacttcgaccaccgaccgccactaacctgccgcaaacgaagcaggagcagcatcatctgttcatggctgacgacggcgccaacgcccgcaatcccctgtcgccgccgccgccgtgcggcatggccaaaccccccaactccggtgacccgctgacggatcagaacaatcagcagctcatggcgaacacccactctgcccctacaccggtttccacaccattggttgcatcgaaccagagtgaatcatcagccatgacgacgacgacgacgacgaacagcaaccaaaactccggcggcggtcgcaccggcccgcaacccgtagcggccggcgctgctccaaatccggccggcaaccagcagcaagggcagcggaaaggtggtgcaaacaggcgaggcggacgaggccaaggcaacaagaacaacaacgttgctaataccaatattagcaacatgagcaaggtgattggcaagggcaacaaggggcagggcaatggaaacccccagctcaacaagaatgggaacccccagttcaacaagaacgtgccgggtgatcatcaccagaagaacaagaatgcagggcagctttgctacaggtgcgggtgcagggggcactggtcgcgcatctgccgcactcctgagcatctggtgaagctttatcagcaggacagaaaggccaaactgcaagcaggagcgaatacgaatacggtttatgtgggagccatgacggattaggggttataagatgggtacattgattatatatctttgtgcgtgtagcatacccattttcgagttatcttaatgttatcgtactagacatgcttttcgtgtttcctacagcatttccccccctcaaattcttagttacagttatgttatcggtttttatgttagatctatattctagtatcattttattctggtaaaatttgatataagacatcatagtgttgtgtcatttgccataacacacttaaaaaaaatgtttgtttgtttgtttttgtgtgtgtcccctggccacatgacactttgttttggtggtaatgtgctaaaacactacaactactccatccagttcaaattacttgtgattctacatatgtccaaagttgaatatatctatctttcacaatcaattttgaaattcatacattcttatgacatgcaaattacatattactcctatgaaagtatttttcatgatgcatctaaaagcataaattttatgatgtttgaccatataaacttctagactccatggctccgaatctccttccggtgccctacgtctcaggggattacacacggtggcctccacccttgccgacaactactgggtaagggacatccgtggcgccctcattgtccttgtcatctcccaattcttgatggtctaggatgtgggtgcttcctacctagctctctccgggaactggagactgtcttgtatggtgttggacgggcaaccagtgctactcagcccgctcgccctatcatgctttattgctgggcaactcccctttccttgcaccgaactgctgtggcaggctgagggccctgccaagtgcaagttgttactttggcttgcattccagcaacgctgctggatggcagaccttctgcagaagcgtggcattgacggccactcggcctgccccttttgcgcgaagaaacttgaaacgccgaatcacatccttctcgattgtgtgttcgctcaccaagtctagctggcctgggctcgctccttcccgtggcgacactcttcagggctggtggtcatatgctagggtctacttgcctgagcaccttcacaagggcttcgactttctgttcctatcctgacagctttggaaggagtggaacgtcagggtttttgattcttccctttcgctggtctaggtggtgttggggtccatcctccaagaggaccatctctggtctttagctagtgccgctttgtttggggatttgttgggaggatagggggttccttttcgcatctttccctctgtctaggagcaacagctttagttttatcttttcctttttgtttgcccctgcagtcccttccttgtaacttggcaagagccggtccggcccattgcgttgtaatgtcaaattctagaaattaatggtcaaaagtacaaatatttgacttaggacaagattaaaacaacaactaatttgaaacgaaggtcagtattatttttaacatgtttcggctcaactagagaaataaatttttggaaaggacgcttttatcaccatggcgtgtagcagcgaagcagcctcatggaggtcgagatcaacattgacattacaatttaaagaaagtcatttgctgatattttgctgatacttacaatagactttgcaggagaagaatgcaaaaagaaatatgcccaacaatactgatggtgcccagagtttcatttcataaaaagattgtgccataatttacttccataccgagccagctcttctgaatcctttggccacagctttgtattcagactgtatttgatcgagagactgttggttctttttatagcagcaggaaatcaagttggttccaaggcataggcgcactacatgtccattgattaatctgcgtttcgtaaaaaaaaaaaaagccaaagagttaatctgtgatcagaaataccagcccagtcagcgtttgaacaggctgccttctctgaatagtaagcctagcacaagctataatctttagagatcagcaagatcagttatgtagccgaccagtacagtaacttgtaaacactgaaatacttttattaactgagtaattctgagtattttaatatctcagatcctgaatgtctgaaaccacaaagtccacaatacttagctaataacttgtctgaacatgacatatgatgataggagctgcaatgcaatcagtttggcaaattgcataccaatcctctgtagcagatcattcataatttggtataggagtatatacttcttttgggtcaagttcacagttcacaccacctccaggtttgcgtatttgtttcaaagcccagaatatatgacagcttccctgtagccttgagggcaaacagccaaacatggctgtaatttgctgaattagtgcagtgtcagattctgcatattttttttcagaaactgggcatattctgtagatgaagtaacaataacaatatgattcacatagacaaggtcacaaggatataagtggtgacagcatattgatggaagataaagagagaagtttcagttttggtttgtgtaaagcccaactcctgcaactcagtatccagtttatttccatacaactcatctagtttccataggtgtgttgagtgagcaggaccaatgaaaccaggtggttattgcatatatacatcttcacaaaggtcacacagcagaaaagaagaaactatagcataaattttggctaaagatcagccatgcaaaactactgctggcgataatattagtcactgtagcaggtctgacaaccggactaaaggtgtcgtcaacaggaagaggattttgatgcctctaggggatatcctctcgttgtttacatgtcactcaaatggttataaaaaaattggaaaaaaaaattaagaagatgtattaatatgtgatatatcactccacaaacatgcaagtaaaaattcaacttctacatctcgcaacgaaaaaaacaaatttgactctgaatatacattaactagctgcggttcaatttgtttttttcgttacgagatgtagaagttgaatttgaacttgtatatttgtgaagtgttatatcacatgttaatacacctttctaatttttttcaaattttttataaccatttaagtgacatacaaagaacgaggggatatcccctcgagggattaaaacagtttccctcgtcaacacatcatagtccacactgtatccatggcttcttagcggataacgcacattattctgcagtctttgtctgctcctcacacaatacaggtttacgtgcaggttggttgtctgaagatgaagtcgttgctgataaggtaagttgcagttagcaaggcctcatccgaaaagcgaacaggaagagatgtgctagaagagttagcctagtctatgcaatgtgtatgtgggcaacacacactgacacacgatgtgaatctgtgcaagtttcagaaagaatttgtgcaatcttcaggtcaacatcgaaccatcagtctgaattgagcagattttactatttagaaatctctgaacatatgtttgaaactgaaattgaatgaacgtacactcaatgctcaacatcagacctattcttgaagagatatctggatccatgtgaatctgctaaaatcatcaatatcagtatgtctggtcccttctattttattagagagaatccattatatgccactgactttgtcagacgtctataatttatcactgactttgtcacattctacaatatgccatcgacctttgcttaacttttacgatttatcatcgttgtccggttagcctccgttcgcactgttcatttttgtccaaatgaccaaaatacccctagaacaaaaatttccaaaatttggataaaattatcaaaatatcatattattaacataagcttgtaagcatccaaaatttggccaaaaacttaaaatctgacatttcagaatttttatccaaaatttgaaagtttttgtcctaggggtatttttggtcattttgacaaatttatacagtactaacgaagactatccggatggcgatggtaaatcgtagaagttaagcaaaagtcgatggcatattgtagaacgtgataaagtcagtggcaaatcgtagacgtgtgataaagtcagtggcatataatagattatctcattttattactgtcctctgaagtaaacaaaacaattgtgtcccggtagcacaacagggtcctgtttgaaaatactgtaagcaactctaatagtgtcctgtttagtaatcatggatacaatccttcaaagattcaggaattggcatgcatcagagaggcaccttcagtatggacaaaatgctcttaacatcttctccataacatagcgaccctctatcaatatctcaaggcatgcagtcagctttgcaaaacttcagtgagtgaaagcatttgcaagttgaagatcagtttcttttcttttccacaatttctgcatatttacctccctgattaatttcttcagtcccaatcagcattgatacagcagctgtcattggtcagagactgcaattcaagatattggcacttgttgataaataaatttactctataagtaacatccgaattaaaaaaaaaaaaggacattgccccttcagtttgattgtcttcaaacttaacagcacttgcccatcaattttcttcttttacaaataattccttcaaaaataagaaggcgtatgaccagcaccagtttaaatcaaattcctaacaagtatccccaaaagtatccccaaaaaagaagcccgctgctcgcgcggcagcgcgcgtgagacagacgctgtctcacgctgacgtcagcgcccccaataaattcaaatcccaccttactggaaacatcccacgcgcgcatcctcctctcctctcctctcgaccaagatttcccccaaaaccctagaaatccccaggcggcggcgcggcgcggcgcgcgatcgggagttccaggcgacgatggcgggcgcggatgggctccctcccggcctcaggttcgaccccagcgacgacgagctcgtctcccgctacctcctccgtcgcatccagcagaagcccctcccgctcgacggcgtcatcgtggatgccgatcccctgagcgtgccgccatggacgcctcttgcggatcacacccgaggcgacgaggccttcttcttcgcgggggcacgcgccaagaatggcaagggaaagcgacagaagcgaaccgtggagggcggagggttctggcaggggcagcggatggccgtggatggcgagcggctggtcgtcccaggcgacggtggaggcggcgtcgacggcagcggcggcggcggcctggagatcacgtggcgcaagtatgtgctgagcttcttcgccgagggtgaacagggcagctcgggctgggttatgcacgagtacgccgtcacgtcgtcggctgacctcgcctcgtcgccgctccggctgtaccgcgtcaggttcagaagcgcaagagggagccgcagtgtctggactcccacgatgatgaagacggcggcgatcaagaacgcgcggctccccggcgcggcgtggctcttcctgcagccgacggcaccgaccagggctcctatggcgtgatcgacggggaaccttcgctggtgtcacattgtcttcccgatcagatcgttcccccagcagaagaagctgatgccactgctggtgcagtcgacgaggagcgctggtcgccaccacagcccgcttcccctactgctgctctggtgaagcagaactcctacgacctgatggtcatttcgtcactgctgttttctgatcttcccgacagaatcgatgacgatgacctgtctgtgtcgcaaacagagggcaccgagctgtccgagcagggctcctccggcgtgatcgacgacgattattggcgggtgttccatggactttccgacctgatcgcgctgccagcataggaagccgatgccaccggtggtgcagagagagaagagatcgctctgctcgacgaggagcgctgcccgcaaccacagcccgctcctcctactgatgctctagtgccaccactgcagggccagaactcctacgacgtgatggccgattcgtcactgctatttgctgatcttcccgggagaatcgatgacgatgagctacagcgatctctgcgtgtgtcggacatgcctgacctgttcttgtcgcagacagaggaagccggtgccggtggtggtggtggcgcagctccagtgctgaacaagcagagtaactcctcacctttgggcgtcatggacagcgaggtgccgattgtgttgtctgatctagagttcccagagagcattgatgaagtgcttagctacattgacttcgccacggatgactgcctcgatttcgacatggacgagctgttttccgatatgccagcagactagcgccctgcagagagcaagtgatcaacgctgacattgtcctcttagcaagagatcagttcttattcctctgtagtgcagtactgcagtctgtgcagcggctagaagtttaggagttttgtgaatctgtcctggaattacctgtatttattagttcattagttgaattaaatgtaacatgtgatttattagttgagattgctgttgattggtatgaattcaatgtaagtaacatccatgtacaatgagtggtgcacattcaataaagctctgtcattcaaattcagaacagagtacattagtttatactgaaagtctgaaactcaggttttgttctcctacactgtatggatataagcgaccaacatgatgtgatcccttcaggacacagcatggatgtaatccttcacaaattgacaacatgctccaaaagagcatttttcagattcaccatgagcaatgcttataaaacatgcaccgttgctactgaattattgactgcagtgatacatgcaacaaaaagacccatcatcactcatcacaggcatttcgacctcaatggatgacatatgaatatatgatacgatttcagataatatagaacaaacattcagaccatatccttttatttgcactagcgatgtcacctataacatgagtgccaccggcaccctggcatttttcttgcatcgaattacagaaccaacatgctagctgcagaacagagctgcagttcccttaaattatgtcagataccaggatgtatattgacaatgcaagttcatcttacattatatttacatttactaaagactgcacaaaaggaaaacatgtagcatattcaagaatctacaacaactttgttggccccaatgcaagagataatgattccttcaaaactgaactgcaaactgaggtcctgtggaagtgctggttcttgaaacagaatgagaaaaattctggtggatcctatcctcttaccacatctagtaccagcagtggttttacattgtacagggatatgctccacttggtctcatgtatcttaccagcagcacttgtgctgagttttttttatatgaagaaggttcaatatgttgagatttgcgtgtcgaaaagccatattattgtgcaccttccacagattgtgggagcaggcggcaaagcatacagacaagccaggttgaaggtgatcctgagatgtttctgccaggttgaaggtgtcaacatattgtcggatatttttgctgattgttgcttgcttgtatagatctgcaggttcagttgcccaggcagaaactgcagtgagggtccgatgaccgttgtttgtggactctgtttccattagtgtttagtctgtcactaaagactagccacatgaaaattatgcaagtatttgggattggtttgtcccaagtttggctgggggacgggaatcagaagactggaggactgaagatcataccagacgctggttgcttttgtttcaatctgggcacaaaaatgtaatctgtcaacttgggtagttttgttttggctggctcagggttcatagaatagattttgagggtgtggtctgtttcagtaattgcctgttcactctgtctgtcccagaccctctatgcctagccctctctcttgctgtctctttttttttttaacctcttcttccttttatttgtaagaactctgattgtcatttctggtaatggaaatgggggccatgcagcccttgataaaaaaaaagaaagataaagactgccagtttctatagtgtgccgtgatactgatatgtgtgcagattataagccgcggctgttgtggttcctgcggaggtaaggatgaaggccctctcatctggtctctcatgttgaagttggtgatcagctaaggtgtccataaggaattgaagttcaagctgagcttgtctggatactgaattggactgtgcgtaaatcaatggcccacatattgtttatgaactgggaagatactgggcaattgatgtttgtgggaaaggtggcgagcattcggaaagatgtatgaaagcaacctgcttcagtccagtgatctctccagaattgaactgactggccattacccactgagacctttgttgaagcactcactgattccaccaccccacagattgtcttccaaactggtgtatcatctgatcttgtttttaacagcatctgaccctacaaatattgagattgtagccactgtaaacaaggattggatgaaccggagagcagttcatgcagctcagcaaggttcattgatttacaagtatcttcccagttcattgaccaaaatatgaactgaagtattgtctacaattaaacaaacataaagccatattaagggtaagacagtagacaaaaaaatagttgttagaatttgaataaattgaacatctaaggcagaagaagccacacccccactaattcaattcactgataaaactgaagcattaccatcatgggatggccagtagttcatcttgctcgctttgtggtatcatggaggatgagactatgatccatttagccaaagcgtgtcaattcttcatcaatagacggcaaatcgtattctcataatttggcctggatagaaagatccaattggcacaatctgtccaacaaagattggtggtatgcaccggtaagggagcaatccaaagaagatagaagattaatccatggataactaattaggacctgacagaatgtatagaaagaaagggctcgaataatgtttcaacaacatattattattagggaggagattagctagggggaataaaactaggaacgaatatttctagctgttatttttcttagttgttgcatctatttcttccaaattgtaactaagaacctctatgactgtgtatgtttctttctgttcttcttaattgaataggcagagctcctgctgttttttatttttagaagggaaaatcatatgatggtttccaacatgataacaaaatgcagtaccaattaactagtgcacgatctagcaaggccaggttttcccaaggtaacagtaggctggaaacgaaggggaggctacctttcggagagcgctggggttgggtgcattgcttgacaacccaccatggttgttcaagctccaattgttcaccgccagagaccttgccccttccagtccgtagagttggagaaggacagggcggcactggcggtccggcgctgtggttggagcagagagggttggactcgatggacagcgaggtcccgtctgcgccgcaccattcccgccgccgctaggtcgatgcgcggcgagccgccggcccgccgcgtcgcaccacaccgcgctgccatgagctagagtggtgtatccacccctcagaagttagaatccaggatggtcacgctgtctctcgtcccggtggcgctctcccctcgagcggtgcggtgcagactgcggaggacggcgcgccggcgcggtggctcactggcaggggggttaacgacgagtggcttcttgtccgtggagtcatgtttctatgggcttttcatggaccgggcccaaacaaataaaaaatgaaggaataagttcactatgggttcctcaaattatcgttgagtctgaaatttgtccctggaccgcaaaaccgcatacaatgtatcccccaactttacaaaaccaatgcaaacgaggtccctcaacaatattgtctccagatttgattgacatgacacatacgtggctcttttgattaggtttttgtctcacgtgacattgacatgacgcatacacgacagtttggtccaatctgaacatgttctttgggcatccacaatgtgcatgtaaaaatgaccttaggattaaagtaatatttatgttctcactttatgcattgggagaaaataaaaggagaaaaagttgctatggacaaccttaagcttaaggctacgccataaggaataaaaaaaaatcattttatacctttgtaacatccatattggtttttgaatcctgcatattaaaggttaaaaatatttttttatgtgggtcctaccttaaggttgagaaaagatcataaacattgtagcatatgttataagtgaaagaccatatgattgtgggtcccaccttatggtctatatctctactattataaaaattgaagatgtttttttatactttggtacgttattcgtgtatgagtcggtttctaagttcgttcgtttttggaaatacatatccgtatttgagtcggtttttaaattcattctcttttggaattacaaaaggagttgtataagaaatctcttaaaaaaactcgcatgctaacctgatatgatcagacttctaactgcagctcataattttctaaaagcatatatatgcgaattcccacagagaatttcactttaactaaaacgtataatgataatagattaaaatagcttgcaacgcacgggtatttgttctactgcacttaaacattgaggatgtccttaaggcaccaagatagtgctttttttttcattaatggaccgtgtaactgcggtaaataagtaattctgtcccgcgcggaggtggtgtggcgggagatgctggtggcgagttgagcccgtggcatagcagcctcacgacggaggctacgaggttggccttcatggccctcaccggcgctcgtgccgcagtgcacgggaacacaactttggcgatcaagcacctttgcggtggttcttcctggcaccggcgtggcgggatcttgttgcccattgactccatggaaaggttgcagttccgttactggttcaagtatatactgcctctttatttttattttaatgtatgatgccattgatttttttttcaactttgaccattcgtaattttcaaaagaatatgtaattatcatttattttattgtgacttgattcatcatcaaatgttatttaagcgtggtataaatattttcatatttacacaaaatttttaaataaaacgtatggtcaaacgataataaaaaagtcaacggtgtcatacattaaaatcggagggagtaacatgcatgtagggggagaaatcgtaaggtagaacccacatagcaaatcgagttaattagatcatgttattataaatttatctattttgaaaaatatcatcatcattcatttatttgaaaagatgccaccacaaacctcccaaaatcatatccatgccatgccatatgtctgagtgttttgaagcgttttttgtccatctttatttcatattttgaccaaattgcccccatgttcctccatccatttgcattcatgtcgaaacatgaattcggcaataataaaagggatagcgcacgagatctaaaagtggatggatgcggagacaaaggatttagacaggttcaggccctctcaatgagaggtaataccctactcctgattggggatttgaatccgccgggtgtattagatctgacgatcatatgtgctcatgccccctagagggcctcctgcccaccttatataggatgtggggcaagattacaagatacaaaccttaaccaatacggtatcggtttcctaaatctagtttacaatattatcaaaccaggactttaggccgttccataatatacaaggaaacgtaatacccaagtcatgatctgttacatattctatagatataagttatcccctatatctagtcggataaccatgccgtgtgggtatggggtacccataatctccacagtagcccctgagaccttcacagtcaaaaagataatcttctcttgaactagattattccaaagccaagtgctttaaccatctttgccataatctcccgaatacttttaccaaatccaaagattgtgaagggctgaaaaataattgaatgtaaatttatgtgcatcgagtagatgcacctaataggtgtagcccccgaccatgtggttagttgaacaaaccaagcatatagtcaaggaataaataatccaaccaaccgagtggtttttaataattatagtcaaccaagtgacttgatatcaatatatagcatatgcggtgcgaatccccaaataacatagcccagatgatataccgactgctttgtaaaaattgatgcgagcaacctaaagttgactacatcattgaaaattcacatagcaaaacagctataaaaaagcttgaatgctgtgaataaagaaatttccaaagtattgggcataagccatgcgcacactgcttcaacagatgtgcttaagtccctaaaagacacatggttttaccacgcctggaaatatacggcatatgtggtgtaaaatccgagtaaataaactcataaaggatttaccaaccgcctagaaaatgaccataatatataatcagcctaagccataatattggtcaataaaaatgcacacttacgtggcaaaaagcaatgatattgtatccaatcaattgcttaaaaacccaaacatcaccttgacttatataaaaaagtcagcggggcaactatataaagctttgctgtttgataccttttaagatgcattgtaccaactcctaaaaagttgagtaactgcggtataaaaggattttaaggtattgggcacttgatcacgcgcactttggcctaagcaaaaagtgcctaagtccttaaaagaacgtgataggccacacctgaaaatatgggctgcagacatattaggcctagaccaaaaaatatgccttcgacaccctttaaaggatgacgcatgtaacatgctcccgagtaataaatcttccgggtgatatagaccaagtgtagctcatatgaatagcttctgatctaagtgattatcccttatgggatactccaaaatagatataacaattgaatcccgactggcgcaagtattcggttgataacccttacagggaataataaatagtccagtctttgagcatagaaaatagacccatgattatgaattcatgttgcatgtatccggaacaagtccaaattggaggtatgatacttgtgtttgagctagtaagcccctgagcatatagcttgtccttctgtcgtagtcacaattgtccattgatggtagctggcgcagttggcatagagacaagacgaccaatatagagataatattgtctaccagaggtggcaaaaatattgatggtagtgaagatagtgataccaatctaaagtgatgaagttgcacagccgtggaggcgaagaaaccagtcggcagcagtcaggtcagccagcaatgaatatgaaggtgcccagtgataaagttgtgtagccatggcaacgaaataatcagtcggtgacagacgagacagctggtgaagaagataaagatgcccattagtggcgacataataagccatccgtgaaggcgaggataccagtcggtggtgacgaaagcaagccgacagtgaagatgtagacacgcatcaaaggcgatgacgaaatccaccaatcatgaagatgaagaaaatagtcggcgacgacaaacacaaccgacagtaatgatgataagcagcaacagagatgatcgactatgaggacgaagttgcccatcaaacagcagtagaataggctatgttgaagaggcttggcaggatattgataaagatgacgatgtcggtgatccagtcaatagcagtgtagcaaccaatgataatgacgaatacgctcaccagcgtttgcatagtaggtcaaccgtgaaggtgaaataacaagccggcaataacggaagcaaccggaggcgaagacgtagtcatccattagcaacggcagagatgtcagagccgatgaagtagaggtgttggtgatgaagtcagtgacaataatccatcaaactgttgagaagatatcaaagctcaagtaattttcttgatgtgtgtataacgaagattgatgtaacaccccttgatttgtaaagatggtagtagaacttggagttgtagctgttgcagatgcttcacttgaaggaaagtaaatgttgttgtccaactcatcgaaactgagctgattggttgataactctaaactcccggacatgtagatagaatctcaaacttgatacttgaaaattttggagtagattgtggcggcgtagagaagccaaaattaccagtgaaatcattggagttgctgaagtagaacacttgctctgaagcgaagacaaaacttataactctcgaagtagattccatagaactcgttggctgatttgagagtcttgtatttgtatagcccccgactctttggttagttgggaaataactgaacatagagtcgagaactgcagcttcttgtcatcgagtagtcattgcaatcaaaagtgaagatgcatgttgaagatgtccgagtaaaaatattgaagatttgaacaccacttgttgtagtaaaataatacggcatcatatttggtgacgtatgccgaggtgtcgaagctcttgtagacgtcgtggctggtgaagtagcaaaacttgcgaagtagcggcaattgagttggccggtgccgaagataataaagatgaagtccctccaccatggtgacaaagttgcaaaggcgtgatgaagtgaacacgagtcaacagcaacataagcaaaccggtagcgaagacgcgtggttgtgaagataaaaacaccagttggcggcggcataaccagtcggcaacggaagaagtagaatgatgatgaaaacgaagacgttctttaacagcggcaaaataggccagccatgaaagtgaagacaccatgggtggcgccgaaggcaaaccggcgatgatgatgacgccagtcaatgatgacgaagacgcgcagccgtggaggtgaacaagccagtaggcgtcaaacaaggcggccagcaatgaaaacgatgacgtccatcagtagtggtagcaatataaaccagcagtggaggcgacgacactaatcagcagcagatgagacgaccggcggtgaagacgataaggccaatcaacactggaagaatcatgcagccatggaagtgaagaaaccggtcggcagcagacgcagacaacttgtgttgaagatgatgacacctattagcggtggcagcgacatggctggccgtgaagacgatatcaccagttgtcgtcatacgaggcagctggtcggtgaagacgtagacgcccaacaacggcggcataataggccagccgtgcaggcggagacaccagtcggcggcagcgaaggcgagctggtcagtgaagacgaagacgcccaacaacggtggcagaataggccaaccgtgtaggcggaaacaccagtcggcggcagcgaaggcacgccggcggtgaagacatagacgcccaacaacagcggcataatagaccagccgtgtaggcgaagacaccagtcggcgacggtgaaggcaagccggtcggtgaagacgtaaatgcccaacaatggcagcataataggccagccgtgcaggcggagacaccagtcggcggcggcgaaggcaagccggtctgtgaagatgtagacacccaacaacggcggcataataggccagccgtgcaggcggtgacaccagtcggcagcggcgaaggcaagccggcggtgaagatgtagacgtctaacgacggtggtgtgaccaaccaaccgtatagacgaagacaccagtcggcggtgacgactgcaagcctgtggtgatgttctgactaatccattcctggagtgtaagagataagcttaaagccatgaatcctttttatgcatatctggatctggatcctgcagaacaaatatataggatgagtagtatctgatgcaaatataatactcgaggaaaatttaagtattttaaaatgtttataaatatatatttctcctattgtcaattttgatttccccgagcagatgactccttacgtttaaacactctgcccgactagtcatagcccccaaacattgggagtcggcctaggcacttcccaaacatgcatatgagtgacatgagttcgtcattagtggaacaaagtttcatggatcagagtttactacttaggtacttttgcaattattaagagtagaaaataaattatcttatctctatgcttttgatttcttccgagtaatacttagcaccttgcgttactcggtccattcaacgagcccccgggtgctaggaatcggcccaaaggcaactatccatcgacaaaccaaacggaaagtataggaagatagaactccataactcgataggcacttttgtactcagattatgtcgcaagcaatcaagataaatattatgaaaattgtttaaaaaatatgatataacatctatagccctcgactcactagtcaacggcgaaccagttgatatagtgaggcagaggaaaagaaaaatatcatataaagaaaattaatgatgacttagctttgtaatattccccttgatgatggcagaggtggccaatgtgggaacaaagtcgtccgtcaataacaatgaagacaccagtcggcggcgaaagaaggcggtcgacggtgaaagcgaagatgcccaccaacggcgtcataatagaccagccatgtaggcagagacaccagtcggtggcggcaaaggcaaaccggttggtgaagacgtagatgcccatgaacggtggtgtgaccaaccaaccgtataggcgaggacaccagtcggtggcgacagagacaggccggtgaagtcgtagacgcccaacaatggcggcataataggccagccgtgtaggcagaaacaccagtcggtggcgatggaggtaggctggcggtgaggtcatggacgcccaataacgacggcataataggccagccatgtaggcggagacaccaatcagcggcggcgaaggcaagccggttggtgaatatgtggacgcccaccaacagcggcataataggccagccgtgtaggcggagacaccaatcggcggcggcgaaggcaagccggttggtgaggatgtggacgcccaacaacagcggcataataggccagccgtgtaggcggaaacaccagtcggcagcggacgagacggccgggcggtgaagacgtagacgcccatcaacagcggcataatagaccagccgtgtaggtcgaggcaccagtcggcggcggcgaaggcaagccggctgtgaagatgaagatgcctagcaatggttggaaaatgctaggatatgtcctcacacatgtttgctcccaatctgctcgcacgcgtgtatatatgtgcatacggcagagtgcaaattatgagtgtgagcagctcgctccagccagatcagggcgacgtcagccggatggataggccaacgatgatctcacatgcaaaaaatacccaatatattaatcagactgattaggaatagcaattagcaataacgtatagatattatatgctatatatattgatgtatgcatgcagcatatacgcatactaatttgcatgtccatgcatctgaaagtattgcactccactgtgcttgcatctgcccctgtaaccaacagtccttcagcatgatgccgtcgtcggaggtaatcatggagccgtcaaacgccagtatatgcacgcgagagaaaacgaagaatcaaagggcagatcaatctatgattaaaaaaatcataattataataatagattggaacgataaattagccgatgccggatagcagtttttatccatgcatgcatgtgtttatgcgtgtagatgcagagccgatccttgcgtgtccaagtgcatgtgcggacggatgattgctatcccggcgagtagctgtcttcacacggctgatagatggctgcggtggatgacgcactgctacacgcctccgccgaggcgccgagtccgcgtcgaactcgaagcgtccagtttgatctcagcaatcaatctcaccgagcataacagaaaacggcgatgacgacgacgactggatcggaggctcgattgctatccggtgcgtgtgaacatccatcgctccagcatgcctgtccagatagcagtggtgactcccgtggccgacctccatgcagagcagtacgatcaagcagggttgtgcaggctggtagctggagacgtggccgatgatctcttggatacagatgattttttttggctacggactgtatagcagctccagccggcatcttggcgagctgcatcttgaggattcaccaccattggtgacgtcggagattggagtgatccaacttgctgaggttgattttccttgctagattgaatctgattcggcgccttctaattggttccatctcacttctcgtagataactcgacgcacccctacctagcgcgccaactgtcgaaacatgaattcaacaataataaaagggggtagcgcacgagatctaaaagtggatggatgcggagacaaaggatttagacaggttcagtccctctcaatgagaggtaataccctactcatgtttggggatttgaatccaccgggtgtattagatctgacgatcatatgtgctcatgccccctagagggccagaactttaggccgttccataatatacaagaaaacgtaatacccaagtcatgatctgttacatattctatagatataagttatcccctatatccagtcggataaccatgccgtgtgggtatggggtacccataatctccacaattcatgaaaaataatacggaaaggtaaaattccaaacttttgcatacacgggcaaaaacatccgtacaattcgacaaactaatttgtttcaaattgcaaacaatacgcaccaaatctgggtaaaaattacacataggacaaaaaaaaaagaaaagaggaaaagaaaggagctggcatggaggtctgccatcgacgaccaccgcccgacctcgctgccgcaggacacaccatccccgacctggcaacctcgatattgctgaatctgttcacaccgttgccgaaccagcggcttgtcgtcgtccccactaccaggcgcacctcgcctgccggacttgcagaccatatgcaaacccagccttcgttgccgccgtcgtcgcacttgtagaaggaaacatgggtgttttggtctttacagaaatacggtagataaaaacgcatcaaaatgtcaaaatgtgttgcagccgtatggcatggcagggataggattttggaaggtttaggtcttgttcggtttagagcggattgaagagaattggaggggattgagaggaaataattccacaccgcaatagatgtggaataaattcccttcaatcctccctcacagggatcaaccgaacaaggcccaaataatttataatattattatcaaaacagacaaatttgcagtggcattagagcaagtttaatagtatagcccactactaactccaaatcatttatagccaatgtaatagccaattcatacaatagttgttcactatactattaatacctggtccacctgtcatacacacgttacgtctttgagtccatactgcagttggctacagatctgtagctcgctgctcttttctcactctttctttatctctttaaaatatgtttatagctggtttatagcatgctattgtatctgctcttagtgcaattaacccaagaagagatgggagagattagggatgaaaacggagcggatagtttccgtccattctggagagaaacgaatacggataccttcagatcggatagttcggatacaaatacggatatttcctcccggatacggatatgaatatgatatcggggttttcgtcggatacgaatagtaatttggatatccagtgaacagtgctattcggatatctatagaagtcatgagacatacctcatttgtttacaactctagaccttcaatatacctttttagattttaatagtagttcatctcttaacactagcccacaatattaatattatttaaattttaaaaatatttataaattatactatattttatataaaatgaggtaattatatattttgatatttgtttctattagaagttgagttggtcttcgtgttccgagaaaaaaattgtttccatattcgtgtccgatcatattcgattcttattcttattcgagataatccatatttgtttccgtattcgagctatccgtattcgtttttgtatccggtaaaaaaaatatgaaaacgaatacagtatgagcattatccgttcgtatccgctccgttttcatccctaggagagatgggggtgccagtgcccggccaaagaggagaaagcagagaagaccgtgacgtgattttcttgttatcgcattgcatcgtgggctggattagagcgagcgactgatgtgtaacactgaaattttcgaatataaaactttagaataactaaaaacctttttcaaaatttgaataatgctgatattcactggattttcctttttctcttcctattgtgctagtgccaaaaattaaaataaataaattcaaaagaaattaaatccaaattttaagttcaaatattaaattcaaacgtcatttattaaagcacccgttatttaaattaaaatcctttagggaaatattatacagataaaaacaaaactagtttcaaagtctaaaccacaccttgtccaaacccttagcctatctctagtctagccgagcacccttatcttcttcctccatttaggccggcccatctagcagcccaacctaccggtgggcctgctctgtctcggcccagcctaccaagccagcctggcgagctgcgagatgagccaacccggccagccaccgtcgtccttccgccgctgtcgcgctgccggagtccggggtgccgctgccgacggaatctacccaacccgttgtacctcgccaccgccgccacgcgcccttgcgaacggtagatgaccgtccctccaccttttcccctggccgactcgccatgccgcgtctcgacggcgtccatcttgctgcaccaggagcacatacggcagcgcaggaaccgtgccgcatcacctgccacacgaaacatcaatttggcataaaaagatcaaccacacgaaagtacgaaactgctgctaatgataagattagtgtcactgtagcatacgcacattattctgcagcctatcttctccttacacaatacagtttcaggtgcaggttggttatctgaagacaaagtcggtgctgataaggtaggttgcagtgagcaaggcctcatccgaaaagcgaacgagaagagttagccaagtctctacaatgttgcaatgtgcatgtgggaacacaaacgatgtgcaatgccaagtttcagaatgaatttttgcaaccttcaagtcaacatcaaaccaatcagtctgattgagcagattttattatttggatatcgttgaacatatgattgaaactgaatgaacaaatgctccagtcttcaagagaacgatatacccatgtgaatctgttaaaatcatcaataacaatatgtttgcccctttctgttttattgtccactgaagtaaacagtcagtcaattacgcctgtgtcccggtagcacaacagtgtcttgtttgaaaatactgtaagcaactcatcagagatccaggaattagcatcagagaaggtatgctgcagatgtgtacggagaaaatgctcttaacatctactactaaatactaatacctcaaggcatgctgcagtcagccttgacatcttgacaaagttactagcagccttgcaaaacttcagtgagtgaacagattctgaaaaaaaaaaatcagcaaaaggtggagttattgggacaagttcaaggaatggatgatcttcattctgtacatttgcaatttgaagatcaattcctttcttttccacaagtttctgcattttcacctccctgtttcatttcttcagtcccaattcaaattgatgcagcagctggcattcggtcagagactgcaattcaagacattggcacttattgataaatagattactctatttatcttagtaacatccaaattcagaaaacaaaaaagacactgctccttcagtttgattgccttccaaaattaacaatactttgcccatcattttcttcttcttacaaaaaaattccttcaaaaataagaatgagtaggacaagcaacagtttaaatttctgatcgaattataaaactgatcaaaacaagttccaaatcaagctcgaaacactagttatctgaaaaaactatcacaaaaaagaagccccgctgctcgcgcgggagcacgcgtgagacatacgctgtctcacgctgacgtcggcgcgtccaataaattcaaatcccaccttactggaaatatcccacgcgcgcatcctccactcatctcctctcgaccaagatttcccccaaaaccctagaaatccccaggcggcggcgcggcgcgcgatcgggggatcgagccggcgatggcgggcgcggatgggctccttcccggcctcaggttcgaccctagcgacgacgagctcgtctcccgctaccttctccggcgcatccagcagaagcccctcccgctcgacggcgtcatcgtggatgccgatcccctgagcgtgccgccatggacgcttctcgcggatcacacccgaggcgacgaggccttcttcttcgcggaggcacgcgccaagaatggcaagggcaagcgacagaagcgaaccgtggagggcggagggttctggcaggggcagaggatggccgtggatggcgagcggctggtcgtcccaggcgacgatggaggcggcggcggcgacgaaggcctggagatcacgtggcgcaagtatgtgttgagcttcttcgccgagggtgaacggggcagctcgggctgggttatgcacgagtacgccgtgacgtcgccggctgacctcgcctcgtcgcagctccggctgtaccgcgtcaggttcagcggccacggcaagaagcgcaagagggagccgcagtgtctggactcccacgacgacgacgacggcggggatcaagaaagcgcgactcaccggcgcgccgtggctgagaccactctgttcgacggatacgtgcctcgtcctgcagccgacggcaccgaccagggcacctatggcgtgatcgacggcgaatcttcgctggcgtcacattgtcttcccgatcagatcgttcccccagcagaagaagctgatgccactgctggtgtagagaatcctctgctcgatgaggagcgctggtcaccaccacagcccgctctggtgaagcagaactcctacgacctaatggccatttcgtcactgctgttttctgatcttcccgacagaatcgatgacgatgacctgtctgtgtcgcaaacagagggcaccgagctgtccgagcagggctcctccggcgtgatcgacgacgattattggcgggtgttccatggactttccgacctgatcgcgctgccagcagaggaagccgatgccaccggtggtgcagagagagaagagatcgctctgctcgacgaggagcgctgcccgcaaccacagcccgctcctcctactgcagctctagtgccaccactgcagggccagagctcctacgacttgatggctgattcgtcactgttatttgctgatcttcctgggagcatcgatgacgatgagctgcagcgatctctgcgtgcgtcggacatgcctgaccagttcttggcgcagacagaggaagccggtgccggtggtggtggtggcgcagcggcagcgctgaacaagcagagcaactcctcaccgttgggcgtcgaggtgccgatggcgttgtctgatcttgagtccccagagagcatgcctttgtctgatctagagttcccagagagcatcgatgaagtgcttagttacattgacttcaccacggatgatacgagctgcctcgatttcgacatggacgagctgttttccgacatgccagcagactagcgccctgcagagagcaagtgatcaacgctgacattgtcctcttaggaagagatcagagcaagtgatcaacgctgacattgtcctcttaggaagatatcagttcttcttcctctgtagcgcagtactgcagtctgtgcagcggccagaagtttaggagttttgtgtttctaccctggaattacatgtatttattagttcattggttcaattgaatgtaacatgtgatttattagttgaggttgctgttgatttctatgaattcaatgtaagtaataacatccatgtacaatgagtggtgcacattcaataaagctctgtcattcaaattcagaacagagtacattagtttatactgaaagtctgaaactctggttttgttttcttctctgcttccttttcagtttgcacacactgtatggataaaaaacgaccaaatgttgtgatccttcaggacacagcatggatgtaatctttaacaaattgacaacaggctccaaaaagagcattctcagattcaccatgactaatgcttataaaacatgcaccgttgttactgaattattgactggagtgatacacgcaccaaaaggctcatcctcacacatcacaggcattttggcctcaatggatgacatatgaataaatgatacgatttcagagaatatagaacaaacattcataccacatccttttttatttgcactgtgaatgtcacctacatgagtgccaccgacaccctagcacttttcttgcatacagttatagaaccaacatgctaggagctacaaaacagagctgcagttcccctaacttatgtcagtactaggatgtatactgacaagtacgtcctacatgatatttacatttactgaagattgtacaaaacaaaaacatggagcatcttcaagaatttgcaacaactttgttggctccaatgcaacacgatacaacgatgctgcaaaactgattaatggaatgattccttcaaaactgattaacagcaaactgaggtcctgtggaagtgcttgttcttgaaaaagagtgagcaaaagtcttgtagatcctagccagatgactatcctcccatcatctaatgccagcagcgctttacattgtactgggatactctccagttgacctcttgtatcttactagcagcactgtgtcgagtgacttccaccttccaccaagtttaatctcatcatcttttgcaagctgaagtatttcctgcaattaaactaatataaagccaaattgagggtaagacagtagacaaaaaaaaaagttagtatttgaacaaactgaactagggcagaataagccacacccccaataattcaattcactgataaaactgaagaatgtggttcatcttgctcactttgtggtatcatggaggatgagactatgatccatttagccaaagtgtgtcaattctttattcatacatggaatcgtatactcataagttggccttgatggaaacatccaattggcacaatctgtctaacaaagattggtggtatgcactgggaagggatcaatgcaaagaagatataagattaatgcatggatacctaattaggacctgacagaatgtatagcagggaagggaacgaataatgtttcaacaagaatcaagaactgacatgcaagtggcacatattatcagggaggagattagcccagggggaattcaaccaggaatagatagttctagctgttgttttcttagttgttgcattcgtttcttccaaattttggctgagaacatgtatgtatatttcttgtatatttctttctgtttttctcaattgaatagacagatctcctgcccttcttttattaaaaaaaatcacactcatgatttccaacaaaatcagtagcacagtaccaatgggcatcagcagagtagttaatattgaactaatctaaaatggccagattcaagtactcaacagatcaaaaagggtttattatgcatgagattaccaaattcaacattactagcgcacaatatagcaaggccaggttgtcctatggtaagctgagagggaaggggatgataactgctggagagcgccggtgttggggccattactggaaacctgccggagaccttgaagaggactgcgccaccggagacctgcttctagtcagtgccggttcttggatataatacttatgcacagagtcctataggtcctagccagatgactattctgtcatcaatcatataattctagcagtggctactcaatctctagttagcctcgtgtcccttgccagcagcacttgtgcagagtgacttccaccaatctcctcatcttttgaaaactttactctatataattaaacaaacataaaagcaaattgagggtaagcaattagacagaaacaatgttattagttaccagaatgaattgaacatctcaggcagaagaggccacactccactagttcaattcaacgataaaactagggttaactaaggaattacagttaacagttatagtagatagtactttcaggtttcaacattgtcagtaccaattagcacctcatcggtattgaagtaatttagacactactccgtttcataatataagtcattctagcatttgtttcataatgtaagtcattctagcattttctacattcatattaatatacttagctagattcattaacatcaatatgaatgtagcaaatgctagaatgacttacattatgaaacggagggagtaccaaatttaatagagacaataataaatattcaaaactgagagaataaggaggaactagctagtgcatcatcgaggaagaggccaggctctcccatggtaataagctggaattgaagggggaggctaccttgcagttgcagagagcaatttctttctcctctctatacacttctcccctacttcccctatcagccattgccgccgacgaagaagcttcggttgggtggtagagcgggncggagtggggggcggcgacgggcttacggcggcgcggcggatcctcgcg

SEQ ID NO: 66143 - DNA, 34981 bp, Oryza sativa
  unsure (1)..(34981): unsure at all n locations
catcacacagttcttgtgcaagaaaaacgaactcctattgggcagcatttaaacgatccacatcatgaaactgcagcagactcactagttgaaccagacacagctgtccattttaagacttacaaaaggtacgtggacacagaccacaactcctaattgtatatgactaacccacccaaaaggaagactgattaaagcttacatgtataacttattaaactgcctcctactcctttagcatcactacctacatgtttcagttagcaaagttaccatattggcacagggcaactgaaattggtagccaaaaactgccccaaaatgctgttcctgggcagatcaaaagggtgtcaagatatcacttattctctttaacgaataaacaccttggactgactgaatcaaagtcgagctttcgacaaatgcttgggctgagctgtaccgctttaagaggtcgcctcagtggcgcatctgggcaggtgtctgcaatgcctgtaagtagaggctctgaagaaggggtctcacagcttctaggtgaattagaacctatcagatcctttccagtcgtctctagtgcttgatttgagataatcagatcaataaacatcatgcagatccgttcgagaaactgatcctcctcctcagcatcatcgaattcaaaacttaaccttttaacagggtaatcacctgaatcaaaacttagctgccttcgcgaaggaagttctggtgccttggtcaccttcttctttggtgcacaagctaactcctctggtcctggagcaaaaggatcaaagatgctttcgcgcggtgtctgacatccatatgaaggatcttcatctgcaacactttttgagatatatgattcaatcgcttcattctctggtggtgtaatcacctcagcaacaccactcttgttattttcatgatcacataccatgccaagggatcttgtgtccttattttcaaagggagattgcacagaagcttcttcatttacacacttgtccaacttttttacaacagggaagtcacagtttgaaactagcgaattatcaataacattcttatccaccccttgatccatttgggagtaatgtggagtcaacctctgctatgacttgcaaaatgaaaacctacaatgaaataagaaatagaaaaaattaaataccacaaactaaccaggacataacagaaaatgatcaccgaaacaaacaagggacacccaagaagattccaaaaggtttctaggggatactaaggcaaaaatggtcacaggagaaactaaagcaaaattaagtggttatcgacaaaacactagccccggatgtaacggcaactgctatgaatgtaaaattgttctaaaagagtaaaggactatgcaaggcgccaaggtagtcgtcagccactaataagcaaagagcttcaactcttgttagaagccgagtgaaatcactgacatcatctaatataaccaaagcccttttgtcgataaccgttatttcttaccgaatttcaaactgttcacccatcactctgagagtctgagtccaagtatatatacaacaattatatatgtttctttacttctgtaaaaagatatcaattaaccatcaacatctattttataaagcaccttccgactgtctaattggataatggggaaacctaaaaaataaaaagctttctatgcattagctccttggaagaccttcatccacactttttgcctactatatatgtatcaatggtttatatgcagctatgactcatacataaaagattaaaaatattctctatagccagcgtttttccagtatatctacacttgatctcacaagtttttccattatcacattttcctgaaacatagtaaaagtaaacaggataacctgtacctttgaaatagtacaggatctgagttgcagagatcaggttccaagagcatcaacacttaatagtagtatgatctttaccaaaagagcaagtgcagagtgtatcggtttcatataaaaacttgatcatgtcaaaatcaagtgtggttacctaaaaaaatgagtacatcagttgatatcaaaagatgaacaaggaacttgatagtatttgcctgacatcaataactcgaaaatgtagcaaatatgtgcagaaatttgacatcattgagcctcatttccagcaggtaaataaatgcagaacaatggcctcagatatatgaagaatgtgaagtagctactgtcattggtatctgttctttccagtatctatcaaatgtagcaaaagaaaaagtacaaggaaaaggaaaataagaccaagtgtaggaaaaaagaaaccgcaagaaaatgagaacaagtgtagagcaaaaatctattcacatgcatcacaaacagcagcatatatcatcattggccatctttcccagcctaacagcacgaaaaaaagaacaagtgtagaaaaatctgttcatgtactcttataaattctgctcagttcaagtgtagaggtggcctcagttctgctaagatcatttgaactataaaatactgagaaagatcacagaaagacagaaacttagaaagggcatgtttggttgcctgaccttatcgaataaggtcaagtgcgggcatatctgttcttatgcatcacaaataagcactattaatcaagtgtgtatctgtcagtatcaatttaaaagaaggcactattgtatccggccttatcagtaacttgtatttgtagccaaagatacaatggcataacacaaatcaacaggaaaaataggaataagtgtaggaaaaatgaaaagcaagccactagacatttcattccatcgaaatcaaccaagaaagatgtcagcttttagtagatctagcatatttatgaaggggacacggtcggtctaatccaaacaaatcggctaaaatcgaaggaagggaggagaagacaacctagcccttaccagagagctcaacggaaagagtcgacgaaagagaggggcatagcagagagacggagagagcgaaccagtggaagagagcgatggcggctagcgaaagagagggaggatgcagtgctgacggacgaccggccctcccgccactcgcgagtcggcggaaccctagctttccactggtttggaacaaatgaggagggatggtggtactggtgagtggtgaccccatccatggcttctgcaagagcaggcaaatctgctgggaaccaaacacgtacacgccctaactgaacaccacagtgaaatactcaaagttgctagtattataatggtactaatccagagatccaaatgtcaaatacgtgtggtctctacatcaagatctattgtagccctattgggtgtcttggcttgcgcatgccgccgctgaataacaccataaaccttacccgagcgctcgcttgacggcgacgtggtgcgctaagaagtttggatttgatccctcacaccacaaacaaaggggacaagactacaacagatatctaattaagcaaaacagggttccttaccaacaaaagaagaaatcaatccaagcccggatggatcttccagtccaacccaatacatgagatggggagcaaaccggataagagttccttgttggcgcacctagaaattagaatcacatggtaaaagaagtagatttagggctttaagaagtgagaaaagccgaaaaatcacatgaaaaaaagagataaagctcactagaaccctaacatgtgaaaaccataaaaaaatccatagaaagaagaggagcattttggatctgcgtgagagaaagattgagaagtagaaatggttaagaaaatggaagaaaggaaatacctcgcggcggctctggattggggcacgagattggtttgggtggcaccaaccgggattgggatgaggcctcccgccgccaaaacaatcccctctattaaaataaaacaaagatttcacaaaacaccccatagaatgtctcatttgctaattttattcctttgtacaacaactagcgaggagcaaggcagctctgctggaccactgaggaatatatgtgaaaaataaagaatcagtgggttggagagtaaaatgcaccaaaaggagggaaaactaatttgggcgggcaaccttggcgcgcgtgtagcaatttagcatatccttcccgcgaaataggcgtgcctatacatatcatcattttggtgaaaaatgaaagtttcccactgcctaaggagttttttcttaggaaaaaataataaaataataatggtcgtgattatttagaaatctataggtgcaaataatcattaaatgagtgggtttcatgtgtatactatgttgaggctagtttgcgggttatcgaagatcataatgattaagagacagttaattttatgttttcctggtttaatggaatttatctattgcaagcaaaatacctgtgtttcatgaccagtgaagaaaattataactttacataccttgttttgccattcatctctccatatgaaacacacctgtgatacctttgttccgtcatttatgtattcgtatgaaacacgccagtcaggttaaagaataagcctgtgagactttgatactcaattttaacagtacagagaagtttatgtgaaaatacatataaactcaaggcatgcattaaaaaataattgaatgaataacttttcataatattaacaaaatgaaagggttaaaatgaaagattgacaatgaatccaagatattttatcatctaatactcatagatagaatccgtttggtgatgcatggtagaggcattatccagcctctctcattgcagctcacgagggacggtggtggtgctcccctagccaaccagcccctctcggcacgacagaggtcctcccttagcgcgaggtagcagtgttcccctagtccttcttagcccttcctaggcagcgagggcggcggtgctcccctatccacactagatggcaatggtgatggcaacaacctctctaggcatcctccagtcttagcctatcttgttgggtctttgtctattttcattggtttatgcctatcttgctagggcaaaaacttttgaaaatgttttgcacataatttccttaataaaaaagtagagaatattcgtgagtagtacgtagttatggactagttaaaacataataagttattgtctataataatatcacgagtattccattcattacaaacttccaaatatcacgagcattccattcgtcacaaacttccaaaatacactcaagcgaatattcttcaaaacaaataaaaatatgcacatatcatcattagctagttcaaattggtgaagaaaagtgtgacagacgcttctcatcagtttagtttagataaatccggcaataaaaatcgctatcgactaccaaacaaggaagttgtcaaatgagacgttcacgacatctatgttttgaggtcccgatccttgcagcctttgctctaggctctgattggtagatttgggaattaggatgactaatggaaatttggaaagatttaatttcacctccttttctcctattagtgattcccagtttaattggggagaggggtggagcagacgcgaagtctccgttcttgtggaacaaagaagcatgcaaagaaaagaaataaggcataggagttggggcaaccacttggatggagtgagggcagatggccgtgcgtagccagcagtgcagcgaccgcaccaagctctgattgatcatgtgattccaacttaatttgcaagtttccaagcacgcaacgtaaggtgggcatgccgcatcgcgacgtgggacaagacgagaagccgtatgatatgctgctttgttacgcaggtgcactgcactagtagtacatagtagagtattatattctacacgggcggcacattagttcgttacagatagtatcagatcaggaattcaggattcagtgctacgattttcttcaatatttcttactgcgtgttgggattgatttgattcatgtatataacacggtgtcagtttggatatatatacagtaatttcactattctctatttcttcaacgtatgcgcccatgatgtttactactccctctgtcctataatataagggattttgggcttttacttgcactgtttgaccactcgtcttatttataaaatttgtgcaaatacaaaaaacaaaaagttgtgcttaaagtactttggataataaagtgtcacaaaaaaattaaataataattccaaatttttttgaataggacaagtggtcaaacagtgcaagtaaaaactcaaaatcccctataactagttgagtgcccgtgcgttgcaacgggtgattaaaaatacatctagtgttatatgttgataagccttaaaaaattctaatagacattataaaacccaaaccccaagtccatgatacacaatattttaaattcaaattgattacaaatgcagtgctacttttttatttcaaatccatcaagcaaaatcaatttcagatttaagtccataatataaaatcaatgttaggtctcagtttagaatctgttttaaattttcccttccactgaccgtaggctaatgattagaatttataggcagaatcagacctttactattgcctctaactgtacattgcctaggtgaagcacaaaggatgccagtaattgagatggcctcgatgggtttatcctcccctattgcagtaccacacgccgcaggcaaattcatctggcaaaagacaaaaataagggaacaatttctgaatatgtatcactaaactgcagcagcaaatgcaacaatgctggaactgtactaccgaagtgatcacagtaagagtctcaccatagatagtggccaagcaagtaggagcagaaagttggaggccatgtagagcaccatcccctgcgctgccaccaccagcaacaacgacggcatggccagtgcccaatgcttgaaagcaaccaccccggtgcgcacaacgccacccatgagactcaaatcactcatccaggcgaagcgaacaactgcatgcatgctaggagtggagacggcggccgtcgctgcatgtagtaccgacctggcggggtagtaggtgatgctgagggagcgcagccaggcggcggcaatactgcctctccctcaactgagttgatctgaaccttggtctgcatgtagtaccgacctggtgaggtagtaggtgacttcgagggagcgcagccaggcggcggcaatactgcctctccctcaactgagttgatctgaaccttggttactggaattgcgctgcatatcttcttctttagcaatcaggagacaagttaataggtgattgaatttaaaaccagttacaaacaagatccatcagggtgaaaagaatagaaagtacaaaggcactcacaattagagttcagttcttcaataatttatctccaagattcagtctcactgcacctaatggtgtggcagcccgaacacttcccattgctaagaaaaggaaaatattttagtaaatatttctattattagaagctttaatcagttgctatataggatatgtagtggtcattgatatattagcagctttttcatttgtctgaattaatattgagaacaaatgtggatataatcctggtgttgcagaaatcacaggacttatggcctttcagtttgtgttctacttgatagtgtgctacaaaattcaaataatacattaatgattgcaaatatttagaaatgcacaagctgtaaataaaccagcaatctcttttaaatcctgtcctgcatggactaaaaataaaagaaatacttcctccgtcccaaaataaagccattttttaggttggcacgggtattaagaaagtaggtgagaatgattggaggaagtgtgtgattggttgaaaagagaaagtaggtgaagaagaatggttgtgattggttgagaggaggaggtaggtgaagaaatagcttcattttgggacaagacactgtgctagaaatagctacattttaggacggagggagtacttaagttcagtacctactgaataagtttgtttgcagttacccataggtccatacaaaggaaacatggtctttataaaatcacagggtctttataaaacaatcatgccatttaaggacaccaaagctacatatcaaatttatttgactcagtacaaatgatcaaaaaagagtaggcatatgaagagtagaatctacgtagttcgaggtggacagtactatttggtcaatttgagcagaggaacaatgagggctccagcatttcttactaaatccctgactcgcatttttcactaaccatatgaaaagcataatcatatataaattcaatattttttcatgacaatactttttgggatatggagtttgcaaactaacattagaaattgtaaactaaccccagactaatgtgtttgatccactaaattttcatccacaacaaacaaataaacgtcgctttatagatgtactataaactccattataaacaaatgggggggaggggtatggaagaaatcataacatgaaaaaaattttacaacgttacttaccaccggctgaggaggaggttgccgcaatagagggcgccgtcgttggtggccggggctcgcagaagggggacgcggaggagatcgacgcgggattgatggttgcgcggaggagatagacgtgaggcgactcgtggaggcagcgacggaggataggcgggcaacatggtcatgggcgatgggatcggctgggaaataacggagagaaattggtacaactacaactccttcaactccctgctattgtatatgaaagccatacaagttatgttatcagcactcctgatgaatacaaaaaggtcaaatcaaatcacagcgaatttttggacacgaaatccacctaagaaacggccataaatttcatgaacacaaaggataaaacaatggatattagtataacttgcgccaatggatattagtatgttagtataacaaaagctaaatactcatggcatactcttttccccaatgttaccattatttacactgtgaaacatattcaagtcatctatttatatgtacgatcctgtttagataacttaaacagtaatgtaccacctcgataacttgcactgcaccattcatttcccactccgacaaatcgaagtatggaagacatcggcacgatactaaaaataagcatttatgcattgaaaaattccctttgggccaagtgagccaaccaaatgtatatgctgtttctatcaaaaagattattgtatcatgtttcgagcctcagatttcattcgagcgggacagtgggtgtaaagttttgacttttgtcttgctgaatagcagaattagtctttcctgatcaatttctgatctaatggcttcagccaactgcatcaacctgatgctgtggtcctagaagaaatgaactttttttttaactcagttcagacttcagaacccattttcttcagggaaaaaaaaaagttcagaacccattgtatttagttactgttgctgtgcttatgttcaatctgtccttgtgttaagcattatgttatgggcatgcagtcacaatcaaattacatcggttgatgacaatgtgtgtgcctgcctgtatctgccttcctatatgtgcccaaccaaggttaatatggattaactcaccaatagacgtcgaaccgaggagagggaatagattaacatgtgaatatgcagatttagagacctagtaccaagaggaaggggagtacaccaaccttgggaatagttggcgccggccttggggaggaggcaggatgcgacgacggcggaggggcggcggtcgagggcggtgcgggtctagggtttcggcgcgatgagggaggagggaggagtcggcggcgtcgggtcacggggtgagtgcgagagagaggagggcgtcgatggcgaatcctcgacggtgacgatgggggcgccgacgcgtcgatgtggggagtcgcgagggtggattggggggcggcgatggtgtggaggaggcgggatgcgacgacagcagaggggcggcggtcgagggaggcgcgaggatggattgaggggcggtgatggtgtggaggaggcggcggtggagggagagaagtcggaggaggggcggcggtcgagggagaggagtcggcgccgtttcctttttttttttttttttgttgcggacgaggagtgtgcgccgtttccttttctttcttttttttccgttgtagagtggcatgtaaattgttgatgtacctttctcatgtttgatcgtctgtccttggcttcactatcaccgtaacgaattttttaaatagtaaagatatgggacgaagggagtagctactgattcaaaaattccgaatccaagcaccaaacttcagataaacatacctttctcaacagcatgcccacagctttaagctgccaagtgccaacactcacagaaaactcggcctggcgcaaaaaaaaaaagaaagaaaagaaaacaccatatcctgagtcctgacttctttcactagcaaatactgagttactaggatttaggaccctcacatgatcaaacaacaaacatattaaacattgtcataatgaagccacatgtataaaccaaacagccatatccagcggttctatttaatctcaccactaactgtcgcatcaagcaagcagcactttacattatcaatcacgattttcactgctccgctgcattcatcacataaatgaaaatatttaagcatggcacaccatctcccagttcttgtgaaaagaaaaaggaataatcattgagcagcattcagacgatccacatcatgaacctgcaacagactcactagttcaaccagacacagctatccattttaagatttacaaaaggtacatggtcacagaccacaactcctaattgtatatgactaacccacccaaaaggaagactgattaaagcttacatgtataacttattaaactgcctcctactcctttagcatcactacctacaagttttagttagcaaagttaccatattggcacagggcaactgaaattggtagccaaaaactgccccaaaatactattcctaggcagatcaaaagggtgtcaagatatcacttattctctttaacgaataaacaccttggactgactgaatcaaagtcgagctttcgacaaatacttgggctgagctgtaccgctttaagaggtcgcctcagtggcgcatctgggcaggtgtctgcaatgcctataagtagaggctcacaacttccaggtgaattagaacctatcagatcctttccagtcgtctctagtgcttgatttgagataatcagatcaataaacatcttgcagatctgttcaagaaactgatcgtcctcctcagcttcatcgaattcaaaacttaaccttttaacagggtaatcatctgaatcaaatcttagctgccttcgtgaaggaagttctggtgccttgatcaccttcttctttggtgcacaagctaactcctctggtcctggagcaaaaggatcaaagatgctttcacgcggtgtctgacagccatacaaaggatcattgctagcatcagtagcaccgaatttagtattcagtgcatcccacaactccttagcgtcggtcatatacatatacacctcgaccagacgatcgccaagaacgctaagaatgcatcccacaaagagagtagtggcttcctcgaattgcttctgctgatcagtagtaagaattccttcaggtttaccagtactcacccagaagcatttcatagccgtcagccacagagtgaccctgatctgccatctcttaaagtgcacaccggtgaatttatccggcctcagtgcatcggcaaaaccagccatagtaaaatcacagtgcctataataaggtttttggattgttgaaattataagcacataatgatttaatttattccataaataaatcatggcattgcagatgtaaactagattgaacgcatcattcgatctacacatgtaaactaagcagtaaaacatgaacagatcaaatatgcgcaacacgtcgaacacgtaccgaggtggcggaaagactggttgctcggcaggaactactcgtggttgcgagcgtcgacaaaggcgcgagtggctaggagggcatcctcccttttaaggaggtctccctctcctagaataagtaaggtgataccaaaatccgcatgcatgccatcccatgaggtggacttttgtgattttccaaagaattaatcttcgaatgggccttagcccatctattaattccaacagaaccttggcaccggcaatgcgggctagagggcgcatgatgtgggtccaagagaagaccgacgagccaaacccatgtaatagcactatgggcaaaccaatttggttttggtcagcgtttgtgatgccagagtctggagattggtcactggaatcctcatgggtgcaaaccttgtggtggacccttacgccattgatctcgtagaagctgctgtctgggtcagcgagggcatcggggtcaaggagatcgtcctggtcaatgccagccacactccggcggcggcggcgtcgtggtggcatctgggcactgtctggaattgaacctgcattagttgtagggtttagtagtgccaaagctgttctgctagttttggggacgtttaagcttttggtgctagctttgccccccagatgaaaaaaaaggctcaataatgcgccattttaaataggggaaatcacacattctacttgcagagagcacatcaacctcaaaatatcccatcttaataacctcctatccaaatgctgcaagtctttcaccacagagaagttacctgggaactcggcagaggcaaaggctgggggagaaccattgggacggcgagggccggaggccgcgggagaaggcggcagaatgtcgagggtgtggagccgagggtggggattggaggtagcgtgggagaggcatctgaattgacctgatcaactgcagagcaggaaactcacgttcgctggactgaacaattgtgtggggtctcaacggaagaagcaaaccgaaaaatcaatctgcatccacacactgcaaatttgtatcgtcatcaaacaaaacggtgctccaaataactatcaatctatattagatgaatgcacactaccatgctcggcaatcgcatttcttggatttttctcatcattgattcattgggcaacaaaatatcaagtcttaatctccctaaaaaaatatatccaatcttgaagcaagtaaaacatctgtgagttaaaagcatgtgaacaacgcaagcagaggaaaaaaaaagatgatatcaaaatagaaaagtttggttatagtaagcttaagagcatgtataagatctgagacaactatagtctctcgtgcactatagacgataccgaaagacagttactacaacagtttgccatatataccatgaaacgaaataaatgtgaactacactcgtagctttggaaaagagaaaatccatcaaatgccatcgatagacaaacaccataatcctagaaatgccatcgacaaaggcaacttcccaaaaatgtcattgcacaagcctctttctcccaaaaatgccatcgccgtcaaattgctgttagcatctttccgttaagttgcatgaaaagacaatcttaccgctaggcaaccatttgctcacgcaacatcatttttgcattgtttgctcacaacaaattatatttatgttagcttacaaatttaccaacatcatttgatagtttccttctgttttcatccctagtcactccccaatggcaaataggcagctcccgagagagagagagagagagaacgcgccgtcgccgccgcggaactcctcgccgcgccctgcgacgccgccaccgccgccgtcgacctcctcgccgtgccctacgaggctgccgccgtggacctcctcgctgcaccctatgatactgccgcgccgtcgccactgccgtcgtggacctcctcgccgcgccctgcgaggccgccgccgtggaccactgccgcgccacccctgccgtggatcctcaccgcgccctgccgcgccgccgccctggtcctccttgccgcgtcctaccgcgtcgctgtgctggtcctcctcgccgcaccctgtcgtgccgcccccgtggaccgccagcatagcggcgccatggccaccgctagggaccgtcgctgagccaccattgtctagacgccgctggggagagcgctagatcgggatcggttgcggtagggttagggctagaaattttattttttttctttgacagtgaaaattgggtatattttgcattgagggcaaaatggttattattaaaaaaaataatggttgtaatggtgtggagttgatggtgatggcatttttgggagaagggcttgtgcaatggtattttttggaagttgcttttgtcgatgatatttctgagattatggtgtttgtcgatgtcatttcatggattttttttctttggaaaattatgtgttagtagtaccagacagtagaaacaggcagtacagactacagagcttggtcccctctatgtggaaatggtagctacagtgatggggtttgaccatttgggcaaattctacaaatactatagcgattggcatgaagtatgaaccacctactaccataatctttatgaaaacatacacagctatgaacaccatctattacttggtgttgagttgtgatccaaattaacttgcaaataaaggccaacttctatcggagcgcagcggagatccgtcgctggaggcttgagccgtagcgaaaaagataccgaaagaaaaaaagggaaggcagaaagaaaaacagagaaaaccaaaaaagaagcgaaattgaaaaaaaaacaaaaaaaaaaggaaaaaagggtcctccagtgctgtccgtcgctccttctccgcgcgcgacaggtgactggttgctaaatagctttctcgggagaccactacacttcggacgtctgatggataacagaaaatcggacgcttgttatgttatatttttgacacatacactaacatgtgcaaaaacactttaaactatttttttctcttaaattatttatccaaatcatgatccgattacaccattaaattcgttgcaattaaatcttcaaaacaagaccacacatgaatatattccgacgaatttttttagctaattattgaattatttttaaatattgcacgatgttccaccatgtatatcggaattgtttcactaaataaatcaaaaacgtttcaatcgtttaaatcaggcgttgtttcaccttatataaaaacaatgtttcagcaaatagcgaaagaatgttccagttcactgcaacatttgatccatacatagtgaaacactataagtacactaggtgaaacatttttggtagaacaaaaaaaataaagcgaattctcttgatagagggtttctaaaatatgtgggtaatttcttgcaaaagaatgttttaattcactgcaacattaagtctatacatagtgaaacattgtgagtacactaggtgaaacattttttgtggagtatgtagtgggaacacgtggcagtgttgcaggggagacgtggtggggcccaaggggagcatgtgcgcacgtggtggttgggggggagcgtccgattttctccccctcccccgggcgaccgaggcgagatcttattgtaaagatttaattgaaacgaatacaccgaaataaatggatcatagactgaatgagtagttttggagaaaaatgattttaaagattacaacttacatatgcatatatacttgcacaaaagttatgcgtatatgtatcctgagttcctgacatgacaaagagatgaggaggcattagcatgatgaggcgtccaaagtttcttccgtgatcggacgctagatgggaagtatttccggcattctcgaactatcgtaccagtttcaacccgtgggagagggttggccgccagctccgatgctagcgcgtatgcgccagatagcagcgcccgatattttctttccggggcgtgggcggaatcattcaatcatcgatttcttccccaaacctagcctcctccactgctcccaacctgccttccgtcgccgccgcctaccctcgactactgatctacctttctccgtcggcggccgcgggtgcccagcgcaaccgcaccctctcctctccagcagcggcgacccctcgcctcataccctttcctgggcaaggccgggaggggatcaatctagggtttccgccgccgccggttccccggacgttgctgcatgacgatggaagatggaagctgtccttcaccagtcacccccagcgaagccgaagctggagccgaagattacgaatcttggacactgaagcagaagattgaggatctcgtcaactgtgatcctatccatggtatcgtgccaaaaaatcctaaatataaagcatatttcgaggaaaagttccaggtacgtacgtacatattttcttcgatccatcatccatggatgcaaaactaattaattaattttgacctcaccagctagcatatattttttttattgtatgcaatcgatcgatgaatcaagtggtatcatatctattgctattgtaggagaagttaagtaagtacgtccgtgttgtattgccgaaacttcgtccagcaattcagaaggatagcgtcaagcaattctttcaagtctacaattgttggtcaggtttcatgggacggggaaacttccttttacctgatatcctcaccaacatggccaacgagaacgctctgcgttgtgccagggtcgcactccagggcacctctcctctgttgcgtcgccgccgcgctgaccccaacacccgccaccgctatggcttcgcccccctacacatggctgccgagaacttcagcgtcgacatggtcaaactcctcttccgttacggcgcatcggcgaacatctgcaccaagggcgagtatgtcattgagggcctcctccctctccatgttgctgtcgagaatgccagcatgcacaagtacattgaggatcattgggctcatggggaccatatcatcaacctcatcttcctcctttgtcttcctgagatggtttcttcattcaattcctatccctattatattactgccagagcatttagcctatttcaaatactagcttggaccaataattaatttcagccaccactgacatgcagaaaatgttcttggacacgactagattaattgccaaacagacagataacattgtcgacgaggtatggaattacattcgtgaagaaaagcatgtccaggcagcaattttgctgctggctgctcaaaagcagctccgtggccgccttaacaacagcagtggcaaagcctctctgaacgggtttgatattgttaaaagccacattgatgatgctcttaacaccatacatcttgaggggttaaatatggttaaggagggaaagaatggcagggcactaaagagattgaaagacaagaaggaagcccttcttacagcacttgtactagttggcattgttcacaaagccggtgaagctcttgagggatacattcaaactcattcacaggtaattgctgaaatttccccattgttaccattgctttctgatacctgtgggttttgatttttccagtttcgttttctttaaatttgtgtgatgcttacttcccatgactttgatctactagtgactcattttctttaaatttgtgtgatgcttacttccatgattttgatatactagtgaaacctcgaattacccttgttttagaaagctgtggtgggtgtggatcgcttttctttttctttttggtgatatgtaaacagttggaggagctcctgctgcattgtatcaactagtcacatccatattataaaaaggagttaaaaagaactggacccatgcagttaatggcatcttttagcctccattttcatgtaaatccaagaggctgaatagcaggcccagcatagtggtagtatactgctaggttcaggtctaatgcatgagtcaaaaatatatggaaacatgggagtagatgcagtgtgttcttaatgcgaagcaaggtggcccaccatcttttagatgcctacgagtttaatgcataagtcaaggtgacaccttacatctaaatctatacaatgttgccaacttctgtattacacacatgcttaccaattattgagcccatgtaccattcgtttcccctttctaaagaagatctaagaggaggggaagaggtcctcttcagtctcagcagcagaatgcaagaagggaaaaaaggacatgtatcctgtccaaagaggcagagcaaagcgcaagaaaaagaacatagatgagggaagaggtgccctttccaaactagcagagcaaagcatagaacaagaaacagagcagagaagagggaagaacaagtacctgtcctgtgcgacggttgacagctggggaagtggagagcatgaaggagaagcagacccgtcggagaaataggggcgttaggaaggcaggctggtcctctgcatctcccccttctccttttctatctctaggccactagcacccctcacacaccagcctttcgactgtgcacgccacacttgctctccccacatgtgcgtacccccatggcacttgcggaaggctaagcgagcaatatgctctcttccactggtgcttgggcgcgaaaggcgatgcctttacgacactttaaaaaccaagaattgatatttgcatgaactatagaagagcataggggtccattgaaggtaagtttatctttttgggatcaggaacatataaaatttgtagggaagatcaattgttcttaagtatggtttgagaataaaaatataatagcaccctcccttggattgggctaccttttaaagtgggaccccatgtaagtttagcaaagcaagttttttagcttggaaactgagtctttgagtttttgtaaatattttcaattttattcatgaatatatgcgtattcagcaattttaattatgactccatatatattcagcttctattcttttttttttttaagttgagggctaacataatgggtaagatgagcaagaaggtgcgtagttgttatgtgggagatcatgaggctaataaagggaatagcacttagattatgtcaaggtaacctgcaaaagggtagagatgaatagatgatagtgttaagggtgatggtggtttgtctttagccccattggagtggaaacctgatattggatatgctgcccttgttaataatatatgtttgagtggaagtttatatattctttctctaaccatgactatgactaggaatcatcatattgttctctcaacaagtctttcatattttaattgaattcaagctctaagaaatgaacgaaacaaaagctggactaccctgaagcaacttctcataatgacccaaattacatgaccagaaggcctgcattatggaagcttttgttggtgctgaccagttctttttcttcctcatttatttcttctattcctcacctggcatgttcatgtaaaacgcaaaacacatgtcggattgttattttctttcttatttatttgctttattctacgtgcatgttaaagtttagtgagaatgcatgtgtcaaaaattgtgaccctctttcaccccacgtctctatgcacacgaagagtgggttctaatattttctgttcaactttacttgggtctgtttcgaaggcccgccatttcacagcatccatatatgccatcatgccacaatgaatatatcaataaatttaaaaagtggatgcttgaaaagaaagattaaccnnnnnnnnnnnnnnnnnnnnntcatgccacaacttagttggcagtgacgatacatgttcacatggtacctatcataggagaataatagtttaagcgttaagcctccaccttctcacatcaagcctagcagagaaaaggccttggcttttggtgtcacttaagattcgtttatcattaggcaaccttctatagtttgtctttactacttttttatttgtagtaggaaaagtgaaaaattctctgctggggtccatggcaatgaaactgcaaattccatgcaactatctatacccccagagtgtagaacataacattgtgacaccacaatattctagagttgattaccatagagcatctgtatagtttagactgttatactttcaattccaaaaaagtgatctggtttgtagcaggtgcaacggtaccgaaaacaactctcacctgccaatattctgctttacacgtgtgccggcatagtgctgccataccactgttctgttgtgtaagatctgttttaattttcttctgctgttatactgtagtgtcgtcaagtaatgtgccattggttccagacaaaaagtataagttgggcaacttggttgtttgttcatctagccaaatgagatgttattgacaaggccctagtgggctttttggtgttgtcttgtttgcggtgagcaaggatggcaaataaatccaagcttggaatagtagagttggttgactatggcagattggcagcatgccaaatcaatgacttactgattcaactcttgaccacttagtatttgtgtagatgtagtgcttaaaacaccattgttgactttcagatggtctgtactgtttgtctcgagagatgatgttattgaaggctgttatgtgtcttgcaaccaccaccacctgcaagtttagatatctgaattctcgttttggaataatatccttgaacattttgtaatgatacgttttaacaattttcttggtgaaatgtaggtgcgccatgacgaaattgttgaacatgtttcatcaattctaaaaagcaatggcattgctcattctggggaaagcattgacactggaaaacttgaatggtttgacatctactggctttatatatatattcagttcatgtttttgtgcatataatttatgcgttgatttatttgtgttttgaagctaccaacatggtggggggatgtcgattggcaagtcagattcacaaagaggtgtgtttcattttggttgatcctatttcttattaaaataaactagaaaggaaaatagctgtgaaactttattacgtgtccacccattacaaagtcatttgctgtggtgaatgcacaactttggaacattgcagaaagcttatgacttgcatccagcgcaaaagggggtgcaaccagactctgtacaccaacctcggaactatgctttccatttcataagctgtctcatgaccaatttcattgctgattacagtgggctatggggaaactattgaagcggacaagtcatcttctgatataggcgaagttagtaaaatggtaatgagatacgcaattaaatttatttgttgagtctaattcatgctgatgaaattagtatgaaaacaagattgttcctccaaatttgctcctactgacccctatcaattaacaagatatggaaatatttgataacgtaatgcataaccatcaattgttgccttattggttaacaacagaatgaatactcactacttaaatctgagtgtttttataattttgtttatgcgttcagttgctaattttctcatgtaaacagatcctgggaaagcaaccacctaaaggatcagccatacgcgaagtgagagatatgttcttcccatactggaaatcggtgttgtctcgacggttgcagctaaagatagttccatcctgtcaactaagcaggaaggacttgctaagtgctgaagcgagcacgaaggggaccaagagtatggaccacccgtgtaacccaatcaaatcaatgggaaatcttggttcgatgggctggcccccattgtcaagtgagtccagaaggatgctttatactgttgcttcaatgtcccggaaggtgtttaagcgcacttgactacagaaaatctttggcggtatgcttgttgaaacactttttttttctataataagcctctagaatgtattttggtcatagatgagaaggggagaaaacagcatatcctgacttctttcactagcaaatactgagttactagtaggatttaggaccctcacatgatcaaacaacaaacatactaaacattgttacaggtttcaaaacatataatgaagccacatgtataaaccaaacggccatttccagcagttttctgtttaacctcaccactaacagtcgcatcaagcaagcagcactttaccttatcaatcatgattttcactgctccgctgcattcgtcacataaatgaaaatatttaagcacggcacaacatctcccagttcttgtcaaagaaaaatgaactaatattgagcagcattcagatgatccacatcatgaacctgcaacagactcactagttcaaccagacacagttatccattttaagatttacaaaaggtacatggtcacagaccacaactcctaattgtatatgactaacccacctaaaaggaagactgattaaagcttacatatataacttattaaactgcctcctactcctttagcatcactacctacaagtttcagttagcaaagttaccatattggcacagggcaactgaaattggtagccaaaaactgccccaaaatgttgttcctgggcagatcaaaagggtgtcaagatatcacttattctctttaacgaataaacaccttggactgactgaatcaaagtcgagctttcgacaaatgcttgggctgagctgtactgctttaagaggtcgcctcagtggcgcatctgggcaggtgtatgcaatgcttgtaagtagaggctctgaagaagaggtctcacagcttccaagtgaattagaacctatcagatcctttccagtcgtctctagtgcttgatttgagacaatcagatcaataaacatcttgcagatcctttcaagaaactgatcatcctcctcagcatcatcgaattcaaaacttaaccttttaacagggtaatcacctgaatcaaaacttagctgccttcgcggaggaagttctggtgccttgatcacattcttctttggtgcacaagctaactcctttggtcctggagcaaaaggatcaaagatgctttcacgcggtgtctgacagccatacaaaggatcttcatctgcaacatttattgagctagatgattcaattgcttccttctctagtgtaatcacctcagcaacaccactcttgttattttcatgatcacataccatgccaagggatcttgtgtccttattttcgaaggaagattgcacagaaacttcttcatccacacacttttccaacttttttacaacagggaaatcacagtttgaaactagcgaattatcagtaacattcttatccacgccttgatccatttgggagtaatgtggactcaacctctcctgtaacttgcaaaatgaaaacctacaatgaaataaggaatagaaaatttaaataccacaaactaaccaggacataacagaaaatgatcaccgaaacaaacaagggacacccaagaagagtccaaaaggtttctaggagaaaataaggcaaaaagggtcataggagaaactaaagcaaaattaagtggttatcgacaaaacactagccccaaatgtaactgcaactgctatgaatgtaaaatgtgttctaaaagactatgcaaggcgccaaggtagtcgtcagccactaataagcagaacccagcttcaactcttgttagaagccgagtgaaatcactggcatcatctgatctaatataaccgaagccgtttttgtcgataaccgtttttttggccacatttcaaactgttcaaccatcactctgagtccaagtatgtatacaacaattatatatatttctttacttctgcaaaaagaaatcaattaaccatcaacatctattttataaagcaccgtctaattgtaaaatgggaaaactaaaaggtaaaatgctttctatgcatagctccttggaagaccttcacccacactttttacctactatatatgtatcaagggtttatatgcagctatggcagatacataaaagattaaaaatattctctatagccagtgttaaactgaacaccatagcgaaatactcaaagttgctattagtggtaccaatctagagtaataggcgcccaaatgccaaatatgtgtggtctctacaccgagacctattgtagccctattgggtgtcttgcctgagacaaatcttgcgcgcgccgccgctgaacaaaaccataaaccttgtccgagcgctctctcgacggcagcgtggtgcggctaagaagtttggatttgatccctcacactacaatcaaaggagacaagtctacaacagatatctaatgaagcaaaatagagttacttaccaacaaaagaagaaatcaatccaatccaatccaagcccgggcggatcttccagtccaacccaatagatgagaaggggagcaaaccggatgcgtgttccttgttggcgcacctggaaatcagaatcacatggcaaaagaagcagatttagggctttaagaggtgagaaaagccgaaaaatcacaggaaaaagagataaagctcgctagaaccctaacatgtgaaaaaccataaaaaaatccatacaaagaagaggagctttttggatctgtgtgagagaaagattgagaagtagaaatggttaagaaaatgggaagaaagaaaatacctcgcagcagctctggattggggcgcgagattggtttgggcggcgccgaccgggattgggatgaggcatcccgccgccaaaacaatcccccctattaaaataaaacaaagttttcacaaaacaccccatagaatgtattatttgctaattctattcctttgtacaacatccagcgagctcagctggaccactgaggaatatatgtgaaaaataaagaatcagtgggttgaagagtaaaatgcaccaaaaggagggaaaactaatttgggcgggcaaccttggcgcacgtgtagcaatatagcatatccttcccgcggaataggtgtgcctatacatatcatcatttaggtgaaaaatgagttcttttttaggaaaaaaaataatggttgtgatcactcagaaatctataggtgcaaataatcataaactgagtgggtttgatgtgtatactacgttgagggcttgaggccagtttgcaggttatcgaagaccataatgattaagagacagttaattttctatttttcttgtttactggaatttatctattgcaagcaaaatacccaagtttcacgacgggtgaagatcacaattataactttacataccttgttccgccatttatctcttcgtatgaaacacgtcaatgaggccaaagaataaacatacgtttgttctgtcatttatctcttcatatgaaacacacaagtgaggttaaagaataatcctgtgagattttgatacctaattctaccagtataaagaagtttatgtgaaatacatataaactcgagggcaggcataaaaataattgaatgaataacttttcgtaatattaacaaaatgaaagggttaaaatgaaagattgacgatgaatccgagatattttatcatctaatacacatagatggaatccgtccggtgatggtggaggcattatccagcctctctcattgcaactcgcgagggacggtggcggtgctcccgtagccaaccaacccccttgggcacgatagacgtcctcccttagcgcgtggtagcagtgctcacctggccctaggcagcgagggcagcggtgctcccctgtccttagtagacgacaatggtgacgccagcagcctccataggcggtgaggacggcagtgctccccgtcctccctattcggcgatggcaagtgtatgaggtggcttgctaagatacaagtgtactatactttcttgtgtgttattgagttgttcgaatttttggtattttattatgaagttctcgtcttctactatggtgaaaagctcatataactggatagcgtttgcagcttcatctattcttgttgccgatttttggtcatgttcctccaattttgaaggttttggattggcaaccatgtggacatgtttgttttcctcgaactctgaaggttttaagctggccacgaacgaattggaagcatttgagccggccacgaatggattggaagcagtagcggacatattgcgcttgccgtgggaacattgcggactcttcgcgatccggacgtacacggggaagaagggaatctgacaaaaatacatgcacgggaacaaaagctagacgacgggcaaaaaaaattcctggaagctttaagtattttttatgcaggtataaatatcctcatcaggattttgatatatgtcatttccttatttctgttgtcaacatgtttttattagaatacacttaagccaaattacatgacgaatagatggaactgtatctatcataggctatgcctagtgcttcacctaggcgccttttgctcgctcaaaactattggtagtgtaactagttcaatttccaccttatcttcatccacctttgccagtcctcctatgaagtccccgtgagtcttcacacgtatctacaagtcttcctcccctctccttagcgttcacccatctccaccagtcttagcctatcttgttgggtctttgtcttttttcgttggtttatgcccatcttgctagtgcaaaaacttccgaaaatgtattgcacataatttccttaataaatagagaatattcgtgagtagtacgtagttatggactagttaaaacataataagttattgcctacaatattatcacgagtataccattcattagaaacttccaaatattccatttgtcacaaacttccaaaatacactcaagcaaatatccttcaaaacaaataaaaatatgcacatatcaccattagctagttcaaattggtgaagaaaagtgtgacaaacgctttttatcagttttgtttagataaattgacactaaaaatcgctatcgactactaaacgagaaagttatcaaatgagatccaagaaatatgggcaacatagcacgaagcgttcacggcatctatgtttcgaggtcttgatccttgcagcctttgctctcggctctgatcggtagatttggaattgggatgactagatgagatagggttaatggaaatttggaaagatttaatttcacctccttttcaataattacataatctttttaataaaataaatagttaaacgtatgtctaaaagtcaacaaataaaacaaatggccaaacgtaaataaccgtgcataatacataaatactatttcaatcgtaaacataaacgaagggcaatgcacgtaggtttatcagtccatgaatgaatattatattaaaaaaatatatataatgtcagaagtgggatttgaacccacgccctcgttagaggaccagaacttgagtctggcgccttagaccactcggccatcctgacctcacagttttttttcacctgatgttgtctaaaccattaattgacagacgagaagtaaaagtttcattccacaaataagtaacacttcaatcggtgtacagaattgcatactgtagaatatactactgtttacactcgagttgcagcattgttgcaaacacataccaaacaaatataacaaggggaaaagggaaacatttatataaccttcaagaatctcaagtcagagctctctaaaaattaatggaacacctttcccaggctcgatggtcagtctgaacgcagggcaatgcacatagtttggagaaagcttgaattcaaacttggacagcaggagtgacagaacaaccttgagctcaaccatggctagattctggccggcacatgtccggaccccaacgccgaagggcatgtacatatgagggggtttgcaggcccctgctatgccgttggcgaacctgtccggatcgaatttgtcggcactaggaccccatactgaaggatcccggtgagccatcgcgatcgggatccagatgttagttcctttcggtatgtcgatgccgccaagtttcatgtcattcagagcttcccgggcgacgaaggaggctggtgggtacaatcggagtgtctcctggatcaccattgtcagctgcacaagtatcaacagcacaccattgttagctgtaatctaatgaacggattgttttcatctcttctgttactggaagaggatgagaggacaaaacatacctttttcaacttccgtagaatgtcaaaatctagtggtctcccttgacaaatgtcaagggattccacccgggcacgggactgccattcatggtgtgaagctagaagcatcaaacaccaagcagccgtggtcgaagttgtctcatgccctgcgaagtagatgtttttgcagttgtcgacgatgaaatcctcgggcgtgcatgaagcaaagggaccatccttagaaccttgaataatggagtgcaggagatccttgtttactgaggtcgatgaatcatgttcatatttctttgatatgtttaaaatgagggtacggatgctactatccagattccagatccctctattgctccttgttggtaaatacctagtcggcccagcacaaaaataaaggaaaatccttaaatgattaaccaattacaataagatgataaaacatgagaagccacttattttcatataattattctcatgcaatggtatggattggaaaatacatgttatgatactcttggatctactgtagtatctcacggattctagataaaatattattttttaggccttatatccatttagaatgatatgtaggaattgcaggtagatcagaccaaaatgggacatgtaagttagcccagacaaaatagaagctgtatatttctccaaaaggttattctgatactgctgcaaaccaaaacagtaacacattatctgaattatagtgatttcagaagttgaatctgggcagctacttgggtattgaaatcattcaaactaagcattatctaaaaaaagagctcaacagaggattttgagcagttcaaagacagcattcttttgagttttaaattgtctcaaattgaaatatgtgccacagtagtacatgtgtagtttctgaaatatacctacttccaggaacaccaatgagcatactttgttttgccattgctttctgaagttgtcgtatttttatgaaaatctccttgccttcactaaagctgcttccaaaacaagcccttgatatgacatcagctgaaaaggttctcaagaactcatcaaccacaatctctgcactgcctcctctgtcctcaacttcatttttccatgagttcaacattgacattgcagcctccatcatcaaattcaccattccctatggatgtcattttaacaataaattgagttttagtatatgctacatgtagtgtactagaaagttgctccaagaaaaatattgttttttgacagagagatccatggcccaatacaagtgcctgcagataattaccttaaccctttccatgaatagttcaggtgcaatcacttttctctggtgtacccatagatcaccatttgatgtcagaattcccataccaagaagagctccacgctctttttgcaagtagcaaggttttccaagatccaaagatttgcagttggctagctccttcaccatgtttggatcagtaacatttaaaacttgtatgcttccagtggaatacaggtagatggaacctaacacaacatcaatgtttcaggaacttatcagctttaattttaaatatgaaatgcacaaggcatccgtcgatgttctaaaaataaatctattaggacatggttacagaacatacaacaaaagaatttacagtaatttaaatagcttatatgtaatgagggtaacaatgagactggtcgacaagatgagacagtatatggtacaccatcagaacgtatatgaaaccatgagctatccataaacaggccccaatcaaagaaattatgtttcgatggttgcagagcgaactaccatccaaaatacaaaggtacctaaaactctctgaattcaagtttgcatcaccccaaaataaaaacaatcctgttatgtgggacaataaaaagagaaattttagagaaaaaataagtcaatatcaaaacattcctcttaacaaaattccaatgaattacatttaacatcgaatataaagatgaattaataaactttattttactgaaactattatgcactacaagtttcttaacgtaccataaaccctgctccagtggaggaagtaagggaaaagagttgccacataatttgatgaaaacatgtcggtactccctgcttcttgttcatgtgctgacttggccaattgctggattctcctcatctctggtatgtttccaaagagaaaagaaggcttgggacccctcactccttggctcctcagtttctgcctcaaccgctctggtcttagccatagaatgatatacacataggagaacagaaggatacagaggatgatcggaggtagaagtgctagccattgctgtgatgagaatagctccatttttgtgtgtacgtatctgggtgtgtgtgtgagagaagagggagactacatgttcatagcatatccatatactgtatactgcatatttgctgggtgatccatctccatgtgaagcttggagctgaaaaggacataaagccgcaaagaagcgcctcactcactctgagcagttagcatgtaacgatcatacaacactgcaaatttacaacatagaaaagaaatccaaggttagtggtaggaaaacttaatttaacatgcatttttttaaggaaaccagggtctgttatgaccaaattattcacatggcataaaaaggaacaatttgggggtttcatatatcttcaacagattatgaggttgggcaataaccttgtagtaaagagctttcaacaaacaataaattaagacttttcggcatgatgttgtatgatagtttagccccattaatttggcaagaaattgcacaagatatagacatatagtagcctagaggctgctagaatatagagagataacatcaattggttgcttgaataaaaaactacgggcctctgctaagagtagaggactcaattcattccccacacaagttattaaaggaagtgttagcctgcactaagaaaataaatgagatgagatgagtgagggcacgcaccgtggcatttcgagctcaacaattgggctctgtgactctgcagctagcagctccatgcgaagaccatgctgatgagttgattgattacaagtatcagcgcgagggcgcggaggatgcaaagaggatgaggaaactgactgattaagaagaatctgcggtccagatagatgcagtctccagaaacagccctgtctgtctacttgctaagttttgtcactttgttagactcccatcaatcaacgcttggacccaaacgtcagtggcaaaccagacaaatgcctttttttttttcatacaaaagggagtgatggcctctcttactttttcaacccaaaagaatggatcgcaacaatgttctccatcataaaaccctttgattgggttcaacgagcttagagtgcttaacaacttcatctcaaaaaaggagctttattataacaagcattgctgtctgtggccagcaattataactggagctgtcatgaatcgactgggtgggtgtgagtaacagggctgctagctcatggcagctttgtcaccatgagtggcaagccgaacccgggttcaatggtcagcctgaacgccggcgagtgacggtacctcggcgacggcgagaaggcgaactttgtcagcagcctggccaacaccaccttcagctccgccattgccaggttctgcccgatgcacgtcctgggcccgtgcccgaacggcacgtacatgtgcgccgccctgcacgccgccgccacgccgttcgcgaaccggtccggccggaactcgtcggcgtcggcgccccaggcttccttgtccaggtgcagcatcagcctgggcacctgcacgatggtgccgcgaggcacctcgatgttgccaagcttcacgtccgtcagggcctcctgcatcatcaccgacgccggcgggtacagccgaagcgtctcctggatcaccatcgtcacctgcatcatttcgacatcgttgtcattcatcatcagtaaacagccattgttaatttctacgatgaacaatgcggtttaagatgttaatttctcacaatctttaaccggcgaagggcgtccacgtccaatgtcgaccttccccggcaaacctccattgcctcagagtgcgtggcgagtagcatcaggcaccagatggcggtgaccgccgtgctctcgtgacctccgaagtagatggtcttacagtttccgacgataaagtcctcagcctctgcagcgctgcgaccatcctgcgcaccatcaatgatggcgttgacaagactgttgtgtgagtcttggtagtggtgttgttcctttgcgacatccaggatcagtaagcggacttgttcatccagcatctgtatttcttggttgctcttggttggcaggtatttcctacaacagcaatatagcatgaaccatctaaattagcatacctgatcacttatagctgtgattgtgacatgtaagtctagtttatgccatgcttgaattataatactttaagcatgtgctgtttgaaaacagtttacggcgaggttttctacctatttgtctctactgaatgacaggacttgttacctactaatctcaaattaataaggagtatacaaaagactatttcttggttaatatcatgatacacacgtgaaggttctcatttcattgcaactaatttcattgacttaccacagtgcagacagaccaacaaacgaatcttgctgagcaattactttttggagctgcctaagcttgcaaaatatttcttctccttttgtgaagctactcccaaagcaagccctggcaattacatctgctgacaagttccgcaagtaatcatcgacaactatttccctacaccctcccacatcgtcaatcatatcctcccatgcttctaacactgtaacagttgcatcctcaatcagctggatcataccctgcatgcatatataaataacaactgcaatcacgcgtgatacgagttctagttttcagtccatgaaacctacaagcaatcacaatttaatggtaccttaatcttatccatgaagaactctggtgcaattatcttcctctgataggcccattcatcaccattctctgtaaataaacctcctccaaagagggccttgcgagatttctttagataattaggcttaccaagctctgatggtgtccaccggcctatatccttcaccatatctgggtgagaaacttgtagtatctccagagctccagttgagtatagaaacactgggcctggtcaaaatacacatgtaaattaacttcattaagaagaactcaacatggacattccctcaaatttgacatgaatatagggaaaatgagatgaaaagcataatctattctaagattgaaatcatttgtcaaacttgcatttttcggagcaaaggaaatgataaatatgattgttattgtattagaattctcactaccaaagtagatcagatcctgcttaatctacaagtagttgggaaatttttagttattcaacacaaaactcgagataacatataaaatgggtgtatgaaaattttaattgatggtcaactactgagtcctttatatgactgtcaagagttgaatggctattatattaagctgtaaaagggtcccacagtctaaataaactattcatcaataattatgatcctgacaaacttgtttaataatactcagtactagcatctgagcttgtttagagtctgaaacagaaacttcgtaggatggtaaatagcatccaaaatggacaaaataaaattacaaaacaaaggattagatatatatttaaaaatgtgtgatggcaccatttcgctgaaaagtgtctgatctgtttatataatttgatatcctactaaaagttgaaaaacagtaaaaagaggagagattaaaaaaattatgattgccctccaactccctactaaatgatcaattcaggcttataaactagattttaatagcaaggatactttgggatcctgcttctccatggtaattcattaattcacttcaacagttgtaggtgactaattttctccaagacatgtcattaataaacttcaggatcctatcatcaatctgatctactcatgagccatgaacatatgagtgcaagagccaatcatggacaaagtcacaacactagcatatgcataccataagtttcccgacagaggagaaagtgtgggaagagggtggagatgaagttgttggtgccttgcttctgtgaaaatttgagttcttgtcggattcttttgatctcctttgtgttgccgtacagaaaagtaggcttgggaccccttatgccttgcctcctcaacttcttccttatcttcacagccctcagccataggatgttgcacaagtagaacagagctaagctaagaagtatgacaagaacaacaatgagtgcaagcaattctccatgaagcatagggaaccagagaagcaaagtatttctgtcaaatcttcagtacattaggtctttcgtgcgctagctttatatatttgtttaacacctcaagcatgtgaattcttttgtttgaccttttcttcaacaactgattgttttgtaggttgctttcacatcttgggatcaacttacaatcagttagaccttccag

SEQ ID NO: 66144 - DNA, 51336 bp, Oryza sativa
  unsure (1)..(51336): unsure at all n locations
cagacgatgcaagtcgttctcctgcggccgcggcggagacgtgctcgccggtggctgcggggacgagccgcagcggcggtcgtgcgacgtgcgcgggaggagcacgctatgggcgctgttccaccaggacgaccgcgagcgcgtccgcgacggcacggcgttcggggcgttcccggcctcgtcctcagccgcggcagcggcgctcgcctctgaagtacaacctcagccgccgccgccgccgccgccgtgcgttcctgaggtgttcctggaggaggagatagctatggctgaggagtctgacgagattactccagtggtggagccaatcttggtggtggacacctccggggagatggaaacggaagccaatggtggacgggaggccaaggccatgaaggaccacatagatctagagtgttcgcaggccaagaagccgcagcccaaggacctgaaggaaatcgccgggagcttctggctcgccgcctcggtgttcagcaagaagtggcagaagtggagacgaaagcagaagctcaagaagcaggacgccgctggcagcaaggcagcagccgcagcaatgccgccgccggagaagccctccaagccctcgttcctccggcggagtcgcctccgtggagaagcctgctcggagttcgccggaggtcggcgttcgtgcgacactgacccaaggttctccctcgatgccggccgaatgtccgtcgacgatgtaggcttctcctgggacgagccccgcgcgtcgtgggacggctacctgttcggcgccggcaccggcattggcctcggccgcgcgcccccgccgctctcccgcctgccgcccattctctccgcgatggaggactccccagccggcatcgtcgagcgttccgacggccaaatcccggtggaggacgactcccagccggagcccgatcccgacgccgacaccccgggcggctcggtgcagacccgagactattacgacacgtcgtcgtcaagccggaggcggcggagcctggagcggaccagctcggtgcggaggccgtcattcgaagtcaccgacgcaaagccagtgctgccggcggcggccgccataacaagcgtcaaagattcgccgctaattgggagctcagagttctaccacttccagcatgccgaggacctgctcgaacaccaccggttcagcaccagctccctcatcgaagacttccccatgagcctggacgccgcgttcccgggccccgacaagaagccccggaggtggcgcaaggcgtggagcctctggggcctgatacaccgccgcgccgccggccgcaggggcggcgcgtccgacgtcgcggacagggccttctcggagccgtggccggagctgcgcgtccgcgggtgcaacgccaggatgcagcggtgcaacagcaacgccagcgcgcggagctctttcagcagcaacagcggcggcctcggcagctcgaggcgcagctacgtcgacggcaacggcaacgtcgtcaagcggcggcgggaggagtgcgccctggagcgcaaccgcagcgcgcgctactcgccggggcacgctgacaacggcatgctgcggttctacctcacgccgatgcggagcgccagcggccggcgcgccccggggctaccggccaaaggcggccggcaactgaggtcgcaatcgttcgcgcgtagcatgctccggctgtactgagttgtgtttttcgttgcagcagtagtggaggctcaatggcaatggtataaccataaatctttttttacatccttgtgtagcgcagtgttaattccgttcatttggggggttggattggatagaatggaggtttatctcataatcacctcttaatatcttgtcttgtgccgtagtatctggacaacgtactaactatcgataacgtgtagtagtagctgtagtaatgctgcaggccagaatggcagatcgaccgatgatcgggatcggaggatagaagctgcagctacagctatcctgcaaattctaaactggtgtccaagtcatggtgaagaggggtcctactagacagtgccgaattctgaattcgtttgacatggcgctgccttgccaagcggcagctgagcgctactactaggctcggccccggccgctaggctgcacctgaccgaccgatcccttcgcgaactgtagctgccgctgcctcggaaaccgttaaagtcgcgctcgtattccgctggtcccgccgtgccacacccccaagccccaagtgctgtgcgcgcgggcgcgcggcgtcggcgtcgtcgcgtcgcgtgttgcgttgcagctcgcggcgcgggtgtgtttgttctaccgttctactagcgtttggatttggtcggttggcttcacgacgctgcggggtgcgggccgtgcgccgcggcgggcgcgtgcgtgcgtgcgcacggggtttgttggggtccggcatctgtgggatctgtggggaggggagattctgatttggagggaggggaggacgtacgtggccatgaggccatgagggggggaggctcaagtaatcggcggtgtgccggatctaaggtcgatgtgtggggattatgattatcttatgcgtcgccggacatgtgcacgagaaaccacatgtttggcgaaggactcatcgaactggtactggaacacagttttttttttttttttttgagattgttaggaagggaaaccggagtttgcattgtaagcgttgaatggttgccataacttgtaccatgtcatttctttttcagtttatttacacgatccgcttggaagcaagctttctctcgccccccacaaacccttaatcaatgttataacgacgctgtcgtctctaagactctgtaacctttttttttatctatcaatgaaaagttcaggtgggaaaactctcctttccagtgttttatcaaaacaaatagtttatttacacgaaacatctatgcacacattcctcgcaaaaaaaaaaaaggatgtatacacacattcactagtatgcctgttaatacatggttaaaacgagaagatcagcaacaaatatctggcctttgtcgctgaactcttcaatatttctctaccggcgtgggagttatatttaaccaaggacctaagaggcgaaccaattagctagtgatcagctaaatggggatgcaagtgaacaatcgcactattagagtgaaaacagacaggtacaatcatattatgatattctcatatcttaacatatattttcctttaaaatcagagccagagccagatacgaatagtactagataacatatcactcatcccgtattctattcagtattatttccttcgaatcggattcaggacaattatctatttgtatctctagtttatatatatataaatataagaggcaattatagtgttagaagatatacaataaaggaaaaaaatatacaatattacatgtgagctcgtaaaatagtgattaaccaatattttatcatgtttgtaggtggatttataatagacttttatatatgttttataatataggacatacggacacggctacaagtctttcatattctaacccatatttttcatggatggatattatcgagtatctctttttctcccatatttttctcgcaagtctcggatcgggtgagtggctgagaaatacacgcctcattttcaacccaacacattatccataaaaacttgcttaataatttatttagtacaaagtttgaattttttttgactaggatgtgttatgcaaggaaaaaaaggttgcccaccctacttgcgttcttacaaccagatggttagaaagagaatgtgtcggaggtgaggtaaaaggtgtattttttgaagactttttgtcggctgctgcttataaggtaaagatatgtctgaagcgagaaaaataattttaggataagatttacatagtttttctctctcaagttttagccatccaaaagccaaagctaagtaatatttttttaaaaaaaactattatcaaattgtcgacgagtggtacttgtggaccggatgagttgggtattgaggtacgttagaacgaggatctacataatacgatatcaagcagacaaaatacaaggtttatactggtttaggccccttgtcaggtaatagccatagtccagtttatatgagattgatgatgaggaaccacagattacaaaggaagtaaacaaaacagatgataccgacaagatcgtagtcgatgaattcgacgagatctcccggcgacttggctccgcgtactctggcttcgtgaactatggtgggtgtgtatgcaatgaaattcgatgccttgcacccctccctaggggtcccttttataccacggatcatcttgacccccaattaaggcctggagatatttgatctggtacggtataacataatctctatcccttccaagtaggattttggaaatcacttatctcgtagagatatttccgtaatttgcaacagattccaacgacgtatacggaaacaatccatatacgtgaaagtataccttatcggtatattccataagtcgtaggataggaggcatgttttatccgtaaccctgacacaaattaaactacaaatttagaagttggttagttcaaaaaaaaaacatccggtctggagagggagttgtggaggagaaagagaggcgaaatgggttagagttatcaactgtggaatagaggcagcagctcatctccgtcatcagggagtccaaatctagcaaaacctggtctcgtagctaagcccgtcaccctagttgtcttccacagctcgtagccaaatctagccaaaaagaggagatgaagaggtagtatctcgaccaagcagtatcccttgagcttgcgagtcaccgagccattcttggtcgtccctcacttcgttatcatgcttcttcaacaagcacctatgcacgagggagagctggagacgaagatcattaaggatccgtcatgatttgaggttgtttggaacctctttgttgcaccaaaccacttgtcgctatcggggttatccggaggagcttgccgtgcggcagccagccaacagcagctacattgctgcaaccagccagcagaagatacatatgttgcaaccagccaagacattagcaagatacattgtttcctcgaatccgtccgctgctggcctgctgcaatctaacggttggcctgcgcagccgcaacccagggcggtaaagcagctccacctaataaccctatcgtagagtctggatttagactaaggtgtagatctggctaagtttgtgttgctcaccgttgtctagatctgagatatatatacggtggatcaactcatcaacccttaggttagtctccttccccctatctctatctcatctcgttgtcctcttctcccattttaaattcatgcctcactatttctcgtgttaccgcactatgttagttcttatattttgggataaattttaaatgatagatgtagctatatattttggtatgtagggagcatttcacgacacctaaacttttaaattaatgatatgttgttctctttacatttgactttaaaatgtaattagcggtggaaaaacttgaagctcgtgattcggatcgacttaatcttgtagtcataattagtcgaaccgaacgggcttttagctcatgagtttatcaagtcagttcgcgagctgctcatttaggttgttagcataaatatcacaatatctaattatactttgtgccgtttagccagtgcttaatctttagcgacatcaaatcaattttatgttcacatacgtataaatttaaaattatagaagtggtataaacaagatgattttttttttgccgggaacaagatgaaggttgttaactacttcctctgttccacaaaaactcaaccttctagtaaaatgaatgtagacaaagagatacccaggttcattgcactagaaggggtcacatcccctcgtaggtttagtttttttgaatggagagagtagtctactcgcgagtcgggctgaatttttaatcgttaaggtcaatgagctaagttaaacccaaatgagcctaatcttgattcgttaagggggtgtttgggtganaggtnctatnacccanacacccctaaacattcctacatggtcatcagtcatggacagttggagttggacacaaggcgattctttccgagagcgaagcgagagtccatcgacagggctataccacggcggaatgaatacgatgagacttgattgggcattcagatgtgtacgtgatggcgagtgaagtggcagcgcagcgcaggcgggccagctagcgcctctgatacccccgctgttaactctcgcattcattgctctggctgccgcagtgaaggcgaacacatacgagcgaatatatggtgatgctggcttatcgcatcgacgttcctttgcgtgactcttcgctcgttgtctcatctcatcttctcatggagagagccatctacatccattccattccatggacttctcctgttaacagttagtaggcaaccgaactgacccgactgttagtatacgtgaagtagtgagactcgcgtggcataacgtacaacatgttgggtttcggctgttctacgtgggccgtgcagtcagtcacacgtagtactactctctcggctgtggatatactccactgtggtgcggtgaacaagaacagagatccacggaacaagtgcacggtgcacggaaggcgctgtactgtacagtttgtcacctccgagttccaacccgtttccattacggcgaactgtttcggtcttttccgtccggcgagtacttggatccatggttcagacgcagtaatcaactgccagatggtagtaacagtagtactactagtagtacctgtctcagtgctggggagcgggaaaaagaacgcacagattcgtctgaaaaacatgctcgtctgaatttttactgttgcctacccaagactgaatatttgttcatctccttgcggtagaggccgtgttcgacgtcgtcggcgttgttgacgacgaccgcgccgacctctccccgattgcgtgccgtgccatggccgtcggacatgtcgggggcatgctctctgctgatctctctaccaagatcaccggccgccatgcaccgtcgcgatgaaccatgtagatcttggagcagaagagggaacattgaagcagaacaagtagcatgaactatctgcagggtcagcattggcctggttagagttgactgcggaacaatccccaggggagcacaaaatcgttctccaaggagcgttgctcccatccagcaacttgtaccggcaggtactggtaccggcaggtatagagataaattcatccatccatgttagaagggtacgatcggtaaacagagaaaggagtcgcaccctcgctttctcctttttgttctttctctgtttcctccctccgtgcggcgccgctttctcatctaatctccttttttcccctccctccgagcgcaaccccacccgtgcgaagcccgcctgagccgcgcgcatgctcgccccgcatccatgcccccgcctgtgcgctcgcttgctcgccctgcatccgccgcccgcggcggcggaaccagcgagctccttcaccagcggcttcattcacacccttactcgaattgcagtgatcagtaaaatgatattgcagagaacaagcaacgattgagctcatcaaaacatccaataaatcgtacaatacaaatcctataagtaatgaagaagaagagcatatgcagcccagaaaataaaagtatctactgctgcaaccaaccgaagctaatgatttagatcggatgaaaagaaatcaatgcatacactgcacatcgcctgctaagatgactccatgaccacctcgccgctgcagccgccacaacgccggctccgacgaccacctcgtcaccatggccggcaccatcgcgcctgtcaccacctcgcagccaaggctgcccacacaccagccgccgccgctacctcgtgaccgcggccaccaccaggccaccgccgcgcccaccaccagcagcaccaggccactgccgcgcccgccaccactgcacccaacacaacctcgccgcaacgaaccacttgccgccaccgccgccgccgccacctccgcctcaaacggatcagacgccgccgcctcaaatggatcagccgccgccacgccgcctcctcccacgaagcaagttgccgccgacgaagcaacttgccgctgccacgctgcctcctcccacaaagcaagttgccgccgccgacgaagcacgaagcaactcgccgctgcctcccctgaacactcctacgcgaaaaagacaaatttacccttccaccactcgaaattttttggtacctcctcatgggcaaatttgtacctagaggtaccacttattttccaccgtccgatttcgctgattgaatggctgggatttggtaccggacagtcccgatggtacctgctggatgggagcaaaactcttctaagtggttttcttgctttgtctgaaaatgctctctctttcgtgccaaaaatgtagtattgacgtaaaaatgacaagtcagattgatcatagcatagttgagttagccatggaaaactgttcttcaggccatgctgccatgttagaacacctgtaaggattttcttcgaagctacgtaaggctgatcccatgtatgagtgatcgcagtgagacagttcttcaaatcatttcagacttcacgttttcatcacagcgagagtgccagtgacttggggtttttgttcatgccttcacagaatcacatttcctccggtgtaacgcaacgtcgcaacgagtgcttcgccttggttggtgtagttgcggacgagtaaagacggaatgcattttaaaatagacatactctaacgattatggataacagtatgtctgataaatgtacaacaattaatagtatgcccttaacaggtgtcaaatactaaaaatttagtactactagagtattaaattttggtaggagacgtaaatgaatacaggtgttcagaccccttacacctgttctgaagtgaatcgtgagaaaattcatcattccaaaccgggtcgtcaactatttcgatgagagaattgatcagcatatgtgagcgctagagcttgttaccttgagtgggctttcaacaagatatatatatagaaaaaataacaatcgcggtcgttcgagttacccccctcaactctaataccagttatttttaactctaaactttataaaccggatgaattaccccctatgtcgatccagggcagttttgatcctacgtggatgcatacatggcactccagtcagcaaaacaaataaaaaagatatgggacccgcttgtcagccaaaaacaaataaaacatggtgggacccacctctctctttcccctttcccttcctctcaatctctctctctctctctcagatgtcaccgggagcggcgactaggtggccggcgatgggcgaggcgggcggcaggcatggcggagagcgggcgacgggcgcggcgggggcgggtgtggcaagagcgcggcgtcgcggcgaagggagtcgcactcgaggcggagggcgtcctggcgggagcggagggcggtgtcggtggccgcgtccatgacggcgacgcacgagatggagctgcacaggagggccgcggccgccgctcatccctttcccctctccttctcttccgattccctatcctttccagtgcagcgacggtggtcgggctgagaaggcggcgacggcggtctgggcaaagaaggcggcggcgtcggcggtggttcgggcagctgcatgtacatgaggcaggcaggcaggtagcaagtaaggtgttgatgagagagaagaagaagagcatatcatgcaactaggagtaggtaggacgggcagccggctgctcctcgtctttgtagtagttgcaggtgatgaagacgccgccgttgaagcactcggcgagggcgcagccgatcctggtgaagttgagcctaactatgaagacgaagtggccgcacttgtggaagtcgacgccggcggtgcagttgccggtgtccctgtcgtacaagtgctcctcgtacaagtgccgcttaggcaatctctgcctccgccgccggactcccaggcaactgaggcaagctccgcctccgccgctggccacgcgggcgatctccgcctccgcagccggacttccggacgagctccgcctctgccgccggtcgtccgagagtgtgtgcctcctccgttaccagccgtccgagcgcgtgtgcgagacagagagagagaggattgggttgatgaagggttatgacaggtaggccccaacggttactttttttctgactggattgccacgttgacgcaacgtgtacaagttgaagtcaaaaccggtcaaaaacagtgtgaggggggttatatgtctggtatgaatagttgagggtgtaatatgtctggttttatggtttaagggggggggggtaattcatactgtcgcaattgttcagggggtaactcttactttttccatatatatatgaaaaactcctctctgggctcttcaagcaaaaatggcccaatgggcaatgcccaatatggtgttttcttgtgttgtaatatggacttggctatggcaagtctgaccagtttgccattggtactctctctaaaaaaaaaaaaaacttggccattggcatattaaaaccttatcttgtgttgtacacttgtactatgattcagtgaagaatactagcacagtagcaccactatctttctcaaacctccgacgaatgcattcgaaaatttttgcaatggactattccttccgttctgaaataaatcaatttagagttggatgggatactatctaactttatattttaattctagattgatttattttagaacgaatggtgtataatgcgatgctctgggttatggtacctttattgcgtcgttaactcgttatcttgaattatccatcacatctgcgtcggctggtgacgtgcttttaatcatgcaaatactaaattatccatgatcatgtacgaaccacaggaaaaagaaatagctctctctatctacaaatataagcactcttgtctcaactaatatggtctagtggcatatctagtggatgtgcgtaatccaactaacatagaaatacttaaaacaacctaagtacataattgatcatgagcttctttcctttttcgcatacttctcttctcaggttttttttcttttttctttacatgcatgggtcttgggctaggtttttttcttccaccgcctaactagccactcagacacgctttgcgcgactataagcactgacataacctgtttgtattattagcgggccatcgagaagagcttgtggttctcttcacaagtggtttcaatagatgggaattagaccagaccttgccgatgtgcgctctagaaaggatgtattgttgtcccacgccagctcatcatatgtggggcagctatgacacaaaatccccaaataaaatcaagtactacctccgtcccaaaataagtatagccgtaaatatctgtgcacaacgtttgaccgtctgtcttatataaaaaatttataaaaaatttaaaaatatttagtcacacataaattactatttatgttttatcatctcatagcaataaaaatactaatcataaaaaattttcaaataagacgaacggtcaaactttgaacgtgaatagtgcaaaactgcacttattttgggacggagggagtagtagtatggctgtgtttagttccaccggtaaaaaaaattgccaggtcacatcagatatacggatacacatttaaagtattaaacgtagactaataacaaaacaaattatataatccgcatgtaaactgcgagacaaatttattaaccctaattaatctgtcattagtaaatgtttactatagcactacattttttagatcatggcgcattaaggcttaaatgattcgtctcgcaatttacactcaaactgtgtaattatttttttttaatatttaatactccgttatatatgttcaaacgttcgatgttgcacaatatgctctgagcacatgctatggcctgtcgctagatagtacagtagtttattggaaatagcacaagttcagaaaaagattatagaccggaagcctgctagagacctctagaggaaaaaaaatcagatggtacggttttgtttgatgacatggcgtaatacgtagtaatttataggtaaattttgctatcggacatcgtaattgtgtggttttagctcagggtctctgaaagtaaagttttgggggaagacatcccataaccgtggacatttgcctatggacaccgtgccatctgtcgtgctgacgtggcggacgggaggcccttttttaatgtggtcggacgtaaatacccctgcgcaagagataataaggttatgtggggcccacttgatagtgtccccctcctcttctttttcttctctctcggcttcttctcctctcgatctctccctctcgtttccctttttccccacgcgcgtgcgcgcctgagcgggatggcaggcgcgcgagccaagagaccggccgtagcggcgcgggccgaggcgacggcggcggcctgacggcgtcgggtggatggggaggcagcgtggcggacggcgacagcatcgggtgacgccggtggcgaacaagccgccgagcaaggccatgggcgacgccgccgtgacgaaggcggacacaggcggcacgtcgcggagtgtgcgccagtcggcactgttgcacttgaagcctgagccgaagccgatctgccagacacggtggccgcgatggacgcgccccttggcctcggcgtaggcaagctcataccagagcgagccgctgctggtgttaattgcatattaggctcaacatcccatgttaattgcacatgcggcataggcacattaggctctctctttgatttcctgcatcaatcaagctaggcttggttaattaatcaactcgcagattattgtatatcactcatcattgtttgtactagatcaaacacttttgtgcgtgcggttacctcgatggcgggagcaagagcaatggcaggcggcggcggcggcgcgagccagatgcagccgccgtcttcgctccaccactcggctaccgcccgaggcagcagctccacttccgccgacaggcgtcgtgcgggccggcttggccgcgcgcggggtcggcgctcgcagcgtggtggtggccccgagcaagacgaagatggcggcggtccgggtggcgattcgtccgggcggagatggaggtcggaggtgctgacaatcgtggtggcgaagcagcagtggcgcgcgggtggtgctcgcgcgggagatgtggccgcgcgtggcggcagcggccaagcgtggcgacggcttggcgcggcggcggagaggtgaaagaggtagttggcggcggtggggagtggcctgacgagaggacttttttttttctgacgtggcataagggtatttacatccgaccacgtcaaaaactggacttccgtccgccacgtcagcacaacaagtatcctttagacgatacagtgtccatcagcaaatatccacgattatgggatgtcttccctcaaaacttcactttcacggtgtccctgagcttaaaccacaaaattgtgatgttctgtagcaaaatttgcctaatttataagaaagctcgctgttttcactattttagatatgctactaatatggtcttccatacactcctttgaccatgactaaatgtaaaattgaattatttcaaataaaataatatcagcatattatgatagtttgtttaacgataaatctatcaacatcatttctatgtcattggttgttatgattttttttctttcaataggtaaagttaaaaatatttgtattattattattctaaaagtgcttatatttatacatagagagagtatctaaaacaatataaacaatataggagtatatgacaaaccccgaggttacgaaatacgaacatacttgaaagtcatgccctaatcgttgaacttctttttgcattataatataaaacgtgatcttacctgagcgtgaaatttgccatgtaatcccaatatccttatgaaatagattcatgtgagacgtgtacagactccacagaattagagtagtacgccagaaacagaaaatgccaaaaagaacaaacgctttagaccggcatcggaggtagcaagatctgtttgcaactttgcactgcgacatgatcgcggtggcagaccaacaagatgccaatctatattctctccgtccttataatcgttgatttttgtttctataacgtttaatcatcatatatcatatttaaaaatgtagtataaagtatgacttaagataatagtttcttcaataataaatcaagtcacaacataataaataatatttatgtaacttttaataaaacgaagggtaaaatcgacaccatcatacgtttatagagggaatatttatctttttatatattttcttagtctcataaaaaaaaagtaaattccggctatgaatttagacataggttacatctaaatttatggctagatgttgattttttataacacggggaagtacatgtcttgtcttggttatatctaaaaatttatggctagatattgattttttatgagacagaggaagtaactgtctttgtctttggttacatctaaaaatttatggctggatattgatttttctatgagacgaaggaagtaccctgtcttgtctaaaggcaatttgactgtgttcggatgtccctttttccaaccctccctcccttatttttcgtgcgcacgcttttcaaactactaaacggtgtattttttaaaaaagtttatatacgaaagttgctttaaaaaaataaattaattcattttttaaaaaaagtagctaatacttaattaatcacgtattaattaatgaatcgcgctattttccgtatgtaccgtagccggttggaaaccagcgtctgcgaacacaccctgaatgaaggaggactgggcggcggtcacaactccagagtccacaccaagcagccccccggcgcgctgctggtcgcacacgacaagggtgcgcgcgcgtgtatcaccggctgcactcggccagtccgccacctcctcctgacctccccactcagaaacgtaggtaagactaacaaagaccagtccaccacctggccggtcttacattctcagtttctcaccacggtcacgccgaacgaacgagacggcggtctcgctcgctcgctcgctcttcgttcggcctcggccgcgcgaggtaggtggcgcgactcggcgcggctcggctaccgatcgcgcgtccccgcaatccttgaccctttccaaatcccaccaacacgagccctcgttttaaatctactcgtgctacgcttacttgcttacacttgacgaaccaacctcactttctccccgtagctggctgggctgtggctcgctgctctctcatccgccacctaccgccaccaccttccccccacggtccagctcctcaccgtcgtcgttcgtcctcgccgagtcctaatttataccaacccatccaccgggcgatcacacgcacgcacgcacatggtcgattggttagctctctttcccattgccatgggccgccgcctctgatccccctcgcctctcgctaccgagttgctggccattggttggttggtggatcgggtttgtctcgccggggcgcggggggggggggggggggggggcccatggcgtcaatcaggtcgtgcgtgtcggtgaagccggcggcggcggtgagcccggtcaagtacaaatccgcgagggtcggggcggccgggttggacccgaaaggcctgaggatatcttgctcttcgtcttcctcgtccttggccgcaggtggtggtgatgggtgcagggatgccgggtgcgccagtagcagcggcaggggcagcggtgtcgttggttcggttggcgatggttggtgggggaggaggggcgggcagcgggagcgggccgtcgccgccatgtgcagcgccggcatggagggggtccggcacggcgccgccgccgtggccagcgtgccggcggcgtcggcgtcggcgttgccggagcgggccaaggtggtggcgctggtggcggccgtgatgctgctctgcaacgccgaccgggtcgtcatgtccgtcgccgtcgtcccgttcgccgcgcagtacggctggtccagctccttcttgggcatcgtccaggtactcggttcggggtcttctttaccttcccagttcatgccatctctttcacttcacttcactattagtagcacatcgcacaggttccaattcatcgaaccttaggcaagaatctctgctctgtcactagcaacaaaatgtccaaaaccataattagttcatcatatagcaacaaagtcaacgaagcatcaacgtcacaatcgcgacaagagaatgaccggaacattacaattagtagcacaaacagacaattatggcagtccagggtattagctcctttctgtgtgcaggtccagtgcaaccgtgtagcaaccaagttatcttaatacgattgttttgagagtggaacctgaaatgaaatttgctatgtgcttcacacatgaatcgtgatgcagttttctatttataagatatatgcttagctttagtggcttccacatagatagtgtagggtaccaatttggaagaaaccaatctgtgcaggcataaaggtcagggagcaacttgaggtggtatcgaataccaatatctcctcatagtggcaatattggaatttgataactggaatactaaaacatgcaacccaactgagttaagcattgcccctcttttttggtgatggagttcagcacttcagatttacttggtgacagaacatgaatgtttcataacaaattaccagctagcttaaataccattgcaacatttgaagtcattcgataacaaaaaattgtttccctcaaataaagaacggcaaaagaatttgtgcatgcttattgtatatacacttgggcaacaatatgtcttgactagatggaggttcacataaagaagtcatcgtaaaaaccaatatgccgtaacactaccggttctatatgaaattgtcaatgtgcataactaactaggccagaacaaacacagcttgctcttttattattatgtcatgcgtgattaatgatttccagatggattgacttgaggttaatcttctcatcacctgtacagtcatcttttctttggggatatgttttctcatccatggttgggggagctttggcagaccgatatggagggaagaaggtgatggcaggtgctgctgccctctggtccttggccactttcctcactccatgggctgcttctcaatccacaattatgttgcttgccatacgtgctctctttggccttgcggaaggtgttgcatttccaacaatgagcactttcttaccaaagtaagttgctctatattattttctgtgatgccaattctagttgttagagattagagattctggacaagaatttattgatgcaatcaaacacaatctcatttcgggctttcaatctcactttgaacacaaaacaggtggttcccaacacatgaacgtgctactgctgttggcatttctatgggaggattccatcttggaaatgtcataagtttcttagcaacaccgatcatcatgtcacatataggcctcgccgggacatttgccttctttgcatcacttggttacttgtggctttctgtatggttgttcaatgttgaaagtgaccctcttgacagtcgtacaataagcaaatctgagctgcaattaatcctagccggaagaagtgcatcaaaaattcagggtagcaaattcccatccttacgagaaattctgtcgaagatcgaaatgtgggccatcattgtagctaatgtggtcaacaactgggtaagattgataaatcagttatctacaaattggtgttgacatatctatctaaattttaacttccgtgagttcgaaatactatgcagggctattttgtactactatcatggatgcctgtctactttaaaacggtatgttgtctaaggtgttcaaattggtcactgtgacaacgctgctattaagctaattcctgactgctatcctacaacaggtttataatgtcaacttaaaacaagcagcatggttcagtgccataccttgggcagtcatggctctgtctggttacgtcgcaggagcttctgcagatttcctgatcaaatctggtttctctgttgcattagttcggaagattatgcaggtaacagcaacacctgaaattagacttgtgcagcacttggaagttactgatagcttagcacagccagaaacataaaacttaccacaattttgttctctattcatgcttggtacagtccatcggttttatcgggccaggcgtttcactgctttgcttaagatttgcccagacgccatcagttgcagcagtcctcatgaccatcgccctgagcttgagttccttcagtcaagctggatacttctgtaatgtacaggtagtgtttcctgcattaccctgctcataccagattccgccttaactcgaacaacctttttttttcttcttgttcaccacctcaattgcaattgtaccctatctgacggaatgtgttcttcttgattgttcgagcaggacattgctcccaaatacgctggatctctgcacggtgagtccacaaactcgatcagctgtacacaagacccacaccaaatgaacgcactccttggatcctgaaatctgacatatcttcttctgcttgaacaggactgacgaacggcatcgggacagtggccgccatagttagcaccataggaacaggctacttcgtgcagtggctaggatccttccaggccttcctcaccctcacggcggtgctttacttcagcgccaccgtcttctacaacacctacgccacaggcgacctaatttttgactgagatgatgacattacccctcgtgtaaaatctcgaagtgtagtacttccaccattgtttctctcctagtcctatggctgagccaggaaaccaataaacagatgttgattgaaattgattgattgactgccatttttggtgtaaaattgagtgcaaccgcggttacttttgaggaagcaaatcgttaatacaggaaaaaggggtggagccgctcatacgcggttcaggtgttcgacgaaattaccgagccacgcgcgcggaaggaagcgccggggaggggcatggagcggcggtacccccatggcgcgcgcgcgcgcgcgggggggatgctggctcgccgccggtggcgccgcgatggaagacccgaagaggcgagcagccgactgcgcggcgtcggcggcgtcgcgcaaatccatggctgcgaatgcaacttttcggccgtggatgtggtatgtgtggtggggggcgcgtgcgtccgttgctctcgggtgagaaacgtgggccggtggattgagtgggattcttcgctttgggctatgtaggccaatccttcgtccggcccagctaaaatttggcctgtacacgtttggctattcaccggatcatcccatatcctcttggtatttcctagctcgaaatcagaatgaccataagctgacagaactttttatctggcaatgacccattttccatagacacacggaaaatatccttacagcaaagagaaaaaactgacagaactggtactctatccacttacacggttacaccaatcattcatgatactgagttttgagtatgaacagtgaagttgcatacgacaagttcacataaaacacgatgaagagcaggacagattcatgccttataaaccttgcagttgcagcgctttcatttctctacctttctctgagttcctccgatatacagaagtggctgctctatgtgctctttattctcttcagatgatttataaaaagattcatacagcagaagggaacccggtcaggactcaggagtcactcctgctaggcttgtttgaaactggaataacctggaaaaggaacacagtagattagtaagtcaccagatgaccatatgcaactcggtattggctagtccacatacatttttactgccataccgtctctgaggatggtatccaatcatttgttgcagggttgctcatgcagcggataatgctgtcagatgagtaggcaacggttgtcacgttgaaggagctaccattgggtctttccactttgataaaccctgtaccagtctgtaaagataacaattaactcaaccatttcatagagtattgtcgttttgttacagaatgcgcatggtggtgaaattagaatcgataatctgttgttcatggaaatgtattctatataaggtacacatgtttttttttttttgcgaggatataaggtacacatgttagtgcccctgatctgaatgatatgagccatcacatgtgacacaagaactccacatcagaactttggaattcctaacaatcatcaaccattagttctctttgcagggcctaaactatatttatgttttccatgccagtaccggagtgagcaatgaactgctagctagatacaagaggcttcggaaatgcacaagatattactggcaagtggcaacaaaatgcacggcaatgagtttaggtatgtaatggttagcatgtaagttgttttgagaggggaagactacactatacttaattttcatgacagactaaagactccagatttgtgtatgcattcgactagacagcagagtctattaagagaaatgcttgtgcaagaaggccagtgttccggaatcgcactgggaaccagaatcgacagatatacagcttatttgagcactttggttgcaatgacggttcgttgcaggcttgcagccagttataacattatttgatagtatttcaagggaaatgctatggtgctcaagtcttttttaaggttctcgtgcaaacaaactttcttctctaacgaatttatgactaacatgcgtcttctcggaaaattctagccattcaattgaagactaggtaacatgttatttatcgacaggtatttgatctcataaaacaaaaaggtcctgaaaaatattactaacaaattctttactggtatatcaaatttctctaaagaactagtatatgcccacatacccacatctacgtgctataaatttggtgcttggtaggcttcataggcagttaggcacaacaatactacaaagcttaccgtgtggtgttgcttgtcgatgcaattgagcccgttgtagtattgcgtctccacatactcctccccgttcacatccccaccgtccagcaccaacttctacagcaacagtcagtaccaattagtaccaaacagcacgctcacatcgatcgattcagcagcaacaaattaacaaaaccagaattccacaaggacgaacagatcgccaacctggggtttggcctcgaggtcgcggagcctccgaagctccggcaggtcggcgtcggcgtcggcctccgccccaccctccccggcgtccgacgggtcgctccgcggcggcttggaagggcgcctgggggccatgctgtcgaagtagccccgcacctcggcctccacccgcgccgcctcctccggcggcaggtgcgggtcgctgcgcgccggccgcgtcgtcgccatggcggctcagctcggtccaagactgggttggcgggcggtggagtcgccggtttccggggggcggttttgcgagcgcgaggatgtccggctgacaggtggggccctggtacgtgggcaaggtggcgatgccgtgaatgtggatgagatgagatggggacgtttgatcgcgattagctggggttgggccgggcgaggtggcccactgttccgtgagccgtgtgaccgcgacgcggcgtgatggattttgcgagacggcgaagtcgagaacagtaacaatcttcatgtgcccgtgcaaatctcgcgtgctagcgacttcccaattgtaggatgtgatgtgtttctatcattgttcaaagtacaagaaattttcctttattttccaagttctctgtttttcactggcattcatgtattcctttttgttcttttatttctgaaatcttacttgacaacatgatatacctttctaaattttagtttggtttacgtcccaaaggatttccaaccgaccaaacgaataccttcgcatgatatcgtgaaagggaaaagtccacttttaactctctcaaataaagatcgaatctaattcatgtatcatcaattgtaaaatcgagtgtaacagctatttcaactattaaaaccagtagaaaattactcctacgacaatattgagaataatattggttgacatggcatattgaccacagtcaaaaacaccgagtcaacaagaaaattgagaatactatatggagcccacatgtcatcctcactattctcctctgtcttcctccttcctctctcccccatctctctcttctccttttacgaaggtagttgttgatggcaaagaggtggatggggaatcggtgatggcccagtcccgcctaatgcgcccacaccactttggcatgtcgtcatctctactacgatagctggactccacaaaagcagcggtaactaacgaacctgtgataaattttgtggtcagtcacgcatccagagcttggcaagcccatgcaacatctttctgatataagtgtgcaggatggaggggcccaccgtatcccatatctaggaggggccggcgatgggggccgaggctgattgacctcccttcacgtcggtttccactgcagtcactagcctgtagcccagcagcctcctctcagaagccgcccacatctctttcttcctcctcttcctctctctgctatggtaagtgataaggcccatgagtcggagatggatcgagcaagggagggacccgaggctagtggttgcaacagggccggtattgtcgaaggggaggtaaagcggtggggcagcgcaaagaggaagatgcttttctgcgagcttgattgcaaaatccattggagaagggatgggcccccgcgagcatgagactgcatcatcgtcgcatagggtggcagccagcaggtcacggctgtagccacagatgatactaccaatgctggaggagaaggcagcatagaggctcatggggagagagcgatggcggcgacggaaccccgacgtggtcggaaggctatgctaggggccgctccccttccttctaccatgccttctccttcgctcctggcccgccaaagccgtcaaccaccattccccaatcgagctcgtcggcgtcatcgctatgtgcccatgtggggaaaggaaaagaggacaaaggaacataaaaggatgagaggagaagaaagagccggtgacactaacatgtgggcctcacatgctgactcaatcaattagacctagtcaataagtcacgtcaatgaaaaccactcttcaaactgctgagggagtcaaaccacaacggtttcgatagtttgtcaaaccactcttcaaaccgcaagatatacgatattgtgtttaggggcacgaattagattggaggtatactcgagggagctaaaatagacttttccatcatgaaaagccaggctaagaaatttgttaggtttccatcatgcgttagtttccagatccaaaataaagccgggcccaaaatatattcctcgatgcaatttgtcatggatcgcgattactgctagcgatatgggcctaccttgatcaagccaccaccgcgtgggttttagccgtcggagctgcgccgccgaatcccgccacacagcccatcatccatcagccccctgatgacgcagcgccgcccctcctgcggccgggcttccgcctccggcgagggccacgtgatgcgcgccttcgtccgtacgccctcgccgtcctcacatcgcatcgtcaaaagcttccgcaacatttcttaggctgtgtttagttcatgtcaaaattagaagtttggttgaaattggaacgatgtgacggaaaagttggaagtttgtgtgtagaaaagttttgatgtgatagaaaagttggaagtttgaagaaaaactttggatctaaacacggccctaattccattccttccaaatttacaagtaaggccgttcacaatgcaaggagctggcattcagcctgagtcctccacgtccgccagcacttaagattccatgccacatttcttgatggcccaccgaaatgaagagaacctgtgaacctgtgaccaaaacctgccactcggtctttgatgatatcaaggcaattgcagtgcgtggggctttgcctcgcctttgctctgcatggatttcgctatgtgactcttgtgtcttttgaaggtcttcatcctacttgtcagttcaggacgagcaaaatgcaaaacgcattgctattgcccttaacaagctacaaattggtagagggggacggtcttagtccttatagattacatcaattggtgtgtaaactacaaagtacaatcttttaatgtgtattcccatcataatctctgcttgtgatttttagaatcgctgtcagcgacacgctcaatacacaccgaaggctttagctgaagatgacacttcacctgtgcgatctacatcttacgtgatgtggcacggaggaacatagctgccgccacaagtgttcagacatcacagaacgctttttctggagtaaatgagaattatacttctactactaggtgtcagtcgctcagaattcagaaacatatcaagaatcaaagatgctgttaggtgcccggtggaacggacgcaggtatgcgtcatttctataagacatgatccctccatcccaactgcacagatcagacaagttgattggtaaatacatatagtgagaactgaacgctgaaagagagttgtaaaattacaccacattggaaaatacaagttgattggtggtgtaattttttttcgttttttcctagctacgacccttcagagttgtaatcttatgattttttttgttttatccatagaacttcgcaccgtttcgtgcgagtcgttcgaaaaaaaagctgaaagagagttgtaaagctccagccagcagggccaagtgttcatatgttccatgtttctgtaagtagccagcctaagattttctcaggtgatctcaccgagcttgaaaattctgcagatggtgatttctgcagccatgaatgattcttaagccttttgcacatcatctttccctctccctgctacgtgctggtttggaaacctttgcgacctcatataacaaagagcagccacaagctttggagaaacctttatgagacctttcagctcaacaatccatattgatctcacagcgtgcagtttcggggtgcggaaaagcgacaggtatagcatccctgattggtgtgtagtgggatgaatcacgctaaaatcagttcattcctcctaccgataatgggcgacgcactgatgaggtgcagaataatacaagattgggcgtcggagatagcctataaaccactctatggatttgacacgcaggcatgtgtgcacatgatccgttggggctaagatcaaggaacacatcaagaagcaagctctttgaccggtgatgtatttcttatacgggagttaagctagtatcactctctaagtatgaatcactgtactgtattaataattcactggcgtatagtagtgctttagatagttagatgatgatctgacaggcaatttgcttgtccatgggcatgagttgggctgagctaagtgtgatgtgagcaaatgtcaacatctgacgatggccgatctcatcttcattcatactctttaatttagtcatgcaaaactgataaaaagagagacaaatcgttcctcgtcactcacttattggaattgatcaagagcaccgttgacaccaaactagtccacaaatttgtatgctcttttttttttccttcatgctgtggcctcaaaagtcatctttttttttttccttttcgtggtcgcgcgcgagttatgattgcattttattcagaaggggtcctaatgagtctggacgtaagagggcggttgcagaggccacttgttgttttgtgtaataaaatttgtgattaggacgtgggggagtttggattagaaacatgtactccctccctgccccatattatatactccctcagtcccaaaataaatccaatcctaaagattcgtatttagaattaaatttattttgagacgggagagtataagttattttggtttataagttaactttgtttaagtttgattaaatttataaaaaatgtgataacgtctacaatataaaatagatatagtactccatttgttacaaattacttgtcgttctaggtttgttctaaattaaatattttaatctttgaccatcaatcttcataagctcatatagtttaattttataagaattacatttttttattatatacttcacatgttattaaactacatagatttctaaaaagtaataatcaaagaaaaatatgtttgacttaagatatacacggaacaataagtaatttgaaaacaatgctgtggagattatgggtaccccatacccacacggcatggttatccgactagttataggggataacttatatatatgtaatatgtaacagatcatgacttgggtgttacgtttccttgtatattacggaacggcctaaagtcctgatctaggaaaccgataccgtattggttaaggtttctatcttgtaatcctgccccccatcctatataaggtgggcaggaggccctctagggggcatatatgagacaacctgatcgtcagatcaatacacactcggcggattcaaatccctaaacaggagtagggtattacctctcattgagagggcctgaacctgtctaaatcctttgtctccacatccatccacttttaggtctcgtgcgctaccccgtttcattattgccgaattcatgtttcgacagttggcgcgccaggtaggggttgcgtcgagttttctatcgacgagtgcgatggaatcaactccacgagtcgccggtattatcttcgcttctgtatcgtgagatccgccgccgtcgacaccacccgccgatcaaatcaatctacagagagattcaatctactatggctgccaccagcttcacttctgtcttccccaggatctttctggacttcatcgctgccgccgaaaatccgaccagccccaattagtcggctaagagatcatacgtggcatagcaatcaacagcgagatacaagactggacagctatggagttttttcttttctcaagatcagccgtggagatacatgcatgaatatgattgaacagcatacaccggagagccacacatgttttgatcggtcttatatcaatctaaccgtacatgtttcctgctttatcgctttggttcttgccacatacaagaccatgtcgatctcgtttggtcgccgttgtattcatcagtttcgtcaaaaaggttgccgtactgccgcagtcatcatctgtatcaatctactcagcgatgcagatcggttcccagctgccaacgcctcttgccgactgatatcaaattatctggcaagattgaattactagttcaaagcggaatcgacatggacacagagacagcgtcattagcaactacacgtggcatagcaatcaaccaggaagtaatgatctacacatgtgtgctcctgatcgtgcatgaattgggccaccgctgcgcactccaaaaccggccgtgggacaacatacgtgcatcaagataaactactatcaggtttatcgttttaaattttcttatgtgaaatagattaattaacagatcactaattattatttgatctattgttttaacgcacgtaccgccggccgccctcgtcgctgccgattggattacacgcctccacggttggtgtgcaccgtcgccgttgctgatggcgacatcctcttcaccgccggcctgcctccgtcgccgccgagtggtgcctccgcctacacggctggtctattatgccgccgctgttgggcgtctacgacttcaccgccggcctgcctccgtcgccgccgattggtgcctctgcctacacggctggtctattatgccgccgctgttgggcgtccacgacttcaccgccggcctgcctccgtcgccgccgagtggtgcctccgcctacacggctggcctattatgccgccgctgttgggcgtccacgacttcaccgccggcctgcctccgtcgccgccgagtggtgcctccgcctacacggctggtctattatgccgccgctgttgggcgtctacgacttcaccgccggcctgcctccgtcgccgccgagtggtgtcttcattgttattgatggacgactttgttcccacattggccacttctgccatcaccaaggggaatattacaaagctaagtcatcatttattttattctttatatgatatttttccttttcctctgcctcactacaccaattggtcctccattgagtagtgagtcgggggctacagatattatatcatattttttataatatttatcttgattgcttgcgacatattctgagtacaaaagtgcctatcgagttatggagttccatcttcctatgctttccgtttggtttgccaatggatagttgcctttaggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagcgtttaaacgtaataagtcatctgctcggggaaatcaaacttgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggctcgcctcgaccgccgccgactggtgtttccgcctgcacggctggcctattatgccgccgttgttgggcatctacgtcttcaccgaccggcttgccttcgccaccgccgactggtgtttccgcctgcacggctggcctttatgccgccgttgttgggcgtctacgtcttcaccgaccggcttgccttcgccgccgccgactggtgtttccgcctgcacggctggcctttatgccgctgttgttgggcgtccacgtcttcaccgaccggcttgccttcgccgccgccaactggtgtttccgcctgcacggctggcctattatgccgccgttgttgggcgtctacgtcttcaccgaccggcttgccttcgccgccgccgactggtgtttccgcctgcacggctggcctattatgccgccgttgttgggcgtctacgtcttcaccgaccggccgcctcgtccgccgccgactggtgtttccgcctgcacggctggcctattatgccgccgttgttgggcgtctacgtcttcaccgaccggccgccgcatccgccgctgactggtgtcccgcctgcacggctggcctgttataacgccgactgatgctatcttcttcacggctggctacatcgcagtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcatcttccgtcgccgactgattatgccgccgccgactgagcgacttcatctttattatcttcggcactggcaaactctattgctgctacttcgcaagttttgctacttcaccaaccacgacgtatttgtgagcctcgacatctcggcatgcgatgccatgttattttactacaacaagaggctctccaatattcatgatttctacttggacatcttcaacacatatcttcaatcaagcaataactattcgacgacaagaggctacagttttcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcaaacattctacttcaacggttgacctactatgcaaatgctgatgagcgtctttgtcattatcattggttgctacattgctattggctggatcaccgacatcgtcatcttcatcatgtcggttgcgtttgtcgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttctatgctcaaagactggactatttattattccccgtaagggttatcaaccgaatacttgcgccagtcgggattcaatttttatatctattttggagtatcccataagggataatcactcagatcagaagctattcatatgagctacgcttggtctatattacccggaagatttattactcgggagcatgttacatgtgtcatcctttaaagggtgtcgagggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcatcgcttttcgccacgtaagtgtgcatttttattgaccaatattatgacttaggctaattatatattgtggccattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttgaaaatttctttattcacaatatacaagcttctttatagctattttgctatatcactcatcatattttacaaagcagttggtatatcactcggatcatgttatttggaggattcacaccgcatatgctatatattgatatcaagtcacttggttgagtacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggagattatgggtaccccatacccacacggcatggttatccgactagttataggggataacttatatatatgtaatatgtaacagatcatgacttgggtgttacgtttccttgtatattacggaacggcctaaagtcctgatctaggaaaccgataccgtattggttaaggtttctatcttgtaatcctgccccccatcctatataaggtgggcaggaggccctctagggggcatatataagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgtttcattattgccgaattcatgtttcgacaaatgcctaaatatatttaatgttggatttaataaaactaatttggtattgtaaatacattttttataaacttggttaaatttgataaggttaggagcctcttctacagtaattttcttttaagaaaatttaaaagtttgattcaggacaaattaaaatgacttataatatatgaagcggactgggtagcatttcttaattttatctctagaacggaactaacttttcactaatctgccagtatacctctcaacagacttatttttccactccactgtagcacaaagctggtacgggcaaaccgatataaaattaacctgcaagcaagatggcgtgaaacatattctggaaaggaaaaagtagagagcgagtattagtattttgttgcggagaaagacgacaagaacaacacgataatcttgtctgagatagccgccacagcttagtggtgcattgcacactaggctctaggtgattaagtggtgtccttttgctttctgatgttgggtgagtgtgtgtgtgtatggagggggggagccggatcgagctgcgttgtgtgctccattatcccggcgcatgcgaccatccataccctgaaaccgacctgtggcccgacggagagtgacccatacttgaccatgcccgacccactatctatttctttctctgtgtggatgttcgatggtcggcttataaaccaaagcgaaatttaaattttaaattaatatttttagtcttatttttaacagattaagaatataaatataaaagttgtaccataaaatcatcatttctagttgtttcgtttattttccacctcttgtttattgttgtcactgctggagaaaccatcttcactcccggttcgcagcccctcacaaattcacaaaaacctcatagatcatatcgccaccacccactaccgaatcgcgtgcggctcgctgcctgtggcctgccagtgacgcgcctcctcccgctaacgcccacgacgcgcctcctcccgctgacgcccgcgacgcgcctcctcccgccgacgctgccgacctgcctcctcatgccgccacacctccacttgccgccgcacctccacctgccgccgacgacgctggcggccagcctccgcccgccgccgcccgtggcctgcctcctcccgccagccgcgcctccaccaccgctgccgacgcggctccgccctcctctagccaccgctgatgcccgtggccagcctcctcccgccgacgcgcctccgcccgacgcccgctgacggagagagctggtaaagggaggaaggatctgaggagagggggggatgtcacctcggagagggctgggaaggggaggaggctgggatctagaggagggaggaggaggacgaagagataaaagactaaggatgggagcgcgaggagataaggatgaaggaggagaggaggcgcatgcggcagcgttttttttttcaatctttggtcccggttggtataaacaacttggtactaaaaatagtgaggggcctgacacaacttgacaacatgttgaaccgggactaaaaatgatctttagtcctggttggtaacataaagtgtcgtgccgcttttgaaccggggctaaaaatgtttttttgtcccagttcctattcgaaccgggactattgtggattttgcaccacctagcaaagatcagtttttcagtagtgtgtgtttaccttttcgattaagcgccagatcactaccctcggcagtatgcgggttttcataaatgtttatcaaaatttgacatatttcgatcaaaatttggtcaattttaatgttttatatttgagttctcaaaaactattcggaatttcacccggagtatactttcttggggtatcgaaacatcaaaatttcgcgattttcggtcagttttcataaaaatgtgaacatgattattgctcaaccaatgagatatagtttgtgtagtccattgctacatcacattctggtgtttatacgagagttacgatgactatgtatgtgtacatgtacgatagtctcgtgctctcacttaacacgttcagcgcacaaacacaacattattgttcctacatagatcacgcatgcgtacgttcaatctgtttgtgatatatatatgcatctaaaagaaagtgagccattatcacgagatctgcatatatacatgttagtatattgctccgtacgatagtcattggtgcgtgtcaacttcggttttgatcgctcgacgagtcgatgataggcatcaatgcgactttcaggtcccacgccgtggaacattgcctcttacaccaacccgatcaatcatcaatcaaggccagcaattaaccccaaccgaaccctgcaccgtagaacctatcttgccatctgtacacaacatgtacacaagctcacgctcgaatgttcgatatatccctttcggcttaattaattacacgcgtcgcattaaccactcagatgatgaccaggttaaccatctgttattagttaatttaccggacaaacactacttagaaaaaacattttttacagacggccaaaagtaatttttccaggtagggaaaggaccgcctgcagatcaacgactacgaaaatcattcatttttataggcggcccaatggcccgtatgtaaaaatcctctagacgaaaaaaaaattgcgcccagccagccccgcacctcgccgccgccgctctcccccggccttcctccggccagatttgtaaggagaggggaggggagccgcaccggagccaccgtcgccgccccacgcggcatcgtcttcgccccgcgcctcgttgacgctgccctccccgggcctccctccggccggatctgggaggggaggggaggggagccccgccgttgccgccgtcgccgccgccgccccgcgcgtcatcgtcgccaccccgtgccccgcgcctcgccgccgccgccctcctccggccggatctgggaggggaggggaggggagccgcaccggagccgccgccgccggcgccctgcgtcgtggccggccccgcgcctcgcctcgccaccactacccttccccgacctccctccggccggatttgggaggggaggggagccgcgctgagagccaccatcccgcgcgtcgtcgttgccgccctgtgcctcgcctcgccgccgctgccctccccggcctccctctggccagacctgggaggggaggggagggaggaggaggggcccggtggggagaggagaagaagtgttgagggaggagagagagttacgagggaaatgagtggtggaggggtggcaggagaagataagagttaagtggtccgtctgcgaaaatcattttcgcaagcgccgcttaagtgatccgcagcgaacttcaccccaatttaaatttttataggtggttatttggctaaagggttatgtccgcctgcgaaaaaaagatcctatgtcaggaaaagtgatttttttagtagtgaaaccaaatggcaaaaatatacctgttcgggagggttttaaatcattaaatctaactctaaaaacggagtatggaacggacatatgaagcagcctaaattaaccgtgttgaatcggttccactctttcatatcactttagcccttcgttttctgggtgaagtttaaatcatttgattggactttaagaagagatgaatctagagctagcggccggagcctgtcaaacatgccttaattataactctcataatctaatattgcgctggttaattaagctggtgttactttctcacttgttacacgggacccatccgtggatgtgattagctgtagagccatgctgtgggctgtggcatggtaatgatggtacgaaagccaaggcggtgccaagtcaactactagctgcttctagtgtagctttggcacgtacatacaacggcaaagtcagcttgtatatatacacggcgcgtggcaaccgtagatgccagtagagagagcacgaaaaattccagaagaagaagcgtacgctgctatacaaaaggggccttcacgagaccacgagtttcaaacatgaatttaaaaattccagctctgctgtatgcttcaaatgtcaacgacttgcacgagttgaatcaacggcaattaaacaatttaatcgcacgtttcttgaaccattatgttttgcctatttcaagtcactactacataaacctagataggtaaaactagataggggtcgaatttttcaaccgacacatagaaagcataacatattagaaaaatcaaaggtgctggttacagaaccgacacctttaaggtccaaaaaaaagaaaaaagcggcttaatgcatgggctcgaatcgagccgatgcatcgagcagctccccttcacccgatttcacccaacatttaattcatacaatcaattggcatcaagaattcaagaacattgatccaagaacttcaacaacatcaacacaaacacaaaacacagagaagatggagaggatggacgacggcctccgtgaagaggatggagtggcatacgagcagcacgtcgggtcccatctcgcacagctcgtcggtggtggcgaagaaacagatctagcagcacgtcggaaggcgttgcccgtcgttgccgcctcacctcccaccatcgctagccgcacgccactaccatcgcctccccccccccccccgggtcggatctggcgaaggggagggtgctgcccgtcgttgctgcctctcctcacaccgccgcacgtcgttgcgaccaagagagccgacagagagagagaggggggaccgagagagaggggagaggatgcggtggagattataattaagacggagaggatatggatagatggtgctgtgcggtttggctcagctcgattaaggggtgtcagtttttttaaggaaaaagtacgttttacccccgtactattgcggttgaccgaaacccccccccccccaccgaactcgaaaaccagtcatttcgtaccccgaactattaaaaccggatagttaaccccccttaagcacacaatggggcggttttgactggagtcgtgcgcacgtggcagtccaacgtggcaaggcgggctgagtcagcatagtcgcgcctggtttatagacttgacccagaaaaatttcccctccctccctttctctctctccctcccaaaaatttccccttctctcgaaaaccctagctagcacaggcgatctcgttggcgactcctgcacggcggcgagggtggtgcgctccaaagcaggtgggtgtcgtggtcagaggcgacggggccggagatctccaccacggacgcggcggcgacggtctgcagtacggccacctcgacctcgttggcatgatgacgagctcaggtacgtcccggggctcaaggtcgtcttcttgggctggaggtcgtgaacgaggaaggatgcagccgccagtaccatatagggaggggcctctcgattatgagccgccagtgcggctaggtggatttcgtggagtcccagtaaccccgggagaagatatttcacatgctacaatgcgcgtgtgagtaaatttgtatttatttttgatttggctcatttgtttggtttcaaactcattcgatcttggattatacatttatttgtgtagtctggttggttgcgatttttgggagtggcatgaccctgagtcagatccatattggaagcaattcctgcttgatttgaggaatgctgtgtggactgtaagagaaaaaatcaatgggctaaaggctcatctccaggacagcaggaatgaagccttgaagaacaggtacagttgggacaagcttctatattgcagtgcaaaatagaacagtgaaatggaaatacaaagaaataagagcactagttatagttggtggagcatctggctgaacaactttcgtacagcctgctaggaatccctgtttgcaagcagccaggcaaatatatatccttttgaatataggactaggctggtcagtatctaacttgacaacaactgtactcccaggattactcctcagcaactctaactgatagtcaaagattctaaagtattcacccctggtggactcatatatcttcctgaatacaaatgctttggctctcttgcactgcccaacactaacatttgcaaacatttcctctgaaacagtggactgcatgctctgtatactccaagttggattatctgtgatcatcttctcatacttctgagcaatcctcttgtatgtcactaggtggttatccttccttggtgggcaggtgtgttcatcaactagactagctatttgccagctttctgtcctgctattctttgatagcaaacaagcccacgggcaagttgccaaatcacacttggcccttgttctgtaaccttcatcctttataaaccttatgaacctcttgctgtccagtgcaagctgcaccactgcctctttgaattctttcttgccatcaaatttcattcctagtgcaagcctagcaattggcctattcacattaaatctgggggtatttggacttctttctgaccagctgtccatcactatcctcttcataggaatcatcatctgcactgctattgtcatatgggctagcactgtcatcaccctcaatctgaaccaaagctctactatttgtctgcctagatgacccctcacatataacatcatccaaattccctacctcaccatccttcagtttcttcttgaactctttgtaagccttcctgatttgctgaacctcttcatcttcttctgatgaacatgagtctccaccaacataatcactgtcagagtcagaaatcacaggtttcttcggcctctctttacctactaccactgccttccccttatcactaggttcagctactaccattgctttttctttatcaggtgtacgaaatgctcgcacttgttccagatctctctttgtcttctctggtgtagacactatgacaagaacttccttccctatattcaactcaaacaaatcctcatcttcctcatcatcccattcatcatctgcaggagatatgtcctgcagttcatcttcaaagtcactatcctccttgctgccagactcactggacccctctgccattactgtctccacataaatatcagcaacaccaccttccccaacacagtttgacatataattgtagacctcatcatcaatcaaaaccctcagcccatctgcaagttctttgccaggaaacaaccattgcagaagcatgccagggatcacttcacaatgatctttcaaatgtccaactatctcaggcagagagaccttatcacgtttgatgtaggacatcccctcagatccaccaatataaaaggtttccctcccattgttaatgaaatccccaccaaagtgaaatctaacaggtaaatactctagaggatccattcttaacctaaaaacaacatagtaatggcagtacacaatcaatccttttgcctaaatcaattacaaaaatcaaaggaaaacaaactctcacacatccaactgattccatatgccctagtaaaaaaatcctacacttttctaggatctacatcacatacctgcaaagcctagctgcgtcgctcttacttcatcctcctcgacaagcagctggtgctggccgatgtggagagcgtggccgccacgaccgtgccgcagagatccctcctcgtcgcctttgagcgtgccaccctcgttgccttgggcgcagctcactcgccggcgtggagtgcgccgcccatcctcaccggagtcgccgacgagatcgcctgtgctagctagggttttcgagagaagggaaaatttttgggagggaggggaaatttttctgggtcaagtatataaaccaggcgcgactatgctgactcagcccgccttgccacgttggactgccacgtgcgcacgactccggtcaaaaccgccccaatgcgtgcttaactattcggttttaatagttcggggtacgaaatgaccggttttcgagttcggggggtttttcggtcaaccgcaatagtacaggggtaaaacgtactttttcgtttttttaataggtgcatattttttaaaagaaccgacacctatttttatattataggtgtaggtttttttttcctaaaattgacacctctagtgtttaaaggaaggtgtcggttctgtatatttttcatcgtgtggaggtgggaaaagatctataggtgccggttggtacctatatggccggtccttatgagaatttttgtaatagtgagtttgcaaaagtagtgtactgagtactgtacgtacgtaaaataatgtctaatcaaggccgtatacgaagatctggacggttagtttgatcagtttttctcggccaagagcagcaacggagcaaccaaacctgacttagtcgcaaacggataaataatctcataaatttataacgtacgatcggtgcatggtcttgctcgtctaacgaactcctcgtccctgctactgcaaatcatcgaaactccagttgaaaattagttgggcttgcacacaagtgctgtcctaacatatgcatcagctggaccacctccactggccataaagctcacaatggaaaatcttgcacctgttttaattagctatgatccaccatagtatgtatatggtccatacatgcatgcaagggcacataattagcttaattaattagctagtccttttcctgtgcctcaaaaagtgacaaaacatttcttatgtgcggctctagctagctaaggtaagtggacccatcaagttcgagatgatgaaaatgcatgcatgtttgtagaatgaggctgatttgtgaaggtttaggtggtgtttagattcagggaccagtcctgttacatcagatgtttgacactaatttgaagtattaaacatagactacttacgaaactaattgcataaatgaaagataattcgtgagacaaatttttaagcctaattaatttataattaatacatgtttactgtagcatcacataagctaatcatggattaattaggttcaatagattcgtctcgcaaattaggccagagttatgaaatgagttttatcaatagtctacgtttaatacttgtaattagtgtcaaacatccgatatgatagggactaagaattttagtgccatccaaacaaccccttagtttgcatgttccaagatatactttgatgatcatcgacatgcatgtgggtgtaaattggatttggatttgtcttattgatgctctaccatatcaggaaagtagtcttagacattataaatagacgtgacatttttcataaaatagggggatacactgtgatacgggtacaaattaaactatacaaatacaacaagacactagcttatttccatccaaagtcatgtatataaagcttgtttcggttagaggaaaattgtttttttactgtttaatctgcagattgaatattgcaatcagaaggatgaaaaaaaattaaaattggtgcgtcacacgaagttgctaaaattacagacatggcatgttctagatcaaaattgttgtaagattcccattggcccaatttgccttacccacaaactgaattccctttccggcatctttgtctagcaggggtaccgagtgccgagtacaacctaaacgaccaaaccgttgcaagccctgctctgaatcgatcatctccatgactcctttctggtgttttggaaagcaaagtcttgcaccttacctctttctgtcttcagtccacccggggtcaaattgtagatgcctctctgcttccgtttcttgggtaactgttcagcactcccaagttccaactccaagtgatcatgatagcaaaagaaaaggggtaaataataaggaaaagaaaaaaacaagacgcacaacaacgcaaacgtatacagatcacatgtacactttctgcatttcttaaacaaaaacagtacaaagaacattccattattccatataccttcgagcatgcttgccatataaaggtgccatgtctgagtcatcctaccaaagtagtcccaaggcaaacccaatcaacccgacctaactaacgccctccgtcttatcatagccgtccattgccacgatcgggcggccgcgcgcgtagtcaccgaccttttcgtaacaattcagttacaatgtagtactagtacaagtctattgtagcacagcttcacgttgccgaagcagaggttgcggtgcggtgccgccggtgcggctgtcacgtatatgcgcgcagcgcgcagacgatcgattcgtctgcgcatacgagctgacgcccactactaaaaacccacggaaacaacgccacgcgcggcgtgagatagatcgattcgttcgatcgaggcgcgggactcgcccggtggatcgcgttgcgtacgagcgtacgagggagaccgacgctgcagcgcacgtacacacgggacgcgacgagacgctgcagcgcagcgcagcctcgcgcgcgcacggcgaggggaagaaacacgcacgcgggggctggatcgcgcgctggctggctggggggaagcggcggttggcgagcagagcagagtgagttcccgtttctttctttgtgttcccgggcttttctcccattcatccacgcgccaccacgcggatcctattcttaggctcccgcggccggacctaaccggggcggttaagcgagggccgcacgttcgcgggaggcaggctatggccacggccgcgacgacgacgtcgtccacggcaaccaccaccaccaccacctgctcgtcaccgtcgtcgaccaccagccccatccacccggccgtcccgcaccggcggcgcctcaacgacatcgagcgcgtcgactacgcgcacggcgccgcggccgacgactgcgcggcctgcggcggcgtcgcgcccgacgccgccctcgcggacgacgacgagtgcggccacgggcaccccgtcgtcggggccgtcacgccctgcggcggcggcgggagggcggcgctgctgttggcgcggaggaagcgcgcgtgggtcgtcggggcgggcgggcaggcgtggatgaggggcgtcgtgctgtgcctgctcggcctcgtcgcggtcgtcgggttcttgggatcgcaccggcgaggcggaagcggcggcggtggcggtggcgcaggctctggccccgttgccggcggcggcggcgacgacggcgggaggctcgtcaagaaggtggaggtggccgacgccgacgtgatggggtggacggaggagaacctgacgggttttcacgcgccgcccgcccgacccgccggtgcgtacgtgcactcgccgttaatcactcgatcaactcttacttcacttgatcgacactcttttattaccaagatcatttagtcggtaataactactccgacataatcacacctgctcttggttttactctgggaattcaatgaactctctgaagtgtgtttcttttctgatcaaatgggactaatgttctaatctaaaagcattttttagtcaatgtctaatcaaaaccatttttttttgttacaaaacattggtccaaagggaaaaaaaagaagaaaaagaagatacagaggtgtgcttgcatctaggccagctgaggattgagtatatgagagaaaggatggatgataacgacaaggatatttgcttgtatttgttgctagcgtgattcattggcataaaaaaaagggaggcagagactatatgacattatgacgttagtttcagagtctagaaacaaagcatcccatttaaggcatttatctctcgactgcttttgtgcaaatgatttccttgttctttccgctgtttatttgtctctgcaaataagacgcatcgctttagttcttttttttctggtcgctgttgggcaattgcggcctcgcaagctagtagtcactcgtaatgagatgttaggacctgactgacctgcggttggtgccgttgaggttgctttcacttgtaattgtcaagtgatgcatttcaaggtgtgaaaaaggttttagtgcataaacagaaagagttttgctggtaaaatattaatcaatatcacatttctgttctctaaactaatgttaagttttattgcacaactgagtttaattgactaaaaagggacgtaattttccatcagacagcttaatattgtaatgctcttcttttggggtttgtgattgatagacttcgtaagattcatatttacccaatcggcggttctcttaggcgatcgttttgagtcagaatatatattgagaaacccttccttacctggtagtggtagggacatcaagatttatggctgtataggtttaggacagagctggcagagactgtccgaaagcaatattgtgcttatgttcagacaagaaatttcattcacgaaagcaagacatccattcaaatgccgtgctgtgcggcctgaatttactcgagtttcctttataacatcgacagatacctgagatatggatgaagccagacagtgagggttatagccaatgcattgaacgcccaaagaaccagcgcagtaatttccctctctatatctttcacttcaatctgttccagctccagttccatgctcatgttctctagttgggtgctcttattgcagggactaacaatgcaactgtcggttatctaattgttgatgcaaacggggggctaaatcagatgagaatgggtgtacgtatctatttaaacggtttaacatgcaacgcttttcagctaacccatactccttcgaaattattcttacagataagtgatatggttgcagtggcaaagatcatgaatgcatcactagtaattcccactctagatcatcagtcattctggactgatccaaggtctgtaccttttctactcaaggatcatccctcatgcccttataaaacatcaagtaaactgaccataagtccttgaatatagtgatttcaaagatatattcaatgttgagcacttcaaggaaatattaaaggaagatattgtaatcgtggattcccttccaccaacttacaaaagggtgaaaccctatatgagagcacctacctcctggtccagggtaggtgttcaaaaacatttgttcctgcaattgcatagcttagaaattcaggaaatatgagcaagctaatgaattgatagctccattttgcaggcttcctattacagagatttttcaaggatactaaggaagtacaaagtagtgaggtttactcacacagattcacgtatagtcaataatggtcttgctccttccctccaacgtctccgttgtcgtgcaaattacaaagcacttcaatataggaaggagatagaggagctcggtcgcaccctggtagatagactgagaaatggaatggatcattatattgcacttcatttaaggtattgaaaattcaaaacattcagagaccaccttacttcatttcctgcaaagaaaccgtttacagatcagcaatcttccattttgctttgttgattgatttacagatatgagaaagacatgctgtccttcactggttgcaatcacaacctgacagtacatgaggcagatgaactgacggacatgcgactcaaagtgagacactggaaggagaaggagatcaacagtgaggagaagcgactccaaggcggttgtcccatgactcctcgtgaagctgctgtcttcctcaaagctatggggtatccttccaccacaaagatatacattgtggctggtgaaatatacggcgcacatagcatggatgcattaaaacttgaatacccgaacatctacacacactacagtctagccacagcagatgaattagaacctcttgagttgtatcagaacaggctagctgctgtggattatatagtagctcttcagagtgatgtttttgtatatacatatgacggaaatatggccagagcggtgcagggtcacagaagatttgaaggattccggaaaactataaaccctgataggtatgtaccttcatacaggtcaagtttttttttctggttttcaacttacaatatatatatttttatctgtaggctgaagtttgtagagctcattgataagctggatgaaggttccatggactggaatgaattccaaagtgaagtgaagaagcatcatgaaaacagacttggaggtccatatgacagattacctggtgaaagtccaaggcaagaggaatacttctattcaaatcctatccctgggtgcctctgcagaaaggtacaaaagactaggtaaaatagattaatctcaaagggagatgattcagtcttcaaaaagacatgaattgtacagtcttcaaaggaaaatagtttcgcagctgcattaaggatggagatgacacttcctcacaagtcacagattgcatcaaagtggaagtcctagtaaactgacagagaccggtcattttgattatttatcctagactgacaacactcgtagttcagggcgtggggccaagaagtgctgcattttcaaagaaatgttcatccaaggaaggaagatgagattctgaagtagttgaagaattaaatgtatcatcgattataggaacagccagaaggaaaactcttcatggaggctgattgtagttagtccatacacacttcccctgttcttgacgttatctgattcgttgtagtgggcatcttacatctggatggattcataacagtaatggaacaaaccacactatcagtatagaatgacagacaaatatttcagtagcttaggtcagatcaataattctttgtaatctagcaatgtgccaatgtcatgcacatcagattagcttcttgtaaaagtatgttctttgttgcagtggcatctgcatctgcactatcctctaggaggaatcaatgtgagtttcagaaacaaattagaaacaaagaaatgcatgaaaacaaaaggaaaaccgtctaaggaaggtggcttcaccccatgagacgtttaccgaggcaggaggcagtgtcgaggcggaagtcgaagacggcggagaggaggcctcagacgcagaggaatcgggacgagcggaggtggtcgggggatgcgagtgtgccatgacgggcctgagcgagctcagcgagcagtcggaatccggcactgaccacggccacgacgcggcggcggggttcggacgaggcgaggaatacaaacctgccggaatcgggtaccccactcggccactccccggaagagtagcgggagagccggcggcgatccggcggcggcgcggggcgcttctccgacacacacggagaccggcagccggagaggcccttctccttccgaaagacacgggccgcgcgtcagccaaagtccagttccagcccaattaacagatttaacacagaccgcacgtcatccgcagccccattacggcccaaccaatattgggcctcatcaaacataatactctttggaataagttcatcttgggtcccttcattttacaccgaatctcaaaaccagatacaaccggtccctgaactaaccggtgcaaacgagatctctcggcattttggattttggaaggcggttttgtctgacgtggcaccttcgtggttggtttgactaggtctccgttccacgtggcattgacatggcgcttacgtggcaattatatctcggaaaaataacaaaaaccatgggcccacatgtcagctacacacaaaaaaaatttaaaaaattgtgaggcccacgtgggccccacatgtcatatcctcccctcactcaactttccctcttcttcctcatcgcgccgcggcgccacctcacagtcattgtctaagtcctcaccgcctccgatgacaacaacggccgaagcatgccggcggcaggccgcaggcggcagaggtggccaaagaaggaagaggcagagaaggtcgccggccagcgcggcagttgtggcgggttatctcctcccaccgccgttggtcgctcgtcgctcttattgctgaggtcgggcgaggattttctcgatgccggggaggggtcggcagcggcaagccgcgggccgcgggccgcgggcggcggaggtggctggaggaggaggaggcaaagaaggaggttgctggcgagcgcgacagctgtggcgggttatctcctcccgccgctgctcgccgctcatcgctcttgttgacgaggtcgggcgaggattttctagatgccggggagggatcggtagttaggaggatggggggtcggcagcggtggtagaggggtagagatggcggcatcgttgccaagaacgacctccaccgctccaacccggctgacacccaccgaaaatagagctcctcgccggggatggccaggcaccgtgggtgggggttcgatggtgacgggcgaagggagaggtgcgcaacggccgagcgtgtcctcaccgccgggatccaaggccgccgtcgccagtcccccggacgacctcgattcccgcgagctatccgcctgcccgccgccccgttgtcgtcacgcgccgccgctcgccactgctccttgcagactgcagagcaagggagagatagatgggggatagagagaagagagaggagtaaggatgacatgtggggccgacgtgggtcccgccattttttattattttatgtgtgaaactgatatgtgggtcccacgggtttttattttttaatcaaattgccacataagcgccatgtcaatgccacgtgggacgaagatctagtcaaaggagccacgtagcacaacgtcagccagaaccgggaacaatattgtccgagggacctcgtttgtacggttttgtaagttaaaggatgcattgtacccgattttgcactgaagggacgaattttggactcggcaacaaactgagggacgtaaggtgaacttattccatatctttagttggtctctgttctgtaaattggcatatttcttgttcttttgtttgcttgatctttttttttaaaaaaattagttaatacttaattaatcatgtaataatatgagcttcgttttgtatgccggggagaagggttgccaacccctccttccgaacactacaattcctagttctgtacaatgcatatggaactcttgaggcttatttccaacgttatcgaagtgcttgctcttaattgcccatcctgaggaacattttgcacaaagttattttgactgtattttacgaattttggtcttttcctcggtgaaatttgtttgagcatacacgagccactgaccagagcggagcatgacaaatacgggcgtcgaaatgccgattgcatccttcatctggatctggattggcccattatgtctctataagcttatttgggcccataaatttcactcaaaaggaataagtccattttacctcccacatctcttgcccttcgtcgaataacatccctcaactaaataatttttttaaaaaccggtgcaaatcaactccacatgtggttctgtaagtggtttatgctgatgtggcagccaggtcatcaaagcgattgaaatagaagtgggtcccacatgtaagtgacaaatgctaaaataaaaaagtggtggggtccacttgtcagccctattttttcttatcttcttcttcccatgtcccttctatctctttctcgtagccgcacgcgcggagtctgattcggccagccgatggcggtgaacgttagtcgggggtggcctcggagggcttgaagacgtgactcatctactcctaccccccgtgtcaccagggagggggtgtaagagatggcttcatgctaaccttcctgaaggcggcgaagacgaactagggaggctcttgagcagcgtgcccggtggcagtggcgcccttctcatcccagcgagctcctcctctgcgctcggtgggccgcaaccacccgatgagctccccggcggctggccggccgtggcctcccgatgagctcctctcccgcgtccggccggctgcggcatcccggcgagcccctcccccgcgcctggcccgccgcgccctcccgacgagctcctccccaacacccgccgccgccgctcgagccgatggaaggcgtgaggctgtaagatatgaggagatgaaagagagatgggaggggtgataggtggccccacgtgggtcccacctattctttttattgtgaatgccatctagatgccacgtgggatgaagaattagtcaatgtgccatgtggatgccacataagctataactggactcaatactgtcttgggggtcgatttgcaccggttttcggagatgaggtagtcgttatacctggtttatctaccctatagttcaacaaatgcttttactcattcatcattcatcatgtcacacatccaatggcccaaaatcaacagaggaggtagatccgaccgcccagcgcatctctcgcatctcccaccacacagagccgcatctcctctcctcgcgctctctccgcatcctccaccatcagcgccgcatctcctcctcggcgtcctagcgctctctcgccccctcgccgccgtgcgcctccccctcgctccctcgccgccgtgcgccggatttttcattgaatcgacgcgctccttctccggactagggaggggaggcgcggcgatgggcgccggcgcggcgatgtgggggaggcgcgacgagggaggggtggcgcggcg

SEQ ID NO: 66145 - DNA, 68264 bp, Oryza sativa
  unsure (1)..(68264): unsure at all n locations
ttcttatatttttcatagaggttttagttactccttttcattacttgtctatgttactagttgaatttcagatatgtttcaattttgtcttgcttatttgcttggactactttgtttttgttttgcacattcaaattcgtgctgaaggcagatcaactattaacaacagaataggccaagcgatgattgggccattcgtcgtgtcactgaaatcagtatatcagaagttgaaacttcaggtgataaattggtgcatttttatgcatggtttactgatggaatgaatacagtaaacagactggttactctgaatgatatttctgagcacttggctgaagccatttgctcggggtttcctttatggacaaactaagcacattgaagtggattcatgatgtagtaattcactggaacaaaatgattcagataaataaggtccttcaattatcagtcctttctgatgaggaagtcatattactactaggtggaggctcatttctgaaaatatattcaagttctctaggtttgccatactgctaagggccatgttctgcacgtatcactaaccgttgcgtatttgaaatctgatctagatttaaacagtgggcagcttttttcctcatattgtgttttgtcatgcaacagaaaggtgtcttaggggaggaggcaatatgtaaggattgaggtatagagagttgagtatagagatggtatgcatgcttaattattcaggtcaaatcttggccacttctggcatatcattattgctgtttcatggaaaatgttatcagcaacagtgctccatggaatgatactattgctggagatcggaggcatagatcttacttggttaacatactgaagtttgactccggttcttgctgtgatattgatggcctttacctggaatgacagtgcctcatgacttgggaaaggaggctcaaatttctgccttgataacaccccccccccctctcttataagtaattatatgaagcatttgcatgtcaagtttcataatgcttatgcttggattccttttgctgctattatatagtatagtaattcgttgcaatccttaagtcaattaaatacatgtaagcaaagtgagtacatttaggcttaggaaatattcatgattcctgcagaatattgaactgttctctatgaaattatgtaaattcctgcgttccacacagaatatataaagttgttttccaaatatatatgcttgataactccaaatacctcagatggttttaattccatgataactccatgagagcctgagaaacatattattcatagcttgtataatggctacgagagtacaatcgattactaacagacagcatgatgcattttcttttctttctgaaagttccatcgcccaccatggcactcactggccaagctggtcctttatggacttgaagtgatgctgatgaatttgaacagattcctttcttggagattcatactcaaacaaaaaaaaaagcagtgtttactgctggattttcttttaaatgtttccatcaaacatgcgttggaaggggaaaggatatatttcctggcactaaacgttttgtctgctaacaatgtaatttgaaaatccattgttctcttgatgattttttttacgataaagtatgctatttgaagctaccgtttgcaacagtttcggatgcatttttttacatataagacaaaatacccataaaactgttgctaccttttctttcacagaaaattagggtaagcctgctgcatggattgaagttttgagcagtttgtggatgacatccaattgctagcttaatcaatgctgcatctcaaagaatactgatgtgaagattcttgcaagagtcttggagcacccatgctcttgtacatctcttaatgcaaatactcatgtggtaaactcttttagatggtttattatttggtcagtgacccagtgttgttcttttcccatgtattatgtttttagctaagagtggatttataagctgtaagaagcatgtgataaaaaaaattacatgtgaaattcaattaccaaaactcattcagaaactgtcttctgttttgccaaaacataatgaactttctatctataccctaactgtataaatcgtctatgctgttatatttcgtttaaagaaccctttgagaaatgcaaaggcaatcctgttaagtttgtttgcttctagtacattatattagtgtagtccgtatttgatcaccttgtgccaggttctctgataagtgatgactagtttttttttgcaccttctattgattagcctggctaaaatatgcgtgtccctgaagtagaactgatggagatatggaagggagtgaggcgatctggatctgctatggtccaaatgctgttgaaaacttaaaatctccttgttttcgttttgcatatatgacgtgagcacagctttggaattactggtaaggatttcagttcttttctgaaatcattaagtatgaaatatctgttttgaggtctgaagtttataagactgcatggcaagagatacaggaaatgtagtgacatgacaaaaagggaaatagaaagcatgaattatgttgatgaaaatgaaatttctgttacaacaggatcttacgatacagaatatctagtaaatctaagagaaagagcatcacttccttttgcattcaagtgaaagttcaaagccctgagacaagcaccatgatctgatctgtggtccagtaatgattttactttagatctttgcaagaagtgaaacttctatggcctgcccatcaattaaaggggccactagagcagataagcttcaggggctatttagtgattggcaaccaacaagttaatattgcctaactttattgaaaaaaaaatctaagttgttagatatttttccgttgctacgtacgtacagtggttatttccttttaactgaacaaccttgtattttaaattattagaaactgctcacaaaaatgtttagggcatctcattaaggattacctccaagttcacatggaggacattttaaaattttaattatccagcatttcttcctctctttttttattgttaagttttaagtggctttcttttaagttctttaggctttacttcctcagtccaaaaaaaaaaagtactctaacttctggggataaatctgaagggcgtagatctattctactgtttcaatttcacatggaggattaaaattactgtgcgtcaactatctcgccgtaagatactgttgagagaaacaggtattgtttcacctgcatttatatcacaagcaattgtctttcttttcacaagtgtttttctctcctttcaagctggtggcatgtgcccattattgagccatccatctccgctctcctctcttgcatgtgcagcacctccggttttttaacttgtgcataaaataatttcgatggatggtccctcttccatctcccttagcacaaacatcagtgcatgtgagatgtgacacctccatgtttacaatttttacaggcacgctcggtattatctgttcctgccaaagaaataaatctggagaaaactgattaccgagatgcagnccggagaagaagaagagcacccatacgcatccactgtagattcaaaggcaggggggcacaggtacgtattgtaatggtcgcagttggggagggtggtccgtcccctacggggttgatggctacctgctgcttgaatgcgcctgttggttttgaacgcctcttgatgctgcgttggagtcacgaccagtgtgtgtgtccctgtacaggagaagcgacgctgatgctctcggtcaatttggtccgtcccgtggcgataacgatgcccacagccgcagccgcaggggcagaggcagagggcatctcgtctcgtctcacccatgacgtcgtcccgtcgcagagccatcagttcagttgttgctgggttcccatccttcctgccgctcatcgagagatgcaggatgctgacgccgctgctgtgctgatcctgttcacttgcctctgcagctttgcactgatccacatcgatgataatactactcctatttggtcatttggtgtgcaagtgcagcaacaacttggcgtttcacaaaaaggtatgtcacgttcacgaacctgcatgttcttggagaatgtatatttttgtactggtagtagttgttgtgtactgatcaagcaaggtgtgaggccgtacgctggcacgtagtagagtggatgaggagagtattctgatcgtagtggggggggggggggggggggtaaactactcacggcctcctgccgggaaactacacctacccggtggtccaataatcccccgtaatatgttacgtgatggtcggtattagagctcatttgtttactgcatgcgcatcgaccagctctgcccccactggctgtgtcaagtgtcagctacgccaaaaacgtgagctctttttttttgctccaagtgcggggttagctatacctacttagtctgatctaagcacacttttctaccaaatctagccaatggatacttgggccttcccttcattttggaaaaagtaaagtaagtggccaacctttttatattgaaaggttttgatgaggcgaatttggatgacatgaatccaaaagcataatctaggaaaaaaaacagaatgaaccattagagcgccacgacttgttgaacaggattacaaaatcgtgtgaattgtaacaaaagaagggtttggagttcgtattagggagtgaggacttttatacatactgtcagtacaaacaaagacacttcaaaaatttgccacaaaattgaaaaggccaagtggcagcgcggcatgctcgtggtggctagcagccgtggcacgcctagcgttgtttcattgtatgttatgaattcatccgagttaggaagacaattttatctcttttaattttatacaatctaatttaagtggaataccaaatcactctaaatctttggaccgtttatattagtattatatactgccgataaattgtactgataaaagtatttttatttgttgctctaaatctttcgactgtatttgctggctgcactagtggtgcaccggtgctgagcgctgacacggtttttctgttctctttgctttgagctgtgaagttccccttttcctcccataatgatatgctttgcctgtattgggagcagcaaatctttgtggtccgacgtgagaaagaagggagacggaatctcgaatctctgcaaccagcctctctacctctagtcccggctcaattatacgcccatttgcagagtagcccccaggaatctcaacacttgctactcgtgcaacgcaaaggcttttaccgacgcctacacctgttgatgccctccccccaaaaagcgccgtgatgtcgatgcgttgcggcctgttccagttttcccccaatggcagctcggcaacgccgagatcactcaacagcactagcggtatccaagccacagctttcagtctttcacgcggtgcgtggaggagttgatcatctgcactctgcagcacaacaggtgttgcacagttgcagtagctggatatcacccgatcaggtgcgcaattgaactcccatcccctaacgccataatttcaatccctaacaaagtttatgttacaatgttctactccaatatataaagttgctaccgtttgtcaattcctaaggaggaagaaaaataaactaagatagaggatagagcgaggctagcaaatattccatacatcctagaatgtaaaaaacttttaacatttaaaatttatctcaaagtataacaatttatctttctacttcactctttaaataaattacaaccatctaatatttatttatgtaacatttacttcctcattttaaccaattataaccatcatttatttaattttatctatttttaaataaccatgctacccactaaacttcttatattttaggaaaagggaataattgttttgttttctactaagtagaagaaaaaaaaaggaaaagcacaggatgtcgcccactttgcttgtgttggattgcatgcatctttcgctcctgcccgcctgcttgtcctagggggcccacttgcagccccacagctgcaagttgccgtattatggtccttggcctgcactatgctggaaccaataataccaaatgtatactaataatatactagtacactcctgctgccctacgtagtaacgtttagcaatagtagcatagtacgcccccccccccccctccccattgacaggcaacaatacagggagggtagactaaaatatgatcaaaacggtttgcagcgaaagggacaccaactagcacacaagatttcatcagagcctgtctatcctcgtgttcttgtgaattgtggtgaagaggccttagcactgagtaagggtttgccttaccgccgctaaccgcgaggtacggtaatataaataccgcagtaacctctttaaattcaaataaattttaaaaataatttaaatttttgataacccataacgtcatcgtttcacccatgtcgggtatagggtacggtcattggtgcttagtgaagttgccctgcgctcatgccattcggcattccagcttagcttgacacaagtgatccctgaaagagtgatgaaagggttccaattcgtaccgctaagttcctgccttttcactcgaaaaaaatattcggataggagtatactatttcttcttaataccattgatacttccactaccgttctcatctaaaatattccctccggtcctaaatatttgacgccattgattttttttaaataggtttgaccgttcatctcatttaaaaaatttaagtaattattaattctttttctatcatttgattctttgttaaatatacctttacgtatacatgtaattttacatatttcacaaaagtttttgaataagtcgaacggtcaaacatatataaaaaaaattaatggcgtcaaatatttagggacagagagagtacatcctcaacttgaaaatacaaccgattaattttcacatgaatagaaaatatatcatgatgagttctttatatatatatatatatatatatatatatatttatcaagagattacggggtaactcatgcttcattaagtttacaaattcaaactgattggaatgtggctccatcgaatcacccaaaactacttgaaatcaactgtttccgctcgaattttgctgagctttaccaaattctaccgatttgagctagcttgcataggttgacaaacttgtagtggtgttttgaatgcattcgtgaacctgcttcatagaattaattattagagcatcacgagtagatgcgcaatatacttttcacttctaaaattttaagcttatcgatggaaagtttgctccaacagttttcctaattagtatcctaaaattttaaatcccctttcccttctggctctcaactagtgggagagagcatcggctccgagtccgcagcgatcagatcgtgcaggaggaagtgaaatcgacaacttcagttgatagtttgaattatctcttatagagaagtatcttttaattcttaaatcctcatttacgcgcgttttgtgcttcacatattaagacgctttggatttaaatagattcatatatgtatttcatatatatgtttaagtttatacttatgttaacataggccgtgtttagttgtaaaatttttcttcaaactttcaacgtttccatcacatcaaaacttttctacacacacaaactttcaacttttccatcacatcgttccaatttcaaccaaattttcaattttggtgtgaactaaacgagaaaattgcttatctaccatcgcataagatgggattcgctcaaataccatcactaaaatgggcttcactataataccattctcaaccaagatgtctttgctcaaataccatcccggacaaaaatgcccctagttcatcttcttcctctctccctcccaccctccagtggaggaataggtcgtcggcgaccaccaccggctccactacctcgtcgccgtcgcttgtgtcgtctcgagcactgcagccccgccccggctcgtcggctgccgtcgcgcaccgcctcactcgcgtggtctcggctggccgccatagtgcgccaccgccccaccacgacgcgccgcccttgccagtcgccgtcgccgccgccgccgccgccgccgccgccgcgcctcgctcgcgtggtctcgattggccaccgtcgcgtgccgccgccccaccccgagcccaccctgactcgtcgccctcgccggtcgcggtcgccgccgccaccgccgccgtgacgagaaagagatagagggaggagatgccccaactcatcgcccgccgtcgcgcgccgcctcgctcgtgtcgcctcggttggctgctgtcgcatgctaccacccttttccgactcaccggccgatgacgacctcgccccgacatggtggccgagacaacatgagcgacggcggcgcagcaatgaagccagcggtggtcaccggcgacctattcagccattggagggagggaggaagaagagctaaggggtatttttgtccgggatggtatttgagcaaatacactttggtagaggatggtattctagcgaagcccattttagtgatggtatttgagcgaatcctatcttatacgatggtagatatacaattttctcgaactaaacacagccatactcctaccagaaaaaccgatcctctcttgatcagaagattctcatggatttccagggccgcggagataccgcgtccaccaccggaggccgggggaagttctccccaagattgcgtcttccctgagcaaatcaaccggcaccacctttttaccctttccagggaagcatctccccgttttttcaccgatgcgcacggccgccgggccaggccaagcgaagccccagagccaggcaccgaagctgccccgattcccctcccttctcttcccccgatggcgtgccgtgagccaccaatggcactttccctggggtggatctgtgtgtgcaggcagcctggcgcaagttgaaggtgttgtgccaaatgaatcctgcaacagcagcgaactgttttgccgtgcccaccctttgtggtggtgtggtgccccgttcccttccattggtgtttctgtgggctgtgattgtgaaacacagaggagagaagagctagcaggaggatgacacagagaggtttatggcatgtgatgcttggttctttggtggtggacctccaactctcaattccctgctactgttgcctgtgtgacagccacacctccccatcagcatcagctgggggtacttgcaaggtacaacctccatttcagctaaactaatcacggctcatgcgatggcaagctcccattggccgcccagaggaggaagtaaccaactggactcgactgcgggtgaagtagtagtagagtgtacggtgtaggcctgatctcagaccggtcattaataaagtgtcatttgggtaaagcaagtactccggtgcttgaaatccgtaagacgaaattctcagccagagtgaagtcaatggggggaagcttcttattagaggggagtcattagcgcacaccacgtctgcttcaggttttattccctcaaaagcgacaggaaagagcagataaaaaccataattatcattaataaagcaagggtcaatgagagggtgaccaatgctaataccctcaactgaacactagagagccttgacaaaaaaaaaaacagagacaatatgctgctgctacgtgctatatctccaaataatacttgcatgacaataataacttgactaatagtacatcaacaaaaacggtgtctagctggtagtagtacccatcctgtgcctcctcccatagcacaggagataatcaatggagtatcaaatatcaattgtgaactaattatttaaccttggtcttggtcttatgtacacagatgcgaaatgcagagatgccatgtccaatatgcttcttcttcttcttcttctttttcttctatctcgtgattcttcttcttcttcttcttcttcctctcatcatccgggatacacggtagtagggagcttaatttagcagcagcgcaatgcctggctactgtgctgttactacttgtccttcgtgctgttgcgatcatttcgttttcagaactccattgatggttggaagcaagagcacgagttgcatctccctcctcgagcacaccaagagacgagagcattttcatggttggtcgtgggttgctgctccaggaacagggttgtcaaccgagaggctgcatcagctggccgcattgcatctgcaccagaacggagtcgtcgaggcggccgccgccggcgacgtgcgaattgccggcctcgatcttcacctgggcgtagggatggggcatgaagtggtggtgcccggcgccacggccgagcggcggcggcggaggcttgccgtcgacgagcacgccgaactgctccgagacggcggcggcggaggaggaggagtgcgcggtgagcacggacggcggcggcgacggcgaggggttgccgtggtcgtcgtcggggaggttgacggtggtgatgtcgtggatgctggagcggcgcttgtccttgccgccggagttgagccggatgaagtacttctgcgcgtggctggccacctgcgtcggcgtccggctcgtcacgaagttgcgggagatgttcctccagtcacctctgccgtacttcttcagccccatcaagaacaacctggaacaaaaaaagcctcaccaaattcagctccaagaacacgccatggcttcatcagcttggtccaattccatcaaagattctgagagttggggggtggcttacttgtgctcctcctctgtccacggcacgcccttcttgcgctcctggtcagggccgcgcgcgcgcttgccgccgaccatgtagcaggagcgcttgaacccaaggccggcggggtcatcgccgccgtcccagtcaagagtgaacccggagccgccgccgccgccggcggcgccgtagtgggggaaggggacgaggccggcctcgatgaagcagacgtcgttctcgaggtcgtcgtagtgcgtcatgacgtcggccaccgtcttgccgggcagcagcagcgccacccgctcccacctctccgggtcgttccggtcgagcgccgccagcgcctgctcgaacaccttgttctcctcctgcgaccacgctccgccgccgccgcgccggtccggcaagaaccacccgcccgccgccgcagcctggccgacgaagtagtgcgccggcgccggcgggagcacctccatgtacgactccttcatcatctccgcgaccgcgaggcggctggctggctggccgggccaaccgaccaagatttttcacctttctttctcaaaagcgagctcttgggaggtggaagaagagggggaggggagatggggggcggcagagaagggcggtatttatggatgctacagcatcgattccggcagatgccaaagtggccacagatgattcggcctccaccttgagacgccgcttaaaagaaatcgaggcgttcgttgattggcccttggtggagtttgtggcgtctcaaccaaacaaaagcctcctcctcctcctcctcggcttctctcactcctgcgagaagaggagggcagagcacaggagaagctgagctgaggaggagcttggttggggtttcgcccgtgtgcgcgtgtgggtgttggtccaggctgggagaaataataatagggaaacttggtgcctttcctgtgcagttgcaggcaacgttgcgtttctttattggccgttgcttgccgcttttcccaatgctggaggaggaggaggagtcccggcttgtttattcgtcccttcattcattaccaatagagacgatccacttctcatgttgtgctagcattttcggttggccaattcaagattacaaatcattctatcttttatctattatattattaaaacagctaggcatcacattctttgtggaggctagaaattcccacattaatcggaaaaaaagaaaaaaaaagaaaatgagagtccaagtagaagtacaatctaagaatagctatctaaaaatagctgaaattcggaattaaaaataagcaatattgaaagaagtttctatataagaacctaatacgagattaattaaaatttgaaataaaaataaaataaaatctaaaattagaaaagaaaagaagagtccaagtagaaatacaatttaaaaatagctgaaattcggaattaaaaataagcaatattgaaataagtttcaatgtaagaacccaatacgatattaatcaaaattcgaaataaaaataaaataaaatccaaaattaaaaaagaaaaggatagtccaagtaggaatataattttaaaatagctgaaattcggaattaaaaatagggaatattaaaacaagagtccatataagaacacaatacgagattaattaaaattgggaataaaaataaaaataaaatccgaaattagcaaaaacaaaagaagagttcaaataggagtacaatttaaaattagctgaaattcgaaattgaaaataaacaatattgaaagaagaatccatataagaacccaatacgtgattaattaaaattcagaatataaaataaaataatatccaaaattagaaaaattaaaagagagttcaagtaggaatacaattttgaaacaactgaaatctatactattataaaaattgaagatgtttttaccggtattttgttacgtcatccgtgtataagttggtttttaagttcttttatttttaaaagacatatccatcatccggtgaaaaaaaagcgagaaaaaaaaaataaaaaaggagaaaataaaacttctatcgtaaagaaaacgtccgactcctccggtggaaaaaaaaaaggagagacgacggaaaaaaaatcgatacaaaaaataaaaaaaggagagaaaaatttataccgtaaaaaaaagtccgactctgactcctccggtggaaaaaaaaaagagagacgacggaaaaaaaatcaagaaaaaacaaagaaaggagaaaaagaaaacttctataaaaaaaaagaccgactgactcctaaaagaagtccgactcctccggtggaaaaaaaacagaaaaaaataagagaaaaagaacttctatgtaaaaaaagtccgactccataaaaaaagtccgactatctgtggagaaaaaaaaggcaagaaaaagtaaaaaaaaaaaaagagaaaaaaaaacttctaccgtataaaaaaaataaaaacgttcgattccttaaaaaaaagtacgactccctcgaaaaaggacttttttgtccgtaatcttctcttctacttctactattttttttataaaaaatctctactattataaaaaaattaagatgtttttgccggtactataaaaatttaagatgttctattgtcggtaatttggtacgtcatcagtgtatgagtcggtttataaatttgttcgcttttgaaaaaatatatatccttcgagttggtttttaagttcgtccgcttttggaaatataggagttgtataagaaaattcgcatgctaactttagacgaacagactcctaaccgcagcttatgattttctagaaatatatagatccaagcgaattctcacagtgaatttcatcgtaactaaaccatataacaataataagactaaaatagttgtcacccgttgcagcgcatgggcttttcttttgaaaataaaaaataaaaatattaaaagaacacaatacggtattaattaaatttgaaaaaagaattctgaaattagaaatcaaaaaataagatttcaatttggaatacaatttataaataattaaaatttatgataaaaataaagaatattgaacgaaaagaccatctaaaatacatgacgagataaattaagtaacaagcctataatggagcagagtggtggcgattgatacgatatataaaaactgttaataaaacaccaaatagaatcctaataacgagagacgataggaaggccgtgaagcaaacgaacaaaacgattgccgggacttctaaaaagtaaaaataaaaataaacctcaatgataattatattcgatttttaaaatctcaatgacaataaaaaggagaagcagcgggcggggtgtataggagtatagttgcagagctgccgacggttgacgggacttctaggaaataaaaaaatgaattccaacgatagttatgttcaatttttagaaccacaatgacaataaagagtaggcggcgtacgggccgtagaggagcatagtagcatcgtttgacaaaacttctaaaaattataaaaaatgaaacccaacaagacaataaactctaaaaactataaggttcaatttttaaaagttcggaacttctaaaaagtaaataaaaaacaatgataatcatgttcgattttaaaatctcaatgacaataaagaaaggaggcagcgggcgagccgtagagaagtacaatggcaaagccgctgacggtttggcgggacttatagaaagtaaaaatgaacccaaacgataattatgttcgatttttaaaatctcaatgacaataaagagaagagatagtggacggaccatagaggagtataatggcaacgtttgacgggacgcctagaaattataaaaacgaaacccaacttgacaaaaaaaaactctaaaaactataagatccaatttttaaaggttctaaggagaatgaatagaaatagtggtagatcgaacaggcaaataaagaaggagatgatataaggggtagcaactggtgtgacttttaaaaaactatataattagaaacacggggatgataaggtttggtctttcaaactcttaagacaatgagatagctatttaataaatgttaagtaaaaccatactaaaactatatgattttatttaggtgctagccacgcaattgcgcgggccacccagctagttttattaaaatagcttggaaatgaagcaccacgttcgctgtggggctagaaattcccacattatttggggaaaaagaaaaagaaaaggagagtccaagtagaagtacaatttcaaaatagctgaaattcggaattaaaaataatcaatattgaatgaagtttccatataataacccaatacgagattaatcaaaattcgaaataaaataaaataaaattcaaaattagaaaaggaaaggagagtccaagtaggaatacaattgaaaaatagttgaaattcggaattaaaaataagaaatattaaaagaaaagtcaatataagaacccaatacgagattaattaaaattcagaataaaaataaaaataaatctgaatttagcaaaagaaaataaagaagagttcaagtaggaatacaatttaaaattagttaaattcggaattaaaaataagcaatattgaaaaaagatccatataagaactcaatacgagattaattaaaatttcgaataaaaaatatagtaatatccaaaattagaaaaattaaaagagagttcaagtaggaatataattttgaaacaactgaaattgaaaataaaaaataaaaacattaaaagaacacaatacggttgtcaatgtttgatgccgcgattccggtatttacatagtatggggatcgttggtactaggttatacgcgaggctgaggtaaaagagacggggatgaggtttttataggttcaggcccctgaattgtcaggtaataaccctacattatgttggccgaagtcggtattgctcttattcaccataatcacaccattaaaatatttggggtagcctatctaattgttgtcaatatggcggtctgaaggtctgactcgtagtcgacaacagggtagccttcttcctcgaatccgtgccccagagattagagatagcactttcgtctctcctgacagtatccggagacaccgtaagggactagccgtgcttatccctaaagtcgatatctggcgtcttgtcttggcttatgttggcttgtatgttgtggcttctattgtgccgtgtcttctatggtgggtctctcccctctcctcctagggggccttgtatttatacccataggtgtccccttatccaagtagaactagagaaaccaatatggatataatctgagtagtccttgtcgttttcatgtagaactctggttgtctttccttatctggaactcctcctatatctacaggttgtttccatataggacatggtagaactctggttgtctttccttatctggaactcctcctatatctgcaggttgtttccatataggacatggtatgtggtgggtcctgccgagatttagtcgactactattaggtatgtggtatccataaccccgacaacggtattaaatatttttttaaaaaaatctgaaataagaaaaaaaagatttcaattaggattaaaatttataaataactaaaatttgtgataaacataaagactattgaaagaaaagaccatctaaaacacatgacgagataaattaagtaacatatctataaaggagtagagttggtggcggttgatacggcatatagaaattgttaataaaacaccaaatagaatactaatgacgattaaaaggaggacgtcaggcaggccgtaaaacaaacaagtaaggcggttgccgggacttctagaaagtaaaaaaaaacacattgataatcatattcgaattttaaaatctcaatgacaataaaaaggagaagcagcgggcggggtgtataagagtatagttgcagagccgccgacagttgacgggatttctagaaaataataaatgaattgcaacgatagttatgttcgattttttgaatcacaatgacgataaaagagtaggcggtggatgtgttgtagagggacatagtggcatcgtttgatgggacttctaaaaattatgaaaataaaactacaagtctaatttttaaaggttcggaacttctaaaaagtaaaagatacaatcataatcatgttcgattttaaaatcacaatgacaataaagaagggaggcagcgggcgagccgtagaggagtacaatggcaaaaccgctgacggttttgcgggacttctagtaaaagtaaacccaaacgataattatgttcgatttttaaaatctcaatgacaataaagagaagatatagtggacgggccgtagaggagtataatggcaacgtttgacaggacatctaaaaattataaaaacgaaacccaatgtgataataaactataaaaactataaaatctaatttttaaaggttccaaaaagaataaatagaaatagtgatagatcgagcaagcaaataaagaaggagatgacataaggggtagcaactggtgtgacttttaaaaacaatataattagaaacacgaggatgataaggtttggtctttcaaagtcttaacaatgagatagctatttaataaattttaagtaaaatcatactttaaaaaatatatgatttttttttgctagccgcgcaattgcgcgggccacccagctagttgactgaaattaagggatatatgagtttgttatcaaaaattaatcaaaccatagtttgttaatctggtatggttaaattttggcacaccttggcgttaaaaaatttagtagtgttggatgtgtttggtttggtttatagtcttaacaaagttgtagtgtttttatgagagaagacttttggtatttagtttgttaccctatcaaaatttaaaaacaccaaaatttaggccttgtttctttcagcttgggattattataatctagattattgagtcagattactataagctagattgttataatctgtagtagaataagtggttagttgtttcattcctagattattagagcctaaattattgcgtttgcaagtctaaagagggagtggggtggcatggtgggtaatttttcacccaataatctggaaaaagctcacctaaatgagcttatcagattataataagctggcctccagattataataagctacttcaataagttgtctgtttctttcagcttattttcaataatctggattaaaataatcccaagctgaaagaaacagggccttagtaggattgaaattcatacttcctccatccttatctcatcatcacgaaagaatttttaaggtcttctccaattgatcagtctgtccatttatttgtaccatagtaaatagcattgttgcacgcctcacatgcatccaactgcatttgattgcatcatgtttgcatgccccgcatgcacccttgaattaggttttattgtcttggtcttgacaccatgtacaaataggacgatgaaaagggatggagggagtaataaactaaactaagtgaaaccctgtgcatttctatggaaatttagtatgataataataaaaaaataacatccaagatagctagataacatcagattaagtaaattaatgtggtttatgataatttaaatttaaatagtatgtagaatggtgattcaaacgtaaaaagtaaggtggtatgactttatggaagaagaaaagtaggaagatagtttgtaccgtagattaatcatctaaaggctaaaaacaattgatgtgatatgacttaattagagggaaaaggagaaagataatttggatcatatattaatcatttaagcactaactaagtaaggatgaactatataagtatataggatatcataaaacataataaagatatacattgaaacattatgtgaattatgttggatgataatttaacatgtttgtatttgaaaagctcttaattataaaaactataaagatatagcatgtttgcatgatgtttaaatgtgatgattgttagtggatgatgatgtgacatctttgcatgtaagtttaaggagttagtgagagataactttaagtaggataggccagaaggtagcaaccatgggtttgccactgacgaaggcgagctcctggacgcttccttcatattccctcgtcgttggagacataagaactctagcagatgacttatggattagggtgaaaatttgtggaagttagtgaaagaaattatacattagagtatgaaaaatgagtgaatttttaacatttgtcgtgtcctttgatctttaccatgcaagttgacacatgttgtgcctctatctttccctaaattaccatcgcatatccttcttgcatccgctttccctatgtttttctcacctcttctcttctctatatatctttgtcatgaatagcatcacctccttcgctatcttccgccaacttcgtcagaacgcaccaagccaaaaacacatcattaccggattactaatacaaccatttgtactatatataacccctctattttgggaaaaataagaagcgatgtttataagagcttagcttatcgaatgtgctatattttgaaacagtccgcacaagtgtgacgtttctattgataaagcaggagaaaaatacaagtctataatcctgagagattatagatagggaaaaaaatatacatccataccacgcgtctacgtctgatcctaatgctaaatacaggacaagcacacaacacccctaaggaatgtgttttctaaacgacgcctccaagaaggaaatgacaccaatagcaccgccaccgcccgtggaatgggctatatgataatggtaactcaattggacccatggtctccagtaacgctgatctatactcttcaactttgtcgttcaagccgttgcaaaattgggcaagaatcatccttagcggacacatgaatcatgctatcactgtcttactgatcgaaggtgtgacattcaattgaaattgctccaatcaacgtagcatagtcacattttttgcgcaaaattttacaggcgtacgtgcatgttttacctttgttttaatagaagattctaagtggacgtgtgttgtgtgttgtgtgtttcacttttatgttaatgcttgctcttgctgaaaacaaatgctatcactttattgaataaaggactaccttttccaaaacggtctgaatgaaggacgccaaaattctttgatttgcttcttaattctttgcacaagcctaaagctatttgaaatcagtggaagcaattatttatgttactttagtttccaattcagctctatctattctcaaaacaatttaggttgcgttcagaactacaagctcccatcatatgttctattgtttttcgttaacatacttctcaagttgcaaaaagaatatatacaaaagtttcataaagaattatattaatcaaatttttcaagtttttaactaatcatgcgctaatgaactatctcgttttatgtacacggggagaagatcccaatcccttcatccgaacacacgttaacatctttattcctctatgtcatctcgtgttgcatcccaattcaccttaattaacctctttattcctctatgtcatcttttgtttcagagggtcgtcttgtcaaatctcgggataactataggccaaatttctagccaaccgctactagaataacgaagatctatgccaatttcctctatattataaagtgttggattgatggttaagattaccaaaccacaatttggacaaactatagcttgaaaaaaaaaggagggtatatatgaccacatttcatgcagagttagctagccattaaaatgagttctaatatgcagagctatatgaaatttagaaaaatgaaaaggactccaagaaaatgtaagaaatgagtctttaaataaaacacccctagtcttaatttgagcatgatattctgaacctatcatcatattatagagcatggtgtttcatagtttcatactctctccgccacttatattttgggacggagggagttggacctatctatgtaattttttgacctactttattttaattaaataaattaaaatttattttaaatttgtacaaacatagtttatctatgtctatgaaaacttagtttacctagtttcaattaaaatgggcgaatctttacccacggatcgacctgagccatccctaccttgcatctatcgcgggaaggtgttgaaaaaacgttcaaacggcatctcacgtttggtggcccagttcacgtgggggaggaggaggaggtcctttttacaacgaatccttgtgttgcaacttgcaagtcctgtagttcacttatgcctctacagtgcaacagaaagggaaaacgaaagcggaaaaaagagcagagggaggcacgcaccaaactggggggctacagcaacgtacttcgtgccccgtaaataccccatacgaacgatgcgtaaagacctcgccaatcacatgtctatgctacctagtcttcctgaatcctgaccacacatacgagagagcagatagcgccgcgcgtgctcaatttacaatggtgctgccatgccttctctatgtgttttggtgcttaaacagagtccggtgagacgccgagtttgttatgcgagggggagagaggtacaaagagaaagaaaagatacaataggaaggagactttctcactctctccttcctctatcgcaatataaatacaacgtagcgtaaatgtaatacattttaagactataaatctgaacggtttagatccgtagtctacaatatatcccatatatactaggttacatttatattgaaatagtgagggtaatagagaagagtagaataatagagaagtcaagttatctgatgtaaagctgatgttacaactagtacatataaaaatatgttctgtatacatatatactctaatatcaataaataaacctaatatattctttgtgtgttttgtgtgcactctgttccctttctcttgcaagggcggagccaccatgattcctgggtattcccggaaatacccaacttttttttatcaaaaaacaagtatacttctagtatatacacatgtatacatattagtatacctaaatcctcaactctttgatccaaacacagctcaaccggtctcttgcgatgcctccaaccaactcaacccactccgtcatgacccatcagatatcagttgactcacttagccatcactcttccagacggccccctctcgctctccctccgtgacccacccctccctggctcggctccctcgcaccactccccatttgcaaaccctaggtggcggcgcggcgagacggcaaccggcggcgggagctggactgtgctaccgcggagggggaggccattgccgcggcgggcggcgggcggcgcccgacactccgccaaggtaaggcggtcaggtcggttgggtagccggtggccacgaggggcaagggcggccaacggcttagtgcttagacgggaatacccaactttgaaatcctgtctccaccactattctcttgatgtaggtctataccgttaaaactcctaggcaatggtgtcgagcggacgattgtagaagagccagcttcacttattagccttgctctaactggagaagatgagaaccttttcggtaaccacttgcacgtatcctaaatcacatctgaaaattttataatacccctattacaaataaatttatttatcaccaatctcacacatatcaagtcatgaaaagcaaaatgactaagatgaactttactttactaaatcataatgtaattgtttcttgctgcatttatcttccactttcataaagataaatcataatgattgcatgaaagatgaatttattttgggcaaacaaaaggggcaaataaacctgttttggacagagatgatattttggtaactttcatgcctctttactttggagagatattgcgttcatttcgtgtgattctagctagggttgttttaggtgcacaccatgtaattgcacgtttaaaatatgctgtgcatacattgatgatttgtgtttataagggaccaacaaaattaagctgatagagaggttgtcaactgtatacggaatatatatgtatggtacttgctgataaagttaattataagatcgtgtaagatgcgctacattagatatagcttaaacgaaaacttttttttatagaatataaatttggcgtgggctggtctgcctgttagcttatcaaccatggtaaaaatataaattttaaaaattatttttgtgattttttatcatagtttatcttttacatcgactttaaaccgctaaatataacacatatagttttatctataaattctatatctctactattataaaaattaaaaatgtttccgctggattttcggtacgtcatccatgtttgagtggatttttgagttggttatatatcgtctgtatccaattcgacgtgagtctaaaataagtattatacaattctatcctggcacaacccctccctgtcccagcccaacccaacccaaccggtccacaccatctcacgcgcctccactcggccccgcgcgcgcccctctcctgatcaacgtcttttttttctcacttttttctttttctccctttctttccaatatcctctcttttctgtttttttccctcatttttctctcatcataaatatttttttatacgacaagtttgctcttttgcaaatgcttttcatctacagtaaaaaaacatttactaatagaataatcaaagtttcaatatttggtccatgatgtatagagaaatggagtcactcctgttgttccccatcaaaaaatgtatagaaaaatgcacatgcgtcaacttatggaatagtcatccgatcgatttgtaaggctatgtaaatgtttacatgaggaattcttcgtgtaatgacgcaagaagcgagcgcaaccagtttcaatgttatatatgatttctgactttgttttgctattgttttgttggcctttttttggtttgtcatttaaattgacagagtttttatcaaattatgaaaattgtcttcacatgttgcaacatacaaacatttttaatagtatgtgtaaagtttatccccactaagtatagttaatgatatttctctctactctcagtaagccacatcatctcaattatttttagcccttggatgactgatctatagtccaaattgtcttactgcttttcttcacttataaagtcatatcatcttagttttgtctttggatgattaatttatattatcttctttctttttcttctcttattgagtcaaatcaccgtagtttaacttttgaacaatcaatctatatatgattttaattattataaaccgcataaccttacttgtttataatttttttcgatagttatcgaggagagatcgtcaatagcggggaatcgtgagaccccccatttgtgagttcggccgggggcggaggctcatctcttagaaatcactcgctcgtccctaggatcaccggcaagcttgcacgcaatcggattatacaggttcgggccgctatggagcgtaacaccctactcctgtgtttgggattatggatgagttttacaaagatttcttcactctaaaaagcgcactcgcttcctccctcctggagttttggttttttctccctctctcccctttttctttcttttttttcttgtctcagtgggcagggtcctccttttatagctcaaggggataccacatgcgccgcctctacctaccctctatcggagggggatcccaattcacttttcctgggctttaaaccgtgccttctccccgaagctaagcaacaaccgattctcgagtggaaccaggcgccgccccccgcctgacacgggggacaaccctgtcattccctcataaatgaacgatgacctgtgacagcccttcctcgagtgacgctcggacgtgacgggtcatacccacccccactctgccgggtacaagggtgacgtgaggacatggttgccctatccgtcggatgtgacggtgccaggccggtcacagaccggtcacatccgttggatagaggttagctaggcgcgccgcacgtctgcccttaccgcattaaatgcggtgagggacagttggggcgtcgcacatttatagctgttcagcctgtgctctcgctctttccctccgccgcgtggcagccgggtgagggcctcggggcgaagacgcgggatagcccgagggggtgacgccatgccccgaggccccccccctcccccccgcggcttccacgactcgcgtgacgcgcgaatggggctaacttgcagagtcacgtggccggaaggaaagtaattcccctctacttcacatacccccgggaccatatctccgacagtagcccccggtgctatatcaggtattgatttcctgagatcgttctgacatggcgcctcacgactcctcgagctggggttgtgggcccggcaggggatccaaaaggatatcaccgcgtggccaggttggcgtgccaaccataacagcagtttgaccgccattgaccgtgctcatgatgaagatacttgaggcgcgataatcccgatgggtcagtcagaccacgcctcgattctcccgctcgctactcgtgtggcggtagtggtgatggtttgctcaacctgcgctcatagccattgtgcactccacctcgaatgcgccactgacagacgcactaaaggcgggaacggatacaacgggcgacatgatgattgggcgcaagatgcgaagagacaaatgcgggcgcgagaatcgtgggggcaagtatgggagcgcgaaacgaggaggcaagtgcggatgaagcgaggataaaagggggcggaggcagagactctgcccccttcctttcgccaaccgcccactcgtcatttcgcttctcgaaccctaacattctcgccaccttatactgtctcgcgctccacgctctccgccacttctccgccggttgccatggcccaagacaccgatgacgcagtgcttccttcctcctgcatcacagcagacaggcaccttagccttcccttcaagatcatgccggacggtgccatcatgcgggcgggagagtcgcggccgcggccgcgatatccggagcgatccgtgcacctcttgtccttcgccatgacgggcttgattccgccgttctccagattcttccatgaggttctggatttctacgaaattcatgccttgcatctcgcacccaatgccgtgatgacgctggccatcttcgcgcatttgtacgagatgttcattggggtgcgaccgacgatgcggttgttccaggccttcttcattccacagctgttgcaaggcgcggtggtggggggatgctacttccaaccccggccaggcacagcgggtcagtacatcgagagccatctccgcaagaaatgggaggactggaagaaggattggttctacaccgcgttgctggaccatccgcgacttcgagttcccgctggccctcctgaaaggtccgctgcatggctggcgacttcggagctgggcgaggaatacgacgcggtgtgggatcgccttaggggcctgcggagcctgggtctcacgggggcgatggtctttggcgattacttccgccgccgcatcgcacctcttcaggaatgatcccgtggagcgtgggaatacattggtcccaacgaccccatgcggacgcatgtgggcgagcgctaggactggggtgcggaggacgcgaagatggtgattcggcgagtgctgggcctagactctgccgagccaacactaatcccagatgggattcttcccctctgctacgaccgcgaccgggagagcattctggccgtgatgtctgccgtcggcgccggtaggagccggtccagccgaggcggcgccagcagtagcgtcgtcggcacgggtggcggtggtgcgaccacgggcgggagccgggccggcggtacaggcggcggtggctcaagggcgcctggatcgagccacggacccggagacgattccgcctgtgacccaaaggggaaacggaaggtggcctattcccggccgccctctccactcatgcctttaattcctttttgctgtgtgcccgtagcaggcacttcttgtatttaggccattgtaccatcctatcttgttctgcaactgaaacttctttaacccctcttactcttttaccttttccattggatgcctgtgacatagagagaagaaaaaaccagggcaaaaggggataattagactgcctgcgattgacatgtcgttttgaccccccccctcgggcttgttctagcgagaagataaatccgcgctcggtccatggaacctaagtggtgataggcaagaccatcgccctgctggagccgcccagcgggactggccagaccgaggctgcgacgaccgggggtcggggatgaccgtatgtaggcccttccgatcccccggggttcggcacaacccggggcgcggcccgcgctcgtgctccctttcggcgattttcaggccgccttacggcacttagggtttagagtaaacacggattatcccttgaaccgggacaagccagaggaaggggagaaaaacggtgtccacaaaaaagtagaaaaattcattgcttgtaaaaggatacacagtggtagcccccggccagtcccgcacaaaccgaggggttgtgcgggggctggcccgtgctccaggaaagcaaaaaatctcgatgtcatggatagaaacgacggaggtgctcgatattccaggggttgggcagctctgtgccgtcctccatggttaaccgaacggagcctggccgaggcactttgatcactttgtatggcccttcccacattggcgagagcttgctcagccccaggcgcgactgaacgcggcgtaggacgaggtcgccaacttgtagtgatcgggcccggacgtggcgctgatggtagcgtcgcaggctttgttgatagcgcgcggcacgcaaggccgctccccttctctgttcttcaagataatcgagatcgtcgcggcaaaggtcatcctggttggcctcgttgtacaacacgacacgaggcgacccgagggaaagctcggagggtaggaccgcttcggcgccgtacaccaagaaaaatggtgtttcgcccgtggcgcggcttggagtggtccgattttcccacaacacggtgggcaactcctcgagccatgaatccccgtgcttcttcaggacgttgtaagtcttggtcttgagtcctttgaggatttcggcgttggctcgctcgacttggccgttgctcttggggtgggcgggtgaggcaaagcacaatttgattcccatgtcgtcacagtaatcgccaaacagctcactggtgaactgggtaccgttgtctgtaatgatacagttgggcactccgaatcgagacgtgatgcccttgatgaacttaagagcagaatgcttgtcgattttgacaactgggtaggccacgggccacttggtgaatttgtcgatggcgacgtacaagtgctgatacctgcctcaagccgccttgaatggcccaaggatgtccagcccccaaactgcgaaaggccaagatagtgggatgacctgtaaggcttgggccggctggtgggtctgcttggcgtggaactggcgtgccttgcaccgttggacccattcttgggcatcttgtaatgcagttggccaataaaaaccttgccggaaggccttttcgactaaagttcgtgaggccgaatgggctccgcactcaccctgatgagagtcggctatgagctcgatgccctgctctcgagaaatacacttcaagagtatcccgttggcggcacgctggtatagggtcccttctataaggacatactgtttggagatgcgcgcgagcttttcagcttctgcgcgatcctcaggatgagtattgccttcgagatacgcccggatgtcggtcatccacacgacctgatgaggggggtcagggttgaccccctcgggccccgaggggcgcgggtcgcccggagtcgggtcggtgggcgtgtcattggggtccctcaaagggctcggtcgcgccgatggttgtgcgagcctttcctcgaaggtccctggggggagtggggctcgtgccgacgcaacacgcgacaactcgtcagcaattgtgttgtcgcgccggggcacgtgccggagctcaagtccatcgaagtggcgttccatgcgccgtacctcgtggacgtacgcttccatttgcgagtcggtgcactgatactctttggatacttgatttatgaccagctgggagtctcccaagaccaggagacggcggatgcccattccggccgtagccctcaatcccgcgaggagcccttcatattctgccatgttgttcgtggctcggaagtcgagacaaacgacgtatttgaggacatccccgtttggcgaggtcagcgtgactccggcacctgcaccttgaaagttgagggagccgtcaaaatgcataacctagtgcccgccgcgaatgtcggcgtttggatcctcttcttctccgggaagggaaaaagggacattggacggaacaggttcgtccatcggggtccattccgcgatgaagtcagccaggatttgacttttgatcgcgtgccgcggttcgaactgcaaaccgaactcagccagctcgatggcccattttaccactcgtccaatacccttgtcacaccctaaaaattcaaaatatataaattgttgtttaattggaacttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaagtcttcttttggctttgggccgaaagtcggcccaaaacccttctctctctcctcggcccagtccggcccagttcaccgccgcgcgcgcgcgtccgcccgctgacaggtggggtcgtcgtcaacctccggccgccgcagcccgaaaccctagtttcgcgccgccgccgtttccttccaaaatcctgccgctcctttccgtttccggtgaaattgattgaggggaaacaatctttgggatctcctctaccttttcccctttggaaacgtcggctaattcgttttggaagttcgtggaatcaagttcgattcggatcggtctctttccttcaaaccccgatctttccttcccgtcgccggccgccgtgggccttcgccgtcgcctcctagcccctttaaaaggttccccgagctctcctctacccgtcgccaccttcgccttcgtctctcgtcgtccgtagtgccctagcgccgtgtagcttcgagccgccgtcgtcgccgccgctccagccgtgcgccgccgtcgtttcagccgtcgccgtcgctcgggaaggtcgccgtagtgatcgtcaagtcgccgccgtcctcgtccgccgcttcgccgccgccgaagaccgccggagcaccgccgtcaccgccgacccgatctccgccgccgtttcaacctcatcgccgtcgccgtccgttgctcttccgccgcctttttggtcgccggtgagttcgccgcgtcgccctctacccgttggtgccctccgttcgtgccgtagtgcagccgttcgccggcgagcatgcgcgcccgagccgccgagccgccgtcgccggtggtgacgtcatcgccgacgtcatcgtcgcccttccccgtgagccggtcgtggaccgttcgatctcggccgtccgttttggatcaagtcgatctcggccgtccgttcgtgtgaaccgccgccgtgcgcccggtccaccgaaaccctagcccgctgacgcaataaatctctttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgtttagattccgtcgtttccggagagtccgttttcgcaggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattctttgttatagcccttttgttcttggttactttattccttgataccttgggttattataacttgactagttgagctttatatattggttcagctagatattagatgtgattgcttatccatgcttagaaacattagcacactattgggataacttatgactcactattattttaatgatggcttaatgattgttcacgatggtcaatcgtgactggttaattaattacttgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatagttcattgcggagcaccagactgagaagtggcggagataagcccacggaggtcgctggggagtccatgccttgtttataagggggtgattatgatccaggaaaggtgcgctgtagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattagctcctggtttggaatggtatattcctggtttggagatagaactgtgcagccgggatggttgttcagaatggttgggcctatgcaacagggtatgttgtatagcgttgggttaatattgtttaatacttaactgttttattaaattctcaaatgtttgctgaatgctgcttttgcaaaaagatgaaaccctactatgccatcctttgttatcctgtgcacttgcatatttgctgtgtggcttgctgagtatgtcatatactcaccttgcaatcattcatcagaggaagagttctacaatgatgctgatggtgtggaggattaggtgtagccttggtcaagctgcttgtggagtggagccgtctgcgccgtttattttattttccgctgcttagatctttattgattgagaggaactatctacctctgtaatgacattttattcgcctattaattagagtaataattgtactctattatcaatttgttattgtgtgcctcggctgattcctggacgagggttcacacacatgtaagcgtttggaattttagatagaaattccgggcgtgacaaccctctcggttgtgcaaaatttggccaacagggtatgtcgtcactacggaaacccgatgcgcttggaagtaatgacgcaacttccttgaggccattaagacggcgtaaagcattttctgggcctgcgaataccgggttttcgcatctcgaagtgccttgctaacaaagtagacaggccgctgcacctttcggcgggaccaattcgtgttgtcaggggctgatgactcggagcgcgcctgttcggaggtctcggggggatcccggactgcctcaggatgatgaggctcggggccacctgccaaagccaccgctcctcccttgggggcctcagggtcctcccgggggctggaaactttgggcgctaggccttcgggggatgagaggccattgcaagccgaaggggccacccgttcgccttcctcacgctcaactactaaggtggcactcaccacatggggggtcgcggccaagtagagtagcaatggttcctccggtcccagggccaccaagatgggggggaagtgaggtaagctttcagttgattgagagcttgctcagcttcctccgtccatacaaatggcccggagcgcttgaggagcttgaataggggcagtgccctctcacccagcctcgatataaatcgctcagggcggccatgcatccagtgacgcactgcacatccctaagcttgctgggggggcgcatcctctctatcgcgcgtattttctcaggattcgcttctatgcctcgggaagagacaagaaaatcgagaagtttgcccgccggcacgccgaacacacacttatcggggttcagctttacgcgcgtggacctaagactatcgaaagtttcggccagatcctgtagcaacgtgtcctggtggtgcgtctttaccaccagatcatcgacatatgcctctacattgtgccctatctgattacttaaggtaatacgagtcatgcgctgaaaagtagggcctgcattcttcaacctaaaaggcatagttgtataacaaaaggtgcccacaggagtaataaaggcggtttttcctcatctttcctagccatacgaatctgatggtaccctgagtatgcttctaaaaagcacaaaaggttgcaccccgcagtggagtcgattatttgatctatgcgtggtagagggaagggatctttggggcatgccttgttgaggtcggtgtagtcgatgcacattcgtagcttgccgttggtcttcgggacgaccaccgggttcgccagccactccggatggatcacctcgcgaatgaaatcagcctccaggagccgcgccacttcctccctgatgaaggcctgccgctccggggcttgacgccgtactttctgccggacaggacgcgcatctggccgcacggcaaggcggtgctcgatcacctccctggggaccccgggcatatctgacggcttccatgcgaaaacgtcagaattcgcccgcaggaaggagacgagcgcgccttcctatttggcggtcttggacggatcgtcgccaagggggatttccttgatgggcacctcgtcagccgaggtgaggcgcttcttggaagcgcgggacgcagaggcttctgggcctgcggctccgtggccaccgccaagttgtctgcgcgctgctccgcgcaggcgagggcgaccttgacatcactaaggacggtgatgggaccagcaggacccagcatcttcatctggaggtaggcgtagtgggtggcgaccatgaacttcaccaacgcaggtctgcccagaactgcattgtagggcagattgaggtccgccacatcgaagtcgatccgctcggtgtggaagttggtggagtcaccgaaggtcaccggaagctctacatggccaagcggccatgtgtgcctcagagtaacgccattgattgggagcgacggctggagcttcatccccggggccttgagcgcatcaaaggcagccggggagatgatgctcagactgcccccccatccaccagcacacgtttcatcttgacattgtggatgctcggggagaccaccagggccaactgcctcccccccccccgagcaacaaccgtcggatggtcgctctggtcgaatgtgagctttacttccgaccagcgcgccttccggaccgcctcatgcgtgggaacaacggccagaagctcccgcttcatggccttgaagcttcggcgagaggcgtgagcgcaagcccccccgtcgagcgtggcgacggtcccctgaggtatctggaaatccagatcctcaccgtctccaccatcatcggcggggcccttgtccttggcctcccctcgccggtcaccggttgaggtcgcgggggctttgccctcccgtcgaccctgccagttttcctcatcagcctttcggaaccgctcggccaaattcttgaccgagcggcagtcggcgagactgtggcggtaagtgttgtgtaccgagcaccacttatccgccgaccggccctcgccggagggaacagcggggctcggcttatcgccggtggcctttcctttgcgcggggcccgcgtgggcccgtctgctgcaaggacatggtcctcgtcatcggagcgggctggtttccttttgcctctcctatctcgccgcttagagcggggggcagattcgggggtagccgcagccgccgcaccggtgccgggggagttccaggcccatgcctcctccttccgggccaccttgtccgccagctcgaagagctcggcagtggtcttgggctccttggaggcaatcttctccagcatgcgattatgtcacacgccgttccggaatgcatatacaactgcgtgggctagaatgcacggaatagtgttgcggacctgacagaagcgctgtatatacgaacggagggactcatcatccttctgccgtacagcgtgtaggtccgcctcttcccccgggcggggatatgtgccctggaagttcgtaatgaactgctggcacagatcctcccaggagtgaatggagccggggggctgggtcatcaaccagccacgcgcctgacccttgagggctatgggaaagtaattcgccatgacccggtcgtcacccccttccgccacgataaccgtggtgtagatctggaggaactcggagggattgatgctaccatcatacttctccgtaaggttggggcgaaacttcgggggccaccgaacattccgaagactcgccacaaaggccctacaacccgtccccccaggggtgagtgtggggggagggccgccccatgaagaggagcgtggcgctccagatgaagaggcgccttccccgatacgggcagctcggcgctcgtctcggcgtcgctcgatgttgattcgagcgtcctgcgtcccgtagaggccgtcatgatgcctccggctttctgaggcccctgacgatgttagaaccgtggatcgcctcgagatcgtggccgattgacaagcccttcttcttgccgacgaggagagggtgaccgaggtacgcgacgtaccagcggcagcggatcggccactcgtggctaactgccgctgggcagtagtgaccaagttggccacgtcgtccagccaacgcagaacaggagtctccggctccgggttcaccgggggatgccgcagaagggcacctgctgcctgaagcgcgccttggggcgaaccgccgtctccatagtcgagacggcggcgtgtcccggcgcgtcgcggcctccctccgccagggggcggagaaagagccgaatcacccgaacgagtgagatcctccctccgcgaaggttcgcggcggggaggagttggagaaccatggcgatggtgacgaggacctcggctcgcgccggaattcccactcccggatggggtgggagtaaacgccaccgcctcctcctctacttccaggacctcaaccatggtcggctaaggcctggagaaaattgggacgaaagaaagcgacttcctctcggaatgcgcaggcgccccctacctggcgcgccagctgttgaggagagatcctcaatagcggggaatcgtgagaccccccatttgtgagttcggctaggggcggaggctcatctcttggaaatcactcactcgtccctaggatcaccggcaagcttgcacgcaatcggattagacaggttcgggctgctatagagcgtaacaccctactcctgtgtttgggattatggatgagttttacaaagatttcttcactctagaaagcgcactcgcttcctccctcctggagtttaggttttttctccctctctcccctttttctttcttttttttcttgtctcagtgggcagggtcctccttttatagctcaaggggataccacatgcgccgcctctacctaccctctatcggagggggatcccaattcacttttcctgggctttaaaccgtgccttctccccgaagctaagcaacaaccggttctcgagtggaaccaggcgccgccccccgcctgacacgggggacagccctgtcatttcctcataaatgaacgatgacctgtgacagcccttcctcgagtgacgctcggacgtgacgggtcatacccacccccactccgccgggtacaagggcgacgtgaggacatggttgccctatccatcggatgtgacggtgccaggccggttacagaccggtcacatccgttggacagaggttagctaggcgcgccgcacgtctgcccttaccgcattaaatgcggtgagggacagttggggcatcgcacatttatggctgttcagcctgtgctctccctctttctctccgccgcgtggcagccgggtgagagcctcggggcgaagacgcgggatagcccgagggggtgacgccatgcnnngagncccccccccccccccccccccggcggcttccacgactcgcgtgccgcgcgaatggggctaacttgcagagtcacgtggccggagggaaagtaattcccctctaattcacatacccccgggtccatatctccgacaatagtagattagaaataaaaattatacagggcatgttcggctgcactacagcgagctgcgacagagccgccttgcacagtattttgtgtagcacagctgtgtagcaggcttgctgccgctgtaacgtgctgccgaatacagccacaaagtgctattttacaatattatttctattaatatctatcctacatgaaaaacatgtattggtggtggttgttctccaccactagcgcaaacctgacagtgagccctttaagtgggctagcctcccactctcccatagtactgtcatttcgctctctgttttatttaaaagaaaaaaaatcagtgtctatattcgtggtcttaagtgatataggtcgtgggcataaatttgacccattgcattatatcaatgacatgtgactaatggatggaaaaccacaaaaatcataaaagtgttgttcgctttggtgtactaggattgataaccctttcttccataagaaaatttgttgcaacgcatgggctatttgttgtcatataaaactttcgaagcaaaacgctggatttttttctagttactgattattttacctttagtttatgcgttcattttgacacggcttatgagccgtacttcaaactgataataactagcactggctagtactactattttccttagattcccagccaagaggatgccatcgcgtgatagcatacatagcatggtcctcctccctcaatcagattcttggaatacttgcattgcatccaagtttcatcggtgcggccttcttgtctggtcagaaactaacaccctagataaagggctagctaaaacctaagcgcgagaccgcgagagcgaaccaaagctatgctagccattattgcgacttggcaggatttttgacatcttggttatttcagaaatcatattttataaataaaacctctataaaacttaatgaatatggctctctacctcgattctatagatatgctagcgctgggatgggatgtctcggtgccgcatacactagtgcgacattgaacctcaacgccgatgttttgacgctgacctctcctacttaatgacaactctcattttttaaatttaaatactattgatttgctttcatattttggaaaaatcgaataaatcaatgtatcgtactttattggtttgtttatactactttagaaaaattctaatggtccacctacttctgttgtattgtagtttttacatattatcatcttctcaatatcgatatgctatcatattttagaaaaactgaacaaatcaatgtatcttaattcatttctgctagtttattttatttataaaaacttaatccatgaggagtacgtaggttcctccctcttccccatacataaatcctattaatttgctgtcaaattttgtaaaacaattacaaataatgtatcatcatatcattcaatttaccctatttgttttcttaaaatttgatagcaaattagtaggatttaggaatgataaggagggagggagccacatcctcctccaagattaagatttaatagaagtaaattagtagaaaatgaattaggatatattgatttatttagtttttcaaaaatatgacagtaaattaatttgatttggtgccgaaacccagcgtgtatttagcgccaaggcatctaacgacgtagggatgcatacaatatctttttaagctaatctatttctataaaatatgtttttaaaaggactaaaatgtcaaaaatccagacaacttgcggcctctccttcctttcactcttccactgcccaaaccgaaagttcccttggaccgtgtggcaccggtgcttttcggcgatgccactctccgttgtgcccaccggccggcgtcatcctcgcctccggctttttctctcccggcagacggcgttcgcttgtaatggacgcacacacatcaccctgacctcattccgatgtgtccatccatccaatattctcgcgccgacccttgtcatgctcggaggaaagcaaagtcccattcgatactcttctaaccaaactggacaatcatgagtcacaaagtttgtaactaaagattagttagtgtgctctgtcagttggtaactacaggagtgctcactgctttatgtgcagctagccagctaacatggcagcagcagcaccagtgccagtagatctctgttaggtgcttatagcaatagcagtgtgtctgtgagaattgtcggatctcacatgccacctagatcaagaacgtgttaagctacatgattcataatgcaagttacttgtagtaggtcctaccagtaccacatttttcacttttcatctctctcatctctccctttccccaccggtaccggaggaagtcaaggtcggagagagcaagacgccgagcggagtggcccaagcagcaattgtaccgggctaagtggcggtggctagcagggtggccctagcattgacggcactgggtggagcagcggcagggcgaacatcctcctctctttcccttatcctcttccccttccggtctcgtcctttggctacaccgagcccacgcagtggcggcagtcgaggagctccttagcagcacagccacgtggggcagatcgagctgatgcccgccctccctccccaactctggccaccaccatctgtgtgtgccataatggtcacaaccgacgagctagggacatatctggcaatgtcggcgtccccgctcctctcctctctccagtctcatcccttggctaccctgagcccacacggcggtggcagcttccttgagcccacgcggtgacaacaatcttctcaagcccacgtggcggatttggccagagaggtgatccagacgatgcctcagctcattggtggcaacctccccaagcccacttgggggatctagttggaaaagtggtctagccagcggcagcagcctccccgagtacccaatcgatgccgccgttgttttcggaagcttggccgacggcagcagcctcggcaatggcatcgttgttttcctgcggctcgatagtgacggataaagctgtggcttcatacccgcttcctatatctagcttgctttttatgacaaggccggccgaagaacgggtgtttctttggacgcgtgagcttcacgtgtgtagtgctagaggcaaatgtggcagcgaatctccaacgtgtcatgctcaagctgaatgccatgtcgggcgcattttgaacgcccttagactgtctctggtaaaggtggtacatatcttctactttctttatttttatgagcacgtttatcgaagcgatgaacaatatatttatttttaaaaaaatctgtagaaaagttacttaaaaattatattaacctaattttcaagttaatttatagcttgtgtacttaactaatcatacgtaactagcacataatcttcccatccgaactcattctgtctgcgttctttgcctaaaggaaaatttctcgtacacgcaaacggagaaagctgcacataattaattaaatattaactattataaacttaaaaaataattttatttttaaaaaatcttctattgagattttgttaaaaaataaacaatttaaccatttgaaaaacgttttaatggaaaatgtgaaagtttaagtttagaaccgaagaaaaagacagggcatctaggctaacacgcaaacatttgtactgatggctggttacactcggctactggcacatggattaatgttttttttccttcttaactttttaatgaaagtattagaagaattgatcattgatgtgaaccgtagttgattttgtgtctgtgtgtgtgtgtgggggtggggggggggtgcattctgtgaaatgcattacgtgccgagcgatggatggtgcgacggagaattggatccttcgctgtcacgcccccactttcgccgtcccgttcgagacgtgacaacctactacccaccttcctcgcggccttacacaaacacgcacacactgacaccgcgacacgcacaaatgtctctgtctaatggatcgtagctgtgcttcctatatatatatatatatatatatatatatatatatatatacagtacgagcgtgtcttgtaccgtttcgtactctctttcttctcttttattcgtcgcacacgtctacaagagagtatccaaaagcttacgcagaagaacttaatatactcgagattaccgtgataatacaattattagagatgtgtagttttaacctgaggtctcgtgttcaatctctatacactcacaattttaactcaaaatctctctcttattttaattcaatatacaacgtgcgtatttgatatttatatactatagttgattgaattctaaatagctgactttccgcccaacacactgattctatttttgttttacatttttctgtataaaccttcacttttatattaactagcatgattgcgcggctagcatcattatattttctctcatataatagtatatatggtttctcaatgtattattcaaatatattaaaatgataacataattttaaattttgtactaactttacgaaactactaatgcgtaatattcgtattgtattttatataggtgttagttattgattatttttaatatcaaattttagttatttgtaaattatatttctatatggactctagactcctctttcaatattatttttaatttcgagttttcgttatctgtaaattatatttctatatagactctagtctctaggctcttcttccaatatttttcatttttaattctgattttttattatttctaattgtatttctatgtggactctaaactcatctttcaatattctttaatttttaatttttaatttcagttacttctaaattgtattcctatattgactttagattcgtcttcccatgttttttaattttgaattttagttatttgtaaattatatttttatacggactctaaacactacttttaattttattatgtgtattccgaattttagttagttttaaattcctatatggagtctatactctacttctaatattccttatttttaattccaaatttcgctatttcctaattgtatttttatatggactctgtttttctttttctccaattaatatgagaatttctagaccgtgagagcgaacatagaggctcatttttctatacctttaataagttaatagattaatcttgtatggtgtatttccatctgaatttttttttgtctccgtcattggcaaaactagagtcattggatcattgctactaatcgccgacagtatttgttacgtttttttttcttttcatcacatttgactttgaaccgcaaataagtagtaaaagtgaaaaattacaccctaaaattatttttcgtctcatacgtaataggcacacgtctttggttaagccatagctcaaaaattgcctaccatcttttgcacaatatgcggtgttagagtctgtttggatgggactaaaaatttttaatccatatcacatcggatgttggacacactaattagaagtattaaatgtagactattgacaaaactcattccataaccctggactattgactcgctcttacaactttcaagctggattttcttttttttttctttattacattgtttcatatatggctgactataaacgtaacgcttattaacgataaaaatatattttagggtaaaacttatatatatatatatatatatatatatatatatatatatatatatatgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgttcttaactatgtactaccctcgttctagaatataaaaagttttagagttggacacagctattaagaaagtgagtagagttagatatggagagattgtaattggttgagaagtggaggtaagtgaaaaaagtgaatggtggagagttgtaattggttggtaaacaaatattggtggagaagttgttatattttgggataaattctaaatgctaaaattgttatattttggacggagggattactaaacaaccaataaataaactaccatagaaaaatcaaaattaactctaaacattacaaggcagtcatggtgttagaatttgtatatggaatgcatatacaaagtcaattatagtgtaggatttggagttgttctatgtgtttggataaagttagtcgaatatgtcataggctctctctgaaatacagtggtaccaccggttgtaactgcacgacgactgcaacaactggtcggcagcctagttggtcgatgatagtggataccttgatatactgtagctatgttggattagaaaggagtgttttcataatctgtgtttcaaggatgttctccctccgttcaaataaacgaatctaggaatgtgacactatgtccagattcgatgtactagaaaatatcatatccagtcctatgttgattttttatgggacggaggaagtaggttttgactaaacatcgctgacaaatatcatgatttgttgtcttcatcacttcaaggtcttctatggcatactccctccgtactcgtaaaggaagtcgttttggacagcgacacggtctccaaaacataactttaacttcttgtttctataaaaatatttattaaaaagtgatatatgtatacttttatgaaagtattttttaagacaaatctattcatataatttttacattttcaaactcaacaatttgagagttattcatgatttatattcccaaggtttgacttaagcattgtcctaaacaatttcctttataagtacggaggaagtacttcataatttgggtatcgatgttgattttagagtcggtttcctaacacctagaaaaactaaggtttaagccctaggcttgactccaaaactctaattaaatcttttagaaattggatgaaaattttgaaaatgtattacgtctaaccaaaactgactaattcaaccctaggcttgcacgttttctgtctgggtcttcaaggcgacagttgagctaaacacctagcactcacctcatttcaaatgtgcttggatttaactttcttggtagaatttgtatattctcgaaaaatagctatgcttatttgagtaagaaaatgttgttagctaatagttgggaaaatgctttatatcgcacgtccgacgaaatggaaatatcggacgtctcatctaccccactggaatgctgcaaatcgacagcatgatggatcggaagaaccctgtcaccgtaacaggtatgactagctgtttctttttattcttttctcctctctttaaatattttttcttctaaattacttatccgatctacgaaccgatcacaccgttgtattcgttgtaattaaatctttacaacaagatatcatatgatcatattatgtcaaaagaaaaacatgtgtttcaaactgttaaaactaaatgtttcatacgtaacagtgatatgtttcaatgtacgccttcagtgtgtttcacaaaattcctgaaactacctgctactactctctctccacctcatccatgcacacatgcatgtattttagcaagcttcaaaataatttttctctcaaattaattatccaatctatgatccgagacatcattgtatttgttttaattaaatctttacaacaagatatcgcatgattattttgataaaagaaaaacatatgtttcaatccgttaatactagttgtttcatacgtgacagcgacatgtttcaacgggtatcttcaccatgtttcataaaatatttaaacgtttcagttgctgattttttgtttcacttgttggtcaactgcaacatttgaccgtccgatttttttggcatcggacgtccgatgggtagcttcctcctaagagcccctttgaattggaggaaaaacatagtaattttggaggatttcaatcctataggaaattttcctataaagccctttgaaacaaaggattgaatcatatccaatcctttgaaattcctatggaatggacaatcctatagaaattttggaggaaatttagcaagatcaacctcttggtaactttcatttgagtctatccctctcatccaattccagtttaatcaaacggtcattcctgtgtttttcctgcgttttaaaatcctctgttttacacttgcattcctatcaaaatccattgttttttctattcctacgttttctcaaaggggccctaatagttgttaaaaaatgttctttaacggcttaacctgatcacaatagatgataatggtctattgttagtgctagcaacggtgatcaaatttcagtcctctaaaaaaaatctccatgctactgggtggcacagaagatccaatcttcagttgatgtcgcccttcagactaagtaaattggtacggctctcgatgtacttgtgttgccagccaatgacaaggccagcgtacaactaagaagtcatgacaccaacaattaacgacaagtcatatgattaagatgtcatgtagtagacctaagcaaagcactgccgaatctcatctctctagcgtacattaaatattcagatcgtcgtcaaaaagaactttcgcatcattagatattttttccaacttgtgctaccatataataccaacgatggataatagttgagcaaatgtatggaagttgcagccaaaaatgtcgcacgaagatgaaaaggagtatctaatttgtaggaaattgcctctttgtaattttaaatattacttttacttaaaatttgctggataaaagaacataagttttttttaaaaaaaaatcggccaacgagtttgtgtgaaacctaagtacaagcccgagtaggtcgcccacaactggggactttaccagtgcgctaaaattttcagtttgttaatagtagatggcagcgcgtatccatggaaagggaacatcctgtcaattttctcttcttcccttatttctctgcgtctgatgatatattgacatgtggactgcaaattggatcttgttatttctaatggtctccaattttctaaaaccattatttcgatctccatcttgcaagagttgagcaagctctttcacgtctttcctcattcaccagaatcaaagttgagttggatgtttgaagtggtgaatatcctatttcctctggtcagtagtcatggtctcactggtcttttcttttttttttctattttcaactggaccctactcttgttagcttgtcactatggcctttttgtatttgaacttgtttacttgattatgttgagctatgaaatggtagtacacctgcaattattgggtctctttatatgtttattattgaccattgacacgttgaaaggtggttcctacatcaatgcattttttaagagcaagtttaacaatgtagctaagtgctagcttcaaaaatgctacattatctataaccaacctaatactttattaattatgaatatatactacctcacatgtcctaaaatataacaaattttagcctttataatttatcctataatataataacatctaaatcaacattctattctcaacaaccacaaccttccaccattcaatttccctacctaccttcatttctcaaccaatcaaaatcttccaccatttaattatatatactttcttaataattatgtttaactctaaaatttcttatattatgagacggaggtaatacatcatcaatacatggctcatctctctttctcacatggtttattagggttgtattgtagctggttataaatttgatctcattttttcattgccctctctgcatataaatataagagtgataatttttatgcctgtttgtatcattttgttgcactaaataacaacggatacttctactgtacactgtgtagtgagcagggatgcccaatagtgagagtgcgatatgcagctctacagttcctcacctcttttggcaatagatacaacagcaaggagttgctctttggggaaatgaagggataccattgcataaattaatcgttctttgcccaggcgttctgatgcctccatcacatgacctcacaaagaaccaaacgagcattttggatgcattgcaactccattgccaggaagaaagtacaccaaatgctgacacaagagcttggcctggaagaggattcccctcatgtcatttgttttgttcaaaaaagtgacttttgctggcagttttgtatgacaaaaccattcaatttctctccttgttgggagaaagaacaaagtagggagaatcttagggaggttggtcatcagcattgctggcggttgatgcggttgaatattgcgaccttgatgcgagagcatttgctcaaggaaggcatctggtgctgcttatggcagaaacgagagatgcatcttatttggttagaaagccagccaccgaagaaaaaacgatgtggaagattcgttcgtcatgtaagaagatatttgatgagctcctgaaaactcatgttctctcttgagtttacctggccgagaaggtagagtttgttggacttaattcagcccatggctggatgctcatacatgttcggaaaaaaaatccactttacgtctcacaagtttggctgtttgagtcaactttcatttatgcccatcaactataaaactgggtataaaacatccttcaactatcaaaaccaatgcaaatcaaatctctcgacaatatttagagtagtttgggttgatgtggcatcatagttagtaaaaagaaaataaaaatacatagggacccacatgtaagtggcggtcggttcaccttcttcctccctccccctctctccagggaaaatctacaatgaaaattatcggatgtcctgaacctatcaatcataagtataatgctttatttttgtgctaaaatgtgtcctatgtatcatatggattgtacttgtatgtagatctgctcctgcctctcactttaacctctcctctctcttctctccctgtgggcattgttgacgaggacgaccgtatgcaggacaatgtcactgtgcttattgctccatccaaacgatgtagccgtcgccggatgtgccacttgcgtggccttctccctccaccatttaggttgtgcgtgagcgcatcgtttgcaccccttgatttcattgtcgaccggccacagcgcgacagccacgattgcattgtcacatgttctcaaccttgtctctccgtccatggatcggactggcctagcagttgggggtaggtcatgcaaggaggggtatcgctgttgggagaggagccaagagtagtgcccctcatggagagggattggcaaaaggactcaatttggtgacgggtgccgtcgattgatgttgttgttaatgcgaagtagtagatctatcgagatcaagagcgacgacaactgtgagggggtggaccagagcagcttgtggatgtcctaaaagagagtggttgaattgtttccctcactgggttttggggtggcaggagaggagggggagcgagaggaatcatcatgatcgttaggcggtggtgggggaggagggaagagagggttgtgtgtgaagaggacaaggaaaaggcccgaaggaggagaagcttcttttgaaggttgatgcggcagagcaccatggcggtggcagcatgtgactactggcccaattaggattgacttgtgtagcccatgaaaattgtatgcacatgtttaataccacattgctaatttagtaagggtgaaatcaacttataagagtttatccatccaacaatataactctttggtttatccttttacatgagactaaggatggaagtgtaagtaagtccgctcgttggatgggttgggctgcacctacgcggttctagagggcgggtagtagtggtacaagagtactagtcaggaccaacgcctagctccaacgatcagcgctagccgcctttcttcccaccatggtcgcttatgtagcgacatccccgtgctcggcagtgccgccgtatgggttgcgaccaacatcaagccgtactaccccatcatgggacatctctcttgtggccatctacaacgagatcatcagcacgatgatgaagaatgccttcatcaccggtctcatccccgtcatatgcatccttatctccaagccacactccctcagcaacgtgttcatctctgcaccaccattagctagttggtttctcgacgtccttgactgtctcgtgttagggctgatgctcgagttccaccacacgacgagatcgacgttcgtcaacccctacctacttcagttacaacgacaacacgataccatacatgctagcatgtgggtcccatcaagttttttttattttttgtttctagtgccatgtatgcgtcatgtcggacgaagactaagtcaacaaaccatataggcaccacgttaatttgcactgattttgtaaattgggggacgctccacacctggttttggaggcgagcgacgcgaatgaaattagaccatatagttgagggataataattggacttttacctagatgtttcgaaaacattgtggaatcataaaatgaaggcccaacatgcgttgcaaaagttgccggcctgcagttgcggcccatcgaaatcagtccactgttttattcggccatatgaggccttcgattcagccggcggtcgccccccgttttcgccatgttgcggagataccgggcagtgcggcgtgccgccgccgccggatgtcgatggtggcgagtcaggatggcggcgcggcccgaaacagcggctacacagttgaaaggtaataaggatttggccgagccgtgcgagtcgctggcgttgacgacgcaaattgacgcgacgcgagcccaatactccccgtatatatctccagtttgcacgaccaactgccagctgcaaaaggcgagagttcagtggaaaaaacagatggtcgctgttcagaccgtgcatgcggcgctcttgccgtcgacgacgacgacgcgcaggcggccatcaccgggtaggctaccgaggcgttcccccatccgcgcacgagccggatcgtccgagacatcgtcgccacgcggccgcgagaactggcgggtgcaggaggcgctcgcacgggtcgccgagatccaggttctgaaggtccgcatcgccagcttcctcgacgactgctccgagaacctgctctggctcgcggagaacgcagcgctcgacgcgacggcacaggacagcctgagggtgctcgacctcgacggcgccgccgacgatgaggtgagagcggccgtttcttgcaattaacacatggccggggagttaacacatgacacgttcgtccgtggttgcttttctgcagataatggagaggctgtactgtaagttgggtcgttcgacgacgcgcaagcagaggagaagtggatggacttgatcggcttgggcatagacgaaggtgtatccgttgaaagcatcggtgaggaagccaaacatgaacatgtgctggtggcaagggagagcggacggtacaggactcgcaggaacgtttacctcggtgtcatgggattgatctgggttggcctgatgcagaccaccgtgttcgcggcgcccaacgtggagttggacaagtttgcggccctgtgtctcatctttcttgcccatattgttcaggtctgcttcaaggaggaaactgataagaaacaagtgtgtgtaaatcatgagactcagatcagcggaaggcagcggtagactccaatcatttggtttggtttaaagtagacagggatatgacaggcaatttggacagtaatgatatgttacatgtaataactttacacgtcgtaaaattatagcggttgatatagtttacttaactgtctggtaaccaatggacaatatccttctctttcttcccccttctccttccaagttattttagcctgagtttgatttggagatgagttgtgatggtttaaccctatccttatttttttttagagatttgctccggtccaacaggtataggtacgtcacaataccaaatcgtttttcgatcgttggatctaacaatttggatgagttgtgatcgttggataggcattgttagatccaacgattgaaaacgacttggtttcatgaggtaccggtatctcaagatattttttgctggattagagcaaatctctattttttaataagaaggtttcatctatttatttggcgcaagagatagaatgatcatattttttaaaagaaatgggagggtggtatgtatatcaatgagaaagataaagaagctgatccggatttaaaggaaatattcttttttatagattatttcatcctaactattctcaaaccaaactctataaaatgggttcgtcccgaccgatcatgtaatcatgttcttctaaccaaacacatgctaaactctataaaatgggttcgtcccgaccgatcatgtaatcatgttcttctaaccaaacacatgctttaaatggagccagctgattaggagtcacctggactccaatgcctagtagtcaatgttagtaaatgcttttgattgcctgagctcgatgatgttgttggctttaccactactagtaaatctcccaatgcaaatagatagtgttacatgtagacttccgtattccctccgtttaaaaggaaccaatttcatcactagttaggaattagttcttttgtaacggaggaaatattgtttggctatgtaagagtgcgcagcccggcccaccaaccgtagaccacccaggttatattgggcctgctccaccacaagcccaaccgaagccacaactttaggtccgcccggcacaccaaccgtggaccacctaggtcatattgggcctgctccaccacaggcccaaccggagccacaactttaggtcctaggcctatacaacccaaaaagactagtcatcgtgctcctccatcatcaattaccgatgtgggactaaacccaacgtcacacatcaacatcaacccatgtgaccccgaagacttgttatctagcctccccaccatgtgacccataaaaattgttccgggttccaaacctccccaccatgataccacatgtaacccatagaaattattccgggttccaaaactccccaccatgataccacatgtaacccatagaaattattccgggttccaaacctccccaccatgataccacttgttgcagcctgctccagcacagacccaaccggagccacaactttaagtcctgggcttacacaaatcaaaagactagtctgatgggtggggatcgcccccaccttttaaatcgtgctcccctatcatcaattaccgatgtgggactaaacccaacaggctagctagtaaccatggtcgtttttgtctcttcccgaactgaatcttgacacgtcaaatccggacatctatgtccgtatccaatgtccgtaccccaaaaaaaagaaattgttgggtcagtacaacacggtgtcatatcggaagttccgaaccaagttccacactttcactgttttcaccctgctgactgggccttgtggcaagcaggagcacatgccggcccgtcccgccgtgcacccgcgcgcgcccacgaaacacaacaccgccgcggcgttacggcccaaaacagggagccccatccgccgcctcctcgtcatccggcggcgccgcgcggctgtacgcctcacgagaatgataacgacttctgctgatccgccgcgtccctttcgtacgccatccaggccccggggggatagcatacgctgcggcgccgatctgcagtgcccgccgccgcctgacattctcacctctctgctgcctgctaattcatcggccgccaccttgtttttactgccatgcatgtagcagtggtaattacagtatgtcggtacactcattgtcatgcagtaacagccaggagagttctgactgcgcccatgtgatgaactgatgatggggtttgatttctccctgcagatactactactgcagtactgctatcgctaaacatgagagggatcggggcccctttctcctacgtccagtccaattcaggtgcgctttttaatttttcgaattgccgaatcattccttgcattttttttctagtacacatctaggcaaattagttacagtatgtaacctgaacaagaatttcctcctatctagaagtgcataattaattagcatactttatgtaccggagaaacgttggtttctagataagttcggaagaaaagatttatcatccgtggaaagaattaaaagtttccccttggtacgcactcttcgtttgcttcacgatatgttcagtgctggagaagcgttcagcattcatctacagcatcctttgatggctcatgatagctttcataggaaaggccaagcaaagtatcgagcatggacggacgagcacattgcacccacaaaccacaccaactctctcactctcagccacaggagcgaggcgtgtcgagacgctctcgatggcacacgaacagcagctactccagctcgcactgatccgagccgagcatccgatgcagaaagttcatgatcccctatgattgtacacctctcggtcctgtttggcgaagcttaagattctgagaaatagatgattggtagccagtttctcagaatatggaaaaagtgggtttcccagtttctgatttttagttcattttctagattttacaactatatctttttaaaatttaatataggggagcttttattctataagctcccaagcaggccctcattatctctctgaaactctgcagtacgtgcaaggcagcagcgcaacaccaacatgcgtagcagaggcatcagcagcagcagcagcagcatcagcagacagtgcacccgaaatccaagcgggaggcaatgattaggggaaggaaaatccggggggatgaaaaaaaaggttaatctttttttgcgctcgtatgattcgatgcgtaaaagggatctttgatcgtggtaaaccatcatcatgagcgattagtagcggtagtaggcgcctcgagatccgcgctgggccggagatgccttccatgatgctgctgggcgccgatggatcatggatgggagccaagatgatctgcctgctcctcctcggctcctctttaccattctgcatctctatgctttgctgtagtatagcctagctttcctcgactctgctttgctagggggcatttaactatctgccacttttattacatggtaattaaaaatttattactcgcagtctataacgagctagctgggctcctttgagcatgttatcttaacgagttaatttggcttgattcattaatcttaatgagttaaaagtctagcttagttcttgagcggtctagttaaattcgttagttttgttgacgcgttaattatataaacctaataattttaaattttattattatctcatatactaacttaatactccctccattccaaattgatctacatatagtttttttagattattcctaaataatcttcacatttgtcttcatttattaagtctattcgttatttgtgcgttggagtaaatagacattaatgcatgcatccatgcacacaagtatttatagcccacaagcaatatcttaatttgctattggctagaaaatattggggatggtacatgcatcgaatgtattgctagagtaaatatagtatgagagaattattagtttttcttggttttggtgtacctattaaatatgtagatcaatttggaatgaagggagtaccaaatactaactaataactcacttaaatataaatagtttggatgactaatcactagttaagacacactaactatataaagatatgatgatgatagtctatatcaatgagctaaatgagcatcatgcgagttggctcgttattcacgaggtaaaaacttagatttgtttgactcattgtaactccagttctagccaatccagcttcgctcgctacgaaccaatccgagccataagtttcgagttttgttgaataatttgacgatgaaattttgatagcaaataatagttatagtgaagtttgtccgggttcaaaaagttatctagctccgccgctggccggctgctgctagaacagttctaccgtctacgaatctacagggcagtacactacttccactcaactgctactactgcattgttctctaccgcctagtatgctatacaacgcacgaatgacttgtggccggggaaagggtggtgattaaagctggtgcaatgcaatacatgcatgcactcctctttgctcgctttttctacccccactttggttgggagcctttgaaccccagtgtggcatgcagcagcagctgatgattcccatgcaaatatactccaaatctgcctttgtgaggatgtgtttgttgctagctactgctaccatctctccctcatgggccacatccccggcctcctttgtgagctccaaggcatgctgtcctcggctattattttcaagctccagcagagccgcatgccaattgctaatgctccatcattgggcctatctgctgctgtttcatttagacctgtttcaggttcaggcagtcacacatgctactccagattcttttaaccgagcatcataagtcatttggtaatttagtatagccgtgctgcaattatggttgcaacttcaacatgctcgtatgagtatttagcgtagaaatccgggggatcttcgcgtagaagaactttctgcgcctgttaataattattagctactcaagttatgaaagttcagtattgtttttcctcttgatctttatacgtgctttcgatcaaagttcattcttaaccatccacttgcgcattattggaaaaattgaggacgagaaaaggctggactgttagactgaaaatctaaaagccagagagttctgtcacaaaaaaaaatggctctgtttcagtgacaacagcatctacgagtatttctttttgcaggcacaaggacgcagaatttgcagacgcacactccaaaaactatcgtgctgatgaggatatctcaggctctctgcatgctggtcctgcacactctgcctctctcttcccaactgtgcacgccatgccatgccatgccatgcaagcacacaggttgcaggatcgcgagcttgcaaactgcaacacacattctctcatcgggatctgcgtcgaatggcggatgcgagagagagagaaagggataacaacaagcaaagcagcgccgctgtgagcttttgcagtagcaagttggcaggaaaaatcctaaccgatcaaacggatcgagcagagattttcagatttcagtacgacgatcgacgcgatggcgaaaatttacagcgagagagaggcttagcatagctacgtactagtacttcttctagtactagctaggcttaaagatgaacaacgaatccgtccacatgttaacgcaatcatcatcagtggcgcgggttgttgttctttcgcacattcccatacgttttacatgtgcagtgcctcatttctttctcctattcttcttctcctcctcctcctcctctttctcgttctcttcttttgtgttttgggtgtatgtgcatcctttgatgccgagctctcccttttgtcagcagaggaaaaaaatggcgagggagaaaggtgttgcccgaaaatgccacggcgaggtatctgcttctgtgtgtgtgtgatactgtgatgtgatcgatcccgatgcgtttcgccgatcgatcaaaggggagcactgttcacgatcgcggcctccttttgctttcgttgggcttgctcaaaagaggatggggggtatgtagcctgcctagcttagcatcttcttgcccggggatttcatcagtacaggtgaaaatgtcaccgttaggccaatcattctcctgctgctgcccatctgtttaactgtttttgttcgaatatctgctgcctgaagtgacatcagacgtctttttttttttttgtgtgtgtgtgtggtttggtaaaattggtagcctgaggtatgagcagataaaaccagaggcaaaattttcagatatctattgttagtgcgatttgtaactaggaaattcagtaagaaggttcgttgtttatatttataagttaataacaacggaaatgctcagtttgattcgggtggaaacgtgatcttccaagaactgaatcttgctcatatcttgcattgtctgaacaaagatccaggacggcgattaatataaccacggctgtgaattagtttatggcacagcgttatctgaaccctctattccttcctagaagctcgtaacatggcccgtttcatgctttggtttctcactaatcaagacctgtaagtcacctatagaaaaaaaaaagatgctcctgtgtgcattgaggcacatcgcacatgtgagagatggagctactgttcctgatcaaagggaggctaggggtgcaaaagataaggtaccatgattaattatcattcctaagctcgagaaggggacaactttggcctcccatcatgtgcccggaacgctccctttcaccaatctgctaattagctcctcctactaggagcttgtttgatcagatgcccatcttttgtcctaaactcgcctaagtaggacaaatctgaagtggagaggacagtgacaaccgggtgccacttttgttctcttgctgtttgcatctgtttggttagtcttgcagggaaaatgaccatcctagcctgcaaaggaaacaaggagatggggataaaaagggaaagctggaaagggaaagttcatatcggctgtcaagaagaaaagcgcttcagaaggaatgtgatgctttcagattttgctttgactagctagggagaattacaatttacctgcaggtggttacttgtaggtttgtatgaggaatgacagtgctttcacgactgcatttgtttgttctagcactcaaatggtacttagcagatgtaataagattccattaacgagattccctgcaacggttctttccacgaaatccacaggccagaaaaggcctgcctgctgagtggattgactctggctgatttatggcacgaatgcgctaaactcttttaaaaggaacgtttgaatgtttgatattctcactgtgcattttagagtgacgatggagaatgaagttgtggagagatagcttcatgaaatatctgaagaaacatctccagatttatcagatatttcacgtggttcagactttagagttcacatcgtcacggcctgcccttttcttcagcttctcgtgtgttcggggcatctgcctgggaatatctgatgaaacttacgcgtaggacataatcaagcctggtgccccaagtcataaggattttttacatgcaacgcgacgagcgctgtctcgtgaaagtcaaataaaattgttgtagaactctacatgacttcatatcgctctcctgataagggcaaaaacaaaatacaggaaagtaggaaaccaaagactgtcaaccagtgctgttctctagtaaaataaactggtatttttggcatggcgttgctcggacttaattgatcatcagaagaattgtactagtagtgcttttttagactgatgaagctttcagattctagagtttgaactcgaagaaaatgaaggaacactgctgccaaagcatttcttcggaaaagggaatttggtatatacgtcaacattcttaacacgtttcttgtttgctactagttgccaagcgtgcaaacatcattataatgtttaatacagtgtcaacgggtccggcttgcctacaagattccttaggaccatatcaaatgcaaccaacaatacatctttctgttcctttttcattcctttccctgatgaataaatagtacagaacccactattgtgttcgatgattgccttttctaatcataggttaggagggaaaatacaatgatattgatgcatgtacatttattggcaagcctatcaacacagtatcatacggtgaagctaaattccttttcataagattggtctgagttataaaacaatgactacatgcatgacaagtgaaaaaaaaaagagagaagaaagtaaggtgatcaatcggccacccaaaccttactaacttgtttagttttaatggagtgggagcgtccctcaaacctaaacaactgttttatccttctcaatgtagtacttatttttctagcaaactattgtgcttcactcattaactacatcgtaattacctttcttaaagaaaacattaatattccataattatactaagagtactagtgcttgtatggatacattgatgaagggtaagaaggaaaactacatcattaaaagtgctttagaatgtgagaataatagcaagtattttgaaacaaataaaatactagaacaataaataaattgaaacgtatggagtaacatattacgaatcaagaaccacaagatataaaaattctcgtttgctaaactatgacatattagtacactctctctctcggattgataaaaaatagacgaactgtgctcaacgtacccagccaatgcacaaaatataaagagaaattgttttgttggaacagatctcataatttgaactacattaaaacagatcttgccatgcatcctcgaagaagaagaataagatcttgtggtccgagttagatctcaatctgatgaaaacattgttttgaatgtttagaacataaccacaaattaacaagaccatgatgtactcacaagtaggtggaaataactccaagcaagtgattgcaaaacaacttagggcagtcacaaccctccacctaggatggtgtctatggcattaactacattgccatgtagtacttttagcttatgtggcactatattaattaagagagagagtgaagagaggaagaaactgggtctcatgcaagacacagcttcaacacgagaacctatgtactagacactatcaagttttgcattgggagagaatagtgtcttcataatagatgaagaataaatatgattggtagaaaagagagatgatctatttattaatggcccactttaagaaaccatgggttgtagagtgtagtttctattgtgatgtcttattgatatggcaccatagacactacttatggacactatgggttgggactgccctaataagggagcgaacaccgcatcgcccctatgcaagggacttgagggatgattgaaatcatagctactgccattcttctcatctcctccacctcaccgctaccggaaaacagtacaatgagctaggatggtggcgccgaggattggtttgccacctagttttggtgcgaagaaaggaaggtgcaaggtgacgatgaagaaggcatgacgttgaaagcgacatgcccgggggggagggggcttcctccgtgagcatagatctggtgcctcctcgactcggtttggctggaacacgtgatgcgaccttacgatggtagacaagcaaacgattggtgttgagtaggttgccaatgtcaatgacggcatgagtggccacagatggcataggcaactgacacaggagaaggaagcgattgcggctgaggtgttgccctagggggaagggggggtcatagagtagcgtagtaagaaagcaactgagatggtgcttggacgaagcaacatcctggttgtttggatggtgatgacatggaggtctctaccgcatacgacggcttagacgatggcaagtgggtttatcctaggagctcctccccttcaaacggttggcatgcttctaaacctgatcactaggagcttcaagcaaagagggaggcgatggttttggtcggaagggtgttgcttggcggaagacaacaacctttggcatcggcaacatgttgaatgaccttgtggtagctaggtgtaggtggttgtccaacacattagaggtactgtgctggagacttttgtgttgtggcggagtaaaaggtactacattgggtgtgatctaggatatgataacccacgatttcatgatcctgcaaggtggaggtgtgagtctggtggattttgtgatgatatcctgcatctttgttgtggtagagtcagagatgctacatcggtgtagcaagctaggcaatataacaacttcttcgctttggcaacgaagattggaaggtacaaagagcttagggaaaaggccatgcctggtcttagatcaatgctggcgacgtcaacgttcgtgggcaattgggcatcatttctatccttggaggcgttataatggcatttctcttgcttaaatataaaacctagtatgttgttttggaccgaccttgataccgtcgtagatgatgtatctttcttgaaggcttcgcctagaaggtcatgctatatgtttgtggtggttgttgcgactaacgatagctagttgaagctgtttgatcgttatgccatgaacttgacaacaaagacttgtgatgggtctcggtaggttgtcattgtaggtttttcgtgtttctttgtctgggtttttatcggtttcacttcaatttattgtgtcgttttaaagtttttaggccaagtttcacttataaactttgtcgactttagttttctatcaaagtaggagctctctaccctttatgatggatttttatgaaaaaaaatatatagctctataccataagcctcccattgtttgtcccacagcttataagtagttgcataattttaaattttaaatttattattgaatttggctttagttttttcatcatagtttatttttaacacattgacttttaaatcaccaagacatactccatttgtcacataaaaaatcaacttatgactataaatcttgacataagctaaactagctgggtggcccgcgcaattgcgcggctagcacccatacaaaattatctattttttaatatgattttacttaaaatttattaaataactatcttattgtcttaagactttaaaagacaaaaccttatcatccccatgcttctaattttatggtttttaaaagtcatatcaattgctacaccttactttgtcacgccttctttatttgcttgctcgatccactattgtttctatttattctttctttttagaacctttaaaaatcggaccttatagtttttaaagttcatttcttgttgggttacatttttataaattttagaagtcccatcaaacgttgctagtatactcctctatggccagtccattgtctcctctctttattgtctttgaggttttaaaaatcgaacaaaattatcttttgggttcattttttactttctagaagtcatgccaaaccatcagcagttgtgccattgtactctatacggctcgcccattacctctcctcattattgtcattgagattttaatatcaaacatgatgatcattggggtttatttttttactttttaaagtcctgccaaccgccgtgaacatgttgcttaatggcatgtccaacgtctatccttttaatcatcatcgagattctatttagggttttgttaatatttttagatgtatcatcaaccgtcaacactcaattgctttacatgtctcatcaaactgtcaacggcttcgttactatactcctctaaggcccacctgcttcctcccctctttatttttttttgagattttaaaaactgaactgattgtcattagtgtttatttttctactttctaaaagtcccatcaatcgtcgtgactatgctgcttaacggcatgctcatcgttcctcaccctaatcattattgggattctatttaaagttttgtttatttttcttagatgtcccatcaatcactaccattctacttctttacgcgcatattgtcttctctttttattgttatttgtcatcggtgttctagagatggacttcttttcttttctttttattttgaaaattccatatttttcattccgatggtttttatttataaactatattcctatctgaactcttttaattatttttttgtttttggaatttattttatttgttcttccgaatattagtatttggtcatatattcttagatggtcctttattttaatagtcattgttttttattgcgaattttagttatgttcatagatggtcttttatttcaatagtctttattttttattacgaattttagttatttatagattgtattcctagttgaactcttcgttttccttttctaattttggatttttttttctaactctatgtggcccacacaattgcgcagctagcacccataaagaattatctaatcggtgcggtgttcattggcaaattatcacgtttatggagtgagtttgaacggtgtcccatgggccacggctaaaaccacgaagtcgaagtgtcctgtagcaaaatttgcctttgtataaagattagtacactcctgaacgtatctaagctattattaatttatttttattatgaaatttattttctttagaattcttattgattcgtattttaaatttaatttaatcccgcattgtgtttcatttgtttttcatctgtacggtatgtacttggcggtagtaatggtggcaataatcactgtacataaattgatatatatacatgtcttacgtcaaatggaaatgctgctagggtacataaaaggaagtgcttctatgaagaaaagaaaaggctgagtgcctcaatcggacaataagtcctattcaaattaagcttaagctgccttggttaggagtccgatccaagccagatcgtatatatttctatgtttgattttataatttcgatcagaatttattttatttttttatttcaaatttaatttattctcatattggatttttatattgactcttctttcaatattacttatttttaattacgaatttcagttatttttaaattatatttctatatatagattcatcttttattttttattatttattataatgagggagtaagagaggaaattactgcatagtagagtcctaatgggacttctgctcatgcatgcgcctgatttgattcacagtagtatttgtttcggtgcccactatcttggttcgtattgctttcccataaatctatcaggaattcaattttcatataaatgattgtattttatatacaactctatcgatcaatctacaccactacaatctgaatctactataattctatttttttcttcttttctccgattaatgtgggaatttctagcccctacagtgaacgtggtgcctccttttaaagctgttttaataatataactagctgggtggcccgcacaattgcacggctagcacccatattaaattatattttttaaatataattttacttaaaatttattaaatagttactcgttgtcttaagattttgaaagaccaaaccttatcatcctcgtgtttctaatttatttcagttgctacctcttacttctgtcttattagctcgctcgatctactattatttctattcattctccttggaatatttaaaaattggatctaaaagcttatagttttatagtttttagagtttattgtcctgttgggcttcttttttataatttatagaagtcccgtcaaacactgacattatactcctctacaaccgtccactgcatcttctctttattgtcattgctattttaaaaatcgaacataattatcgttaggtttattattttttactttctaaagttccgccaaaacgttagtgactttgtcactgtactcctctacagctcgcccgctgccgccgttctttattatcattgagattttaaaataaaaaatgattatcattggggttttttttttttactttttagaagcccgaacctttaaaaagtgaaacttcttatagtttttagagttttattgtctcgatggatttcatgttttttataatttttagaaatcccgtcaaacactgccactatacttctctacgacccgtccgccgcataatctttattgtcattgggattgtaaaaattgaacacaactatcattggaattcatttttcacattccagaagacccaccaaccatcagcggctctaccattgtacttctgtacgacccgcccgctgcgtctcatttttattgtaattaagattttaaaaatcaaatatgattattattggggtttatttttttactttctataagtccccgccaaccgccttgactgattgcttcacgacctgcccgccatttttccttttaatcgtcattaggattctatttggtgttttattaatagtttttagatgtctcatcaaccgctaccactctgctcctttatatgcctgttacttaattaatctcgtcatgtgctttagatagtcttttctttcaatagtttttttatcaccaattttagttatttataaattgtattcctagttgaaatctttttttctttttctaatttcaaattttattttatttattattatgttcttttgatatttttattttttttattttcaattttagttgtttcaaaattgtattcctactttaactctctttttaatctgcctaatttcgaattttattgtatttttatttcgaattttaattaatctactattgggttcttatatgtactctttttcaatattgtttatatttaattccgaatttaagaattttaaattgtatttctagttgaactcttattttcttttcttttttctaatttcgattttttatttttttattcagaattttaattaatctcgtattggattcttatatggactcttctttcaatatttcttatttttaattccgaatttcagttatttataaattgtattcctactcgaactttttttttatttttctaatttttaaatttattttattattattccaatattaattaatcacgtattggtttcctatatggactcctctctccatattacatgttttaaatttcgaatttcagctaattttagattgtacttctacttagacttttcttttctttttctccgattaatatgggaatttatagcctccacagcgaacgtggtgcctccttttaaagctgttttaataatataatagaatagatagatccaggttagtagataaaagttgattttttttattgaacgacgtgagtaagtatcaacgtttcatccataaattatttttatattgccaacaaattattttacggctaactgcgtatccgcttaaggctacatttaaacaaaacatgtttttagctagtgattaattaagtattaactattataaacttaaaataaaattatttattaattaaaaaatatatgtttagcggtttgggagggtgcatatatgaaaaaggagaaaatagctcactttaacgagctagtaattcaaactcagccgagctcgaccttcagaaccgagaatggccaatagattatgcccctggcccttctgctgccccgtccatttcccgtccacttgacactgatgcttcgcacgagagcagattatgccgtgataatcacctttggatcaagcaaatcacgaaaggacaaccttgtccaaatcacagggcgataaatagccagaacatggcgagatgcacaacgaagcagagtgtgcaaggaagagagagcgtgtgctgtggctgtgctgtgcgcctgtgcagctgtgctgcgtttgatcccccttcccctccctcggaaacggggaaaagcaaaacactcccaaagcccaagacggccagagaggaagaaagcaagcaaaagcagagagagagagagaaacaaggcagcagcagcagcagcagcagtagcagaggctagcagcacagagaggggccccgtgattccccccccccccccccctcttcatctttcactttccccatctcttttttttcaccattttaccactactgctgcctcacgcagtcacgacgctgaagtggtagtagtagtacgctctcaaaacccaaccttgaatccgtcacgctcactcacgcagctcacaggctcacagctgcagctacttactactggtacgggctcagggccagcagccagagtgaaggggaggcgaggcgaggcgagccgtgtcaatgtccaagaaatgtgatggcgcgctccggtgaggcgactggttaggttagccgaggagggggaggaggcgaggcgaggcgagggcgagatgacactgcagatggagccgccgccgccgccgccgaggcggtcggtgtcgacgagctgcgacctgcacccgggggagacgttcacgggcttctgcgccgcgtgcctccgcgagcgcctcgcggggctcgaggcgtccaccgccgccgcggccgccgcgccgggccgcaggtccacctccgccatccgctcgctcttctccaggccattcgtcgccgccggcggtggcggcggcggc

SEQ ID NO: 66146 - DNA, 147221 bp, Oryza sativa
aggatatcttgctcttcgtcttcctcgtccttggccgcaggtggtggtgatgggtgcagggatgccgggtgcgccagtagcagcggcaggggcagcggtgtcgttggttcggttggcgatggttggtgggggaggaggggcgggcagcgggagcgggccgtcgccgccatgtgcagcgccggcatggagggggtccggcacggcgccgccgccgtggccagcgtgccggcggcgtcggcgtcggcgttgccggagcgggccaaggtggtggcgctggtggcggccgtgatgctgctctgcaacgccgaccgggtcgtcatgtccgtcgccgtcgtcccgttcgccgcgcagtacggctggtccagctccttcttgggcatcgtccaggtactcggttcggggtcttctttaccttcccagttcatgccatctctttcacttcacttcactattagtagcacatcgcacaggttccaattcatcgaaccttaggcaagaatctctgctctgtcactagcaacaaaatgtccaaaaccataattagttcatcatatagcaacaaagtcaacgaagcatcaacgtcacaatcgcgacaagagaatgaccggaacattacaattagtagcacaaacagacaattatggcagtccagggtattagctcctttctgtgtgcaggtccagtgcaaccgtgtagcaaccaagttatcttaatacgattgttttgagagtggaacctgaaatgaaatttgctatgtgcttcacacatgaatcgtgatgcagttttctatttataagatatatgcttagctttagtggcttccacatagatagtgtagggtaccaatttggaagaaaccaatctgtgcaggcataaaggtcagggagcaacttgaggtggtatcgaataccaatatctcctcatagtggcaatattggaatttgataactggaatactaaaacatgcaacccaactgagttaagcattgcccctcttttttggtgatggagttcagcacttcagatttacttggtgacagaacatgaatgtttcataacaaattaccagctagcttaaataccattgcaacatttgaagtcattcgataacaaaaaattgtttccctcaaataaagaacggcaaaagaatttgtgcatgcttattgtatatacacttgggcaacaatatgtcttgactagatggaggttcacataaagaagtcatcgtaaaaaccaatatgccgtaacactaccggttctatatgaaattgtcaatgtgcataactaactaggccagaacaaacacagcttgctcttttattattatgtcatgcgtgattaatgatttccagatggattgacttgaggttaatcttctcatcacctgtacagtcatcttttctttggggatatgttttctcatccatggttgggggagctttggcagaccgatatggagggaagaaggtgatggcaggtgctgctgccctctggtccttggccactttcctcactccatgggctgcttctcaatccacaattatgttgcttgccatacgtgctctctttggccttgcggaaggtgttgcatttccaacaatgagcactttcttaccaaagtaagttgctctatattattttctggtgatgccaattctagttgttagagattagagattctggacaagaatttattgatgcaatcaaacacaatctcatttcgggctttcaatctcactttgaacacaaaacaggtggttcccaacacatgaacgtgctactgctgttggcatttctatgggaggattccatcttggaaatgtcataagtttcttagcaacaccgatcatcatgtcacatataggcctcgccgggacatttgccttctttgcatcacttggttacttgtggctttctgtatggttgttcaatgttgaaagtgaccctcttgacagtcgtacaataagcaaatctgagctgcaattaatcctagccggaagaagtgcatcaaaaattcagggtagcaaattcccatccttacgagaaattctgtcgaagatcgaaatgtgggccatcattgtagctaatgtggtcaacaactgggtaagattgataaatcagttatctacaaattggtgttgacatatctatctaaattttaacttccgtgagttcgaaatactatgcagggctattttgtactactatcatggatgcctgtctactttaaaacggtatgttgtctaaggtgttcaaattggtcactgtgacaacgctgctattaagctaattcctgactgctatcctacaacaggtttataatgtcaacttaaaacaagcagcatggttcagtgccataccttgggcagtcatggctctgtctggttacgtcgcaggagcttctgcagatttcctgatcaaatctggtttctctgttgcattagttcggaagattatgcaggtaacagcaacacctgaaattagacttgtgcagcacttggaagttactgatagcttagcacagccagaaacataaaacttaccacaattttgttctctattcatgcttggtacagtccatcggttttatcgggccaggcgtttcactgctttgcttaagatttgcccagacgccatcagttgcagcagtcctcatgaccatcgccctgagcttgagttccttcagtcaagctggatacttctgtaatgtacaggtagtgtttcctgcattaccctgctcataccagattccgccttaactcgaacaacctttttttttcttcttgttcaccacctcaattgcaattgtaccctatctgacggaatgtgttcttcttgattgttcgagcaggacattgctcccaaatacgctggatctctgcacggtgagtccacaaactcgatcagctgtacacaagacccacaccaaatgaacgcactccttggatcctgaaatctgacatatcttcttctgcttgaacaggactgacgaacggcatcgggacagtggccgccatagttagcaccataggaacaggctacttcgtgcagtggctaggatccttccaggccttcctcaccctcacggcggtgctttacttcagcgccaccgtcttctacaacacctacgccacaggcgacctaatttttgactgagatgatgacattacccctcgtgtaaaatctcgaagtgtagtacttccaccattgtttctctcctagtcctatggctgagccaggaaaccaataaacagatgttgattgaaattgattgattgactgccatttttggtgtaaaattgagtgcaaccgcggttacttttgaggaagcaaatcgttaatacaggaaaaaggggtggagccgctcatacgcggttcaggtgttcgacgaaattaccgagccacgcgcgcggaaggaagcgccggggaggggcatggagcggcggtacccccatggcgcgcgcgcgcgcgcgggggggatgctggctcgccgccggtggcgccgcgatggaagacccgaagaggcgagcagccgactgcgcggcgtcggcggcgtcgcgcaaatccatggctgcgaatgcaacttttcggccgtggatgtggtatgtgtggtggggggcgcgtgcgtccgttgctctcgggtgagaaacgtgggccggtggattgagtgggattcttcgctttgggctatgtaggccaatccttcgtccggcccagctaaaatttggcctgtacacgtttggctattcaccggatcatcccatatcctcttggtatttcctagctcgaaatcagaatgaccataagctgacagaactttttatctggcaatgacccattttccatagacacacggaaaatatccttacagcaaagagaaaaaactgacagaactggtactctatccacttacacggttacaccaatcattcatgatactgagttttgagtatgaacagtgaagttgcatacgacaagttcacataaaacacgatgaagagcaggacagattcatgccttataaaccttgcagttgcagcgctttcatttctctacctttctctgagttcctccgatatacagaaggggctgctctatgtgctctttattctcttcagatgatttataaaaagattcatacagcagaagggaacccggtcaggactcaggagtcactcctgctaggcttgtttgaaactggaataacctggaaaaggaacacagtagattagtaagtcaccagatgaccatatgcaactcggtattggctagtccacatacatttttactgccataccgtctctgaggatggtatccaatcatttgttgcagggttgctcatgcagcggataatgctgtcagatgagtaggcaacggttgtcacgttgaaggagctaccattgggtctttccactttgataaaccctgtaccagtctgtaaagataacaattaactcaaccatttcatagagtattgtcgttttgttacagaatgcgcatggtggtgaaattagaatcgataatctgttgttcatggaaatgtattctatataaggtacacatgtttttttttttttgcgaggatataaggtacacatgttagtgcccctgatctgaatgatatgagccatcacatgtgacacaagaactccacatcagaactttggaattcctaacaatcatcaaccattagttctctttgcagggcctaaactatatttatgttttccatgccagtaccggagtgagcaatgaactgctagctagatacaagaggcttcggaaatgcacaagatattactggcaagtggcaacaaaatgcacggcaatgagtttaggtatgtaatggttagcatgtaagttgttttgagaggggaagactacactatacttaattttcatgacagactaaagactccagatttgtgtatgcattcgactagacagcagagtctattaagagaaatgcttgtgcaagaaggccagtgttccggaatcgcactgggaaccagaatcgacagatatacagcttatttgagcactttggttgcaatgacggttcgttgcaggcttgcagccagttataacattatttgatagtatttcaagggaaatgctatggtgctcaagtcttttttaaggttctcgtgcaaacaaactttcttctctaacgaatttatgactaacatgcgtcttctcggaaaattctagccattcaattgaagactaggtaacatgttatttatcgacaggtatttgatctcataaaacaaaaaggtcctgaaaaatattactaacaaattctttactggtatatcaaatttctctaaagaactagtatatgcccacatacccacatctacgtgctataaatttggtgcttggtaggcttcataggcagttaggcacaacaatactacaaagcttaccgtgtggtgttgcttgtcgatgcaattgagcccgttgtagtattgcgtctccacatactcctccccgttcacatccccaccgtccagcaccaacttctacagcaacagtcagtaccaattagtaccaaacagcacgctcacatcgatcgattcagcagcaacaaattaacaaaaccagaattccacaaggacgaacagatcgccaacctggggtttggcctcgaggtcgcggagcctccgaagctccggcaggtcggcgtcggcgtcggcctccgccccaccctccccggcgtccgacgggtcgctccgcggcggcttggaagggcgcctgggggccatgctgtcgaagtagccccgcacctcggcctccacccgcgccgcctcctccggcggcaggtgcgggtcgctgcgcgccggccgcgtcgtcgccatggcggctcagctcggtccaagactgggttggcgggcggtggagtcgccggtttccggggggcggttttgcgagcgcgaggatgtccggctgacaggtggggccctggtacgtgggcaaggtggcgatgccgtgaatgtggatgagatgagatggggacgtttgatcgcgattagctggggttgggccgggcgaggtggcccactgttccgtgagccgtgtgaccgcgacgcggcgtgatggattttgcgagacggcgaagtcgagaacagtaacaatcttcatgtgcccgtgcaaatctcgcgtgctagcgacttcccaattgtaggatgtgatgtgtttctatcattgttcaaagtacaagaaattttcctttattttccaagttctctgtttttcactggcattcatgtattcctttttgttcttttatttctgaaatcttacttgacaacatgatatacctttctaaattttagtttggtttacgtcccaaaggatttccaaccgaccaaacgaataccttcgcatgatatcgtgaaagggaaaagtccacttttaactctctcaaataaagatcgaatctaattcatgtatcatcaattgtaaaatcgagtgtaacagctatttcaactattaaaaccagtagaaaattactcctacgacaatattgagaataatattggttgacatggcatattgaccacagtcaaaaacaccgagtcaacaagaaaattgagaatactatatggagcccacatgtcatcctcactattctcctctgtcttcctccttcctctctcccccatctctctcttctccttttacgaaggtagttgttgatggcaaagaggtggatggggaatcggtgatggcccagtcccgcctaatgcgcccacaccactttggcatgtcgtcatctctactacgatagctggactccacaaaagcagcggtaactaacgaacctgtgataaattttgtggtcagtcacgcatccagagcttggcaagcccatgcaacatctttctgatataagtgtgcaggatggaggggcccaccgtatcccatatctaggaggggccggcgatgggggccgaggctgattgacctcccttcacgtcggtttccactgcagtcactagcctgtagcccagcagcctcctctcagaagccgcccacatctctttcttcctcctcttcctctctctgctatggtaagtgataaggcccatgagtcggagatggatcgagcaagggagggacccgaggctagtggttgcaacagggccggtattgtcgaaggggaggtaaagcggtggggcagcgcaaagaggaagatgcttttctgcgagcttgattgcaaaatccattggagaagggatgggcccccgcgagcatgagactgcatcatcgtcgcatagggtggcagccagcaggtcacggctgtagccacagatgatactaccaatgctggaggagaaggcagcatagaggctcatggggagagagcgatggcggcgacggaaccccgacgtggtcggaaggctatgctaggggccgctccccttccttctaccatgccttctccttcgctcctggcccgccaaagccgtcaaccaccattccccaatcgagctcgtcggcgtcatcgctatgtgcccatgtggggaaaggaaaagaggacaaaggaacataaaaggatgagaggagaagaaagagccggtgacactaacatgtgggcctcacatgctgactcaatcaattagacctagtcaataagtcacgtcaatgaaaaccactcttcaaactgctgagggagtcaaaccacaacggtttcgatagtttgtcaaaccactcttcaaaccgcaagatatacgatattgtgtttaggggcacgaattagattggaggtatactcgagggagctaaaatagacttttccatcatgaaaagccaggctaagaaatttgttaggtttccatcatgcgttagtttccagatccaaaataaagccgggcccaaaatatattcctcgatgcaatttgtcatggatcgcgattactgctagcgatatgggcctaccttgatcaagccaccaccgcgtgggttttagccgtcggagctgcgccgccgaatcccgccacacagcccatcatccatcagccccctgatgacgcagcgccgcccctcctgcggccgggcttccgcctccggcgagggccacgtgatgcgcgccttcgtccgtacgccctcgccgtcctcacatcgcatcgtcaaaagcttccgcaacatttcttaggctgtgtttagttcatgtcaaaattagaagtttggttgaaattggaacgatgtgacggaaaagttggaagtttgtgtgtagaaaagttttgatgtgatagaaaagttggaagtttgaagaaaaactttggatctaaacacggccctaattccattccttccaaatttacaagtaaggccgttcacaatgcaaggagctggcattcagcctgagtcctccacgtccgccagcacttaagattccatgccacatttcttgatggcccaccgaaatgaagagaacctgtgaacctgtgaccaaaacctgccactcggtctttgatgatatcaaggcaattgcagtgcgtggggctttgcctcgcctttgctctgcatggatttcgctatgtgactcttgtgtcttttgaaggtcttcatcctacttgtcagttcaggacgagcaaaatgcaaaacgcattgctattgcccttaacaagctacaaattggtagagggggacggtcttagtccttatagattacatcaattggtgtgtaaactacaaagtacaatcttttaatgtgtattcccatcataatctctgcttgtgatttttagaatcgctgtcagcgacacgctcaatacacaccgaaggctttagctgaagatgacacttcacctgtgcgatctacatcttacgtgatgtggcacggaggaacatagctgccgccacaagtgttcagacatcacagaacgctttttctggagtaaatgagaattatacttctactactaggtgtcagtcgctcagaattcagaaacatatcaagaatcaaagatgctgttaggtgcccggtggaacggacgcaggtatgcgtcatttctataagacatgatccctccatcccaactgcacagatcagacaagttgattggtaaatacatatagtgagaactgaacgctgaaagagagttgtaaaattacaccacattggaaaatacaagttgattggtggtgtaattttttttcgttttttcctagctacgacccttcagagttgtaatcttatgattttttttgttttatccatagaacttcgcaccgtttcgtgcgagtcgttcgaaaaaaaagctgaaagagagttgtaaagctccagccagcagggccaagtgttcatatgttccatgtttctgtaagtagccagcctaagattttctcaggtgatctcaccgagcttgaaaattctgcagatggtgatttctgcagccatgaatgattcttaagccttttgcacatcatctttccctctccctgctacgtgctggtttggaaacctttgcgacctcatataacaaagagcagccacaagctttggagaaacctttatgagacctttcagctcaacaatccatattgatctcacagcgtgcagtttcggggtgcggaaaagcgacaggtatagcatccctgattggtgtgtagtgggatgaatcacgctaaaatcagttcattcctcctaccgataatgggcgacgcactgatgaggtgcagaataatacaagattgggcgtcggagatagcctataaaccactctatggatttgacacgcaggcatgtgtgcacatgatccgttggggctaagatcaaggaacacatcaagaagcaagctctttgaccggtgatgtatttcttatacgggagttaagctagtatcactctctaagtatgaatcactgtactgtattaataattcactggcgtatagtagtgctttagatagttagatgatgatctgacaggcaatttgcttgtccatgggcatgagttgggctgagctaagtgtgatgtgagcaaatgtcaacatctgacgatggccgatctcatcttcattcatactctttaatttagtcatgcaaaactgataaaaagagagacaaatcgttcctcgtcactcacttattggaattgatcaagagcaccgttgacaccaaactagtccacaaatttgtatgctcttttttttttccttcatgctgtggcctcaaaagtcatctttttttttttccttttcgtggtcgcgcgcgagttatgattgcattttattcagaaggggtcctaatgagtctggacgtaagagggcggttgcagaggccacttgttgttttgtgtaataaaatttgtgattaggacgtgggggagtttggattagaaacatgtactccctccctgccccatattatatactccctcagtcccaaaataaatccaatcctaaagattcgtatttagaattaaatttattttgagacgggagagtataagttattttggtttataagttaactttgtttaagtttgattaaatttataaaaaatgtgataacgtctacaatataaaatagatatagtactccatttgttacaaattacttgtcgttctaggtttgttctaaattaaatattttaatctttgaccatcaatcttcataagctcatatagtttaattttataagaattacatttttttattatatacttcacatgttattaaactacatagatttctaaaaagtaataatcaaagaaaaatatgtttgacttaagatatacacggaacaataagtaatttgaaaacaatgctgtggagattatgggtaccccatacccacacggcatggttatccgactagttataggggataacttatatatatgtaatatgtaacagatcatgacttgggtgttacgtttccttgtatattacggaacggcctaaagtcctgatctaggaaaccgataccgtattggttaaggtttctatcttgtaatcctgccccccatcctatataaggtgggcaggaggccctctagggggcatatatgagacaacctgatcgtcagatcaatacacactcggcggattcaaatccctaaacaggagtagggtattacctctcattgagagggcctgaacctgtctaaatcctttgtctccacatccatccacttttaggtctcgtgcgctaccccgtttcattattgccgaattcatgtttcgacagttggcgcgccaggtaggggttgcgtcgagttttctatcgacgagtgcgatggaatcaactccacgagtcgccggtattatcttcgcttctgtatcgtgagatccgccgccgtcgacaccacccgccgatcaaatcaatctacagagagattcaatctactatggctgccaccagcttcacttctgtcttccccaggatctttctggacttcatcgctgccgccgaaaatccgaccagccccaattagtcggctaagagatcatacgtggcatagcaatcaacagcgagatacaagactggacagctatggagttttttcttttctcaagatcagccgtggagatacatgcatgaatatgattgaacagcatacaccggagagccacacatgttttgatcggtcttatatcaatctaaccgtacatgtttcctgctttatcgctttggttcttgccacatacaagaccatgtcgatctcgtttggtcgccgttgtattcatcagtttcgtcaaaaaggttgccgtactgccgcagtcatcatctgtatcaatctactcagcgatgcagatcggttcccagctgccaacgcctcttgccgactgatatcaaattatctggcaagattgaattactagttcaaagcggaatcgacatggacacagagacagcgtcattagcaactacacgtggcatagcaatcaaccaggaagtaatgatctacacatgtgtgctcctgatcgtgcatgaattgggccaccgctgcgcactccaaaaccggccgtgggacaacatacgtgcatcaagataaactactatcaggtttatcgttttaaattttcttatgtgaaatagattaattaacagatcactaattattatttgatctattgttttaacgcacgtaccgccggccgccctcgtcgctgccgattggattacacgcctccacggttggtgtgcaccgtcgccgttgctgatggcgacatcctcttcaccgccggcctgcctccgtcgccgccgagtggtgcctccgcctacacggctggtctattatgccgccgctgttgggcgtctacgacttcaccgccggcctgcctccgtcgccgccgattggtgcctctgcctacacggctggtctattatgccgccgctgttgggcgtccacgacttcaccgccggcctgcctccgtcgccgccgagtggtgcctccgcctacacggctggcctattatgccgccgctgttgggcgtccacgacttcaccgccggcctgcctccgtcgccgccgagtggtgcctccgcctacacggctggtctattatgccgccgctgttgggcgtctacgacttcaccgccggcctgcctccgtcgccgccgagtggtgcctccgcctacacggctggtctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggtctattatgccgccgctgttgggcgtctactacttcaccgccggcctgcctccgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcctccattgagtagtgagtcgggggctacagatattatatcatattttttataatatttatcttgattgcttgcgacatattctgagtacaaaagtgcctatcgagttatggagttccatcttcctatgctttccgtttggtttgccaatggatagttgcctttaggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagcgtttaaacgtaataagtcatctgctcggggaaatcaaacttgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggctcgcctcgaccgccgccgactggtgtttccgcctgaacggctggcctattatgccgccgttgttgggcatctacgtcttcaccgaccggccgccttcgccaccgccgactggtgtttccgcctgaacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgaccggccgcctcgaccgccgccgactggtgtttccgcctgcacggctggcctattatgctgccgttgttgggcgtctacgtcttcaccgaccggccgccgcatccgccgctgactggtgtcaccgcctgcacggctggcctgttataacgccgactgatgctatcttcttcacggctggctacatcgcagtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcatcttccgtcgccgactgattatgccgccgccgactgagcgacttcatctttattatcttcggcactggcaaactctattgctgctacttcgcaagttttgctacttcaccaaccacgacgtatttgtgagcctcgacatctcggcatgcgatgccatgttattttactacaacaagaggctctccaatattcatgatttctacttggacatcttcaacacatatcttcaatcaagcaataactattcgacgacaagaggctacagttttcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcaaacattctacttcaacggttgacctactatgcaaatgctgatgagcgtctttgtcattatcattggttgctacattgctattggctggatcaccgacatcgtcatcttcatcatgtcggttgcgtttgtcgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttctatgctcaaagactggactatttattattccccgtaagggttatcaaccgaatacttgcgccagtcgggattcaatttttatatctattttggagtatcccataagggataatcactcagatcagaagctattcatatgagctacgcttggtctatattacccggaagatttattactcgggagcatgttacatgtgtcatcctttaaagggtgtcgagggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcatcgcttttcgccacgtaagtgtgcatttttattgaccaatattatgacttaggctaattatatattgtggccattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttgaaaatttctttattcacaatatacaagcttctttatagctattttgctatatcactcatcatattttacaaagcagttggtatatcactcggatcatgttatttggaggattcacaccgcatatgctatatattgatatcaagtcacttggttgagtacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggagattatgggtaccccatacccacacggcatggttatccgactagttataggggataacttatatatatgtaatatgtaacagatcatgacttgggtgttacgtttccttgtatattacggaacggcctaaagtcctgatctaggaaaccgataccgtattggttaaggtttctatcttgtaatcctgccccccatcctatataaggtgggcaggaggccctctagggggcatatataagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgtttcattattgccgaattcatgtttcgacaaatgcctaaatatatttaatgttggatttaataaaactaatttggtattgtaaatacattttttataaacttggttaaatttgataaggttaggagcctcttctacagtaattttcttttaagaaaatttaaaagtttgattcaggacaaattaaaatgacttataatatatgaagcggactgggtagcatttcttaattttatctctagaacggaactaacttttcactaatctgccagtatacctctcaacagacttatttttccactccactgtagcacaaagctggtacgggcaaaccgatataaaattaacctgcaagcaagatggcgtgaaacatattctggaaaggaaaaagtagagagcgagtattagtattttgttgcggagaaagacgacaagaacaacacgataatcttgtctgagatagccgccacagcttagtggtgcattgcacactaggctctaggtgattaagtggtgtccttttgctttctgatgttgggtgagtgtgtgtgtgtatggagggggggagccggatcgagctgcgttgtgtgctccattatcccggcgcatgcgaccatccataccctgaaaccgacctgtggcccgacggagagtgacccatacttgaccatgcccgacccactatctatttctttctctgtgtggatgttcgatggtcggcttataaaccaaagcgaaatttaaattttaaattaatatttttagtcttatttttaacagattaagaatataaatataaaagttgtaccataaaatcatcatttctagttgtttcgtttattttccacctcttgtttattgttgtcactgctggagaaaccatcttcactcccggttcgcagcccctcacaaattcacaaaaacctcatagatcatatcgccaccacccactaccgaatcgcgtgcggctcgctgcctgtggcctgccagtgacgcgcctcctcccgctaacgcccacgacgcgcctcctcccgctgacgcccgcgacgcgcctcctcccgccgacgctgccgacctgcctcctcatgccgccacacctccacttgccgccgcacctccacctgccgccgacgacgctggcggccagcctccgcccgccgccgcccgtggcctgcctcctcccgccagccgcgcctccacccaccgctgccgacgcggctccgccctcctctagccaccgctgatgcccgtggccagcctcctcccgccgacgcgcctccgcccgacgcccgctgacggagagagctggtaaagggaggaaggatctgaggagagggggggatgtcacctcggagagggctgggaaggggaggaggctgggatctagaggagggaggaggaggacgaagagataaaagactaaggatgggagcgcgaggagataaggatgaaggaggagaggaggcgcatgcggcagcgttttttttttcaatctttggtcccggttggtataaacaacttggtactaaaaatagtgaggggcctgacacaacttgacaacatgttgaaccgggactaaaaatgatctttagtcctggttggtaacataaagtgtcgtgccgcttttgaaccggggctaaaaatgtttttttgtcccagttcctattcgaaccgggactattgtggattttgcaccacctagcaaagatcagtttttcagtagtgtgtgtttaccttttcgattaagcgccagatcactaccctcggcagtatgcgggttttcataaatgtttatcaaaatttgacatatttcgatcaaaatttggtcaattttaatgttttatatttgagttctcaaaaactattcggaatttcacccggagtatactttcttggggtatcgaaacatcaaaatttcgcgattttcggtcagttttcataaaaatgtgaacatgattattgctcaaccaatgagatatagtttgtgtagtccattgctacatcacattctggtgtttatacgagagttacgatgactatgtatgtgtacatgtacgatagtctcgtgctctcacttaacacgttcagcgcacaaacacaacattattgttcctacatagatcacgcatgcgtacgttcaatctgtttgtgatatatatatgcatctaaaagaaagtgagccattatcacgagatctgcatatatacatgttagtatattgctccgtacgatagtcattggtgcgtgtcaacttcggttttgatcgctcgacgagtcgatgataggcatcaatgcgactttcaggtcccacgccgtggaacattgcctcttacaccaacccgatcaatcatcaatcaaggccagcaattaaccccaaccgaaccctgcaccgtagaacctatcttgccatctgtacacaacatgtacacaagctcacgctcgaatgttcgatatatccctttcggcttaattaattacacgcgtcgcattaaccactcagatgatgaccaggttaaccatctgttattagttaatttaccggacaaacactacttagaaaaaacattttttacagacggccaaaagtaatttttccaggtagggaaaggaccgcctgcagatcaacgactacgaaaatcattcatttttataggcggcccaatggcccgtatgtaaaaatcctctagacgaaaaaaaaattgcgcccagccagccccgcacctcgccgccgccgctctcccccggccttcctccggccagatttgtaaggagaggggaggggagccgcaccggagccaccgtcgccgccccacgcggcatcgtcttcgccccgcgcctcgttgacgctgccctccccgggcctccctccggccggatctgggaggggaggggaggggagccccgccgttgccgccgtcgccgccgccgccccgcgcgtcatcgtcgccaccccgtgccccgcgcctcgccgccgccgccctcctccggccggatctgggaggggaggggaggggagccgcaccggagccgccgccgccgccgccctgcgtcgtggccggccccgcgcctcgcctcgccaccactacccttccccgacctccctccggccggatttgggaggggaggggagccgcgctgagagccaccatcccgcgcgtcgtcgttgccgccctgtgcctcgcctcgccgccgctgccctcccccggcctccctctggccagacctgggaggggaggggaggggaggaggaggggcccggtggggagaggagaagaagtgttgagggagagagagagagttaagagggaaatgagtggtggaggggtggaaggagaagataagagttaagtggtccgtctgcgaaaatcattttcgcaagcgccgcttaagtgatccgcagcgaacttcaccccaatttatatttttataggtggttatttggctaaagggttatgtccgcctgcgaaaaaaagatcctatgtcaggaaaagtgatttttctagtagtgaaaccaaattgcaaaaatatacctgttcgggagggttttaaatcattaaatctaactctaaaaacggagtatggaacggacatatgaagcagcctaaattaaccgtgttgaatcggttccactctttcatatcactttagcccttcgttttctgggtgaagtttaaatcatttgattggactttaagaagagatgaatctagagctagcggccggagcctgtcaaacatgccttaattataactctcataatctaatattgcgctggttaattaagctggtgttactttctcacttgttacacgggacccatccgtggatgtgattagctgtagagccatgctgtgggctgtggcatggtaatgatggtacgaaagccaaggcggtgccaagtcaactactagctgcttctagtgtagctttggcacgtacatacaacggcaaagtcagcttgtatatatacacggcgcgtggcaaccgtagatgccagtagagagagcacgaaaaattccagaagaagaagcgtacgctgctatacaaaaggggccttcacgagaccacgagtttcaaacatgaatttaaaaattccagctctgctgtatgcttcaaatgtcaacgacttgcacgagttgaatcaacggcaattaaacaatttaatcgcacgtttcttgaaccattatgttttgcctatttcaagtcactactacataaacctagataggtaaaactagataggggtcgaatttttcaaccgacacatagaaagcataacatattagaaaaatcaaaggtgctggttacagaaccgacacctttaaggtccaaaaaaaagaaaaaagcggcttaatgcatgggctcgaatcgagccgatgcatcgagcagctccccttcacccgatttcacccaacatttaattcatacaatcaattggcatcaagaattcaagaacattgatccaagaacttcaacaacatcaacacaaacacaaaacacagagaagatggagaggatggacgacggcctccgtgaagaggatggagtggcatacgagcagcacgtcgggtcccatctcgcacagctcgtcggtggtggcgaagaaacagatctagcagcacgtcggaaggcgttgcccgtcgttgccgcctcacctcccaccatcgctagccgcacgccactaccatcgcctccccccccccccccgggtcggatctggcgaaggggagggtgctgcccgtcgttgctgcctctcctcacaccgccgcacgtcgttgcgaccaagagagccgacagagagagagaggggggaccgagagagaggggagaggatgcggtggagattataattaagacggagaggatatggatagatggtgctgtgcggtttggctcagctcgattaaggggtgtcagtttttttaaggaaaaagtacgttttacccccgtactattgcggttgaccgaaacccccccccccccaccgaactcgaaaaccagtcatttcgtaccccgaactattaaaaccggatagttaaccccccttaagcacacaatggggcggttttgactggagtcgtgcgcacgtggcagtccaacgtggcaaggcgggctgagtcagcatagtcgcgcctggtttatagacttgacccagaaaaatttcccctccctccctttctctctctccctcccaaaaatttccccttctctcgaaaaccctagctagcacaggcgatctcgttggcgactcctgcacggcggcgagggtggtgcgctccaaagcaggtgggtgtcgtggtcagaggcgacggggccggagatctccaccacggacgcggcggcgacggtctgcagtacggccacctcgacctcgttggcatgatgacgagctcaggtacgtcccggggctcaaggtcgtcttcttgggctggaggtcgtgaacgaggaaggatgcagccgccagtaccatatagggaggggcctctcgattatgagccgccagtgcggctaggtggatttcgtggagtcccagtaaccccgggagaagatatttcacatgctacaatgcgcgtgtgagtaaatttgtatttatttttgatttggctcatttgtttggtttcaaactcattcgatcttggattatacatttatttgtgtagtctggttggttgcgatttttgggagtggcatgaccctgagtcagatccatattggaagcaattcctgcttgatttgaggaatgctgtgtggactgtaagagaaaaaatcaatgggctaaaggctcatctccaggacagcaggaatgaagccttgaagaacaggtacagttgggacaagcttctatattgcagtgcaaaatagaacagtgaaatggaaatacaaagaaataagagcactagttatagttggtggagcatctggctgaacaactttcgtacagcctgctaggaatccctgtttgcaagcagccaggcaaatatatatccttttgaatataggactaggctggtcagtatctaacttgacaacaactgtactcccaggattactcctcagcaactctaactgatagtcaaagattctaaagtattcacccctggtggactcatatatcttcctgaatacaaatgctttggctctcttgcactgcccaacactaacatttgcaaacatttcctctgaaacagtggactgcatgctctgtatactccaagttggattatctgtgatcatcttctcatacttctgagcaatcctcttgtatgtcactaggtggttatccttccttggtgggcaggtgtgttcatcaactagactagctatttgccagctttctgtcctgctattctttgatagcaaacaagcccacgggcaagttgccaaatcacacttggcccttgttctgtaaccttcatcctttataaaccttatgaacctcttgctgtccagtgcaagctgcaccactgcctctttgaattctttcttgccatcaaatttcattcctagtgcaagcctagcaattggcctattcacattaaatctgggggtatttggacttctttctgaccagctgtccatcactatcctcttcataggaatcatcatctgcactgctattgtcatatgggctagcactgtcatcaccctcaatctgaaccaaagctctactatttgtctgcctagatgacccctcacatataacatcatccaaattccctacctcaccatccttcagtttcttcttgaactctttgtaagccttcctgatttgctgaacctcttcatcttcttctgatgaacatgagtctccaccaacataatcactgtcagagtcagaaatcacaggtttcttcggcctctctttacctactaccactgccttccccttatcactaggttcagctactaccattgctttttctttatcaggtgtacgaaatgctcgcacttgttccagatctctctttgtcttctctggtgtagacactatgacaagaacttccttccctatattcaactcaaacaaatcctcatcttcctcatcatcccattcatcatctgcaggagatatgtcctgcagttcatcttcaaagtcactatcctccttgctgccagactcactggacccctctgccattactgtctccacataaatatcagcaacaccaccttccccaacacagtttgacatataattgtagacctcatcatcaatcaaaaccctcagcccatctgcaagttctttgccaggaaacaaccattgcagaagcatgccagggatcacttcacaatgatctttcaaatgtccaactatctcaggcagagagaccttatcacgtttgatgtaggacatcccctcagatccaccaatataaaaggtttccctcccattgttaatgaaatccccaccaaagtgaaatctaacaggtaaatactctagaggatccattcttaacctaaaaacaacatagtaatggcagtacacaatcaatccttttgcctaaatcaattacaaaaatcaaaggaaaacaaactctcacacatccaactgattccatatgccctagtaaaaaaatcctacacttttctaggatctacatcacatacctgcaaagcctagctgcgtcgctcttacttcatcctcctcgacaagcagctggtgctggccgatgtggagagcgtggccgccacgaccgtgccgcagagatccctcctcgtcgcctttgagcgtgccaccctcgttgccttgggcgcagctcactcgccggcgtggagtgcgccgcccatcctcaccggagtcgccgacgagatcgcctgtgctagctagggttttcgagagaagggaaaatttttgggagggaggggaaatttttctgggtcaagtatataaaccaggcgcgactatgctgactcagcccgccttgccacgttggactgccacgtgcgcacgactccggtcaaaaccgccccaatgcgtgcttaactattcggttttaatagttcggggtacgaaatgaccggttttcgagttcggggggtttttcggtcaaccgcaatagtacaggggtaaaacgtactttttcgtttttttaataggtgcatattttttaaaagaaccgacacctatttttatattataggtgtaggtttttttttcctaaaattgacacctctagtgtttaaaggaaggtgtcggttctgtatatttttcatcgtgtggaggtgggaaaagatctataggtgccggttggtacctatatggccggtccttatgagaatttttgtaatagtgagtttgcaaaagtagtgtactgagtactgtacgtacgtaaaataatgtctaatcaaggccgtatacgaagatctggacggttagtttgatcagtttttctcggccaagagcagcaacggagcaaccaaacctgacttagtcgcaaacggataaataatctcataaatttataacgtacgatcggtgcatggtcttgctcgtctaacgaactcctcgtccctgctactgcaaatcatcgaaactccagttgaaaattagttgggcttgcacacaagtgctgtcctaacatatgcatcagctggaccacctccactggccataaagctcacaatggaaaatcttgcacctgttttaattagctatgatccaccatagtatgtatatggtccatacatgcatgcaagggcacataattagcttaattaattagctagtccttttcctgtgcctcaaaaagtgacaaaacatttcttatgtgcggctctagctagctaaggtaagtggacccatcaagttcgagatgatgaaaatgcatgcatgtttgtagaatgaggctgatttgtgaaggtttaggtggtgtttagattcagggaccagtcctgttacatcagatgtttgacactaatttgaagtattaaacatagactacttacgaaactaattgcataaatgaaagataattcgtgagacaaatttttaagcctaattaatttataattaatacatgtttactgtagcatcacataagctaatcatggattaattaggttcaatagattcgtctcgcaaattaggccagagttatgaaatgagttttatcaatagtctacgtttaatacttgtaattagtgtcaaacatccgatatgatagggactaagaattttagtgccatccaaacaaccccttagtttgcatgttccaagatatactttgatgatcatcgacatgcatgtgggtgtaaattggatttggatttgtcttattgatgctctaccatatcaggaaagtagtcttagacattataaatagacgtgacatttttcataaaatagggggatacactgtgatacgggtacaaattaaactatacaaatacaacaagacactagcttatttccatccaaagtcatgtatataaagcttgtttcggttagaggaaaattgtttttttactgtttaatctgcagattgaatattgcaatcagaaggatgaaaaaaaattaaaattggtgcgtcacacgaagttgctaaaattacagacatggcatgttctagatcaaaattgttgtaagattcccattggcccaatttgccttacccacaaactgaattccctttccggcatctttgtctagcaggggtaccgagtgccgagtacaacctaaacgaccaaaccgttgcaagccctgctctgaatcgatcatctccatgactcctttctggtgttttggaaagcaaagtcttgcaccttacctctttctgtcttcagtccacccggggtcaaattgtagatgcctctctgcttccgtttcttgggtaactgttcagcactcccaagttccaactccaagtgatcatgatagcaaaagaaaaggggtaaataataaggaaaagaaaaaaacaagacgcacaacaacgcaaacgtatacagatcacatgtacactttctgcatttcttaaacaaaaacagtacaaagaacattccattattccatataccttcgagcatgcttgccatataaaggtgccatgtctgagtcatcctaccaaagtagtcccaaggcaaacccaatcaacccgacctaactaacgccctccgtcttatcatagccgtccattgccacgatcgggcggccgcgcgcgtagtcaccgaccttttcgtaacaattcagttacaatgtagtactagtacaagtctattgtagcacagcttcacgttgccgaagcagaggttgcggtgcggtgccgccggtgcggctgtcacgtatatgcgcgcagcgcgcagacgatcgattcgtctgcgcatacgagctgacgcccactactaaaaacccacggaaacaacgccacgcgcggcgtgagatagatcgattcgttcgatcgaggcgcgggactcgcccggtggatcgcgttgcgtacgagcgtacgagggagaccgacgctgcagcgcacgtacacacgggacgcgacgagacgctgcagcgcagcgcagcctcgcgcgcgcacggcgaggggaagaaacacgcacgcgggggctggatcgcgcgctggctggctggggggaagcggcggttggcgagcagagcagagtgagttcccgtttctttctttgtgttcccgggcttttctcccattcatccacgcgccaccacgcggatcctattcttaggctcccgcggccggacctaaccggggcggttaagcgagggccgcacgttcgcgggaggcaggctatggccacggccgcgacgacgacgtcgtccacggcaaccaccaccaccaccacctgctcgtcaccgtcgtcgaccaccagccccatccacccggccgtcccgcaccggcggcgcctcaacgacatcgagcgcgtcgactacgcgcacggcgccgcggccgacgactgcgcggcctgcggcggcgtcgcgcccgacgccgccctcgcggacgacgacgagtgcggccacgggcaccccgtcgtcggggccgtcacgccctgcggcggcggcgggagggcggcgctgctgttggcgcggaggaagcgcgcgtgggtcgtcggggcgggcgggcaggcgtggatgaggggcgtcgtgctgtgcctgctcggcctcgtcgcggtcgtcgggttcttgggatcgcaccggcgaggcggaagcggcggcggtggcggtggcgcaggctctggcgccgttggcggcggcggcggcgacgacggcgggaggctcgtcaagaaggtggaggtggccgacgccgacgtgatggggtggacggaggagaacctgacggctctcacgcgccgcccgcccgacccgccggtgcgtacgtgcactcgccgttaatcactcgatcaactcttacttcacttgatcgacactcttttattaccaagatcatttagtcggtaataactactccgacataatcacacctgctcttggttttactctgggaattcaatgaactctctgaagtgtgtttcttttctgatcaaatgggactaatgttctaatctaaaagcattttttagtcaatgtctaatcaaaaccatttttttttgttacaaaacattggtccaaagggaaaaaaaagaagaaaaagaagatacagaggtgtgcttgcatctaggccagctgaggattgagtatatgagagaaaggatggatgataacgacaaggatatttgcttgtatttgttgctagcgtgattcattggcataaaaaaaagggaggcagagactatatgacattatgacgttagtttcagagtctagaaacaaagcatcccatttaaggcatttatctctcgactgcttttgtgcaaatgatttccttgttctttccgctgtttatttgtctctgcaaataagacgcatcgctttagttcttttttttctggtcgctgttgggcaattgcggcctcgcaagctagtagtcactcgtaatgagatgttaggacctgactgacctgcggttggtgccgttgaggttgctttcacttgtaattgtcaagtgatgcatttcaaggtgtgaaaaaggttttagtgcataaacagaaagagttttgctggtaaaatattaatcaatatcacatttctgttctctaaactaatgttaagttttattgcacaactgagtttaattgactaaaaagggacgtaattttccatcagacagcttaatattgtaatgctcttcttttggggtttgtgattgatagacttcgtaagattcatatttacccaatcggcggttctcttaggcgatcgttttgagtcagaatatatattgagaaacccttccttacctggtagtggtagggacatcaagatttatggctgtataggtttaggacagagctggcagagactgtccgaaagcaatattgtgcttatgttcagacaagaaatttcattcacgaaagcaagacatccattcaaatgccgtgctgtgcggcctgaatttactcgagtttcctttataacatcgacagatacctgagatatggatgaagccagacagtgagggttatagccaatgcattgaacgcccaaagaaccagcgcagtaatttccctctctatatctttcacttcaatctgttccagctccagttccatgctcatgttctctagttgggtgctcttattgcagggactaacaatgcaactgtcggttatctaattgttgatgcaaacggggggctaaatcagatgagaatgggtgtacgtatctatttaaacggtttaacatgcaacgcttttcagctaacccatactccttcgaaattattcttacagataagtgatatggttgcagtggcaaagatcatgaatgcatcactagtaattcccactctagatcatcagtcattctggactgatccaaggtctgtaccttttctactcaaggatcatccctcatgcccttataaaacatcaagtaaactgaccataagtccttgaatatagtgatttcaaagatatattcaatgttgagcacttcaaggaaatattaaaggaagatattgtaatcgtggattcccttccaccaacttacaaaagggtgaaaccctatatgagagcacctacctcctggtccagggtaggtgttcaaaaacatttgttcctgcaattgcatagcttagaaattcaggaaatatgagcaagctaatgaattgatagctccattttgcaggcttcctattacagagatttttcaaggatactaaggaagtacaaagtagtgaggtttactcacacagattcacgtatagtcaataatggtcttgctccttccctccaacgtctccgttgtcgtgcaaattacaaagcacttcaatataggaaggagatagaggagctcggtcgcaccctggtagatagactgagaaatggaatggatcattatattgcacttcatttaaggtattgaaaattcaaaacattcagagaccaccttacttcatttcctgcaaagaaaccgtttacagatcagcaatcttccattttgctttgttgattgatttacagatatgagaaagacatgctgtccttcactggttgcaatcacaacctgacagtacatgaggcagatgaactgacggacatgcgactcaaagtgagacactggaaggagaaggagatcaacagtgaggagaagcgactccaaggcggttgtcccatgactcctcgtgaagctgctgtcttcctcaaagctatggggtatccttccaccacaaagatatacattgtggctggtgaaatatacggcgcacatagcatggatgcattaaaacttgaatacccgaacatctacacacactacagtctagccacagcagatgaattagaacctcttgagttgtatcagaacaggctagctgctgtggattatatagtagctcttcagagtgatgtttttgtatatacatatgacggaaatatggccagagcggtgcagggtcacagaagatttgaaggattccggaaaactataaaccctgataggtatgtaccttcatacaggtcaagtttttttttctggttttcaacttacaatatatatatttttatctgtaggctgaagtttgtagagctcattgataagctggatgaaggttccatggactggaatgaattccaaagtgaagtgaagaagcatcatgaaaacagacttggaggtccatatgacagattacctggtgaaagtccaaggcaagaggaatacttctattcaaatcctatccctgggtgcctctgcagaaaggtacaaaagactaggtaaaatagattaatctcaaagggagatgattcagtcttcaaaaagacatgaattgtacagtcttcaaaggaaaatagtttcgcagctgcattaaggatggagatgacacttcctcacaagtcacagattgcatcaaagtggaagtcctagtaaactgacagagaccggtcattttgattatttatcctagactgacaacactcgtagttcagggcgtggggccaagaagtgctgcattttcaaagaaatgttcatccaaggaaggaagatgagattctgaagtagttgaagaattaaatgtatcatcgattataggaacagccagaaggaaaactcttcatggaggctgattgtagttagtccatacacacttcccctgttcttgacgttatctgattcgttgtagtgggcatcttacatctggatggattcataacagtaatggaacaaaccacactatcagtatagaatgacagacaaatatttcagtagcttaggtcagatcaataattctttgtaatctagcaatgtgccaatgtcatgcacatcagattagcttcttgtaaaagtatgttctttgttgcagtggcatctgcatctgcactatcctctaggaggaatcaatgtgagtttcagaaacaaattagaaacaaagaaatgcatgaaaacaaaaggaaaaccgtctaaggaaggtggcttcaccccatgagacgtttaccgaggcaggaggcagtgtcgaggcggaagtcgaagacggcggagaggaggcctcagacgcagaggaatcgggacgagcggaggtggtcgggggatgcgagtgtgccatgacgggcctgagcgagctcagcgagcagtcggaatccggcactgaccacggccacgacgcggcggcggggttcggacgaggcgaggaatacaaacctgccggaatcgggtaccccactcggccactccccggaagagtagcgggagagccggcggcgatccggcggcggcgcggggcgcttctccgacacacacggagaccggcagccggagaggcccttctccttccgaaagacacgggccgcgcgtcagccaaagtccagttccagcccaattaacagatttaacacagaccgcacgtcatccgcagccccattacggcccaaccaatattgggcctcatcaaacataatactctttggaataagttcatcttgggtcccttcattttacaccgaatctcaaaaccagatacaaccggtccctgaactaaccggtgcaaacgagatctctcggcattttggattttggaaggcggttttgtctgacgtggcaccttcgtggttggtttgactaggtctccgttccacgtggcattgacatggcgcttacgtggcaattatatctcggaaaaataacaaaaaccatgggcccacatgtcagctacacacaaaaaaaatttaaaaaattgtgaggcccacgtgggccccacatgtcatatcctcccctcactcaactttccctcttcttcctcatcgcgccgcggcgccacctcacagtcattgtctaagtcctcaccgcctccgatgacaacaacggccgaagcatgccggcggcaggccgcaggcggcagaggtggccaaagaaggaagaggcagagaaggtcgccggccagcgcggcagttgtggcgggttatctcctcccaccgccgttggtcgctcgtcgctcttattgctgaggtcgggcgaggattttctcgatgccggggaggggtcggcagcggcaagccgcgggccgcgggccgcgggcggcggaggtggctggaggaggaggaggcaaagaaggaggttgctggcgagcgcgacagctgtggcgggttatctcctcccgccgctgctcgccgctcatcgctcttgttgacgaggtcgggcgaggattttctagatgccggggagggatcggtagttaggaggatggggggtcggcagcggtggtagaggggtagagatggcggcatcgttgccaagaacgacctccaccgctccaacccggctgacacccaccgaaaatagagctcctcgccggggatggccaggcaccgtgggtgggggttcgatggtgacgggcgaagggagaggtgcgcaacggccgagcgtgtcctcaccgccgggatccaaggccgccgtcgccagtcccccggacgacctcgattcccgcgagctatccgcctgcccgccgccccgttgtcgtcacgcgccgccgctcgccactgctccttgcagactgcagagcaagggagagatagatgggggatagagagaagagagaggagtaaggatgacatgtggggccgacgtgggtcccgccattttttattattttatgtgtgaaactgatatgtgggtcccacgggtttttattttttaatcaaattgccacataagcgccatgtcaatgccacgtgggacgaagatctagtcaaaggagccacgtagcacaacgtcagccagaaccgggaacaatattgtccgagggacctcgtttgtacggttttgtaagttaaaggatgcattgtacccgattttgcactgaagggacgaattttggactcggcaacaaactgagggacgtaaggtgaacttattccatatctttagttggtctctgttctgtaaattggcatatttcttgttcttttgtttgcttgatctttttttttaaaaaaattagttaatacttaattaatcatgtaataatatgagcttcgttttgtatgccggggagaagggttgccaacccctccttccgaacactacaattcctagttctgtacaatgcatatggaactcttgaggcttatttccaacgttatcgaagtgcttgctcttaattgcccatcctgaggaacattttgcacaaagttattttgactgtattttacgaattttggtcttttcctcggtgaaatttgtttgagcatacacgagccactgaccagagcggagcatgacaaatacgggcgtcgaaatgccgattgcatccttcatctggatctggattggcccattatgtctctataagcttatttgggcccataaatttcactcaaaaggaataagtccattttacctcccacatctcttgcccttcgtcgaataacatccctcaactaaataatttttttaaaaaccggtgcaaatcaactccacatgtggttctgtaagtggtttatgctgatgtggcagccaggtcatcaaagcgattgaaatagaagtgggtcccacatgtaagtgacaaatgctaaaataaaaaagtggtggggtccacttgtcagccctattttttcttatcttcttcttcccatgtcccttctatctctttctcgtagccgcacgcgcggaggctgattcggccagccgatggcggtgaacgttagtcgggggtggcctcggagggcttgaagacgtgactcatctactcctaccccccgtgtcaccagggagggggtgtaagagatggcttcatgctaaccttcctgaaggcggcgaagacgaactaggcgaggctcttgagcagcgtgcccggtggcagtggcgcccttctcatcccagcgagctcctcctctgcgctcggtgggccgcaaccacccgatgagctccccggcggctggccggccgtggcctcccgatgagctcctctcccgcgtccggccggctgcggcatcccggcgagcccctcccccgcgcctggcccgccgcgccctcccgacgagctcctccccaacacccgccgccgccgctcgagccgatggaaggcgtgaggctgtaagatatgaggagatgaaagagagatgggaggggtgataggtggccccacgtgggtcccacctattctttttattgtgaatgccatctagatgccacgtgggatgaagaattagtcaatgtgccatgtggatgccacataagctataactggactcaatactgtcttgggggtcgatttgcaccggttttcggagatgaggtagtcgttatacctggtttatctaccctatagttcaacaaatgcttttactcattcatcattcatcatgtcacacatccaatggcccaaaatcaacagaggaggtagatccgaccgcccagcgcatctctcgcatctcccaccacacagagccgcatctcctctcctcgcgctctctccgcatcctccaccatcagcgccgcatctcctcctcggcgtcctagcgctctctcgccccctcgccgccgtgcgcctccccctcgctccctcgccgccgtgcgccggatttttcattgaatcgacgcgctccttctccggactagggaggggaggcgcggcgatggacctcgcgattcccaaccctaacccccgccgccggcgcgtagcgccgccgccgcccctgctgcccaggatccccccgccttttctccttccgcccacctgccaccgacgccgccacccctggcagtgactcctcctccccgccgccaacgccaccgccgtcgacgcctactcctgtggcagtgtggaggactgctgcttccctgtctccatcaggtgtgtgcacgatttgtgtttgttaaaatgcttatgtgaaaaagctgtgggtatacaatgatatgctgcagattatcttttcctgttataggttgatcaataatggtttccttaattcaactttcatattgctgaatcttttggtctacattgatagctgatgcattggggtgtgattatacaaatgatttctgttggtaatgatttttccctaccttgcagacagaggaataccggacagttttttttctttcttttcttctgttggggtgggttcatttcagaaatacccaatttgttaggttgaccacatgtccccattttgatctgcaaggtcacagacaattctcttgtaatgtgtatgtgcattgtttgtcagaaacctgtcgaatgggaggcaccatcataattatatgatctaataatatgaagtaaccatcaactgatctgagtgtggaggtaatttctaaccctcacctctgatgtttgatgaatttcattttctcgtatatactttgtttgaccagatttcctgctatgtaaatacacatatatgattgtgtacatactagctagatctttcctcttagagcatggacaatataatggttcaggcgactattatctacataatctagaccacacaatagaatattttaagcagatttttcataagtgccaaccactgcctatgttttgctattaatatatagtatagttcctttcgagaatttgcacaaagtctatagaaaatcagaatataagtgcgaccacggccttcctgaaagttagaaaaatcttctcaagcatatagcatatagtctgatggtcatttcataaaaatctcttgatatgattttataagtgaacataccaaattagtttgaatgtacattgttcgttttcacgggattccgacatccgttgtcagtgatcgagatcctgttttcactgggcacttttggagtgagcttttccggttggctggtgtcaaactacatatgagctcggcatttcagaacactaggacaaataacatgttgtatacattctgggatgcctgaatatatggttgcttatgatggaatcagaaaatgataagttctgcagtattttcaaatgcggaagctgatttagaatttgagaatgttggctcatgatgacaacaactctgtacatgtacattctgcagatagagaagcttttcttgattgaagcattttaagacttgtactacaccagatgtgcccccttgagaaacaaaggttagtgttctgctatcgagtttttttttagattgtagcaaatagagattttgttaatttttaatcaaatgtgaagctaaacttctcattaatctgggattgttttccataattgtcccggtgtcagagattgacaattgatttcacaaccaaatgaaaggtagtgtttttctgggaatgccatcaggggcgcagatctgagtgtagtcaaaatccttcaatttttcaaatccgtttggtaaaagttaccactttctgaattccatgcaaggactgacttatgaaaattttactgtatattattgttctataatttgtttataaaagtaatgcagtaatgctataggaatgatgggaccctaggagttagtggcatatatcatcgacacacttgcatggccaggggaattataactcaggtgctcaccgaggatcaactgtccaggatccaggatttttagcatttgttttattgaacgctggaattacttttctcctcgtgccatctaaaggtaacttcaaagctaaatggctggccatgtataatcctaggagcataaatatttttacaaactatataaatttctttgtgaaattttaatagtgattcagtgttgcaacgggaaatgctatatacatggccagccatttatattcagtgtttaagtcgatatattgaccacagatttggtttatatcagtaaatggccatgtttttttcccaagttatgtttctaaatatgtagactgtggtacgatatttataaagttcaagttgtctttgtttcccagaaaatcttaggtctagcagacttacttagtttctgtttacaaatgaataatcgggtagtgaatactatacctgtatatttgtactactctcttatttagtaatgtatctaaaataatgtagactgtactacaatatttatttagatgcatatgctcaatttttatataagtatatgctgcttttacattacttttgtttgaatgtacatgctgatatgaaatttggagagctttcttggaatgtacgctgttaagaaaatttagataaattaaatccttatgccttatattgtttcttaaacacacctataagtttgattggagaaggggacattaaccaattgcttgaaaaaggtgttttgttagctcaagatatggtggaatatttacaactgttttagtaactcccagataatctttctctacatacatgcataactaatttctctaggataatgacacatttctgattcgttaagggcaaactttgaagtacatctgttatgcgcgagatattcagtttatatttctaaacttgggtgcactttgaatcaggacgaataggctcagttggatcagttgaatataaagaagtggtgtgcgattagttttttttgtaaatagctcaagttagttttcttccttgtaggatagttacaaaaaaataaggtaaacttgcatttcttgcatgagcaaagttcattacaacctatctaagtataatttcctgaagagtgtttatagctgaagttgtttcttctaattttgctgaggttaaccctcctatggcatgcatccttctaaattttgctgaggtaaaccctcctgaaattagtagggtgcacgaaatactactgtttttttaatttttgtacagtggcattgaacatggttttgctctttgagatatgatgcttccctcatgatcaatgaagatttgcattactttaggtgatctgctcatgtttgggtgtttgggtaaggaggagaagaaatggctggggtgtcggtggtaatgaggttgttgtttcagttatacagttccgcataattgtgtgacgtcctgactaatcctgactaatctgtatgaccttttcttccatttacaaatgcttgtgtctctccagttcacctgtgagggagatatgaaatcaggtatgagtaattcttgtggttttgcttctttttctggacacacttattttcatccattttgcagcaagcaatagttaggtatgagaaagaatgtgccttacaattaactgtcagtggtacacataaaactattcatttactcttctttcctggtcatattgatacaggttagtttatgctcttactcgaaaaaaaaaacaaagtacatggtcttactatttgaccgtttgattaattatataagtttctgagaaagccctgaattcgatgtactagactcgattgttataggcaactaagtaaaaaaaacaaggtgatccaataaagtattaaaacacccatggatcatgttgctaccctgtggtgatgaaaagagacataagtgctagctactattttttgtttaatcatgaaacagaggcttcatgaaaccagatcaagcaagtcaaatgggattgcatcataggtaagatcaaagttttcccctttttgacatcaacagcgtattcttttgtctgtagagattgtatatttgttttcattcatagaggttacatcatatccaagagagtgccaaatctgtcatgtagcatttgtctttttttttttacccggcctctacatccaactggatatatgcaacctttttaaattaagaacttagccctcaaataacccaatctgaaattcgctcctatagcgatttaaattcaggaccttggggtgctactcaggttactgcaaccattaggctacatacccttttacatgttgcatttgtctagattattgcatttataagcagtaaatctttttcggagcaaatagcatttgtgcagtgaccaagggtactatcttcttgatttgcttgcagtctcccattgtttgctgagaccatcaatactcttgcatggatgatggttcaattgaataattaggaactgcaatactggacgaggcttgtttgagttttctttagttctcttcaataagttacctctttaattatatggcttcaaactttttcatattcccgagagcatgtctgtatggcaccaaactgttcacctgagcaaatggtccaataatgaattgtgctttgtcatggtacgttgctaactgtttgggccttctggtgcaattttatcattgagatattttgtgcagtgatgaaatgcatatttgtattgtacgatacttttatattatcaatagtaatttactttaattattttttcaattttaaaagttgacctgttaaatgaggtttcacaggtgcattaaaatttattgtgttacaatgaaacctgttgctacaacaatcctaggatatcaatgtgttacctaggtgcacttcttgggtgatgagttgtgggagttgtccatatcctcctggaaaatgtgttgacaggttatgcgaggttctaggacagagacatggggatatagttctaggacggaaatatggggagagatatgtatatcgttaggcgtgaagttctgatggtaaatttatggagaaaaatttgatattgaccgaatgtatctgtgtgcaaattgtagataaaagaatgtcaaatgttctgttttggagaagacatgaaacaattcgtgttataatattggtgcatataccttttatgcaaatatttaattaatttatattctgtgcatatataagatgcgattaattgctccatctaaatttactactccctttcacaaaaattaaaacatatgattttttgaattattttaatttactactctctttcacaaaaattaaaacatgcgatttttgaattattttatcttggggttttgcgtttgactacaattttatatttcaacaactttataaaatacaataaatttgtgataaaggggagttattattttaatgataaatatgggcagatcatttagcattcggataaagacatgtatatcttgcttggatatttgtattttagacatgttttgaatatgtttcttcaaaagttattttgatttgtattgttaaatattaccgtagcgttagcacgggcagattactagttcgacgaaggcaagagatgagggaggtaaaatagacttattcccactcaaaaagcttaaaatgacataagcccgatactaaactaaaggcccattattagtataaaacactgctggcccaccgcgttcttccgcctttactgtaggagtgttaggtttagggcttccgccgccgcctcctcctccaaaacctcgtcggcgcgccgccgcggccaagccgctgtgctgtacaagaaccggttcggcgacaacgtaagttccgtgcccgacgaggtatttgttcgctgccccctcctcctcctcttcagtgttccttttttttctccgagagcatcggtgatgttacatccatctaaactcatccttgcactatgaggtcaccggtgaagaaaaaattgggggaatatgtagtctgagatgctctgttgatcctctccttggatcattcttttctactgagctgatgacgcggctggagatttcagctgctgtttgttttcgttttctgaagcctgagagcaccagtgatgtttacatccacactcatccttgcactatgaggttattaccagtgaagaaatcattgggggaatatgtagtctgagttgctcctgcttttcctttctcgcgattctgctttaatttgtggatttatggttgattttttttggctttgcctttatgcttcttgattcctctcgtggatttgtggttgatttttggctttgcctttatgcttcttgggttcctctcgtgaatactgatttcagcttctttctgtggcttgatagccaccaggtagatggggaaggcaaagcgtgcgtcgatttttatcaggcttgtttcagcagctggaaccgggtttttctatgtgaagcgcaagaatcctcgtcggatcacagagaagcttgaatttaggaagtatgatccacgagttaacaagcatgttctctttacagaagcaaagatgaagtgagatggtgctgggcaaatcttctccacaatgtgcaaagctgaataacctgcaaaaaaaactcgtgtcaggattcaggaacctgtctactgttaagaatgctatgatcagtttatcaccctgttctggttccagcgttttatgcagacaatttcaacaagtatgagtttgatcttgattagcactggaattctgatgttatgcatgttggttttgttttttggaatgggctgtaagcctgcaaactaggaatgctttgattgttttaccatatccccgttaaagcaaaattctatcatggcaacttgtagataggattcaccatactgaatttgactgtatgtattcctttaaacatgtttgtcaatacctggaagttatcttgaatttggccatgatctgcattgagacaaatgattcagtgtaccttcttttttttaacattggtttggaaaacactacaaaattcctttggaaacattgtaaaattctccgatccaaatggagcctaaacatgtgtgatttgtaagattggcaggacctggtattcttcttgaatatgctgcaacctgtactgtaagttgtaacagaagtagtttagactctacaatctgaacttgtttgacaagaactcaagataaaggacttcagctgctccacaagttttacctgacctggcgatatctgctgttaagcaacactgggacttctccgggcttctcttcatcacacggatcactggacctggcttgctcattgctgcattttgatcatggattttatcgtcgatggttgctgaaagcgtttcagtgttgcaaatttacatttctttttgtgcttacgacctttcagaattgtaatattgtaatttttctcctgctctatcgaaaaaaattacagccgttcgcatctagaatttgtgtgggccgtttgctttaaagctcctgtaccgaaggcttcttgtatcgtcttgggcttgtgggacaacacaaattcgcaattgtttagctcaaaaaccttgttactccaaacaaaatgaaacatttcaatcgatcagttagacagtaacaaagaaacagaagaatttcctggagaataagcattcgtagtggtggaccaaatcgctcgtcagaatgtcagaatctggctctagcgacgggttcctagtttcaaaggagggccaaacttgggcctttccttttgccgggcgtgttacagcctggtaattgggcttggtcttagcttatgctttcttctgcaacagcaaccgctcgtgtgacctggaccactttgcctgactgaaaacacttgaacctctgctacaatttcacccaaaagaaactacaaacttctgcaaagtggatagcacataacagcattcttttgggtaccctaggttgtctttagtcctcgtagtgctcgattgacatctgatatggtagtacagtagttcctcatcttttagtgaatttctccaatggtggttgcctggttggccctggttagatgtttcaaaaatattcagcatgtataatgtattaatccaactaaactgtgggagctcgacaagactaggctgtgtatcacaggtgcagacttgcagaactaatgctcaccttggttttgtttttgttttgaagaaatgctcatcttgttcctggacatctgaaatactacagtttttttttcgcaaacgcgtaaaaaaattacacgtcatcatattagaagagagcaagattttaatatacaacgtaacaggccatggagacatttgccaggggaatggaagaaaaaaaaaagaacacggaaaggaaacgaaaaaagaactgctaacgaaaaaactgctcctatatagagggaggaaaaaacggtggagccaccctaatgtcccaacaagtcttcaaaacctacggtgccaacaacagaccacaaccagacttcctgaagaatggactccaagaccacaaagaccgagacgaaagagaccacagagactacagttcacaatcagtaaatgatcatatcttgttaaaaggctgcggcattatctacttacattttaacaaatgcaacgcaattatcaccgagacaattgcaacacacgcatgttttcggtagcttatgtattatggattatcacggtgcacttcccaagcttttaaacggtacaccttttgcaaaacctttcttcgttcgtatttcttagagaacttttcaaaattaacttatgaactttacaaaatgcaattccctcgagtaaactcagtttcatttcaccatccactgtttataaagagtacgcgttttctaatttcgcttcaaatccttacaggtaatccccttttaaaatgatgcctacaacaacgatgaacgatgataaattgggtagctgccatatgcacatgccacttcatgacgactattccctccgtcccaaaatataacaacttttggttggatgggatatatcctagtactatgaatctggatatgcctcttgtctagattcgtagtactatgataggttctatccataaaaaaattactatatattgggacagaaggagtacaaagctataggtagctagccctgtatagtgaaataaatctagaggattccatgatcttgcttgcagccctgcgccgtcagtacagttttaatgtaggtcttagcttgatcgtcttcgacatgtctgcctccggtacgttgccatcctgcgttgcaatcatggcgcgatcgagctaacctgcaacctaatccttgccatgattctagtgtctcctcgtctctttgtcacgaaatgttgctcctgtttttatctgctcctactcatcttattcatcatgttttgaggcattaatttcttaccacaacatttggtttgagtgttcgccaatcgacgtccatgacgccacaacatatggccctatttacatacatttattctgcgtgattatattgaatcctctatcctgcaaagcctacctatatatcagccatggcattaactcgacctgattcttttcacgctttagtaatgacaatgctgctgctacgacatccacagtgtgcctttgcatcaatacgtgcttgtacacatgtagtactgtcatcgccactaaatgtgctgcaagtacgtacttgctagaaaatctctagccattatagactgtaatatcggttgctagtacacacctcgcctctctccgttaatttatagccttccattggttgctgtctgaatttatggagacgcaagctagctagagttcctacttcctcttataattcggaagattcttctgctctgcacactgatattacatatatggacacaattgttcatacatgcatgtcattgttttccttttgccatcttgcttggctgctttccattaataattggttgcaaagctccagtaattgtctgctatcttatcttttacaatacatatcaagtgcaacaaatgtctgaggaaagtgtggtagaggtcaccaaccaaaccatctttagttactgcacccaaatcactactagcattcactatacatatatgcttctgttggactgattatttgtttgctgtgcatgcagcaggagtgtttcaatactcagtgggagtagaaagactgagcatgcagctaacagcctaggaccaagagagtaggtatcaagcctggctccaaaggcacttgttagctagaaatgacttaacaattaggccctgtttagtttccagaaagtttttttcaaaaacatcccatcgaatctttgaacacatgcataaagcattaaatatagataaaaacaaaaactaattgcacagttaaaggcgaaattgcgagacgaatcttttgagcctaattagtccatgattagccataagtgctacagtaacccacatgtgctaatgacggattaattaggctcaaaagattcgtctcgcggtttccatgcgagtcataaaattagtttttttattcgtgtccgaaaaccccttccgacatccggtcaaacgttcgatgtgacacccaaaaattttcatttcgcgaactaaacggggccttaatcacaccttgcttagaggttacaaagactatctaggacttaattgatgttgttagtatgctagcagtacagtgtatggattgttcctttgttaattattgccattgtgggacggttgacgcctaaccactgctagctaatccccttttctctttcagggcttcaaagttcaaagagagggtagcatcatgcttgctttagtcagaagaaagtcactcacatccctactgttctagctttcagttgagatcaactcaatcaaagatgccatgccttcgaactatacaagcaaatcgcatgcccctgcttatagtcactggacggagggtcctatgatctttgggccccactttcggtgacattatgtacttcagaaggatggagaaattagagaatttattagaagtaggagtattgtatatgtgtctccgggaatggaccatatatggggatatggatagctgaatggaaacagcacgaaaacataaaatattttttgaactttgccgtttggatagtagcagggttggtgatactttgcgtctttggttgttaagcagttagcatgacgttctggtcattttgctgcttctattatttcgctagattccctctactttgcctttgccggttttgccatgcttttaacagtttcctgttgtgcttccatgcatgttactgaactagttagtatcgtctaaatttgatgaacttctttctttttttcccctttttacacgaaaacatgagcttatgttcgttggatagcagcagccagcaagattatagccttggatagctggtacgtcttacgttcttaaataattgattgtttaagtttaagcttgttttatcttcaaaaaaaagtttaagcttgattgtctgtctttttttttcctgaaaaaaaattataaatgctttgttggtgctagatgggatctgcgctccgaactccttgaacttgaacagtagtacagtaccatcaagattttgttggtttaatatacaatagtagttcacaatccccttaactagtttctaaaataataatggatacgtggaacaggaggcaataacgcacacaatgaaaaatatgccactacttcaagttccgaaagcaacctttatgggatggttttagccaattttcgtatttagggcccctttaaatcgcaggattgagaaaacgtagaaataagaaaaacatagaattttgatagaaatgtaagtgtaaaacagaggattgcaaaacacaggaaaaacataggaatgaccgtttgattgaaccgcagaaaaaacaaaggaattggatgagaaagatagactcaaaggaaagttaccaagaggttaaagttcttgctaaatttttccaaaaatctctataagtttatccattccatagaaatttcaaaggattgaatatttcaaagagcttcataggaaattttcctataggattgaacctccaaaatttctatgtttttcctcctaataaaaagggtccttacttttgcagagtagaattctgaatgaattttgagatatttgttcttcaaaattcgtgtgaagttatccatgatccaaacatataaaagggttatgactgcttagcaacaagaggtaccaaaagataccaagaactctacactatcttctcttttttttccttcgagaaactctacactagttaactataggaagtatcaaagagttactgaaagctaagggcccctttgaatcttaggattgagaaaacataggattttgatagaaatgtaagtgtaaaacagaggattgcaaaacgcagaaaaaacacaggaatgaccgtttgattgaaccgcaggaaaagcacatgaattgaatgagacagaaagactcaaaaggaaagttaccaagaggttgagggcccctttgaatcgtagaaatgaaaaaacggaggaatatgaaaaacataggattagtgacaggaatgtaagtgtaaaacagaggattgcaaaacacagaaaaaacacaagaataattgccaaggagtgaacctctctagcgggaggacgtgagaaccccctttgtgagttcggccaggggaataaggcgcgatgatcaagagcgtatcttcgccgtgggattacgctaacgtggtggatggcgatcgagaaggagacagaggatttatccaggttcgggccgctgagaagcgtaacaccctacttctgtatgtggattcaagcttatgctgttgcaagagttctcaaaccctagggagatggtcggctaactttctcctaaggttcaagcttccaagagtcgttgttttgctcggtgggcaaggtcctccttttatagttcaaggggttaccacatgcaccgtctctacacatatcgtccttggaggggggcccacatcaacccgggctgagtagccaaccatgccttaggccggaagtaaggtggcagcttgtcctcaggtgggtcccagcgctatccttcgtctgacacgagggacatcccccgtcattccctcttaaattcatggagactttggcgaatgcatgcacaggagaggcaccaattgtacattggtctccgagcgttgatgggacggggcatacctgcccccacgctgcctgacacaaggcggggcgtgggtgcgctgccgcccatcccatccacctgcggccggtcttagcccggtcaaggacgattgacgcacgtcaatcgattggacgtcgcacgaccagccacgctgtattaaatgcggcggtggtggttgggacgccgcccatcaatgcgcttggcagcgccccttcctccacccactcagctgcgacgtggcagccgagcgtgggccccggggcgacgcagcccctcgggcccgaggggtgcaacgggataccccgagacccctaggcggttacgggcgcctttcggctacttactacctgcgcgcccgacccccccccctctcgatggggcccaggccgcgcagccacgtggctaggggaaaggaccctttccccttagcatgggtacccccgggcccatatcatcgataatgatcgtttgattagactacagaaaaaacataggaatcggatgagagaaatagactcaaaggattcttaccaagaggttggacctcttgctaattttcctccaaaaccaatatgcaataagccattccataggaaatttataggatttggaaaacttcaatcctttaaatcaaagggctacataggaaaatttcctataggatttcaatcctatgaaattccttcgtaatttctttgattcaaaggggccctaaagctctggctaaatttcctccaaaaatctatataggattgtcaatttcacatgaattttaaaggattggataggattcaatcatttgtgtcaaagggcttcataggaaattttcctataggtttaaaatccaccaaaatttctatgtttttcctctaaatcaaagggccctaacctaaacactgttccctgaatgatttcttctatgattacgaatgatctaccagaaactccatgcccctgacagcaacacaccaccagatagcaacatcaaattggattttaggaattaagcaacaagctactctagtatagcaacaagacctgacaagtttagccagggggccagccagcctctcccgacgaacgatcgaagccagctgctgcattattagtgtgcagtgcagagctctgtagcaactgaatcatggcggactccttcctgcctgcctcccttccaaagctagccattgcgtgctggagcgatggatcgagtactactaagtagtactccgttctagtggcgatcgaactgccgatccatcgagcaacgtatgcaactttggggcacataatgatatacgatcatgtactgatgtaccgagtaaaaccatggacaggccagtacttgacaatatgtactccttcctccaaaaaaatacctgcatcttttgttactatcttcaaccctgctaagtacaggggaatctacaattacccatgtttaaatgcatgtgttaagctgcaccctgtgaaatctgtgatgtataataacctacaaaattaagatgcagtcatgcagacaatcaatcaaagtggatgcattttgttaaaaaaaaaattcataaggctggtagcctcattatctgagaaataaggctgtcaattctgcttcgttgtttgctggtttgagtacggattgagcatgcttcactgaaatcatgaactggttcttcccgaaatgagatcatggaaggcttgccattcactcatccacaaccggagcttcttttccatgataacagtatgggtctcataaactatggctctgtgatgtattccttacaaatgagtcccagaattcgacaaacacaattgtaaatgatcttataatggaatggccatgggtcaaacatttgctcctaaaattggtgaatcattgataatctaggagggccaagacatgataggtgtcttcctttaacatctcccctttttctgttgttgcccattccctgctgttctttctcagaaattttaccctaccatgctaccagcagtttatgatttatgcttgatttttacaaaaacacgctatgaaacaaacacttaattttcacctgacaggtaattaacaggtcccatggtatatgaagccatgaacatttctttaatttcttaaaacaaaattgttattaatcgaacctttctgaagcagtcttaagaaaaatagagattttctttaaccaaaacatggacaggaaatcacgatgagatatgttccatccgtctcaaaaagaattaaacgctacgaatgtccagaactccagattcatttctaagatttgaattttttagaatgaaaggagtataaccttctaattgcacacagtatttggtagtaactggcatgagaaattgacagaacatatgattttttttctctgtttcacgaaaaaaaatatcttttttttgtttggttgagtcgttgtttgcctactccacagcatccatcatccacagctgagagatttgataatttaacactcttttcaatgggtttcgattatttgacatcctggcccattttcattcactcagatggtctcatatatcatcctcacaaatgttaattaaagtaattagacaacgaaaaaatgtcaaattattaaatttttctccacagctacaccctcctcctctcccgaaccccaatcaccatggccataagacgatgagctgagagagagagagagttccaaccatctcctctcctctcttctcttctcttctcttctctcttctctctcctctccccgacaagcacagggctcgtcttttcctttcttcccctcactcttttccccttcactcacacacagtcacactgtgcgagcctgtgtgggactgtgggtgttggccattccagtacaatccgttctctttattcctccctctcctgcttgtctcgttgcgtggccgtggccttgtgcggttttatggatcaagaaacctcacgagaaccccgacgcttcggccgtctggtggcgcggcgctagccatctctttggatcgctcctcgcgatcgcattgcggccgcgttctttgatttttggttttttttttgtccggtcaaaggttggttcttggtggtgtagattcggagtggcgtgtcgtggcggcggttttttgttgttgttgttgttgttggtagatactggttcggattgtttcttggaggaggaggaatttcgcgtcttggtgagttgggatttgatctttgggccggctgaaattgggattttgttttgttttgattgagttgcggtttgttttgtctggattaggagcaatggcgggcggcggcgggcagtcggcgatcgccgctgaggacgacgacctcgagcgcggcgcggagcgcgacgaggaggaggaggaggggagccaatacttcaccgacgcggaggaccaccagtcgtgggcgtcgcactcgcgccacaactccaccgcctacgaggactacatctccacctgcgcctccgtccgcgcgagctcctacgacggcgaggcggaggaggaggaggatgccggcggcggcggcggcggcgtcgagcaccaccgcaggaagtcgtcgtgcgtgtcggagtgctcgctggacgacgtcgacctggaggccgggctggccgaggtcatcaagggcagccccgagaaggcggagaggtgctgccgcatttgccaccttggcctcgagaccgcggcggcggagtccggcgccggcatcacgctcggctgctcctgcaagggcgacctctcctactcccacaagcagtgcgccgagacatggttcaagattagaggcaacaagtaagctccagactcactcatctaatccactctcaattactatttgattagatgcaatgttcgaagtcgaactccatatgttagctcggataaatcgatgaatcaattagtttattattattggataaggcatcacgcatcagcgtaagagcgaagtaacacaagatttatttcagatatatatatatactagggcatatgggtgtatgaacacatggttaaggaatcttgataggtgtctgtttttttttccctttgctttctttgggcggacaaaggtaaaggagcagatggggaggaaaaggcgaagtagtggattaattagtagtgttgtaggaatcgggaaggttgagatcattggagaggataaaggtaggattcgttctttcaatctgcttttctcacagattctccgtggcatctgattgttcctctggagtgttgtgttgaccaagtttgtttgttgatagattgacatggtctgatactatgatgcgccagtctatgtgacatgcctttttttttccttcgatttgatggtgcgagggaggtgtgattgtgtcatcttccattctgaaagtgtttgtttcaacacaattgtagttaggtgatccactgagtctcagtcacaaccataatgtgctccacttagccttgatccacttaataaaattgttgttaagagaatcaaccatagtgtgctccacatagtctcagactctgaagtgataaccgcttccagcgtaggaaaatggcctattatagacaggggatggttatagacaaaattggttttaaattttaataatcatggcttagttgctagtcagtgtaaaaaaggtgttgggcaatacaaactagtctgcaagtctaatttttttagtggttggtgttttctttctcataaaaatcggtagcgcaaaccgacacacaagtacctgttttgttcttgatattattttttactttatttttgcttatatattgttgccacagcttgatcactgtaagatttgctcaaactactaacaagaacatttgctgactaatgcagtttaggctaatgagattagttcaacaatataattacactaaagtttgaaccacagatattgtaattggaaactgtgaaccacggcaactcttactttataaaattatttcgattctatttctagagccaaatttctcaaatgagtctgaaatttcagaccttggtggtaataatgatttacttatgtgacatcagcttcagcaatattcattgcaccgattattgttttcacactatgagatgtaatagtgagccctgaaattcctatgctgctcccatgctgagaagaatagactgaattctgatcactgtgtttgtctgcacttggatctttttggacaattagtaatttttaagttttagctcctaccttttttccgtttgcagtacaaggctataggaaaacactgcggtaattcttgcaaatatatctatatttactgaggcttttatccttactcgcccaataatcaatgttagagtatatggtggttagagcaataatgttgttagattgatttatatcgtagtcttccttttctgtagatccctccttatctccacaccttttgtactcttaacaatcaaaattgcatcaatcatacttgtactgcttaaatcatttttttacactgcttaaatcatacttgataagttgatatccccaacattttacactcatttaatgacataacctgtcaatcaccttatcaaatttcagtaaaatagaattgaatggccctcaataatttcaatcttacttcaagtgcgaaggtgataggttttgagtacatttaaactaaatgatctatccttctgtttgccaggatatgtgaaatctgtagctctaccgcatgcaatgtggtaggcattggtgattcagaatccgttgagcaatggaatgaatcgaacagcacagcacctgcacaagcaccaccagctgaaactcagagattttggcaagggcatcggttcctgaactttcttcttgcttgcatggttttcgcctttgttatctcatggctctttcatttcaacgtcccgggctaagttttgaaacacatggtcctcaataaaagctccaatgccattactacacacctgtgggttggatttagtaaatctgaagaacaggctgaggtgaaggaaagttatgaagtggtacaaaaatgttgggtggggcatgttgatcttaactgtgtcaatggcaattgcctcctttcacaacgaccaagattccattagacaagaagctggaaggacaatttcctcctgtttcccttgtctggatggagatgaaaacaaagaatggagaatgtgtttgttccgtcaatagtgctgtcatggttttcaggaagagattgtgctgtatccattccctatcttctcaggcaatttatcatttattctgctgatttggtgtaagtgttatcttccaggagaaaaatgtgctgagttcggaagcatgtcgccagaaagaataaacaatattgtgaagttcctgggcatatcgccgcacatgaaattgtcgattttgtggagataatcctgtaatggtcctttcgacgtttgtgactccgtgttcggttgtttgttggatggagtacatgatgaaatgtcactctttgttggacgttagtactctttgttggatggagtactacagaatagtactagtagaatttttttatccatgctcattctaaacaatatatcatttcatcagtctttttcgtggtactaatgtggatatgtttgaccacgaagagaactgttgagttgaagaaattactgacttgtggcccaactctctctgtccttaaaaaagccggcctcgtactgtacgtgatacatatattatttctagattcgttatactaaaatatatcacattttaatacaggattggtttcttatattttaatacaaggttggtttcttttgggagagacagagggagtagcgggggaaacccatttggtccatgtcgaagcttgtactgctctttttgtcttaaaatataaggatctggatttgtatcacatccatctaaaatcccttatatctgggacggatggagtacaaagtacacgtggtacaatcttgcgactagagattggaactcctgtgagtgttcgattcagtgcgtgtctggcataaacacgcaataaattgcacgatacttggtggacgtatactggagtacatactaccaccaccaccgtcttttagtttacacacttagaccttgtttagttgcggaaaatttttgggtttgattgtcatatcggatatactaacacacatttgaagtattaaacgtagtctaataacaaaacaaattacagattccgccagaaaaccatgagacaaatttattaagcctaattaatctgttattagcaaatgtttactgtagcaccatattgtcaaatcatgcgtaattaggcctaaaagattcgtctcacaatttacacgcaatctgtataattagttttttttcctacatttaatactctatgcatgtgtccaaatattcgatgtgacagtgtaaaaatttttattttggaaactaaactaggcttacaccgtgctgcagccaggcccagatataaatgcaaattggttgctggaaggccacggtgccaagacacggctacaggttgatgttgaattgttgatgcaggttgaaagtatggacgcgtatgatgagatcgcgtgctgtgccaccctgcggcggtgaagaaatttcacttttttcagtagactgtatcgtccactcgtttaaaacaccgaaaaaacagatggtccctcctgcagttacttccaagttcatccatccatctctgatctcactctacccgtgtcactccacgatcatcaccagtggctctatccaagccggtgatgtgaacaaagcctaatcacacacgcaggggcggatttagcatatagctgatggggtctaggactttagtcaatctttacctatgagatgtggagtatattcttatgtgtatgacctgagtccccacattatctggaaagaaggcctccactctcagtttttgttactattcttgcaatctctgtttgtgcatcgaggcgttactaccaagactcaaaccaatcactcccaatcccctcgatctaattggcaatcaacagaaaatcaagatgaggaacaaaatttgatgcattctacgctcgccgaaaaattcttgcgcttccacagcccgcaatgtgtccaacaagtagccacctagatgccggatgagtcgccactcatgaacgctggcggcctgtggtacttccttccactactctccgtctaacagcaatgtactttcctattcaccgggtgacgtcgcatgttgtggccgatctctgcgccacgccctggtctgctaattcttagtgtacctataaaacccacccttcgcattacgctgtatttagtttttgaaattagagagaagttaggggaaagttggtagtttgaaaaaaaaaagttaaaagtttatatgtgtagaaaagttttagatgtgatgtgatgaaaagttgagtgggggaagtttggtgtgaactaaatagggctttagttattaagttgtgattcgatgtaatcccgtgccccgatcaatttttatcctccatccgcctctgcacacaggctctctgtcgtgcgattgttgcctccacctcgacgcggatagccgagctgcgcacaccatcgctctgcgctcccctacgtcgccgttcgcgcgacgcgctggcacgtggtctcccgctccgctcacccacgctgtcgccgtgcgcgtccgtgccacatcgcgtgagcgacacgctccaggcgaaaagcatgtggggtgggcaaccaaaaccgtcggtgagtgtgccaatacacgaatgaacaaacaattgatcagaaagattaagctggccactatgtacagcgacagctagtgactccgaagaacgtactacggcggccaagatcctgattcctgaatagcgtctaccgcccgattgattagagcaccaaatcatccattcatttcattcgttttatctgcgatcatgctatagtaccaggatggtggatgagcagaaatcgacaaggaaaccatgtgtaatgctgcctctgccgctggaatcttgttcaggatgtgcatgcactatgcagatggaccgggcggttgttctcaatccgcccccagaggattctcctcggggtcgacgcgagaagacaaactcccggtggaaagcagatgccgcggctcatgtaccaccattgacagcagcgtcggagagcgtgctgtgggcgtgattgatgtcttcatcgtgcctcccgttcatctgcgcgcgctgtcgctgaattgatagaaacagacacgtcagaaaaaaaaagtgcaatgtgacagtttgttccagtatgcctagtagatggctcctccaatcaagatcgaggtttttgttgtaatccctctcccaaaatataatactaacctaaaaccagattgaacgtatatatccagattctcatagtactagaatacaatccgatactaaactactccctccgacccaaaaaaaagacaaaccctggtttccgtgtccaacgtttgaccgtccgtcttatttgaaaaaattatgaaaaaaattaaaaagacaagtcacgcataaaatattaatcatattttatcatctaacaacaatgaaaatacgaattataaaaaaatttcatataagacggacaatcaaagttggacacggaaacccaagatttgccttttttgggacgaagggagtaagctgctactaggttacgtcaaatccagattatctaagtatattctaggaagtacttcctccgtcccaaaatgtaagcattttttaggttggcacgggtattaagaaagtaggtgagaatgattgaataaggtgtgtaattggttgaaaagagaaagtaggtgaaaaaaaatggttgtgattggttgagaggagaaggtaggtagaaaaatagcttcattttgggataaagtactgtgctagaaatagctacattttgggacggaggtagtatattattaggatggagggagtaattaaactagcaagggttgtaaacaaatttagtagtactcgctccgtctcaataaacaaatcatgagatgtgacgtattctagtataatgatctgagcaggttatcgcatctcataatatgtttgtttattttgggacggagaaagtaggatccagcatagtataaagtataggcaagttcatctaatagacaggctgactgtactaagctaggcttgttcagggagtatatagggagaagacttctacaatacccgatcagtaggatccccatggtttccgtttaatagcttatggaactcttccttcagtctgctgtctttctcctccttcaacctgccatccttttccctggtactcaatggaagcaaaggtactccatttgtacgatccggcatttctgtaaatatctcaacaaagcttgttacaaagtgtttgccatacaaatccctgtaaaggcgtaaggcaacaaatgtgacaaaaatataacctgggagtttgttgtccacgaagaatacgactaaattaacggtatacctgcatgggaaaagtatgtgaaaagagaggtagtggccacattatgacaataacaagcaaggagctaaacttatcataccaagcaacaacaacatccacagagtagtgtttgcgagaagcaattataagaagactctgaactatggccatgaaccaagcaagaagcttaacaaacctgtaacaaaaggtccaccagttaaattttagtgttcaggaatacactcaggcaaagttaatattcaggggtctcagaacttggtaatgttcaaaccagaaaacattggtaagaacatacctttttgaaccatatttgtggtatgttcgaacaaaaacaagagtaaaaatcatgtgagatgaaaatatcagatcaccgcagccaaaaagtactccacgaggaactgaaaaagaaaaatgaacttgtgtgatcaggaaaaattccttgcgcagctgtcaaaccacaatagaaacttacagttaatcaggagcacttcaaatacattgttgggtggtggaagagtagccaactttgagccctataaaggtaaaagcttcggatgagtgctaaaatgagtaattgacaggtttacaagttttcacatgtccaaaagcagagcaagagtgcatgtaaaattcttggctaaaatgaaaaaggcacctcacgacaatggtagtttgggcccggaagctgggtggaatagaacgtaatgattcttaaaacctgcgaagcctgaagaagaaatattcagttacttttcagtggcatgcataaactatatcaatggaaaaataggaagaatgcactcacaactaaaaaggctagcacccggcgccagattaggacagtgtagaatcttttgctatgataaataaaaggatgaaaagtccactgcacataaatatacttgtgagacccagcttgataagttgcagtataaaaaggaatcacataaatgcatgaaaggaactataatcttcaatatgtcatgaccaggaatatgacccatctctcaacagagaatgatgatagatcacgcctattatttttttatttatgcttaggtgttgatatctgaatgatctagtttttcttggttatacaaattatcagttatcaattaaacaaacagaaataagtagagtacaaggatacatactaaaacaaaggaagcgaagatggaagcaaatatgctctcacttagataacctttgtcttgcccaaactcctaaaaacaacggtaataattggctgttacatatgcaaattaatcgatagcaaaaaggataagtgatttacttactggaagggccataaatccaaggtcctgcagaagtggaccaggtcgatgcaagtaatgcactcctcgagcagccagcccatgaatatactaattataggcaaaatattgtatgaatctccaaagtaatccattaatcaactgacaaacacagaagaataagtaatcctatataactaaatgcagaaaaaaaaaagagaactgaacacagaaaatttccatcacgccaaaaagaaaaggaaacaacaaacaatattgatctgtcagaactatggtcttccaatgaaagttaggaattgcgatctaaaactgcatgaacttattgaccaagattttcaaccgttatgctgtgaatgtgcaagtcacatgacttgagtgcacacacagaaatattctgtttagtgttcagagagacagcacacttatatcccaaatgtcaaaataatataggaatcagagattggatcagtgagtggtgggtcagaactcagaagacactgtctactatcagcaagactgtatcacagacaaaataagttggattgagtagcatttaaaaatagttctcatgaacttttattgtggatttatgagaaagtaatagtagttacaagaatacatctaggaaaattcacaacatgcatagtaactattatttccatgcatgacatgatagttcaggcgatatactgttaaaagaaacataaacctatattaatttttaaaacaaggcaatgaggatagatttaacatgtctcagaaaggaaaacagaagacagatgaatacaagagtatcaattgacacagatggcgacaattcacctctacaatggcatataccatgtaagagcgcggcactagctagacaaacatttgaacaaagtgtttacccgctcaattttcttatactgctcacggccaatgaatttttcatgccatgcatacagcaggactgttccttattatgacattccattgcaatttcaaaaccgaaaaggcaatctgtgcccagggcatcattcattcattccttgaaagagcagcactgaatccctaatctacacagactacaaagaatgcactccaatatacaacacagaacacttgtaaatgttactgactacagatttagtatagctatttaaggtctcgcctagcaaccaaaaaaaccccaaaggctaatcacatggctactaaaaaaccccaaaacggcaacattatcaacgataacaaagtgcaaatcgcgttgcaacaggggggggcaaatttggcaacctctcatcaactcggcattaaaattctgtaacgcactccaccactagcaataaccacatcacgcgcgaaatcagtaattccacgcacacgaccgaaaactagtactactagtaacaaactgacgagctcacctgaaacacaattccggcgaggagcaatccccacttctcgcgcagcagcgagagctccaccgacgtctccgtggtcaccttcctccatacctacacaacaagaggtgaaaaaaataaaaatcgcaaattcacacgacgcgatcgacaaagaaatccacactaaaaaaagcacaagatcgaaaaaaaaaacagagagaaaaccttggaagcctcccgcgctatgtaaatcgtcatggccgcaccccgccgcgcgacccctgctcccaccccgaccgctgcagctcctaccgtgcgacgcgatcaagtccatgctccgatccacacatcacgccacagcccgccgcatccccgcgtcgggatcgccgccccaggagtaaaagacaccgccgagaaaccagagaagcgggcggaaaactcgtttcccaacaatctggctccgcctccggcgccggcagacgaaggccgctagctccctcacctgcgcgggggcgggccacgcggtgtacggacggggggcggcggtggccggcggcggcgtgagcaccgagagagacttggactttggagagagctggagggggggggggagttgtggagagatcgagaaaacgagagaggagagcgatggatggtggaaatatgggagagatgagggggttttatgaaaaaaaggggggtgttgaggatggagcacgaaggtcgtggggggttttaactgaaccttttgggaggaggccgtttgatctggatggacgacgtggagtggagcaaaacacatgacttcgtgctctaaaagttttactaccctcaaatccatccggacatccttatgtgtctcgttaagattcttaatttagggttggtttggtttgtggtctaaataggccttaccaatttttatcaatgccaaattttggtaagttttggcatgtctaatttttttgttaagataaagttgtgtttggattgaatccaaaatagcttaatttcactattgaaatgacatatttttttaggcatgccaaaatttggcttcaaaccaaatacacactaaacactattgaaaataccaaatattggtaagcctaatttaggccttaaaccgaagcccttactgaatttctctgctctgctcttctcttctactgttactctaaaaacgcaatcgttctatacttccattctcttctcatgccgtataccgtatttttgtgcatttataatggtgctactagaacttattcagtccacgtaacaaacaccgtgattgaattatgacgaaacacaagccacaaaccacaaaaacttttcgttagaccggcctttcgaaatgtagtagaagattcagatgcaactctcctggtctagtggagtcggctgttgcacgaggccccacggcgttttgttgatagaggtccagatcaaataccctgtcctagttgcggataccgacccgagcgacgggtggccggatcatgctgctacatgacaagtcagtgctaaccttctcgcaaagagacagattcgtgcttgcgtattttaatactaccgtatagtagtatctgccacatgcagtgatgcagagcaaaaaggccatcgatactgtatctcctagcagctgtagcagactgaataatgatcagtcatgcctcaattaccgattcctccctaaaaaaacctattttatctctttttattatttttctaaacaaaataaacataattgtaatctccatacatataatacttagtaaaaggttttatctttttattactactcaattgaatttttaatcggaaccgaacagacatcttaaacccacttcgaatcaaaggaaattcacatgaattttagaggattttattcctattggaattgaaaggaatcttaggccccctttttattcataggaattcataggaatactcatgggttgtctgcttgaatgtatttcttttttctttttgtctttgttacatgttgtatcgctagtatgagttaatttcttcttccttctagtaaaaaaaatagtacattcatcttagtttgatcatttttaggtcttttcaaaataatcgtcctctctaacaagtgtctcttcgtttattatttgtgcaacgagtaaatgtgttgcatggaattaaccaatattagtttttgttggtgcaacttcatgtaatatttaaaatgtaatgcaattcacaaggcataaaagcgacgtagcaccttgattgatgatgattaattttcgaatgatgaaggtcttgttgtccttagtccctaccttttttttagacgatgattatattgggatggaggaagtatgccctaaacttgcgtatagatgaattactatacattgaaaaatgattaccaataagtcttgaaaagttgaaattattggtgatttggtactggtcgttttttttttttttgctatggaggcacagggcttatttagtctggacggaagtgatgtgttgcttgcagtacatataaatgaaacgtgcatttgttgactttaagcaatggttcacttgagcgcatgatctgctagttgcgcaacacgcagatgcaaggctatgggctatgtggcgtgagagtacatgttcgatggttgcaacggcttatgccgggtgtgatgggcaatttgcacgccacgatgagatgcttgtattcgacggtttaatgaaggattatacagcaaatggagaggtgtgtattgattaattacttcgtggcttggggtataaagagcactaggaatcttggatctctcgcaagaacaagtgacatgttaggttgttctgtgacatgttagcgtccagtgggaatttagctgtgacagttaggatagaggtaggttggtcaaaattctaaatgccagagttacccatgtgatgttgaaataggaaaatattgatgccacggcaaaaggtcagctttgactggtgccatgccaacaaaacctggtggcctggccctcccaatctcctatgttgccaatgccaattgctactacaaggacaaaactgcaataatgaattttcttgagcttgtttgtgcaagaatcccagtatgtttttttttttctatcgaagtcaacaggtttttagctttgacctatcagaggataccgtgtccagtgtatttgcattatgaattttcttgagcttgtttgtgcaagaatcccagtatttgtttcagcattggtaaagggtgagatcacaagacacaggactataagccggagttgatttcaatctataaggggatgtcccatcgttatctacatgtcacttaaatagttataaattttttaaaaaaaataagtatcaaaaatgtattaacatgtgatatatcactccacaaacatgcaagtttaaattcaacttccacatctcgtaacgaaaaaaatcaaatttgactctgaatatatgttaactagctatagtttaatttgttttttcgttgcaagaacgtagaagttgaatttgaacttgcatgtttgtggagtgatatatcacattttaatacatcttctcaattttttttattttattttttcataaccatttgagtgacatgtaaataacgaggggatatcccctcccctcgagtaatcaaaatagtttcccgactataagcatatgcgtttgggtcatggatgaggcagggtgagacgaggcgtgctcacctttgagggtgtttggttcagcgaccggttgaatgagtttatatctgaggttacgtttggttaatcctttctacaagaggatctgaaagagatttattctaaacctattatagtctaagattattcaccctcaatctactccattcccttttactgccaattgaccaaacaagacctaaaagagaatactcctttaatctaggttggtcttgtctcttacaaactcatggatcgattcaaattagttttctcttactgacatatgggtcatctcttaaaaacaagactatctcatacgaaaaggataaatggttacatccaattaaaaacatatatgagtactctaacctgtttcccttcgtctccaaatcgaacacatgctaggagaaaacacagtgcaaaatgcccaaccaacatctacactgcttcaaacagaataagtatcatgttttttttatgtgtttttttagtgtattggttagtaatatgctgataacatgtgtaacaaattgaagcatgagaaaaggtataacaaaatagttcttgatgtcacgatgacaaagtagtgttattggatagaggggaaaaatgggaaaatacaaagaaacaaaaggtcagctcacgaaattgtctgcctaattctgacagtccttatcagcatccaacattgcccggtcagctaagagtaacagatagcaaaagccaacgttccaacaaatggcatgttctctcgcatgataaggtggttaacgcccaatggacaaccgagtttttgctagcacaaatcctatcatgccctgtctgtaactgtaagtggaacaagtatacgctgacgggacgatttcaccggatccagattttgctgctggtgtcttagttttcaatttttctggccggtacgacggtacgctcgccacatttctgttgtttttatactttcgtaagttacaaccttattactgctttagaaaaaggagttggtgccgctggtataccgtcctctccaatctccatggctcacgtttaaccctcacgtttggccttgaaatatgctcacttcatctccaaataaacaaacaacatatcctcggctgcgttggaggtggcggcggttttgcatcggcggctgctggcgtcggtggctgatgacagcagcagcggcaacggcggccggcttgcggcggccatgactgaggaggcggcggcgacatcggcagatgcggcagtggaggcagggaaggagtcgggtgtgaggtgacggcggcgacagtgaggtggtggtgaccatgacggtggtgggaggaggcatggcggcctcggacggcttgccgagggcgtcgcagacggctacatcggaccggcgcagcatcgtttggaggaggggtcggagaccagcttgacgcagagtggcgcaaccgatggcagtggaggccgactcgacgcgagaggcgcgagtagcggagatggaggtcggcttggcgtgagaggcgcggccgatggagggaggccggattggcgcgagaggcgcgtccggtggaggaggctggcttggcgcgagaagcgcggccggcggtggaagaggcgacctcggtgcgtggtggagctactggtgggtgtggcacggtcttcggcgtacgaaggttggccagcggggggggggggcatcggtgcaggggccccacatgtcggcagagtttgagtggtggtggagcattggtgcgtcagccgtggattcgcaggtggggagcggcgggtgaaaacccagcccggcctttgccggaccgacaacgatggttaattccccctcctgaaggtgttgtcgtgctgtctcacccctcaagggtggttgccgggtgaaagcccagtcttggctcctttgagccctgacggacggtggcagcggttttccgtcgcttcttttcttgaagacgccgttttggcacccccttgctgtagggcgatctcgtatgtgttcatttgttggtctagcggcggccggtcacgcttagcagcggccggtctagtgctaaccttctcctgtcgtgtgtgttggcgctgccggtgcgtgggtggtggtatattttttttctttttcctggttacgaccctccagggttgtaatcttgtaatctttttcctgctctatcaatagaatatcgcaccgtctcgtgcgggttgttaaagaaaaatttaagcttgttctttcgtatcactatgtatcacatctcgttctagttttatttattttagaacggatagagtacgtgtgaatgtgttcaaaaatcaaaacccgtatttgtgtaagcatctgtatcttacgaacaagaaaactgacgttagtttagaatcaggttaatgcattataaaatgcacaaaaaagactgtgggttggtttggtttgtggcataaataggccttaccaatttttgtcaatgtcaaattttagcaagttttggtatgtttaattttgataaggtaaagttgtgtttggattgaagccaaaatagcctaaattcactattgaaatgacctattttcttaggcatgccaaaatttggcttcaaaccaaatacacactaaacactattgaaaataccaaatattagtaagcctaatttaggccttaaaccaaaccagtcctgtgtttcggaaacaacgtaaccttagttttttaagacaaattaccaggccagttatgtccgtgagacagtaattggtccgaacaaaattctcttatccataaaacctcatcttccgtaggccttgtgcttgggtagcagttctaaaaagaataagcccctccctccatataggtttaatcttgtttgtatttccacaataccagatattataacaccctaactattagaactagaactggtgtaatttaactccctcagcggtttacgctaacgtggcttgttgactagtccaatcaacagagtcagcatacgagcccccctcctccattctttctttctttccaccctcgccgatcatcgccgttatctccccggtccgctcctcgcgttactctctgggtgaagttctcgagctccagatggcgcccttgatctggcatgtcaaggagaagcagaagtagccaccacgggcaaggagtggtagcaccagaaacatcccgagcagcaaggagcagcagctcgcgcggagcaggtcccaccatcacgatggtgggtggagtagggagctagcagtagcgagcatcgacttctccctcgatctcaccccagcaagagctcaagccgtgaggttgacggctccttcctggcggcgcgtggggcaagcagagctcgaccttggagcagcttagagaaaggaggggccgtcgagggttggcttctgcttctccatggctcgatcaggtgggcttcccaaagcttttggaaggttctcgcccaatcgattggagacgagggagcagcaaatggctgccacggtgctcaccagcctcgccaccacgtcctgtggtgttgtccaacggtggacaccgcacaggccgtcccttcttcctcctaccacagggcaatgctcctcgctgaccacatcctccaccgctgctgcagcagatccctccctctcctccgctggcggtgatgtcagggtgaggctgcccgcccaattcttcctcataccacaggcagcgctccctacggaccgacgcctgactagcgcgtttccaccgccgcaacggatccctctccctcctccggcggtggcgatgccataacaagaccatcggggccaaacctgagttgtgtagttgcgccgagcatgaaggagaaactagattgactagggaaaaggagagagggggaagagcgttgataagtgggttctgtggttttttaatttttttttcttgtcacttacatgtggtccacacttatagtttgtatctagactattgcgtcagtacagatggaccaagtcaatgtgatatgttagcaagcgatcccggactagttggatcggctggtgtttgatcaatgtctggttgtggctggtgttctttttagcaaaaatggaaagaaatgtgtgtatttagtaatcgatgcatgagtgcatgattagcgagttcagagtgccatgccctaatcaggctatcgcaggacttgtgaatagaagggaataatatcatacatgtatatatgtgaaccgcggttcaaccgcctaggccaccagtcaatcgggtcacccaccagttcatttttttttactatgaataatggcggcatcggtgacgacggaacggagacacagcatgaggaagagtcactgatgatggcactagtatctgggaggggggagacacggcgtgtggaagagccgctaatgctggcatcgtggagggggagaaggaagggtgtgacaaagggcttgggaaggcttgggaaggaggcattgtcgcgtcgacatcctcgaggtaaggaggaagggcagggggctgcgagcgacagtgaccccaacatctgtctaaaaaaatgtggcctcctgagtccacactagttttaccagcggaatgggcccaaaacggaggtatatttggcctacggaccatccattcaccatttctacatttaccctcgaaaatgatttgggttggtattttacatctgtattaggcaaaaaacagagcttccaagcagactctgaggaagtcaaattagttcggttttaataggctaaggatgaagatatccggtattgcagatcaagaatacggatgagattgcaactatattggagggagtcaaggtggacttattctgttctagaatcactttacaggcccagcttaccgtacattcactcatcagagcaacacgacagccgtccaagtcgcggccatgcgtagcagagggccagagcccagacgccagccagacaggcagcgtcgtagtgcgttacggagctttgccacgaactctcgtagtcccgtgtactcccggaccggagcagtaggggttcgggagcagtatgccgtgccgtgcccgacggggaatgcatgacctgacagtaacagtacaacccactactagcttcaaatcatctatagccaatgtaatagtcaattcatacaatagttgattactacactattaatacatggtcccacatatcatacacatattacgtcttggagttcgtgctacagctggctatagatatgtagtccgctactattttctctctttttttatctctttaaaatatgtttataactggcttatagcctgttattgtagtgaagacgtgctgtgggcccgcacaccatgagccatgacaccgactactgccgtttggtgttttaccgttctgggttttcgctcgcatggtgcccacgtagagacgatagacgaaaagaatttgaaaatgtacttttatttatcatattttgcatttatatacctgtataagattattttataaaaatatatctaatccgtgcggaatggttgcgcgggagcgagggcgaaccgcagactcgagccggtcaagcggaaccgggatgcgcgactgagccggtctcgcatggctacactgcgggatcaagtcggtaccatggcgccgaagcgcgggagcgatggcgtcgggggagcgtggcggtactgcataacggcggcgcggcaccggcgcggtcccgcggttccagcgcgtggtatcgagccagtctccggctccgtgtgttattccgtgttaatcccccaattttttccaactcatctccttcattttccgcgcgcacgcttttcaaactgctaaacggtgtaatttttgcaaaaagtatctatactaaagttgctcagaaaaatcatattaatctattttttaaaaaaattaactaataattaattaatcacgtgctaatgtactgctccgttttccgtgcggacatgtattcacgagttgggaaagggcgtgcgtatggcagcggtagtccgcgcatccgccatgtgggagagaggccggtcccacgcatccaatatgcaggagcgctccggatccgtgtgttattcccctaatatttccaacccatctccttccttttccgcgcgcacgtttttcaaactactaaacggtgtattttttgcaacaaattactcacatattatggaaacgctctattaagagaatccgtttcaatttttgttgtactcatgatgttacactacgtatagatcaaatgttgcagtgaattaaaacatctcgctatttgcttaaacattttttatatatggtaaaacaatacccgattttttgaaaaccatttgtttcatacattgtagcaaaatgttccatgaggtgatttggttgtatttcatttttttaaacgattgaacattttcgatctacttagtgaaataattccgatctacttggtggaatagagcccgattaatcgggcgtccgattcgtagtcgcctcggaaaaactcttatacgtgcaatgcgccggctcttcaacatcagatccgaaaatgcacccttcccgaaaacttttcggcgaaagggggtaactatatttatagcgccatatttttcaccaacaaatagtcagcatgtatttacattgtaagtccctaaattacatatgtaattttagtgtatttacaatgtaaattctaaaattacatatgtaagtctctaaattacatatgtaattttagtatatttacaatgtaagttctaaaattacatatgtaagtcctaaaattatatatgtagtagtttttttcatgaaaacacatgctgacgagatgagaaatttgaattgattggcttcacgatgcaacacgaaacacgtaaagacgttccatgcacatgtgtagcgcccgttccgtcgtggcgcctagcgggaaaattaaattctaaaaaccatatttgcgaaagtcgtttctttgcttgttgtctatgtgcgtgccaatctctgatctcgaatccccgatccatcgtcgaattcaaatttcaagtccaaatctctcctaaattccatccctctgaaaaagtctagtttgcctccctcaggttcagtgggccgatttccctctcggcccatctctctctctgtctctctccctcagctttcccctcgctctgcccgtgcgcagcacgcgtgtgcgcgtgagccgacgccgagtcgagccgagcaccatctcctctctctcgttctctcgctctccctctccccgtctctctccccggcgaccccccgcccgtgaatttcgaacccgcgcaccgttgcttcgcgcgcgcgtgcccgcgcgttcgccgccgtcgtcagccgcctgctgcccgtgcctgcgccgtccggccctgcgccctgccacgctgcgcctgcgccgcgccctgccccgcgagccagcacgcgtgcccgagccgcgccgctcgcatccgtccaaaacccgaagacggagctcccgctcccatccctctcccttcccaaattggcatggcgcgcccctcctttctcccctccgtttctccctttcccctctcggcccggcccctgcttcctccgttcggttcccgcgccatggacacagaggagcagccgcccaagccgttgcccgcgtttgaccgcgcccgtgaagcctatcccttcccctcgaagctccctcgcaccctagtgtcgcccaagatcggtttccgaaccgacattgccgcctataaacccgagcccctccccaaaccaatctcccccgttttcaccctcgccattgccgctctcttgccctgtttcgtcgtcgccatccgttgttgagcgtgccggaggagccggcgcgttcgtggacgcgtgacgtggactccgggcgctcgtcttcttcctcttcctcatcccgaggccgaaacgatcacgtttcgcgccgtcggccatcgtcactacgccccttcaccccgtcgcggtagtgcactccccgttctccctcctcgttccctctcctccccttagactcgagtagtagcacgactagaccccccgtagctagctggcgtcgccctaagccttgccgccgcccgctatgtgctcgccgccgtcgccgcccgagctcggtagcgcctctcatcgccggcctccctcggtgccttttctcctaatccagcgcaaggaacggactccggtggccgcgtagatccgctggtccggagaaatcgaactcccgtcaccctttccccttttctcgccaccggatgccgccgcagcaatccgctgccgtcgagcatccctcggcgaatccgagccattggctcgtctcccctcgtcccgtgctacctcccggtgtgctcgctttcgcctgtatcaccgtggttctccccgccgttcgcagccgccgtccgtcgtccgttccggccgacgccttcttcaacctcctgccggctagcgtggcagccatgtaggcgccacgtcggcgccacctcggccgcgaccaggtcaagctaaccctggtccgccgctcccctccgccccgccctcgcgcgcggtccaccgtgatccgtaaggctgcgcgtgggcccgccgcatccgcacccaccgcgagccgcgcgcgtgcaccgcgtccctcccccaaaccctagcgcgcgccgcgtgctccctccgcgcgatgaaccgtgtcaccaacaagcgggtcccactcgggaccacgcgaggtgagcccggtccaccggttccctctctcacctcccgcgcaccctactgggccgagtcctctcgggccggccggcccattagctcggccgagccgcgcctcttctctcgggccgcgccctagccgcccgagggaagtctactcgtcctccctctttcttttcttttcaaaaggatttaaataaatcatttttcctttagatcaaaaatccaataatcttagaaattcaatatcttcttaaccgtacatccgattgactccgttcaacttccaaaaatcctcaattctcgagatctatccaatggcacgcatagaggtcaataatagagctttattttcgccgtttgttgagttgtcccgtttcgtgtgtagtttcggagcccgaagacccgcagtgcgaggatttcgaggatcaagctcaagatctcaagcaaggcaagtcacctttgatcatcttgcacctataatttaaatctaattatttcttttccgcaaatattgcatgaatatgtttaacacaagtatttcggccacggcttgcgagatagcctgccggcctcaaccctaattgctgcaattaccctccttgaattattgaacacttaaacctcctttgtcgactgttgtgcttcgatgcacgggccttcgggcacgcgcatcggaacacctcccctcaaatttaaaatatccaacgatgggtaaaacttggggttttacaaaagacttggaaaacccgacacctgggtcggtgcttgcgaactaaatgaatttccaaaatcgcggaccggggaacgtaccgggagtacggtttcccactcttgcacttaaggatcgtttccttggaatttcatccgaacataagacaagtgcgaccacatgggtgtaatgggacacccctggttgagtaattagctaatcgggggaaccatgatgccaaaagacatgtggattcaacggggtggtgccggggagaacccccggatttcctggcacagtatggtgtgggacctaacctggtgttggtctgggacccctctcgttggcatatggtgaacctgtgtcggctttcaaaatgccttgtcatgaaagcctcaaggtctctagacgtggccgttatgcatgggctgggtgatccgggttagtaatgtcgtgtgggtaaagtgtaccccctctgcagaggttattaaactgttcgaacagccgtgcccatggtcatgggcggatgtgaggtgattcctagcgtagttttgtatgactactgctttgtgaaattgttgctgtgaaatgggttcgatgtttggaaaatctgcggctgatggggtcagccaggcccgggtggccatttgaaagctgttggccgggtgccaaccttgaatcaattcaaagattgatacattgcacatactccgaccagacgagacacactgtcacatccgtgtcgtttgagaagtactcacttagttgttttaaaaaggagtttaaataaaatcaattgcaaaaacaacagcctttcctttgaagcctgcattaaacacttaattcccacggcttgctgagtactcctgtactcacccttactctataaaaataatccccccggttgctgaagaagatgaagtggatcccgctgacgaggagttcttccaggagcaagtcggctacgatgagttttagggtttcggtctagttcccaagtcgcgcctgtgatgattggtccaagtcttggcttccgttttcccttttgtaatgcagttatgagctcgggatctgtccgcaacccaacatgactgtactcctactctgtaataaagagacctctgttgttgtgatattctgttttcctgtgataccaacaatgttttctgggactggtatcgattaacaggttaatttggagcgtcacgagctagttccgttcgggactagttcggggcgtgacaacatggtattgcaatcgtacacgaatctcaagggagatcaattgaacaagaaatctactgtgattactcacaaaatgtgtcgatataattatagcaacaccgcggcgaaaagcgacgtcgccttctatcgatcgtaatgtacgcacgacgcttccagcaaattaacaacgggacaagccaatccatgcagcacgccatactcgatcgatcacaacttcgcagggaatcgaggatagccgaggcgtgaagcagacgcgacccgggccgcatccatccatctgcccccgcgcgccgattcctcgtgctcgtgcgcgcgacatgcggggcgcgtgtcctctgccacccgtcccgtcccgtccgtgcgcgcgcgcgatttcttaaagccggcgacatgccgtcggcgggtgcacgacagcgaccgccgaccggggccaatccgtggcttgtactcttgcgccaccgttggccccgccggccggcatggccgcgagaggaggccatttatcagttgcgtcttggcaatatatggtgtgttttcttgctttctgcattaatgagagcaagtttaatagtatagccaactactagctccaattcatctatagtcaatctaatagctcattcatataatagttatatactgcactattaatatctggtctcacctatcatatatacattgcgtcttggagtccgtgctacagctggctataaatctgtagcccgctgctattctctctccttatttatcttcttaaaatatgtttgtagctgacttatagcctactattgtacctgctctgatgatcaatccagcaccgaaatggaagccatctttaaataagcagattgctggatggagcccatccgtgcaccgtgccatggtccatgcgtcgcgttgattagcgctagctgctggtcgagccgacttgtgttgcttgcagcgtccgtcgacggcagcttagcgcgcgctggcacgtagagttgccttattaatgtcgggggtggctcgccatgttctgcgacagcagatcgaaatgagaagttaagaaacccatgttcggaaaatggattgccgcgtgctcgagatcacactggccgacaggtgggcctctcagttgcattcctcagctatgctctggacagcagtgcctgccaattgtgtcaaacggtcaaaccccatcctgaagaaagcttaaaacaaaccctttttgcacagtagaccatacataggcacatagctacagtctgtgagtagattagatcattagagtactttgttactgcactagtgaccactgtcctagcttaagaaatcaccctccctctagtacgcacagctgtctttcttgacaatatctgtactactatgtgttaaaaatacagagagaacatgaacacttgtccttaacatagagtaacccatttcggcaagttcggtaatatatccaaccactctacataaatccgtttggttacatgtgttactctatctcatatctgatgctttcttaggtggttaagctatcaacaagctacctgctcacttgaatcaacagttcctcgacgccaatgagtaggcggttgtgaagagccaattttatcatgtttttcagccacacatgaagtagaatccaccgattcataatcatctataatcgtttttacgcgctttgcaactagacaaaaatcggtattggagagcaatgcaattccccttacattctcgtccaataatctaatttgacgatccaaaagaaaccaaatccatggggaggagatataaaacatagttcacccccataatgcaatgcccctcctgtagatattttttggtcaccaaagacaatagtgtggacccctgcagggtcctcaaagggaaaggcaccagagttaattaactggttgtcttactagatcctagctgttcctctgctgacagtggttgtgtttgtgtatctcggtcccctctgcatccttcctcggtttagtcctgacgaggaggggaaaaaaaataacccagccactacacacctgctggtccaacagctagaaacagctaaccgctgccccagcaagccggtgaactgtcatcacgcccagatccagggacattctcttttcgctttgtcggcgtctactccatcgatctaccacaccctgttcatacgcatttgtctcggttgccgccatccgccaccaacgtgatacctgaaaattttcattcatacgatgaacagagccatctgccatctactaatctagttgctgaacaaagtctaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaacagatcctcctcctctcccaagatggagaattagttgccgacaaaattattaaggattagttacgacttcttagaggaggtacaatagcatgctataagccagctgcaaacatatttaaagcagataaatgaggagagagaaaagcagcgggctacagatttatagccagctgtagcacggactccaagacgcaatgtgtgtatgacaggtggggccatgtattaatagtgtagtatgtaactattatatgaataagctattagattgactataaatgaattggagctagtagttggctatactattaaacttgctcttaccggtgtgtgcaaccatatactccacttatcatatatatatatgcgcgtcggagcgaaattttgcagggtggttgtgatctctccggtgtttgttgttatacagacgtatgtatgttcatacataatgttgccaaacggcaaccgaatttcacacatgctttcaagtttcagcagatgttggttatcgagggattggtgggtgaacaacacagagcagaagagagctgtacgttccaacaaaccattgaacaagtcactgtatgtatctgaacaacgccatactatgggggtgtttagatggggctaaacctttttagcctatgtcacatcggatgtttagacgctaacttggagtattaaatatagactaataaaaaaactaatttcataaatgagagctaatccacgagacgaattttttaagcctaattaatccataattatcaaaagtttattgtagcattacattgtcaaaattatagcgtaattagactcaaaagatttgtctcacgaattagtccaaggttatgaaaataggttttgtaattagtgtatgtttaatacttcaaattagtatccaaacattcaataagacagtgacttattctaagtctctcgaaacgaaataggccctatacattttctttttctgcaaaagaaaatgaaaacgtaggccggttgcgagtgcgtgctgaggcaatcaatcatacattcgagttcattcaactgagcacaatcagtggcaaagcttgctgcaaaacgggggtcccagtcgtactaccttcctatgatttgttaaggccctaattatagaatctagtaagagacagcggagaccaaaagagtgcaggctgagcactctgccctccatttgctagcagaggcaaggctctgtgtagatgattactccttttaacaattcgattatacagattactgaaacttcaccttcgatttaacaattcgatggttgccacagctatattcatccatgtgacgacctaggcttagagcagatagataatgaacgcccaccatcagcctgaccaacggagcagcactatacattcgtgatacggagaactactcctttatttatgtgcccctatagccggaacatttgattacgtccgcacaaagcacggttcatgtacatgaaaattgcaggataaattgcaccggacggcagcgacatgtatcctcctctcatgtcaattcgctctggaagctcgccaattggatttgggcccctacgtgagtctccgaaagtttttacttccactcgttcaaggagtgtgtagttcgcatccgatgtccatagtgaaggtgcaacaaggcgtagggatactaataatctgtgattactcaacttgtggtttgagatgtagaatatgtgcaagtgaccagtatgcaagtagtactagcaccatacaggctagtaatacgctcgagagaataggagtacatcttaagctaggcaggcagcaagcatttctaaactgattggtcggagctgattaaaacggattacagggtggtggccccacaacactagtccagtttaggttgccaacccagtatcgccattggttcattggctagtactagtagcaagccgagaccggccggtggtggtggccctcctcaccagcgcctcacctcggctctttttgcccctccccccgccgtctcgtccccaacgtgacggccacatgggtgccggttgccccccacaccgatcgatcgatcgatcaatccaccagctcactcctcacccccatcaggtgcgcgcaaccacctttccaccgatcacgacgctcccccatccccgtctgctcggctcggcgcagcgcacccacacccacgccgtcgtgcgcgccacccgagcccgcaaggcggaggtaaaaactgggatgggataccgtgcggtttaccccagcgggaaaaagggacaagatcatcgtaacacggcccgaggcgaggaagagagggggtctactttcgggggtcgagtcggtggaacccgagggcgctttctcttggaaacacgcctggtgcgccatgcgacgcaacgcaatggtgagagacggacggacggacggaaacatcgagcaaaaagagaggagggctttgggcctttgaccgggtcaagagaggagaggacgcatgcaaaacacagagagcagaatataaaccggccgaactcatgcgcccatgaatacgcatgccagggccagtccaagaggaagacgggggatgatgacatgatccaatccaaaattgcttttatggcgggcattggagcggagcggagcggagcaagcagaggctctcccgccaaaactcttcaaggccattaaaatcggcagaggcagagagctactatgacggaacggacggacggatggtgatggctccagcggctgagccacccattccagctagacccacgctggatcctgcgatcgagctagccgagccaagcctgggactctctttggggatgcgtcgttttctcggcgagcacgcaggggactaccggagatctagtcagatgctgacccacagccaggcagattcctaggcggttagtcgccggacaaactgttcatcctccattgtgcaagtgtactacaccatccactctataatcatgtatttattgtcaactagtaagaaatactcaccatcattcatatattaaggctttgatggtacaaatacaactgttgtttaacaacacccagcccaactttgctgctgctgcggctaagcaccgaactactacacccctaaataagaatcttattgtaccgaaccaaaacagaaggttagggcacctataagctagtacaagaaaaatggcaattaaattcatagtttccttttcttttttttccttaagaaaggaacgcccttattcacggagcccacggcaagcttcttttgcaagtaaaagactgcaaaaaggagggaggagggagagagaccttatagctgggtgtgcgctggtacttcacttcttggcaagcacccaaagcaagcaaagccatggatgatgtagaaatgggtttatttttggctcccccaagatgacccatccataaaccactttgatgataccttgtcacttcttgcttgcaagctgcacaagccgctaacatttctctctcgccctccaaaagaaccacttattattattccttccaaaccactctgccaaaccaccaaaccgaagacatggatttcctctactgcacgtcgtctccgtctccatctccgccgctttccgtccacaccaaaaaaccaatatatcaccaatcaaacaaacaaacctaacgctgatgatactactgcctcctactaccctctttggctaatactaccacctaacagacgaagtactgttactaactttaattaatatgattaaacttgacgcaaagccagaagggggccgccggaatcttggtgcatcatccttcgtctgctccggccgacacaaaaaagttcacgaactgtggcagagcgcaggcgccggcgccggcgacggcacggctggagacgcgcgccgcttctggctggccagcatggcgttgctccggttaatcaaagcgtctgcataaaaaaaaacaactcgacataagcttttgcttgccatttccgtcgagaaaagaggatttcgccgcatgtggtggttaccgtgatcgagaacgaaaccgccggggtagcgaggctgggcgccgaggtcgtcgaggttgagattgagcgcttgcacgacacgggcggggacaagaacagtcgagcagcctgcagggtcgcggaaaacaccaaaggggaagaatattgagccaaaagaacaggggaatacgccggcaaaagcaaacggccaaaaatggcggacactgcacctgtctttctcttgggctccgccggtgcgccggccgggcgagggaggaagacgccggtgccgttgcgctcgcgcttggcgccgggcggggtgaggaacacggcgcgcatgccgccgccgccgccacccccgactccgggtgccggcgcgtgctgctgcttctgcaagggaggccacgccgcagggttcatgtcgacaggcgacgcggcgactccgcacccggcggtcttcgccgctgccgtctgcctcgcgccccacgcggcggccgcggcgagatgccgatccctctgcaacttcagcagctgctgctgcttgaggagatgaaactgaaacaggagaaaaatgtcggggagaaaaaaccgcggaaaacgacggtgcaactgaagaatctctgcatgaaccaagtacctgtgcggcttgaatctggcgctgtgtaagcaactgggcgagcggatggtagtaggcggcgggagcgacctttgttgccggtggagaaacgggaggcggcggcgaggccttgcgcgccggagcggcaaagccaccgtgggcggggaagccgtagggattgttcggcaccgggatgctgttggtgacccgcatgcgcgccacctgacctgccgcctcatagagcatgtcccacgggtccgccggcttctgctccaacggcgacgacggcggcgagctcacctgagacgccccgccgttcgggctctcctggccggacttgggcagcccacacagcgtcgactgcggcgaaccaaccgtcacctccgcctgcacacgaaaaaccaatcaaaaaccacgacacatcatccccctttgaaagaaccaagaaaaatcaaaccaccttgggaggcgcgtcgcgctcgccgtcgtcaccaagaagcccggcgaggcggcgggagaggccggccaagcaatcctcctcgtcgctgctatcgctcctcgcggccacggcggccttctcctcctcggagaagaagtcgtcgtcgaggaactcatccggcagcaagaactcctcgccaccgtcggaccactccgtcgccatttccctccaattccccaccacaacaatcctgacctccttcccccccgagagttatggcgtgccggtttggtgggcgagaacctctgcccgcccgaggacgacgagaagaactagtgacagcttcgaaccgtacggacagcggccacaaccagctatccggccggtcccccccacacacaaaggaggcggagaacgaagggcgcgaagccgagcgcgacgcaagcggcggcgagtagagaggttcttgtcgccgaaaagaagcgggcggagaaggagatggggggcgtgagaatgtcgctggacggcggcaccgcgagtcaaaatgctgctcggcctcgccgcgacgggggctataaaagaggcgagcgagaggagagagaaagggaagccggattatcatctctcagtgttttttttttgcgtaaattaagcggtttaaatcaaatgtttttttctttttttttttggagtggtgagcaagtgggagttgagtgacggccggtgaaccgtagcgcccccaaatgcctctcccctgttcagcgtcagcgagggggatttcgagtactcttgcgcgtattttttgggccgtgcaatgcaagaccgagggagttattatggggtcagtacgtagttgtggtacgaattcatctcggatctactcctatatttttgccggatgtttgtgtgcgtggggcgatcatgtcaagcgcatttcacccactacaccgtttgctaaatggtggttcaaccgattttagagaagatcacaccacccaaatggacccaaaatggagcagaagcaaaagcttaatttcttttacatcggcgatacaacacccactctaccctggccgctgtacgcaccacctctcgtcaatccccagttgtgaaaatctcacaccgaacagtgcccaatcacggcgtattcacggcgtgtttcgtgcgtgtacctagtgagattgttattgctccattgaatgcacgccacgtcggcgggggtaaagggatgggttagcgccatacggtcacgagaattgcatattctcaggacgatttttttttacagcgcattaaagtcgtgagcgctttaaagcggggagttttggtactacggtgagtggaaaagagaaagaggcagtggtatgatgtgtgtgtggtgtcgggcacatgtcacgtagcagcagtagtaggcaaatgctgcgcaccgtaacgcaccactgcatcattgcatttttcacatcgcccgataacccgccataaatcgagtgaaaagcggtgaaactgaaccgggaccgggtggcccgttcggcgacgagccagatgaaacgacgccgacggcgacgaaccgctgcatcggtaactgaccacgggacccacccgaggcgtcccttctggtgatcgggatggtgcttcgtgtggcgggaggggagtttgatttctggggagaccgtttttttgcccctacgcatgcaccgtttcgaaaaaataatttctcattttttgtttgaatttgaagccttgcctttaaaatcaagtactgatcgaaactgcagcaggttttccagtggcgtgtcagaatcccttccgtggaagtggtggcaatgcggataagggcgaggcaagcaaacggcaaactgctgccatgtagtcctcgcttagcccacctgtcgctctctccgtgggcccacatgtcagtgagccgcaccccagtgcgtgggtcccaccgaggagagcggcctctcggattcctgtgaatctccgcgcgcctggctgacgcgcgccacgccggagattcccgatacggcttggcgcccacgtcgctgtcgggcgggccccgcgccacgcacgtcaccctccctctccgtcaattataacggcggcgcggttgtcgcggtcggtggggtccacggcaaccgctgtggccgacgtggtgggacccttttggtcctgcgaactcgccgaaaccatcgtacccagagttttttcgcgtcctttcgttcaagtttttcacgtttccctctcaataaaaagctttttctgtagttctttttcccataaaatttctttacaagaaaaagtgtttgttgcgtaggccgctgttattatcgtgtccaatgaaattcgggaggccacgaaaaaaactacgctagcgtttgcccctcttttttcaagtgtttacgcattttttttctcgggtttttttctggaaaaaaaacgctatccggatcaggagggtgaggcgttgaggcggtggacgtggggacgtgttcacccaccagaaaatgactggtttcatctggtatataaaaaagaaagaaaaaacgaaagaataaaagataaccagaacgattgattgcatggttgaataggaaaagagagccccatgcacacaggggaatacggttgtgacatgatttccaccgtttgcgtggtgctaatgttgcttttagcgatgattactgacgatgacaacggatgatattattacctcaatgtatatttactaagtgggtagtaagatgagacccacaaaactggatagtaggtgttttgattctcacaatgtataggtaagctgggtcccacatttaagaggagtggatgggtgaggtagagagaaagaatgagagataatagagttttaatatttgtttattacttgttacatgatagtagtgctactacccagatgatactattgctcactttattacatgcctcataatagtaaactaggtagtaggatttcttactacctactttttagcacattgtagatgccctactctatacgagcgaaatgaaaacatgaacctgcagtgatgcaagcccggggtgtcctgtgtcggatcccgattgggtgagcccgctatttcgtgacgtgcccggagagcgacgtgatcctttttattcaagagcggccgatgagttgctgattacggtagcggtagtagtacttgcacttaggacacccacaatggttatctataggctctctacaagagatccatgtcagcatatttttctacttgaaagatattaaatgaagagagagagcaaaactatctactaacttagagatagtctatagagaaaaacgaggcaatacatgagagagctatagatactgttgtagacatactattgaggtggtttactattaatctagtctattgctgagatgtacatgttttatagagagcaccttactttaccattgcgggtgctcttatagcatttacaatagcatgctataagttagctgtaaacatattttaagaagataaatgaagagagagaagagcagtgggctacagatttatagccagctatagcacggactccaagacacaatgtgtgtatgacaggtggaaccagttattaataatgtagtatgcactgtaattattatatgaattagctattagatttggctgtagatgaattagagccagtagttagcttatactattagacttgcttacaactacaagttctttgcttttttttccttttgaatcggatgggcgtcatgcacggttgccttcttttttgaaaaacgaaatgttggtgtgtgcattggatgctctctgctgcgagaaagacgcaactttttccaaaagcgatcttgtttcgagtggaggaagagagcagcgaggggcccgagtgttcttcccgaccgattcaagcgagcacagttcataaaagatggacatcagtagtagtactagtactataaccatacattactccctccgtctcaaaaaaaaaaagacaaatctggtttccgtgtccaatatttgaccatccgtcttatttaaaaaaattataaaaaaaattaaaaagataagtcacgcataaagtattaatcatgttttattatctaacaacaataaaaatactaattataaaaaaatttcatataagacggacagttaaacattagcatggaaatctaaggtttgtctttttttaggacggagggagtactctctaaccctgtctctacattgccaagacatgcaagaacaccaaccaggagacaggcgaaaaaacaacgataaagaacgcgcaaacaaagactcgacggtttgacgagcattttgaacctcagtagctcgagtagtagagtgttttttttcctcttcttgttttggcgtttgtctccagaccggcctgcacgctcccacagcacgcggcacggcagcgcagcgcagccgtagctcctcccctttctgggagtcgctccggccaacctttcgccactcgcctgcgccgccgcagcgacacgcccgtcgcaacagcgcaccgcttcggtgaaagaaacgcactctgcctctgctgctgctgctactgcctggctgcctggctcgtgagtagtagtagctgttgcgtctacactgcatcgcatgcgcgtgccgtgcgaacaggtcagaaaatgcagctgcagcggcgcccgctagcgtccatggatcgatataattttcacgtagctacagtgtaatgaagtacagtactcctgctagtagtgtgtttttattagacggataattagtgccggactgccggtggtcgtaccaaatggacgttgttaagaggggttttaccgaagaaaacagagctccaaagctggcgaagtttggtgataggacgatcagaggagacggagaccgtacggttttcaagataaccgagagcatttcttggcttggagcttgtgaccgaattgaccgaggcagcagtcagtgaaagatcgattatttgtatttagagcgaggtcaatagtgcaacacactacttgctccaaatcatctatagtcaatgtaatagttaattcatacaatagttgtttactatactattaatacctgatctcacctatcatacacatattacgtcttgaagtccgtgctgcagctggctagcccactgttcttctctctctttctttatctttttaaaatatatttatagatggcttatagcctgctatcgtacctgctcttatggccagggcctgcgcctgcctgggtggcgtctgcaactcgtgtcactgcggctcgcgtttgctgcggtcgcagggccagctgttcccggtcaaacccagtttggcgcctctgtagctggctttcccgccatttgtggacaggccggagctttcccgcgcaaatagaggcgcctgctcgccgctcccggttgcaggggcacgggctaacatggacatggcgcgtattgtcgtgtttttgtttgacttttggcaagtttgaaaagagtatactaatattatctactatatatactaaaagtctattaaacatcttataaacacccttaagataccgcgtgatgttctaataaattaggaaaaatctaacgaaacttataagaaaaaaaataaaaatatatagccattaatttacacttaaatcagtggatacattattagtaatatcgttcctacactcttataaactcttctaagatggcatatgacgttgtaatatattagagaaaatctaagaaaaattataagaaaaaaaaacacctaaccattgatttacacttaaactgatgatctattattttaattattagattatatctatcaagtaatcattcattgttaaaaaccggctaatccctccgtttgtatgtaagtacagaaagatatgtcaaaaagaaaagaagaagaagaagaagaagaagaagaagaagaagaagaagtagtgtgtgtacgcgatcaatcccatcgaatagttctctctctttctttgaaagctctacgcttttttctcgaattgtgcatatatagcaactattcctgatgatgttgtcaaagaagccacatcaacaatgcttcaaaccatcccgccaattctcttgaaagtattttttttactagtgatataaaagacaatcacaagtgatcatataaacgcgtgcacactcgtcatataagtacacatatgcacacctaccctatgagagaaaagtatgtcccaggaagaggtaaaattatgtacgtatggaacactactattcgccaaaaaacatacatgtgtacaataaaaaatatcacataaaccacattatatcttttaattgtgtcataatcatctagatagtgtttataattagcataaataattttaacaatattgtcagggttacggataaggtatacctcctatcctacgacttatggaatatctcgataaggtatatcttaacatatacggattgtacccataaatatcacgtggaaaccgtttcggatggaacgaaatatctctacgagtcaagtaattccgaagtcctactcgcaagagatagaatttctgttataccgtaccaggtcctatcccctcaaacctttcttgagggtcaagaagatccatggtataaaagggaccccctaggaggggtttcgggaatcgaattccatctccgacacacccaccaaagtttacgaagccggagtacgcggagccaagtcgccgggagatctcgtcgagtccatcgactatgatctcgtcggtatcgtctgtttcgactactctctttgtaatctgttctcatcatcatcaatcccatataaactggactagggctattacctgataaggggcctgaaccagtataatccttatcttttgtctgcttgatgtcatactacgtagaccctcgttccaacgtaccccaatactctactcatccggtctacgagcatcactcgtcgacaaatgtatattttttccatcatatacctacaaatttacaataaaacaaaaaaaaatcaaaacccatattaactcgtatgtttgcgaaggatggtgtgataggttcacatataaccagaaaaaagtgatttttgtttatgtcaaaagctatggtatattttatgatataattttttttcttgtatgattataagataatctattgttcttatagtaaatatggtgagatatgactagttttctttttacaaacaataataaattgctcgcatagatgcgtgggttttgttcctagttttatgtagagttacccaatagctttggaaaaaatatataagcaatactgacgaagtaagtttttggactaatatttttacaagctgaaatgtaaaaataagctcaatattccataacggatttcctataaaattttcgcaagttttttgcctccaaaacttccagatctgtgaccatcagatcaccttaagatttgtgcatgaagagaaaaacattgctagaaagaatttttttcacacgcatcaggcgtaagatcctagtgctacctaatcaaagcattgttgaatgcaagttttaataaattatattgtagtcagtagttataatacaattacaatgtagttacaatgcagctataatataattataaatcaattatactgtagatacatcttaatgttttagaaaaaaaaacttactacggtttttttattctctcattccataatttggttttagctaaagaaaaacatacccttacgttattgttatggtttatggttcaccagtccgaatcaggggcggagatagagtatattagagggtgcccaggaacccggtcaagaaaattttttagctatacctcgtctatttttaccatatatgcacccccttaatacgaatttaggcacccacatcagcttaaatttgatctacaatagagtgaattaagtaagtgacaccaccctctatttcggtccagctccgtcccactccgaatggatagccctgataattaattgagagcaatgagaactttcaacttgtacgttcaagggtgacgagtactaaatagaaacaaagggaatacaacttttttgagaaaaagacatgaacccagtattgatcaaatgggtataacacccaaggtgatgtgtatgatacttttcaccaacaaacaagggctgcgtaatgcagttatttgcagtagatttggccaatatgcaatttgctgttccaaatgtcgtagacttgtaaatacgctgagtgttcgtattgaggtagtattgtactatagcgatagttctgccatacggtagctagctcacgctacttgcgactaaattgaagttgaatgtaagaacaggttgaaatgtgcatcatccttgtttccaacaaagggccgtatatcaccttctaaaatacgagtactgctcttatctactccaactatttgttgacctacaactcctaatttcgtacggaagactctcatgaacattacgaatcagtgcggatctgcgatgccatcaatctccatgtataatcaatactacatccatttcatgttacaagatgttttggctttgttaaagttaaattgctttaagtttgataaagtttatttaaaaaaatagtaatattttcgtagaactactattgggagcgttgcgcgctcccatattccaagcgcacgtgtatcagccaggcccacctcaccccacgttccatcatcccgctcccaccgttatcggagtaaacgattaacttcgataaaaacaacttactggttacgatcccaccccacgtcctatcatcccactcctactgttatcggagtaaacgatttacttcgataataaaaacaacttccctttcgatcccaccccacgtcccgtatcgtgctcccaccatttttgatttactccgataaaaacaacttctctacttctggtatatattctatttttcccgtacccaaccaaccactctcgccccctactttattttttcttttttttcggatctgaatcgatccaccatcccagcccacagatcggcgacgcaccatggaggaggacgacaacaccgtggcggttgatggcggtgaccggcaagcggtggccggcggcgcttgaggcgaaggcattgcttcaggactcgccgccgcagcatctgcttcagatcaatgttgaagagacgtctggcccatggcgaacgaggtggacgtcatggggacggttagttctctcagcaattcctaatgagattcttgatttcttgcaagaattgtatacaatctatgattaattaaattctttatctttcttgattctatgcagtctaacttcgattgggttgagcgctcatcttgacgtgcttctctattatcccttgcatggcggagatcatgtttgtgatggtcaatcgatttggtaacatcggcaagaaactgtgatttgtttcatcacctctgtcgttgcccagtttatgacagtgaggcggtgaaaacagcgatggcgacctctatctttggctccgtcgccggatccggctcctactgaggtcgcagcggccagacttggtgttgcattggctccagcctgcatctccaccactttgtcttcttgctctctctagcaggacagaaacttcatttagccgtcacgaggaactggcgatggcgtgtattgttgtatttgtgtgtaaaatttttattcttgtgcttttaccatgatgtgcatgtaaaatctttattttttgtcccatgatttaggatggagtgattcaatatataaggaaaaaaaaattcacgtattatttggggtaaactaattagaccccagtaattccctccttatttattttttcccttttttcttgcttgatgcactcactataagaaatcatcaaccaaggctggcaataatgcaattactacaagttaatgcaccatcaattttcatttacatcgatagtaatacgaatactacaagatttgatcaaccaatgttgttcataatccaactactacaagcacatgtaccatctattttcatttaggtcgacaataactcgattactacaagattttacttagcatggttgtcgttaatccaattactacaggcacatgcaccatcaattttcatttacattgatagtaatttgattactacaagatttggtctcagtttattgcacaccatatcgtaactacctcgattggaaatagagataaaccaattacaatgattattttcaaccgaccaccgattttacgaatctgtaattgatttaccccgaattcaaatagaactaatctagacagatcgaacatgggcaaccgaacaccagtttttgcggactctaggcgcgatgtgtggtgctcggaataatattccgcgctctagcgctcggaatagcgctaccgatattttcgacccaagataaatttattataaaaatatatttagttattaatttaataaaactaattcggtaatgtaaatattactatatttgtctataaacttagttaaactttaagcagtttgattttgaccaaagtcaaaacatcttataacctgaaacagatggattataacctgaaacagatggagtatttgtttgtcgttgtcaacattagacataaggaattttgtcaatataatcacagggtcatcagaatcttttatatcataagatgaagatagtagtataaatcccagagatgatgattggaggtaggccgaccaaccccaaagctaatttcatcactgttgtgaatgaaaacaggaccaataaatagacttgcaatacaatggaatgaagtgtacataaaaaataaaaggtcaactactgcatatatagagaaaagatagcatgataaataactgcagagtgtagaaaaatggatcctagagaagaagattaactactataaggccctctttggactttggtttagctagtgatgtaagattttttttttagagttgggtattttcacctccacaaatctatgcaaataaataattttgttcctattttagatgatatttaattttttttaaccgctacagttttgcatataaactttaaatttaccgtggatgtggtatctagaattgtgctaaacagtatctaaatatttggtagcatgaggaatttgtaagtgacgtctttgtgaaaaattggaggtctcgtgtacttttccttgaagagaaacttgtagtataatcaatttaacaagttatcaattggtagaaattactcctaattggttagtcgaagcaaagtgggaattcaccagggttttatatgaaaatattcaactgttcaactaaaaaaaatcaatatttcaattaaaattcaaaaacctttcacctgttgaacgtggcatccactctccacaacctctctcaccaaaagagtgccaacctacatacttacatagaaaagctttttccccttttactattagcacgtttttcaaaccgctaaatgtcgtgtttttcttttaaaatacatatatcaaagtttctttgaaaagttgaataaaaagtaggttgtgttcattttagcaattaggttgggctacttcgtcgttttccataagcacactaaccgatatgctaaacgacacatttcgtgcaaaagttttctatatagaaatttctttaaaaagtcaaataaatatgtttttcaagcttgtgataattagtactagattaagcatgcgctaattcttgtcttcttctatgggccatcgaatacttcagccgatgtacacttagaacgcagttgaattgaagggataagatcgctcaaatgggaaaagataagggaaggttctccttattttaccaaaagaatatgagtgacacctacatgatagcaagctcaaacaggaaaaacgaaaaaacataaggaaggggcaaggttctttctattttgcctgaaaatataactctcgaagcctttaacactactcaagaatcgatttttcgaacaacactcctctaggttgcaggcgaactataattgcctccctatacagaaatcgctccctcgaggacaattcaagacccgcatgcaaaaaatcatttttgttaggcgagcctattaacagaccacatgtaaaaagaaacctattttcgcaggcaggcctgctaaaagacccgcctgccaccaacccaccattgcctgctatcatcctaaaatatctaatttcccctctcctctcctcccccggcgcccctctcctatcccctccacacccgaggccgacggcagggagcggcggcaaactgcgactccgatagcggcgggcgaggaggctagcggaggaggcacgcatcgacggtgacaacggcttagcctcataggcttcctctctctctcttcctcctcggattcctttctcccccttcctcctacgacgatgacaagaagaggtggcgacggcgttagatgtgacatatctagcgcgccggcctcaggagcggttggccgcgcctctccccctcatgcgcgaattcagcggcaaggatgatggaggtgcctcgatgcgcagatttggtgttggcagcaacgtggtgggaaaggagcaacgatggagtcactggatctggcgcgccggccatcgaaagaagtcaacccccctcgcctcttcccctcgttcacagatccgacgatgacggaagtggaggcatcccgactggcggattcggtggtggtggaggggtgacaacgatgatgacgacaatgggaggggtggggtgtccacaatgatgacggcgaggaggggtttccacaacgatgaatggtgacctgaaggacggcaggtccagcggcggaagcctttcaacgatggtggactacggcggcaacgatgttaggtgttggttttggggatttttcttttcacatgtgtggggcttaactaaccaaccgcaaaagttgatttttcttttttatacagttgtgctactggcatgcaaaaatagttgatttttacatatatctccggacagacggtagtccaaccgcatgaaaaaaaaaatcagtttttatggcgagaaaagatattttctctagtattctacagaaaatattatccttcgtacacttttgtgtacactgtacctagctagttcgcttcaggccttctgctagtcaaccactcctacgaaaggcactgtggttttctcgcggcatgtcaaactaccaatcaaacgccaacaccggccgtccgaataataatccgtaggcactagccacgagcccaccaacgacgtcaaccacatgaattgtcccttgaagctcgtacaacctcgcgaggccgcgaaattctcgagtgtcaaaggcctcaatttgcaagcatgatcgacgcgcgccgtcggcgtcgtacgccgaactctcgtgctcgcaagcgaccacacggacgtggcaggtatagagaggccaatagaccatgcgtgctacatagtttgcccccaggtgcgtgtacgagcgttgtttgctaataacgtaacgacgattgctagcaattactgcatgcgtatgattgtgttttgcgtattccattgggcagatgatggaggcatggattgttcctcgattactctcaactgaagtgatcgggctacaggaacggcaatccagtgtgcttgattaaatcatcacatatataattgtaggtacatgcatgatgcatgccgatattacaagtcttacgtgctaaaagcacgagcagatgctctggtcagctagattttaattgttgagtagaagcgaagagtttttaggatggaggtgattggagatgaatgggtcactacatttaattgttcatcttcggagacgtgtgcagttactagtacggatgtcttcgcgcttcccgaccatgtgcaatgtacggtgccaacttacgaggaatgggaaccaaaatctgttaaagtgtaattaaacaagctgaacataagcatcaagccatcaacttgacctaaaacatgagcacccatggagaaattagagaaactctgaaactggcgtggtggcattgttgggaaattttatttctcggcatggaaatctagagaattcccgcacagcaatttttcacccgttgtctacaggattaacatgatttaatttgtgattatttccataattacatgactatgcgcattgatcggtagcaccaaacatttccatgttttcaattgcccccgatctccctcagcgccatattaatagcggagaccggtgtcgtggaaagatgacaatctctccacgatcgtcttctccctgagaaaaccaaaaccgactgttccaggagtgtaggtggcgaccggaaggccaccgctaccctgctagtgatcattggcaaccccttcgggatcaaaccggcgtcctcactgctacgactacttcccctacgccgatgctcaccggagcagttcgaggacgtcctctacttccactcaggttgacgacattgcagagggaacaaggagaaccacatcattggcttcaaacaacggtcagtaactctaaaaattccgcattaggatgatcatgtttacgctaagcactcatgttagtagatcacaaaatctacagtcatgtgtagattgcgcgactattatattgcaaatttctctagtaatagttaaatttcatatgtgacatcaatacagtgccactcattcactagtcataggataattctacctttagacatgaacgagtaaccgtgcacgtgcaatgcacgtagtaacaaatgtaaattaaaactattgtgggagaaaaataagaataacaccaagcaagttatacatgcatggtagcaccaaagaatccatcaccagaataaatatatactgtatataaataagtgaaagtgctaagcctccgcattaatttgcattggatttatactcttatgcccgttaactgggtctttgcgaggaacatggacagaggatcagggcatgtacaatggtctttattagcggtctctctttattgtcatgtaagtatatttggtgatgtggaagagagagaaagaagaaaagagaaagatggttgctacgcatgacaacagcatagaatcgactgttagcatttattaggaaattttttattgcattgagtctaataaaggaaagatgactagtaagaaagtattttggtacattaatgattagagaccgtattgtcttaactattgtaacgtgatagcctctaattaacgtagagaccatatcggtctctacctttgtacttgccctcatacccgcctccgctagacccgatggccaatggggactttccccctccattttagttccatgtgaagaaccaactacaaccgtcatcatctcctaatggtagagtttcctgcgggaaaagagagaatgggaccattatattgacatatctactattgcttctttgccggtactcttcggccacacaactctttttatgcatttccatattgttagaataagtatcgaatatactagttctatttgattatagttagatttggagttgtaaattacaaaatcatgtggttatcatttgccataaccttcttagtttttaaaaccatgataaacctcgcagtaaccgcacggttttcacggtaaccacgtggttatcgcgataaccgacttaccacagggtggcggtaccacgcccaaaatgatttggtgaaccatagtcgtataataggtggtagggggtagagttagattcggccactgtaacccggtgttaacaccaaaatttggtaggtctctttggtggatttggttaaggaaagaaatcgattagtagatgaaagtttatctagataaggccaagttcaaggatgaatcatgaataccatgacaagacatttttatattttcttagtatatcttttaaataggcaggattagtcatttttattttcttgttatgaatttttatctcgtattcgatttgaacttgcacaaattcaaaggtataaatatgtacactcgatatctttgtaatcatctccttatatcaatacaataatattttggcgcatcatcacccttgtagtttcgacatgttcttgccctcaagcggggttgtatcggttaagttcaatttttggcgaagtggtaagtcctgtaaacccagcaaagcacaattaagactttctcaagttccgcttgatattctaactagtttttatggttatcgatttattggttatcgatttatcttgatatatggctttgactagttcgatctagtatatccatcatatgtgtatagatctattggttaaatagatttttcttattattttcgatcttatactatctcggtttgatttgatcgattagattgctgctaataagtttatttctactaagtcggtaggtttttatacaacattcgtcggagttgtagccaatgagatatcattattctaaacatcaattgtcagatgtatcggttaatttgtcgatatatattttaatgtacctgcaccaggccttcaaccgatgaatgctaaaaccatcggatctacatttaccacactatatcagtattggtcgattggttcattagttcaattcttccaatttatcttgttagttgtaagatccaattaattaacatgcctgaacctcgtcaaaattaaggatatgcactagagttaaatagatctctcatgccttcgtatgttagaaaaattttatagcaacacctggtaaccctttaaatacagaggggacacaccacacaatgtaactatggtgattgcaatatagcgtagatacacaggaagataatggcaacaagatcattgactcgtagcaattaggttgtatatacgttgattggggaggagcgtccataatcaaagccccgaaaattaggttaggattgaacttcattaacaaagatcgtgtgctcatacgttgtcatctggcatgtatttgagtgatcaatgacataaacaatcgggaaggctagtcgtcgttccactatattaactatcttttataacacacattttataagttttttttttctgaaatggttcccaataaacctttgtgtaccgcaggtccaagaatgatccctacatatgtgttactgtaggaacatgctactggcaaatgtgcacagccgagaaaatcaccaaccgcagccaatccgtatatatttgtgcgccgaatgtatttgcatggtctagcactagtagtagtagggttttttttttcatcagttactgtgctagctactgcggatctaaagcaaagatacgcggagatatggccatgccgggacggacaagatcttgcattcaaggtgggtcggaaccactgcggatggatgaactctacgttaccccgtcgcccgtgcacgcctgttactgtcacgcgcctgcgcctgcgtgcatatgcacgcgcgaccctctagtgacaagtgagtaatgggtcggaagggacggcacgccgtcggccagtcgcgcacagcgccatatctcttgagggtcgtaaaggtgatcagtctccctccacagattttcctccgtgcaaaggcccccttttgttcgaccacttttgtgcgaccccttttgtgcgatcggtttcgctcgtttctacttcgtactcggcttgaacaggagatggaactactcgccgtcagtccgcggagaagctagtactacttctgtttctcttgtcatcgactggcttgcacaattgcaccaccgacccagtgtcgggcagtgaatgagcaattgagcgtgtgtggctacaatttactgccaccggttcgactaaaaattcactccgcacagcatatgtccccgcgtcactccagcctcaggggcgacgcggggcctggccgccgccgtcctccacctcctccccttcgcctcgctgccacccgaccagcccatggcaaacggctgcctacaaggacggtggcgacggggcttcttccaccggtggcatcgtggttagagtacctatgtgtcgaggtgaagatgtttcagatttggatcaagcgaggagaagttgggaggcgctgcgccaaccatgataggaggttgcgaggcaataggagcggctggacgacaggcggcgaaggagaccgtggctagccatagctgccaagatcggatccttccaaatttgcacggtgggtgcctggcggttgcggggatggcgtctagatccggcgtgctcctgaccaaagctgcggtggggtggtcggcgtcaaggcggcgtgacgactggcgatggcatgcggccagggaggatacagtgaccgcctacatttggcgtcccctagtgaggtggctctcgacaaacgggcgatggcggcggtgccgtggtctatgcagaaggggagagaggccatgtgatggcaactttcttcctctgcagcaataggctacagcacagctggcgcggtgctggcgctttggctagagtttcagtggcggcaggagacaataggacaaggtggcggcgatgcggatgggcagcctatggcgacatggtagtctggccaaggcagcgatgacggggtcctgatccaaacgcctgtcctattttgatggcaccttacctccacaagatgactacgttggcatgctagtgtgggggagaggggatgcattcttctctctcaccctctccctcttcaacttaaccatatgcatggattaatttggagtgcattggatgtcgagctcctacttaatggccgtccggcgacgagacaccggtgcggtgattgtgcatcaaaggggtgtggttggtggtggtctctatgtccagcaggagacctcgacacaagagtgcaggaagattatgagtgaaagcctagcatctttgtctctttgggccagcaatggcgacgcatgtctgcgccatttttctccttgggggtgttgttgagtgatttctcttatcccctgatggattcctctaggtgaaaaccatgtcctgcaccctatgatagacggcggtggcacactcgaatgaaggcgtcgtttagatgattctttttcttcaggatgtcatgtttctatttttttagcgagtttctggttaagacacgtggtgtggttatcttttcttttcctgcttatagcattttagagctgtagtcttatttttttttctgttcaatcgatatacacaacgtcgcactcttatgtgctatgaaaaaaaagtcgctccgtttctcgtttccgaacctctcaaagccttgagctcgacgaaaacatcgcacgcttgcgcagcacgaggcggaatggtgcaattgctagcttattcacggtgaaatattgctgccgagccggcccccgaccgaccacgcgacggatggcgacagcgagggggcggcgcaacaccacaaccacaaactggacggcgccgtgcgtgcgtgcgtgtcgcgtcgcgtcggcgggtgaaagttcgatcgaccggacgcgcaccgaactatcgatcgcaacgagagataataggggattcgcttggtattactgctgctactagcccactatgcgttccattatcgatctccttttgcattagaggacgagagcgaacgaagccgaggggtgtttttgcctttccggcgttggtttttccgggggctcgaaacgattgtaaccacaagctcaaggtaaggctgggatcacgctgtgtgactcggaccatgggtgggcactagccgaaatagcctacctgacctgtcgatcgtactcgtgattgcctctggctgcacaccctcgttcgcaaagtcggtccctttcttgggctgttgctactagtacagtagtacggtcacggtagcaacaagtgctctgatgtgaatgtgaatatgtgatgcgaccctttcggaaagccggattagaaaaggaacaaattcgtgccagttacttccggattacgttcggcaaccacgaaggattaatcaaggaggagagacggttaagacggcaatgcttttccgtcacctctattttcccaaagtgcgatccaactccaagtcttgcgcggctgtcacgttcgttctgacggcactatcactcacgaacgaacccaaaaaaaggtgaaaaacgacgagccccgatcggtcgccgtcgcatgaactcagagacgtcgttttccacccgcgtcacaccgcagcgataaataatttggcccgttgcgtctgttgtttgctccgcggttgcatgttaggtgagtgaatccgagacgggaactgctcagctcaaccacgaaacgaaacctgtttcatcattcgataaagcacctcgtcttgccggatcagctggggtggcaggaaaaccgaaacgtgttcgttgatttttcccatcggctttggctttgtccatccgctgctagagaggggaaaccgttgctgcagtgtgctcgacgccactatcatctgaactttgcctgtacaagaaatcaagattgaagaatgcataggggggcatcactgtcaggtataattgctacgcagccatggacgtgtactagtatgtagtgaagctttcgcggcgtgtttacgtgttggggaaaggtgtcgtggctgcgggtgcgaatgttcactgacagcgagacggctgttcccggatcagctgttccagtcgtgcaggtaggcaggcaggcaggcaggtgtggctggtgagagctcgctcgctgcgacctaacgctgatgccaagcgcgagctcaaatagtcgggagattcagatccccgccgacacggtggtggcagcgacggcggccggaaatattcgtagtatatttcttgacactcccaggtcccaactgcgcggtctataaagctcgtggttcaggtatctgaatctttcggactgcttcagtgttctgaagatttgcaggttaaaagcaaaactgcccgggcgatggccgacaagtcaaaaatcgtgaacacgattgcgcggcttcagagtttaagatatttggggctggtttggtttgagaactaaattaggtttatcaatatttggcaatttcaatagtgtttagtgtctatttagtttgaagccaaattttggcatacctaataaaataggccatttcaatagtgaacttaggctattttggtttcaatccaaacacaactttgccttatcaaaattagtcatgccaaaacttgtcaaaatttggtaaggcctatttaggccacaaaccaaaccaaaccttggttccatctgcccgtatctttgtaggggtcatggctggttaaagatcattacttgcaagttaaatcactagcgagaatttggatattcgatacgaggaacgggtgggaaacatctggaataataatggagtttattcagcaaaggcgtatatgatctcaactgcttgcgcattgtgaagtttgtggttcagatatctattaatagagaagggataagggcagtggatgaccgacaagtctgaactttggacacaacttaaagcatgtactactagcttcagcgttcagattctccaagctaaagctatgaccgacaagtctaaatttttggacacaggtgcgttgtgccgattcgcgtgtacttccttcagagttcagactatatggttccacgcgcagtagttcagaatgaattttggagggttttgtcctcctttcttctgttttaggtgtgtttagttcctgaaaaaagatagaaagtttgaagaaagttgggaatttgaaaaaaaaaagttagaagtttatatataggaaagtttttgatgtgatatgatgtaatggaaaattgggaataggggaaactaaacacggccttggtgcatgtttctctaatgcaagttcaatagatataggccaagtttagttccaaaaattttcttcaaacttccaacttttctatcacatcaaaattttcctacacacataaacttttaacttttccgttacatcgttccaatttcaaccaaactttcaattttagcgtgaactaaacacacccatacgcgggcaacatcccttcttacattgcattaagaatcattcagagaaaggcaggcgagcacgcgagatggtttggaatttacagaagaggattcagggagtaggatacacatggccacagatgcaaggatatatgtacatatgatacatctctgtccggctataacggtatgacttttgctcgctacagaagctgctcttgcttacaagagtagttcctgcgcagcattgttgctgctgcctgctgcgtcctttgcagcttcagtgtgatgagccatgagctaacaaacctaactgggtacttcactagctcacagttcctatagctgtaagaatgatcttgaactacatacatgacttaacagatgacaatcataactacagtggcatgtacaacgtatatacacatggaaccagggagttgaggttttcacaaggagcccaccaggagtttacgtgagagcttcattccaatttttccagttaaagaaacctgcaaaacaccatgcaaatcaatgcttaaattattggcttgtgaactatgctcaaacgagtactcagtaagtgggctgggattgcattaacatgttatgtgaactgcatccataaatagcgaaacgtgcaatatgctcaatggtaagactagaagttaatgtaaactcaagagtgacaagtatatgcaagatttaaatatgaacaatagcagattgaaacaggcacctagtattattcctaccaaaataatatcctcatcagttccaaaggacttgcgggcctgatctaagctcttcattgacaccctttcacgctgtctgaaagaatcaacaaacaactgtaactaagttaaatcttgtcaatagggacatgctgtcatgcacataaagttaagcggaaaacttttttcttctagcgaaggaaattaagcagaaaaccgtacagcgataggtttctcagtcaaatatggcgccattacttgataatcatacatagctataaatggaccctgacatgtagcatataaatatgttcaaagcagaaggtgaatgttctcggttactggtcgttacaagaaactaaatgatccttgcttctagtgagtgttatgcccatatcagcatgacgctattaaagaagcacagtttatccatctgaaaactcaagtgtccgctattaaaagatgtcattaacaaaaggtgaatattaggtacctcgaactggcagggtcccttatctcaaattcgcaagcatcagcatcatacccacatattacaacataatgccctgcaatggaagacagtattaaccatcagaatgaatccttttttatgggcacttttgcagacagcaaatggattcatggaaaaccaatccatcaacgagcttggccactcacccatgtaatctgaatcctcactgaactgttgcatatcttgtagatcattgctccatgaggaactgcattccaaaaatcaagttactgacacactattattgcccatttcaaatgatatgcagccacttcaaaaatgaaatcaaggaacaatggttattgtttgtagaaaaattatgcatataaaaatccatggatacatccatgaaccattttgttccgaactgtaatcttctccgagatattctctcaattaccaagtaactttgggaacagaaagggtagtgccaactgtatattactcaactgcttcatcaacattatcagtttgttactacataatgttggcacggttgcaaaatattaaactaataatcaccttatgatcgttaaatcaaaagaatttgagatattaaaatgagacaagtacagcaagtaacattgtccacccattgcatttaccattggacaacttgcttatgaggcgatgtctgaatgccgaagacaaatgtaagactgtcttaaaggagtaaaagtattgacagaaatacagaacaaagtatacttcatctcacttgctatgaccaaaaaaatcccttacttcaattttgttttgtccactagtgcgatagcaatgcagtgcccagataacagtagaaaagctatatcatacgcactgatggatctgcactgagaataaccacaaattgaaaaattaaaaaaaattgaaagtgagaagtacatcaaatagacaatttttatgatgtgcgctgtgatcttacttgaatactaattccagcttcaagggctctgccaaagagctcatccactcgatcaatgtcttcttgcaattgctcctatcgacattgttatttttgaaactgttactacagtgaacttcagaggaatcggtaacattaaattacaattcataccctataaaaggtttcagcagaatattgcggatttgctcctagagtcacagtgaagaaggaaaaacaaactgaaaacctgtttaacagatatgccaagtcaactgtccatatgctgcacaacccagaaatgtcagattgttaatacaccagacgtgctattaaaatttttaataggccaaaattaaagagaattaaatattatgtccagctcatctagggaatgattgtattgcaatataatatatccacgaatatttctcacgtctaagctactttatgtcctcataaataattgtcatattacaattgaaatgcacaattttttattctcttccaaattaattttcacctaagatggaattatttgcaaagagcattttaactacaccggataaaagtgattatgcagtgcaaaatgtgggaacaatcaagtggtcaaagtagtaacaagcattcatgaactgacagagtaatcactgttcgttatccacgcaatctcataaagaaaagaagaataattatccatgaataaacaaatgattcggggtatcaatttttttcattaactaaggagaattgcgccccccgtgtttagttgtaaactcaaatttgaagtaataatctagtccaagagaggaacctcgtggtgcggcagagcttctcgagatcggcaatgccgtcgcagcaatccatcccgagtgtcctgagcaccatgagcacgcaagcgaggccgcagtcccacgtgaaggcctgctggacatgcggaacctagcaagcatccatcaccagcgccacgaacccaaaaaaattcgtcagatttaacagcagcagtaaacacgacgattattacacagccacacgacaccgccgcggaaacacaggatcagcaaccgacaccaccccgagagacaataattgatcgcaaccatagagcgagcgcgcgagcgcgcgcgagagagagagatagggaaggagggaggaactgacatcgacgtagtacgagcggcgggctagagggacacggccgtcaggggccggcggcgagtcgtccgccccctcgccgccgtccccttcccccgcgaccttgaacagcctctcggagaagaaccccaggggccacatggcaccatcaaccgaccccctcgcccgccgcgcgcggcgccaggcgactgacctcgaaccgcaagagccagccgagccaagcagtgctctgctcggtagcgcgggtgggaaggagaaaggagggaaagcggaggaggaggttgggattctcgcgggttcgcgacgagacgacggtgggagggagggagggaaatgattgggttcttcttcttctcgctccggtgcgtggtgggattattaaaaaaacgggggtccgcgtcaccagaagaatcggtggagggatgtggagcgccggagcgcggcgcctttaaaaaaaaaaacgggggccctcgtcgcctcgccttccagaagccgccgtaatttttaggtgtcgttgggctgtatggcctttgccggtgggaggaggagcagcagcgcagccagcgtgtgtttgcgtcggggaaaagagaggatagggattggcagaggatttttgctctatccatcggccaccgggcggggtggggattgatgtcgatctagtataacccgagaggctcgcggaggggccgggattggtcaggggggtcaggacctggtaccgatttggttagggaacaggaggagatttgtcctataattcttgccttttgttgtggtgttctcttttttctttcgatgataaggatgacgcaggacataactaatcgctatctaccgacaccgagagtctgttttcacaagttttaggccacatttgaatcgcaggattaaaaaatagagaaataaaaaaaacatatgatatagaatgtacacttaagatccctttgaaacacaggattgagaaaacagataaatgagaaaaacgtaggaatagaatgccacacgggcccctttgaaacataggattgagaaaacacaggaaaaagaaaaacataggaatagagggcctgttcactttggtgtcattttcaatcatactatttttttgggtaaagttgctaaaaaatgtctacgttattctgttgccaaatttagtcaatacataagaaatcataccaaaattttgataatagtaccatcttaccaaaattttggcattgccaaaacttgataaggtttattttagctatagtatgaacatgcccagaatgtcatacttattagaatcctataggattttgaaatacaggaaagtccccaaactgtcgtttgattagcaaaaaaaacacataaattttgagacacatgaagaggaaaacatgaggtgagagacctcatgcttattttcctccaaaattgctcaagcaaggtccattccataggaatttcaaatgaattggtaggaaacaatcttttgtttcaaagggctctagaggattatttttcataggataaaatcctctagaattcctatgatgtttcctttatttcaaagggggccgaactatgggattttgaaacacaggaaagtttccaaactatcgtttgattagcacacaggaaaaatacatgaatcctgtttggggagcttaatattctgataaacagctggttggtagccagcttctgagaatctggaaaagctgggtttaccagtttctggcttctgagaatctggaaaagctgggtttaccagtaaaatacattccataggaatttcaaatgaactcataagaaacaatcctttgtttcaaaggattataggattatttcccataggataaaatcctctagaattcctatgatttttcctttgattcaaatggggcctagtagctgcatcttcatacataatttccaattcctcgaaacagttcaaatttaggttagcactctaagggccactttgaatcacagggttgaaaaaataaaggaataagaaaacacaggattccgacaggaattgaagtgtaaaatagaggattgcgatacacaggaaaaatacaggaatgatcgtttgattggaccgcaggaaaaaacgtaggaatcggatgagagagatagactcaaaggaaattttttaaaaggttggaggtctttctaagtttcctccaaaatccgcatgcaatgtgtcattccataggaatcataggatttgaaaaacttcaatcctttgaatcaaatggccaaatagaaaattttcctataggattttaatcctatgaaattcctcataaatcctttgattcaaaggggcccaggttgaatatgtagttgtataagcaataaaattttgctatctatttatcaacaaattttctaaaaaaatcgacagatgtaaatatagtataattacttcgtaatttgcatgtaactaaaatataacttaacttgtatgtaaccttaaaaaaatttgtgataacatgtttttttcgtgaagcggaggttacaacaccaaatcctctcacttctgtgtgcgttgtgttgttttcttcctcgcttacatgaatcttaaagcaaatttaatggtttcataattacatgaaagttacgtaccagttacaatgtaattacactactattgtattatatttacatttacaattttttaggagaaaatttgtggataaatttgtagatagtcccgaagcaataagttaggaaagtcatatctcaaaaactaaataccaaccaatagatttttagaatcttaatcccccaaaacctcttcagatgtgcataatctcccccaacctcttcagatgtggatcgtgtgtttgtcgaattggatagggcattaggacgagtatccttttctttaggtattgtacaaggtggcgttactatgcaccggcatttatttaaaccttatctggtttgttggtttttatcaaaatttagtattttttctaaaaagaaaagtattggtatggttgagacatgcttggtctcaagccttactgaatcttggtggtgttagaatggaacacgtattattttggttgctcatgacacgtataaccgtttataagtcagattaaaaaaatagggaaaaaatagccaccatctatgtatatggcgtgtagatttgtgtaataactagaaaaaaatgttcgcgtgttgtaacaggtaaaaatgtttttccagtgatgcaatagctattaggagctgagcagtaaattaaaacattcgaatagctatacgttataatttgaaaagattaatgaaaaatattccttggttttcagttgaaagcctttttttttcttcattttcaacatcagcccagaccgctatctccccgtgctcggcctatctcttcagcccagcccacaagttgagccacatgcccaacttgtatagtagactatcgtcttcaacctccggaagatagtctcgttactgcatgccgaagcgaccctcccaatcaaatttggcagaatctttctcgatctcctaaaattgattgaaggcttttgatccacttgatctcctctttatgtttttcctaaaatccgagcgaatatgcaaaactcggataaaaacagccgaggaagctcaccggctggccatcatcagcgactgagattaaatccagcgaattaaaactgaaatgaaaggtaaatcatgacgaaaatgatgagggaagagtgataattgatttttgctattaattggaggagaaaacacatgggtaaacatatcgatgtggcagcggtactagggtttgggccagtggtagtgggaggcaaaaaaaatgaagattgaacatctagtgctaccttgcgcatttttaattaggtatagatacatctaatgttaccttgacatgtcaaggcgacgggtccaataggataaagtcttgtgttaatttattctcgtgaacaagtagtatcatatatgatgcatcgatggaccatcttatatatataaataccacaacgcgaccttgctcttctatgtgtatcccacttcactgctacgttacatatagtttctaataatagaatcacataagagcgtgtatgataaggtgatataaatgggttataatggttgccaccttaagtgttgagttagaggagagaggggacgagcgaagagaagttgtatccacatctataaccacatgcacatggttgtttttaacaaactttatgagaatgagatgagttaggtattaacatagtaacatgttgggagagccaacgtcaggatcatgtccccattgcctacacaatatgtattccttctattcaactccccctcccggaaagaaaaacccctcctgcacgctaacctcccacataaggcatgcacccttcttgaactgtgatccctcttttgcgccgcaccatctatattgaatcatcctggcacaccatgtcttttactaagctgcaatctgactatctaggttaagtgaaataagaaagaggatatggagtaatatatatctaatgaaggtatcgggttgatatcttcggataccgcaactccttcatgtattatgatttgatgatactttctgacattattttttttaggaacacagtatatgtgctcagaacacacgtatactcatccttacgagcgtagacatgcacaccatatccctttgaatatcttccgaataccggatcgacatatcacgattatcttttaagtatcatgaaggtattataaatgtatcatgtatcatcgtattttaaggtgtcacgtaggtttcagataataataccacttgattttattattattcttactctaacagcgatgcatagacacgcatcctcttttgcattctgccgttgtcgtttggtggtgcatgttggtcaaaacgtccgactcgagacgtacgtagaagctgtgatggataaggccggagttcttatttttgtcgtgatgccacatttcagcgttcggtgtgacccactttaggtgcgtccaccacaccatgtgacaggctaaagtggcccaaacatggcccagtccaaagagctcgatctgggtggaagagttgaaagcgacccggcagatattttgctcttgatattttcacagcagatactttgctttttgggtaggagcagatacatttttcttgtgttcaaagaaaaaaaaaggaaaattagcatgttcttgatgttagcaatggacttgaagtgggcaccaggcagttaggtattctggcccaaacatgttgggccgtactagattctgtacttagtggaataagttcatttagggtcccttaacttgtcaacgaatccgattttcgttcttcaactgaaaaaacacagatataacgaatccctcaactatcaaaaccagtgcaaagtatgtccctcaacggttttgatggtagttttggctgatgtggtgcctacatggccggtttaacttggtcctcgtcctacgtggcggtgatgaggcactgcaagcaaaatataaaaataaaaaataaaaacaaaaatgtgggacccacatgttaatcagacaaaaggaaaaaaacaatgggacccaccatcctctctatccacagacgacgggagtatagatggccaaaaggcccgaccggcatggcctggcccaggcacggcccaccagccatcgggctggcacggcccgatcggcacttcgtgccgggccgtgtcgacccatgggctgcacctcccgcccaggcacggcccactagctgtcgggccgtgctgtgcgggcccgaaggcacgggtgcccccatcgggtcttttttaaaataagtctatttttttgtccctcctctttgggctgttacatatgtatatcaaaataagtctattttccgcctctcctctttgggctgacatatgtatagctaaaataagtctattttccgtccctcctctttgggctgacatatgtatagataaaataagtatattttacatccctattctttcgtccatggcatataatatgtgtatttttactcccctatttttttttgtgtgtatcaggcctgactgccggcccatcgtgccatgccggtccggtcgtgctggcccagcccaacgtgccggtggagggcccaggcataacctggtggttgggccgggccggcacgggcccgacctccgtcgggccgtaccatgcttgggccgggccaaaatatcgtgccatggtccggaccgtcgggccttgggccttttggccatctatacgggagaggagcgatcgacgcgttcttctctctctccctcccggcgatccttcctcgccggcgagcgcacacggagagagaaaaaggttgcggccggcgaggagggcagagacggtcgctgtccaccgcccgctgcgcgcctcttcctccgcccccaacttgcgattctcgaagcagcagaacatgatctgcaaggaacaaaacaagaaagaaaaaggaaataaatcaaaggatgcacacgcacgccaattagttagcaagaatgatcaaccaagcaaccaaaactaatcaaacaattagttggagtagatggcggagccgagccggcaaatgaaaggcaggattaattgaaaaaggaattttgtttgggttagctagtactacacacctggtgaggaactcggtgatggggtgggaggagatgatgttcgagcggtcgccgttggcggtgcgctcgatctccgggcggaggtcctcgtaggtgacgatggggacgcgcgccttgaacacctcccggtcggtgcgtccttccatgccgtggcggcggaggtactcggtgccgttgttccgcgccaggatcgccgccagcacccgctcctggaccgcgtagaaccccctcgtcatctcctcgatgaactccagcttctccgcgtcacgctcccacgccgccacaacatcccccccccctcctgccaccttcgaccccgcctccgccgcagccaccgcagccggagccatgaagcactcagacggcgcacggatccaatccgaacaccaacggagggcggcgaccaacggatccgccgcctttttccctctccgtgcgctctcgccggcgaggaaggatggccgggagggagagagaaggacgcgccggtcgctcctctcccgtcgtccgtggatagggaggatggtgggtcccactattttttccttttgtctaactgacatgtgggccccacattttgtttttattttttatttttatatttttcttccagtgccacatcaccaccacgtaggacgaggaccaagtcaaaccggtcacgtaggcgccacatcagccaaaaccaccatcaaaaccgttaagggacctgcttttgctgatgcgaaaaacacgaggcgtgagagatctgcttaactccagtgctggtccaaaaatcttgcctttaggttcgtgagcgtgccagttgatttgatcctgccatcaacaagaaataaaaacagaaaagtagtagttaaatccacaaacgatagtcgatcggttagctgccgatgacgtttcatttatctttgagccgatgtcatatatgaatcgatcggcaatcataaataagcataaaagaattaaatctattcgatcggctgtagatatcaatggtatataatacttctgtcgatatatacttaaatcaagtgattgggatagatcggtcgccatgccgagacagtataaatcacttagatcaaaatatatattaacaaaaagattataaacatttatagcatagccgatcagataaatctagcatgtatcggctaatactccgatactactctatattaagatattaaagcaagtaaaatatatatcaaacagaagcctaatatactttgttgtagtaagatcttaacataaagggcagatctagcatatcaattaagcacgtaagatttaaagctaaatcaggtaagatcggctgaaaccccaacactaccctaatcggcaaccaaaagcaggctagagattgagattctaagcacgacttaatagatcaaactcaactgatgcagcattaagtatgaaaaaaagaacaatatcttgacaatcaagctgttggatgtttcatagagtggtggataccctatataatctaagtcaacgttggtatttaacctgatcggctgccttctagcgataaatgttagccgactaagggttaaataacaatattgccagagattatataggatatatgataactcgacaaattacataaacaagattagagtatcataaaaatgaaagcactaatcccgagaacgcaagccgccataacaagttttacctctagttgaagatcgaaatcgatgcagctcaacccgaaagaaagaactcgtcgaaacaaaacgaaagtaaagggtggcgatgcgccaagattgtattgaacgtgtgttaaattgattatatggggctcggggtctatttatactcgagattacaaaatatgtcaatgtcgaacacgactcttatctctaacaaactctaagataccataagtctttgcggctgacttttactcaaacctatctctaaggaaattacataaaatatcctaattaatagatacaattgtcttttcaggactcaatctgtgcatggcaatctatatgaagcactttaacctaacccgatgtcgtgtaacgagtcatattgtcggaatcggcttaatcggctaaccttgtccgactcgcactctgccgatcctgatcgcggccgattcggactttagccgattcttgctctgtttccgaaacgatctccatcttggattccgcttcagttttaccttaacctccgatagttgaattaccaaatttggttattaagagctttgcaccggttttagtagttgagggacccgttatatctggttttccagttgaaggacgaaaatcggattcgttgataagttaagggacctcaattgaacttattccgtacttagcagccagatcgatgggagagcagtgtgcagtgcatgggcctggcctttcagagatgttgaaagccctcgacacatgctttacactccatggatcaggtgatcaggtcctgtagttgtctgaaacgctgcaggctgcggctgacacaccctacccgtgcaggcacgtggctgagaaaaaaaaaaggttatcgcaaagcttttgacaatgccgacttgtccagtgcttgttgcgtggtgcgtagcgactggagtagcgatggcactcggtgctacgagtaaacgaaaagatggcactcgtccatctgttacagcactacagtaacgtacgtggtttgagtgtaagcaacctcagcctattgaataagcacactgagaaggtgcgcttatctcgttctgctctaaagcaagcaagcaatgtccatcgagccaacatcacatgaccagaaaggaaaccgagagaaatccgggagacccgccagggcaagagaacgttctcccgcacgcgaacccgaaacagctaaaccttttcccacgcctcacgcggaaacctcgtggatatcgacgtcgtcgtcgtggcgactctaccgcgaccggctgcgactcccgcggtgcaaatcctaagtccaaaccaacgcgcccatccacagaccaaaccccacccaccgatccgccgcgccgcaccgtgccgcggcgtcacgcacagcgtgcgaagattcgcctcgcgctgctgtgcacgctgctcccccacggcgcgcaggcgcagcggcttgggcgcgacacgcctccctgatgagtcgtgagtcgtgacgccaccccgcgtctcgtgccccgcgccccgccctttccctttttataccacgctgatcgtctactccaatgtctccatctcgccacattcgccgcgcgcgtcacacgagcaagggagcaagcgaggagagaggagaggcttagcgagagaggtgaggagaggagaggatttggaacttttgatctttgggatcgcgagacgacggagatggccggtggcggcagggccgatgacgagcgaaggatcggggtggcgatggactactcggcgagcagcaagagggcgctggactgggccatcgccaacctgctccgccggggcgaccacctcgtcgtcctccacgtcctgcatcacggcggggaggaggccaagcacgccctgtggggcaagtccggatcccgtaagatccgcgaaccaaatctcctccccctttctgcttcttgcttttgctcgatcgatctcggctcaaactaatgtagtggattccattcctccagcgctgatccctctctccgagttccgggatccgacggcgatgcagcagtacggcgtgcactgcgacgccgaggtgctcgacatgctcgacacggcggcgcgccagttggaggtacgtgcgctctcgtgtagtactagtagcgtcacggttttggggctggatcggagacgaaaatgaccgctgttttgttgctgttctgatcagcttaccgtagtggcgaagctgtactggggcgacgccagggagaagctctgcgacgccgtcgaggagcagaagatcgacacgctcgtcatgggcagccgcggcctcggctcgatccagaggtataactcctacttctgtttgcaatgttgttgcctcatcaatcaagaatcaaaattgcaggcattgaccatagaacttgcctttgggccagttgctaatattcctgttcagatagacaagctctgtcgagaacgatgcactgcttaaatcgataattaaactacatactgtgtccagttccgtggtacggtagtttttaatctcaacacataattgcattgcactggaaatttgggggccaaatgcgtatctgacttggccttgcaacttgaatcattacagccaatgagattggattatcgagcatttcagttgcacttgttttttctgtgggaccgccaaggcatcaacttgttgccttcacgattaataaattgtaagagcaagtacaatagctggctataaaccagctgtaaatatattttaagaagataaatgaggagagagaagggtagtgggctacagatttgtagccaactatagcacgaactccaagacgcagtgtgtgtatgacaggcgggaccaaatattaatagtgtagtatgtaattattgtataaatgagctattagattggctatagatgaattggagctagtagttggctatactattaaacttgctctaaagtcgcatgttcatccttgagacatgtatatcctgattcttggtcggcgcgttgttttatgttctcatgtgaaactccttttcatattcaaatgtttcccatgtacagtttgagcataagaatgatgtatatatatagagttagttcaacaactagaatgcttgtgctatttcaatatccaaatacagaagtttatatacaggaacgtgattatcttggttttagcctcttaggttagtgtccacgtccaaagactataactatttagtctataacatattgagtggatgatatgcattgttagcttgaaacttactattgtcatcttgattcagaacagaaaattgtgaagtttgaagatgcgatgtctaatgaacgtttgggagtatacgctttgcgcatatggcagtatttgtttagggctggtttggttcgatgcctaaattagtcttaccaatatttggcaatttcaatagtgtttagtgtctatttggtttgaagccaaattttgttatgcctaagaaaataggtcatttcaataatgaacttattagactattttggcttcaatctaaacacaactttgtcttaccaaaattagtcataccaaaaattaccaaattttggtactgatagaatttggtaaggcctatttagaccacaaaccaaaccaactctttagtgattctctagcttctgaattgaatccagcacaccatataatagtctcatcgactttttagctcgttatgatttcatctgcaactttcctgtctgccaacattttacaggattcttctggggagtgtgacaaactacgtgctgtcaaacgcatcatgccctgtaacagtcgtcaaggggaagtgatcgatgattcgacttgagtggatatactgttactgttgctactgtatctgaataaagcgtgtatggaacttcttttgtgtttgtaatgttgcagccttcccaggttcttctagacagttcactttgcaaacagtccatgcttgtgtgctcaaccatgtgaatcactttatatatatagaccgaatttgaggttttactttcatatgcctagttttgttggacctaactctgtgaagtccaaattctgtacaagtaaaagaaaaataaacatacaagggatgtttaaattgtagccaagataaactttaccaaattttggcaatgcctaatttttggcaatttagcaatattgctaaaattttgataggatttcttatgtgtttgttaaagtttgactaaaaaattaaatggatgcacatatttgataactctaaaaaaaaaggaatatttaaaatgacatcaatctgagcaaagcccacataccacaacggctgcaagtttgcaacaaagaaccaactacttaccagaacaaaaacagaaaagatcaacaagtgcacagagagagtgctgaaacaaaattgagaggttttttttatgggaaaatttactgaacttgccgtagtattggagtattggtccgttccatttagcggcacaccgtacaaaaccatccagctatttagcaaaaaaaaaaaggaaggataattcattgcttatggcaaatcaatccgttgggcctggaaaagaagaattggggaaatgaataagtccactatacatccctcatcttttagccgagtttaactcatatccctgaacgtaataacggaaatctctaacccctcaacttacaaacctgggttaaattagatctcatgatagtatcaatagttagttttgtcagcgtgccaccctagtcagcaaaactaaaataaaaagaaagcgtgtgggtcccaccttttttactccttgctagctaggatgtcacgtcagtaaaatcaaccatttatactgttatgacctaatttaaactagtcgtgcatgtgtgtgtgtgttggggggaggtgttcaaaatttctgataatgatagaaagacatgagacaacaaaaccgttcacttaaggttcttaggtggttttcaccccggttttgtctgacgtggtggctaagtcagcgtgggacccatgtgtcagggtgtccacgtcacccctctatctctctttcccctcttctctccttcctctctcattttttcccctgggtggcggcgtcttcgatgcggcggggaggagggccggcgtggccggcggtgggggaggagcgcagcgaagaggagggccgatgtgacgggcagcgccgccgatggctgtcgtcgcgcggtggccgcggcggtcgtccctttcaaccgtcggccttaacgtagcccagcaatccaagccaaatcaaaaatcggtgctcgtcgtgatactcgacctcgcgctcccgttcgtgctcctctccgcgtacctccgcgccagggacgcgtcgttcgtggaggccgtcgtcgcgcaggtgtgggttttcgacttccggtcgtcgctcgtcgacctcctcgccgtctccgtcgcgcgcttctgatactctgcgtaggaggaagagagaggaaagtgggcggatgatgacgtggccaccctagcatgtggggcccacgtgggtcccacgctaattcagccgcctcagaggataaaatcggagtcgaaaccactgagaaacattatttgcactggttttataagttaggggatgcgttgtatccggttttgcggttcaagatcgattttgtaactcgatgataagttgagggtccttcggtgtactttttccaaaaaaaaatatcactagacataccagcccaaaaggcctactagatataacgcctcctacggtcctaccaattaacccaacccatcccgagcatggctccacctcactggcccatcgaccaactttggcccatcgagcatggttccccaatttttttttcgaaaacttcacatcgaatctttggacatatgcattgagcattaaatatatagattataaaaactaattatatagttaggtgggaaatcacgagacaaaccttttgagtctaattagtccatgattagccatatgtgctacagtaattcacatatgctaatgacggattaattatgctcaagagattcatctcgtgctttccaggcgagttatgaaattagttttttttcgtgtccgaaaaccccttccgatattcggttaaacatctgatgtgacacccaaaaaatttcttttcgtgaactaaacaggccctttcacgagcatcggcactacctcctccaccgctcccagctagtcgtagctaggaaaaagtacacggaaatctttcaccgaattacaaaactgttatttgaaccataaaattggatataatgcatccgtcaacttataaaatcagtgaaaaaaaatccctcaggagaataatccccggttttcattggtctatgtggctcttttaactaggtgttcgtcccatgttgacattaatgtggcactaacgtgataattcgataaaaaaaataaaaaacaaaacgcctagtactccctccgtcccagaatatagcaacctaggatgggataaggtcaggacaacgaatctggacatagtctcaccccatcctaagttgctactaaatccgtcctaaaatagaacaacttttagctatatagttgttcaaattcatagctaaaaatgcttatattttggaatggagggagtattagaaatgagggagcctatatgggacctacatgtcatcctcattctcatcttttctcctatctacttttcccgtcggagccagtcacgcccgaccgggtgtcgggcggggccccgttaccaacccgccaccttccacctcccctcccttcagccgtacactcccgcctcccaaatttcctcgaaaatttttcccgcgcggccgcaccaaaaattccccttccactccgccccgcaccgccccctagcacggcggcgccccccgtccaccgccagccgcgcgtgcccgccgcccgcttctcgtgcttctccccgccgtggcagatccggccctgcgctttagcgccattccgtcgaacacctcgagcgcgtcggaggctggaggaggatgtacgggcggcgcgcgtcgcagctgctgaaggaggtcgactcctgcgaggccggacagctcgtgccgttcaacgtaagtttctacccccccccccccctaagcgctcgcgtttcttagctctggggatctgagtggccggtgattaggtttcgtttgtggctatttttagggcggaattatggttggtctagctgcatagttgaaattgagttcataaatgtgcattttcaatcctacggggggaatgttatctgcatggtgtataactatcaggcgacagtttaaatttaaacgatttggcttttcggtctggtttgcaaaattgtatgtaatttgtgagctttcatttgtctatcttgatgatgaaatctagttctgaaatatactgagcttgcaaattgcaatcacatgaaagcacataaagtctggggctggtggtctggtgggggttaatgtaagttaagattaccgttcctgtgatgtgactgtggcagcatagtttaattagttcggttagttattatgcttggtccctaacttctttttcttatggatgtgcagagcgatgtgtttgatcaggttattagagagtgcaatgaacacaatacacagtttcagtcattgataaggtaaattgcttcctatcagaaaattgatcatcttcatctagttctgcaataagagttatgatcaattaatcaatttctaggatgtatttcacaggaaaaacagcacagaactatatcaaactaataaaactcttacttgacttcttcaccattacagtttacttaattttgattgcctgatttgcattgtgtttatgacaggaaaatggtggagcagaacttagacattgaaacaaccagaaatgacgaccactatggggcagccgtccatcatctttcgctgcttcgtaacaaaagatgtctcatggcttacatgtacaagactgaaatctcacagctgaacaaactttttactttctatgttttatgctgattttacatgcacgcactaattttgagtatggaactgaaagcactgagttcaatcaggtataaccgagcagaggttattcagagctttagatggaaaatcggcccagtgcttcctcatgaaatacaagaaaagctccatttttctgagaaagagtacttcaagaaccactcagcagccattaaatcatatatgtcagagatggatatagatttaacagtggtacagcatttttctgttttatttactttcttttggatgaaatacagttagcagattttctgtaccacttctataggacatggtgcctcccaaggatccctacatccaggttcgggtgcttgaggacattggtgaagtatctcttggtgaccattccatatcattgacaaagaactcacttcatttcctaaggcgcactgatactgaacaatttatatcacaggtttgctatcttacttttgtgatattctcagtgtgtttattccatctgctaataatgttctatcaaacttacaatagggtcttatggaagagtttctggagtagagatcacatatggtgtacaataggtattactcactaccttacaatatatgtacacgtttcatgatgacagttgacagatgaccagagctagcatgtcctatatcagaaaaggctttgatggtcaattggttactgatgaatatttttcattttacacatataaatagttaaatatcacatttttttaagaaagaaaattcaactatcaccacaacatgcatatattgaatttaccagttctaatagacacctattctgaaacactgtttgtgtttttgatctgatttctcaaaccatacatctctggcctgcagattgtaactgaggatatgactctactacagcatttattcgtcattgctatccaatggattaaacactactgaaattctgacagagcctatgtgaaaatcaaagaacatatgctgtctcagctgtgaaggtatgatgcaacatatatgaggggattgtgtaccggggtgctcctaacttatccatttcagtgatgtctagctttagatgaatgaatttaagtttgttctacactgtgaccattctttgcatgttgtattatttggtgataaaatcgaaacttcgtacactgtacaaaaatcttcctaaatttactggagtaggaaggtaacaagctctgttttagtgtttactggtgatgaagacctggagaagcctcatgcgttctgataaatgcagtttgattgactgctgtgttcgttttgctaaaactacagttctggatctcggatatggaattagtcagaaaacataaccaagctgattccaagcaagaatggtgaacacggttcctgctttcatgcaaaggcgtagtacaccatacatcacctagttaagtttggtatcttcttttactcactacaagtttcttgagatgctcttcttcttgctaacttaacttgcacactggcattactttcatcagactaactgagctctaaaagttgcagtcttttacgtctataatatctgcatgacaccttgaaggttcacttgtttataatgcagcgctagccgctagctgtctagctcctgttgaacatattacatattcatgttagttgtgtcattctatgattcgaaatcattatattcatgagggcatggttaatgctaactacctcacaggaccataaatcattccaaatctaaccggtacccaattcttcttaaaaatgaaaatgcccaaacgtgtttcactgctatctctttatctaatcttcgcatggatgatgctttgtacaattactttgtcgagtggttttatggcgactaataaattaatgctggtgacttgagaagctaatccctagttgtgtggtccatgaacattatcactacttcatttcaaccttgaaaatccaccaaccaagtaccctgtacccaacgccaaaatcctacatatacgctcaaacaagcaatcaactttactccgtgttcttttctctctgttgttttggtattcttgggcacaactaacttgtggtcttgtgggccatgatacttatgtatctgttgtcccagttgtagacgaacctaaggttggtcaccggctaccaaatgacatgacatgatgtctacatagttttgacactactgcggtagtgctaaactagccaaacaatgacaaagcctaggtgctaaacctatatataatctgcatccgagacttccaagtgaagaatgtcttttcctacccttgttaggtccacggactcctgaatcattagaaaaccagtacgttaaaaaatatcacgctcagaaaaaaaaaagagcttggttatcttacttctagaactaatcagtaatcatcagctcttatttccaaagatcacattaatcatattgcagcttggcaactactactacttgagttcaaaactttatattttggggacaagccattgcttcgacggatagcaaccgatcctgtgaaaaattccccataaaacccaaatcaagaaattttcaactgctatgattttattttttaaatcactattgatgatgaatagtgattgtgggatcatgtcgaattcaactgctatagtaccctgtttgacaacagatcgagaccttgtgagacaaccaattatggtgagtagctacgcgtattaatcctgttctggcccttcggtgtacgaatttgctaaaagatgtccacggtttttctaatcgatctcagttgatttgtcatcctattgcttattgatgtcttccaccaaatggatcttttggcaagtctatctccttgtgttgtatccatctactctgctctatcgacaaatattactaagcttctactcgtgtgtcagtttgcactttacccttttatcttcttttgaaaaatcaaagatatgtaaaaattatagtgcaagtatatgtaatttacaatgttaaaatatttaactggtttttatgaaaaatatggcgtaaaaaatatagttagtttctttaaaactactggcacatacatacaatggcacgtacttatgaaatatttactcccaactaacatcacatgagatccaatgtaagaaatcatagtgaacttcactatactgttctgtagaatattctcgcagaatttcttcacgtataccatttcactacaataaataactccggacttccatttaattttaaccccagaagatctactgacatctcaaatcctcgtattgcacatttgcacgtacgtaccgtcctcgagcaagcaagcagggactaccgcatttgcaccgtggtactcacccagtcacccacttcacccaggcggcagtgccccatgtgcaacgccacggccatgtgaaccgaagtaccaggtgaccgggagatatttaactatttgccggtagattcaaatattatagacacataagaactcatatgtcatatattatgagtggcaagttcttaattgccatatcttaaaagtgacaaaaaaaagttaaatgcctaggtgacaagagccatcttttcactaattagttaccagtctcttcgtttaacttacaatttattatagaccttaatatttatgaacaataaaaaggtaatttataagtaaaacttttgacttttgcatataacttaaaaatcaatgttgaaaaataaaccacaattaagagtttattcactgtattactaaaatcaacttaccaatatttaccaatattaatttttggtacatattttgatgttactgtattttagtggtgttaaatatgtttagtttttaaacctttttaaaattttggtgatgtttttataagagaattttcggaacttccaaacaacatatttagtttgtcatcctataaaaattaataacaacaaaatttactagagttcaaaatggcagtaaagcaaacaaccagaaaaacatcaaaagagacagtaaagtaatattagaaattcaaattttagttatcagattttggaaggagacagtaaagtaaaagataaaaaaaaaatcaaaatcaactctaaagttaatatttaaattttaactacggctggtaattcctcgaaggcgccgttaatgaccgatgcgccagcgccgcggaaacggacggcatttcgccggaccacggcgtgtcagagagcttcatgtcactgccacggagtacttactgttgtttgaagtacattctgttcaaaaatacagggtacaaaggagcagtggtgagcaccgttattactaggagtagtgagcactcatgcgacagcacttgttattgtgcactacagtagtactcttcttgctcgaaaaaaaaaaaaatctctttcgagttgacaggacaggaagtcctattcacttaactatacatttggatctagctgccgagttagtaggcaggcttggaccatctcccgtttactgaaccaaagctactccttgattgtcttgtttaattaagcaaagaggttttgaccctgatgagtgatgaccatccatcccatccgtgagatgtacggagttttcgaagtgacccatagcccattcaagaccggtaaaggtgagttatacgagtgtacgacatgtgaccgtgtggctggacagcgccgtgctgtcacgctacacactgtccttgcttgaacaagaaaaacacttttaaacactcatccagccattgctctcgctggtgtttatgaggcgcctaaaattttgtcattcacggcctcaggggaccggctacgtacgcaattctggaccagcaatagtgtgctaggacaggagcactataactcttgttttggtctcatccaatcatccgtggatggaaaattccagcatcctagatggcctgtgcaggtaatctggcagtacgccaattgggcgatgcggatcttgtgtcgcacagggctactttacagaagtttcacagtcgctgcaaattttgagaagcttcggcgcatcagcaaaaggacacccaccaccaaccggtagtactactagtaggagtagctaggtaaagctggaggaggttgcatccatgatccatagatcatcaaacgaggccacgaggggggatggggtggcccccgttccccatcattccggccagttgctggctggctcgctcgaatgctcgatgcctcgatccatcgattgcttcccaaccaaacaccttccgatcgaccttgcccaaaccccggggggtgatcgttccttcttaatgagcactaatcacgatcagtcactgcaacattagcgaactcatcttttcgtttatgtgtatgcttattaattaaaatttgaattttcaaccttaacgattttagggtttcttttattgtggtttatttatcagtatttgcttttagttcgttaaaaacatatatataaaagttttattcacaaattatttttcgtttgtaaatatgccgctaaacgatgggagcagtagatttgaaagtattcaacttaaaaagcttatgaccgttttttaatagtccttttactaatgtttatgtggctcctttatatgaagatatcttatatttaggtttatgttacatttgaaagtttttaaataaaaaaactcacggcgccgtcttttacagtctacttttttagaagttttacgtgccttctctgtatatatggagatctcttgttattaacactagcagtacggcaatacgtagtatttatcaaaatgctacaggactacttgggaaagagtagaatgccggaaagaactggaccagcacggccgcagtagcaagttttgatgattttataacggggtaggtgcgacgagtgccatatggtccatatcaccagatggctcccctttcaatacgcgctcgatcggctcgcatgcgctcgttgcatgcatacgagcaactcggcgacgtgggcgcgttttttcgtgggtggggggacgacgacgacgtgtggagtagggtggacgaggcggcagctagcgtccgacgcgggatgcatttttcatggcgccgcaaaaggtggtggatagtgtagtgtcgtcgccttcggaagttcggatcctcgccgagcgcggcttccgagtcaaaactcgcctttttcgcttccaccctcgccgtttctctgacagtggatgcgtcctgatccgcagatggtatcccccttcaaagttcaaccgtgcgcccccacaccattctgctttcttcctctcccggatttcaaaactcagctttcgaagtcactaccagcagcgtaaatggagcgttttgcctagagagaacattaggcatggatgcatggtcaatataagctataacgagaaaaagagagaagacgttgctaacgaaaccacgttataagggcatccacaatgtgagacactcctaaagtgtcctcactaactgaggacactcgtagaaaactcagctcgcaatgggaggtatccttggatgggctcctcaaaatttgaagcaatccgatgagggtactacagcccataatgggtgtcttggcccaaagtaaccccagatgaaaaaatccccaaatacccctcccccagtccattcttcctttttccttctcttttcttccgccccctcttctcgcgtcttctcgcttcttcttctcgccctcctggtcgcccattcgccgcccccgcctcccagcctgccgccgccacctccctcctctctcccctgccgctcgccgccgtcacttccctcctcgccctccccagccaccgctgccgcctccctcctcgccctctctagcagccgccttcctcctccctccgccagccgcgtcccgccgtcgtcgccgaagtggttccagcgccggcggtggccggaggaggcggatccggcgccgaggcgggcagatctggtgggcgggcgcggcggcgtcgaggtggcgggcgcagttgtcgccgggtcatcgtcgtcctctccgtcgcggaagccgagcccgtcgccagctggtggccgccggctgccgcggcggtggccggatctggtcgtcgccgttgtggatccttatcgccgtcgcctctctcttctctctctctctctctctctctctctcgttgtcatgccgccggtgaggggcaagaaggggaaacgccaggagagaaggtagaggacgaggcaccgagtcgctgcaacgcgtagcctcgagggagtgtctctggaaaaagcaagctggggagctagaggggcgcgttccccgcgtggggatcgcgcctccctccagagacatgccgcgcggacgaacggcggacggcgtgagcggggggacgacccagggacaccgattgtggatggcctaacattctccacacaatataagtcttagccacgtgctattttttttacccctcggttggttacatttttatgtataaatccttagattgtttctattcatatataagtccaacattttatagttagaatcttatataagaacataggaaaaaaaattgaattaccccctaaactattgtggtagtacaaattaccacccattcaatttaaaaaacagacattcttcaccctctacattttaattggatgaattacccccttgacagacactatagcggttttgttcctatgtggcacacatgtgatagtctaatcaacataaaaaaaaggggtaatgcccacatgtggtgatctagggaagaggcaaaaccggtaagtgggcctcaccatttttatatattttttaatgctaactggattaccacgtgtgtgccacgtaggaacaaaaccgctccgaagtcgggcatggaggtaattcgttcggtatgaaaagttaaggatgaagaatatctgggtttgaattgaggggagtaattagtactgccactatagttcagaaggcgcaattcaaattttttttccaaaaacctacccttacccttttatcatctccgcccttctaccttttctgagtgcctcgcaacctctaccctctctccttctcggcattgtcgtctatccactaccccttctccttggcgccattgctaagatcccctccctcctccttggctcgaactccccaccccctctcccgtgccagcggtctcgccggattagattggtccttcctaatacggttccagttgtgcttcgctggctgacgaacttctaggcggcgtgaatcgaggcgaagacaaccatatggggttggtgcgtcctcgtgctcttcgacggggccttggtggcggatctatcgtggatgtggtcgaggcaatagagtagtcaacaccactgcaaatcaatgatgatgagtctgggtaggcccttcctctccccagccaccccctcgccatctttgttgttgttgtcaggtccgacctcgagcttgccaaagctacatggcgacaacgaccttgaccttgttcgcgggggcaacaatgcgggagttagttggcagctacccgacacgaggcattggcatagggtgagacctctccccaacgtgtttctccacccatttcttgcacagaaaccacgcataccttaatttgttggggttcacacactccttcgggggtacgggtccctcctagctggcatgaatattttccttgggcggggggtggcggggagtgagaccaagctccagcttgaagcgttagccatggcctcagtactacctttaccccgaaataacatttattttttctctatctgacacataccaacaataaaaaaaagactagaatagccaccacttatattcaatgttaatgcagttgtctcttgttttatcttgttctaattaatatatttgtcctctgctttcataattttttatatagtggtagcttaaagatgaaattattttaagataaataagatgaggataaaaatgatcttattttaggattgagggattacgctgcagcaagagcagcatggtgagcacgatcctctgccgtggttcgagacgttcggcgccggacattagaacacgtacgtctagatcgtccaatccgcatccaacggaccgtatcatcacttggcacgtcaatttaagtgccactccgacaaactgtgcaaaaaataacgtagctgcagtgcttccgtactgttacatgtagtcggttactgtagctgcacgcttgtctgcggtatatgagtatgtagtgcagtgcaagagatctctgtatccgccaagaggatactagtacgtaccactacagcagcatatatcactgtaatgaataaactactgtcatacagattacagactactacctcctctgttctgaaataaaattatctttatccctgctatttgttctattataagcttatttgtagttactattgtatcaaaatttgtgaaagcaaaagatgaatgcatttgagtaggggtggaaacgggcgggtatttcctgcccgcccgcccggccacattatttcaggacaaattcggttacccggggcttttcatggatccgaatacgggtcttttttgcggatatgagatcgggttcgggaacgtagtatccgacgtatacggattatccggtaaaaaaatcggatattacccatattatgtttttgtgaggaaatttttggtactatgtattggttctattacgatgtattgtttcctatttatttcctaaggtactaatggactaatataaccgtattatagataaatagaattgttaaatggttattgcccatgtgatatataagattgtttcttcgacttgatatccaaataaaaatttgtaaccaatagtgtacatatctattttggtacgtattcgctatgtatttttgcccgacattatccgagtttatatccgtattcgacactatccatgtccgacccgattctgattataaaatgtgggttaggatatgagaagggtgagatccgatcgaacccgacccgttttcacccttacatttgagtagataaaataaataaataaatacatttagatttgataaagtaaaggtattttatatttttaatattgtattggtatatagggatggtgaaaaaataaaccaaatttattttatgacggaaacaatactactacccccactagagaaattgaccgtttggtcacgttcaacgccactaaattaagccaacgaggaatcaacggcccctctagcgtacagatgctgcaaccgttttgtttgtttctcccccatcgacctatccctacacggttgcacatgccgatacaacggccgcagcaaaatgaccacgagaagtgactcgcctgaccgaccgaaccatccgaaaggtccgagccgtagctgccacgccgccgacctactctgtcacacacacgcttcccgaactccactgaccgttgccgctaaaaaggaaaagggaacaaacactacagtagcagtaagagcaggtacaatagtaggctataagccagctagcaacatattttaataagataatagagaagagaggagagcagcgggctacagatctgtagccagctgcagtacggactctaagatatagtgtgtatgacaggtggaaccagatattaatagtatagtaagcaactattgtatgaattggctattagattgactatagatgaattggagctagtaatggtcaatactattgaacttgctctaaggagtagaagcccaccaaaaaaactcaaaatccaacggtcactcgcctcgcctttcacctcttttaagcctttactcctcgcgctcgccgcgccatgcatataccaccaccacctcccccgtcctcctctcctccaccgcaaccgcaaccacggccagccacgggccaagcgagtcacgactggcacaacgaggcaaaaacaccattgctacccccgaggcgtccctctcagctagccctggcacccgcaccacctagcggcggcgccgtcgtgttcgtgtcggccaagtcgtcaagaagctagctagtcattgccagtgggcgcattgtgctaggggatggcgagaggaggaggaggaggagaggaggcggcggaggaggagagggaggtgagcgaggcgctgacggcggactcgtcggccgacgaggagtgccgccgcgggagcagcagctccagcgcaagctccggggacgcctccagcgagtcctactgcccgcccgacgagtggcagaaggtggccatcaagacctgcgtgtcgtccgacctcgtcgtcgtctcggccgagccggccaaggagaagaagccgccgccgccgccgtcgtcgccgcgcgtcgacgccgccccggcggacaagcaccaccggccctcaggtacgtgcgccgccgccgcaaatccccagttcactcctcccttccaacacacgcggttaaattaattgaattggctgcagagatggagatgatgaaggagaggttcgcgaagctgctgctcggcgaggacatgtccggcggcggcaagggcgtctgcaccgcgctcgccatctccaacgccatcaccaacctctgcggtaagtgggaggtttcgaattgcacattgcgattaatgcggcggtttcatggacacggacatggaggctgagctgagttgcgttgctgcagcgacgatatttgggcagctgtggaggctggagccgctgctgccggagaaaaagacgatgtggcggcgcgagatggactggctgctctgcgtcagcgaccacatcgtcgagctagtccccacatggcagacattccccgacgggagtaagcttgaggtatactagtacttcacttcccctgacgaaatttactctgcacttctgcagtagttaagctaggagtgatacaggaattactaggatcatcagtgcgggccgttcgtgagcactgagtagcagatgcaagatttaatttggcgtcctacggatgaaccatgaagcgagtgcaaaattcgatttgaattttacatgaacatatggaccacaaaaagaaattatatatagtcattaaatacgtggttagccgtttggtacttagtaatcccgtttatattgaaacagttgggcgcgcgacgccgtatttctgaggcccaaaagagttaaggccacatcaatgtgctgtccgtttagttgtgtccgatttgtttgtcctcaaattatccggtccaaacgtgatccattactactctagatcaaatggagatccatcatttcccacttgctgcatctgtttacaccaatctttcttctgtagtgtccaactttattcgacaatgcaatgttcaggtctttttttggcaaggaaatgttcagtttcttttttttatgaactcttacacagacacattatataacttgtggtgagaacaatgataaactgactgttactctacatgtggattactacttcagatcatgacaagcaggccacggtctgatctctacatcaatctgcccgcactccgaaagctagaccacatgctcctcgtaagtctgacgaactctatctcggatcaacgatctgtccatccatccgaaaataaaagatgaactagtgctgtaataatgtgcatctcctgacgaaacgagcacatcttctgccaggaaattctggagagcttcagggacccggaattctggtacgtcgaccaggggatttgcccgccggaccgcgacggcagcgcccccttcatgctaacgttccaccgccgcgacgagaagtggtggctgcccgtgccccgcgtccctcccggcggcgtcggcgagaccacgaggaggcagctcgagcacaagcgcgactgcgccagccagatcctcaaggccgccatggccatcaacagcaacgccctcgccgaaatggacgtccccgactcttacctcgactcgttacccaaggtccaaatcaattctactacctgtagagaataggagacggattctaatcaaccgcaactaaatggttatgaattttttttaaaaaaataacaagatagattaatatgtaatatattactccacaaacatacaatttcgaatttaacttttacaagttataaaaaataacaaatttaattgcaaatatacgtatactaatttaagttttatttgttgtttttgttacaatttttagaagttgaaatttaacttacatgtttgtggagtgatatattacatattgttctatctttttaattatttttaaaaaagttttataattatttagatgacatgcattcacttgggtgattaaaagagttttccgtagagaatactgtaaaaattatcagaaaaaagaaaactacactaatgctcatcatacatgaacgtttgctgtttcttgattctgacattgatgtttgattgtcagaacgggcgtgcgacgctgggcgacatcatatacaggtacatcacgtcggaccagttctcgccggactgcctgctcgactgcctcgacctgtcgtcggagtaccaggcgctggagatcgccaaccgcgtcgaggcctccatctacgtgtggcgccggaggggcacgtcgggcgccgcgagccgcgccggaaacaagtcgtcatggggcatcgtcaaggacatgatcatggacacggagaagagagacgacctcctcgccgaccgcgccgagggcctcctcatgtgcctcaagcagaggttccccggactgacgcagaccagcctggacacgagcaagattcagtacaacaaggttggtgaatccatcatttgcagtttgcaaatctcgctatccgtgttgatggtgatcgggtttggatgaactgatcgtgagatgactctctcttcaggatgtggggaaatcgattctggagagctactcgagggttctggagagcctggcgtcgaacatcatcgcgcggatcgacgacctgctgtacgtcgacgagcggagcaggcaggcggagctgcttccaaccgcgggcgccgggagcggcaagatctcttgcatgccggccatgtcggcgtcgtcggtgccggcgtacccggtggtgtccacctcgggcaccccgccgccgtacgcgacggcgtacgccacgccgagcttctcgccggcgcagctgtcgagcccatccaacatcgggagggcactgctggtcgaccggcggtcgcacgacggccgagcgttcgacggcagcatggagttcatggggatggcggtcagcaacgccgtgttcgacctaccgggcctgtgaatcgatcgatcacgggccccgtgtctagtgctttacttaccctcgcctgtgtgcagtagttgtaatgttgtatggcgtgatttcttctcgggagggcggcctgtttttgccgtttcgccgtttcgccgccctccagttttatgatgtgttttgacagtgcctttgttaacttgctagtgttgtaagagtgcttaagttcgatgttggtcggatggcaaaagagaaccatcgcgtttgtgcaaaccacagagttttcttggctgtttttgagcaggttccgataaccagaacgtaacaacttttataattttaccgttaaccggcaaccgtacagacaaaattgaaatttaaattgagttcaaattcctagtctttctaaaaggatggtttcctcggaacgtacgtccaaactccaaaaggcctcggctgacggcctgcgctgcatcccacactccagggcttggaataagttcactttgggtccctctatttgtcgcccagtccgattttcatcccttgaccgtaaaaccaggtacgacccgtcccccaacttacgaaaaccgggcaaacgaggtccctcgacagttttaatagcggttatggctgacgtggcgcctacgtggctaatttgacccggtcttcatctgacatggcactgacgtgacgcttacgtgacaattcgattcagaaaaataataaaacccgtgggacccacatgtcatcttcacacacaaaataataaaaaatggtgggacccacgtgggccccacatgtcatactcaccccctcatcttcttcctccctctccatctgtctcccctcctctctccggcctccaggcgccatggcccacgaggtcacggggaggttatcggcgttgttgttgggatggaagggcgcgagggtggggagctcgggtcggcgtacaaggccgccatgcgcaacagcgtcaccatcaccgtgaagcggatgcgcgacatgaaccgcgtcaagttcgaggagcacatccagatgctcggcgacctccgccaccccaacgtcctctcccccgtcggctaccattaccgcagggaagaaaagctcatcgtctccgagttcatgccacgtggcagcctcctctacgtcctccacggtaataataatcacagcaaatactagtagttcttaatcaactactaatctcgattatagtttgctaattacgatgtgtttgtttgttggttcaggtgaccagcgcccggacagggtggtgctggattggccggcgaggatgaggatcgccgtcggcgtggtgcgaggcatggcatacctccacgagaagctggggatcccggcgatgaggctggtgagcatggacggcgccgacttcgacgccatccactcctgccgccgtggacgtctcacaccactcgccgtctgaggtctgcaccgcctccacatcgagctgccaaccgacgagctcggcatcgaggacggcgtgctcctcaagtggaaggctgacttcggcgtacaaggccgccatgcgcaacttccatcccaacagcaacgccaatcggggggagtaggtggagctcgtcggggcgggcggctgtcgcgtcgccggccgccaccgccggacctccccgtgtccccgtgggccatggcacctggaggctggagagaggaggggagagagatggagagaggggatatggagagggaggaggaagaagatgaggggtgagtatgacatgtggggcccatgtgggtcccaccatttttttactccctctgttctaagaaaaaatacaaaccctggtttccgtgtccaacgtttgatcgtccgtcttatttgaaaaaattatgaaaaaaattaaaaagacaagtcacgtataaaatattaatcatgttttatcatctaacaacaataaaaatacaaattataaaaaaatttcatataagacggacagttaaagttggacacggaaacccagagtttgcattttttttggacggagggagtattattttgtgtgtgaaagtgacatgtgggtcccacggactttattatttttccggatcgaattgccacgtaagcggcacgtcagtgccatgtcagatgaagaccgggtcaaattagacacgtaggtgccatgtcagccaaaaccaccgagggaccttttttgtccggttttcgtatgttgggggacgggttgtacccggttttgtggtcaagggacgaaaatcggactgggcgataaatagagggaccctaagtgaacttagttccccagtgctttcatgatgcccagtgggcttgggataaccaaattggccgacgggccagtgcttttgtgatgcccgcgaaagaaaaggtccacttttactcccttaaatttaggtccaatctaaggaaaaagtacaccgaagatccctcaatttgtcgttgagatacaaaatcgtcccccaaccacacaaaatcagataccgggcatccctcaactaacaaaaccgttactttagatctttcgatggttttgaccccgttttatccgacgtgacggctgagtcagcatgggacctgcgtgggccccacatgtcagcggggccacgttggcctcctctgtcttttcccctcttctctccctccctcatctctctctcacttctctgctctgcgttctgcaatgcgggagaggaggcggcggcgacgatggcgtcgcacgaggcggatgggtgcgcggaggagggaggggacgagacccacgaggcggcgacgggggagggctacgcgcgggcggcggggcagccgctgctggtgccgctcaagtgcgggtgcccctcccgctcgcccaatgcatactcgcctatgcagtaccagatcaacgccggcgacaccttttggatcgtctccaccaccaagctgcagaacttgaagcagtaccaggccgtcgagcgggtgaaccccacgctggtacccaccaacctcggcattggccagatcgacatgttccccgccgcttgttcccctccgttccccgctgcgtgttcccctccgtttgtcgccgcagcctggtcgcctccctccgaacgctgccgctgcctggtcgcgggagggcgtcggcagcaacaccagacctacccaataaattatttttgattttcaccatcaattcactagcaatggccaagctagcccgagcaaaacaaaaaaaaaaaagtcatgtacagacatacagaccagatccttccttggaactggatgacgtcgtgacgatgaggagagagatcacgacggcggcgacgcgggtgccacgaactagagtgcctgcgtgagcgcctccatggcgccttcgccttgctcggcagtggcggccgcgagcgcgcggtaggtggcgggggcgcggtgaggcgcacgtggcggagcgcgcgtgtgcgggcacggtaggcatcgggggcacggcgaggcgcacgcggcggagagcgcgtgtgcggcacgcgcgcgcgggaggcgaggctaggatggcacggttccaccgcgatcgccctcacgcccagctcctcccccgccgccgccgcccagttctttcccgtcgggcgccggccgcgcccagcctctccgtcccgcgcacgtccgtcgcccgtggaaagaggattggaaagggcagtagagaggggaaggaataagatgctgacatgtgggatccacatgggccccacgctaactcagctgtcacgtaggataaaaccgggtctaaatcaccgaaggacctattgagaccggttttaattaattaagggacgccagatatttggttttgtggttgggggacgattttgtaactcgatgataagttgagggaccttcggtgtacgttttcaccaatctaattcatataactcaacccaaatacaggatatttagaccctcgaactactaaaacagtgtaatttgatttccaaagagtatttgctgacgtggctcgttgacctgttcgaaacggctaatgtgtggggcccacatggttagtgtcgccttctctttctctctccttttctcttcctttctctcatctcctttccccacagttgcacgtggcgaatgcctcgagcgacacgatgcccccaagggaagggtggggggctcaagtgtcagtgcttcggtggccaaaaagacggcgatggcggtgttaggatgtgtaccacgatatgactcgtccaattaaaggtcccagcgcttgacatattggatgatgacgacggtggagagaggaagatggccaagcgagattcaatgccgaacatgcccaagttagtgcgtcaaaacgcgttctcagaggaggggaactcgtttctcttgaacttgttgatggaggtagactaggagtggctgacagcatcaagcatggcagcgagcagaagaatggccacgacggccaatcatggcggcacagagaaagtgcaagatagggaaaaaccttataaatcttgatgccctcgctgttgcctgccaaccccaccccaccccacccctcccctcccgcgcgcgcctcgatggggaaagccttctggagctcgagctgtaggtctatcaagttattgtcgtggtcgttagctaatggtttgatgcatggtttcggtcacattgttgtgtgcagttacggcccactagcgaggaagggacccctattttcttacacaatgaggcatgcacacacgtggatttagaggaaaaatcatgattagttttatttttacttccgttaatcattaactaacctttccttttctcaaggagtttttttcccttttttactagaaatttaaaaatctatacgtgaggtttgaacctttcaactaaaattttgaaaactttcaacttaaatttggaaacattcaacctaaatttttgaaaactttcaactcaaatttgaaatcttacaactcaaattttgaaagctttaactcgaattttggaagcttcaaacacgaaatttaaactttcaagtcaaatttttgaaaacatttgactcagatttgaagattttcaagtaaagatttgaaaatattcaaatcaaatttcaaaacattcagccgaaatttcaatatttgcgaattgcaacccaatttcaaaacttcaactcaaaagtttgaacttccaaatcaaattttagaaaaacaaaaaaaaagcgtcgatgctttgcgtggcgaattttttggcgcgacgtgaaataggtcacgtggcaacattttttgtcgcgaagcgtagggaaaggggaaaacgccgctaccctagctcggtcaacgtgcgaatgacttgattggttggcgcacacgcatgccatataggagcccccagccgttgaaccactcctcacgacaatgatggccttggcgaatgatcgccccaatgcatccatgccatgggcaagatcgatgacccactcaagctcggtgaggagttcctggaagtaggctcacatggtagcagcaaagatttgtccgtcacaggagaccttggggggtgcagtaggctgcgtcaccgttgctccgcctcgaggctgctatgtcagctgcggaagcggctccgtcgaccgctgttcgagcctgtcaccgtgtggcattgtggtgaaatgagaggggagcaaggaagagaaaagatgggagaagaaaaatgtggtgttggcatatggttctcataatgattcagctggtcgaaccaagtgaacaagccatgtaacaaatacaactatgaataatgccttggaagtcaaattagatcgcttttaataattggagggggtaagatacctagtattgtgattgagggatacaaattatattaaacctatatttaaggaaatgaagtggactactatgaataatgccttggaagtcaaattagatcgcttttaataattggaggaggggggaagatacctggtattgtgattgagggatacaaattatattaaacctatatttaaggaaataaagtggacttattctgctcgtaaattactgtggttgagagatacaaattagattaaacctatatttgagggaaacgaagtggacgacttattccacccgtaaattacagcggcacgaaggtcacttgttctcctacaactccactaagtgtgaaacgcatgtacagtcaacagctttaggagtcattgggggcaacaagggtaaatggtgcgcacaattaggcctggtttagttccctaaaaacatcacatcgaatctttggacacatacatggagcattaaatatagatttaaaaaaacaatatagataaaaaaaactaattgtacagttggagggaaatcgcgagacgaatcttttgagcctaattagtctatgattagccgtaagtactacagtaactcatatgtgctaatgacaacttaattaggctcaaaagatttgtcttgcggtttccagacgagttacgcaattagttttttcatccgtgtccgaaaacttcttccgatatccagtcaaacatccgatgtgacaccctaaaattttcttttcgcgaattaaacagacccttagtaatgttgcaagtagcaaccttttcttttattgaaggctacctgttgctgccctaccatctcatcacatttcatcaggtgaaaacagcaaaacaaagggctacctgttgctgccctaccatttcattatacttcatcaggtaaaaacagcaaaacaaagggcaagaggaaaaaaaaaggaaaacaacacacacatgcacagtaacacacacaaccacatctgctcaggtgaaatgacgcatccaaatactgcctccaccggtagaacagatgtatagttccactatgacttgcaaaccggcttggaccactccttttatttctggtacaaaacaatcgaataagatgcacagaaattgctatcgcaatgatgaaagcattgtatggatttttatatagaacagtctgattacaaaaccttaaaaacttaataggataatctgaaaagcttaagttcctactgcaagtcactgggaattggctgcatacatcctcatcctgtttggatgtagaggctctgttttaatccattttctaaaagaaaaagtcactaagctcctatcaaatgttttcgtcatatgccaacaaaaggagaaatgacaccaaatatgcatggattgcttaacaataataagtttataagggaaaacctgacaaactatggttgtgagtcattgtggcctacaaattaaaatgccttggggagtaactaaactgtaaaatgttaaacaggtttcttgggttaagaaacgcgtaaaatgaacatcttcatcagatgttcatatcattctaaacatgaggcgaaattgctctaagcatcacccatgtcagatgtatgtactttttagaaactactaacaagataaacttttacttcaagacatttgaccaattttgcagtagagccatcattgtcaacctccactactatccaatgattgtgcgcagatatgacaagtaaaattattggcaccagaactatgaggacggcactaatgtaaacaaggatattttcctaagt

SEQ ID NO: 66147 - DNA, 634 bp, Oryza sativa
atgcgatgttttagaccggaatgaaaaagttcaaaaagcaacaaaacatgatttcggacatattggagtgtattggctgtgttcgtggcaaaaaatcactacgtgattcgcgcggcgaacttctgtcaattaatgctaatatttgcatatattggcacacgtgggtgcgatgttttacaccggaatgaaaaagttcaaaaagcaccaaaacatgatttttggacatatttgagtgttttgggtgcattcgtgggaaaagatcacttcgcgattcgcgcgacgaactttcatcaattactgccaatattggcacacgtgggtgcgatgttttagaccggaatgaaaaagttcaaaaagcaccaaaacaagatttttggacatattggagtgtattgggtgcgttcatggcaaaaaatcacttcgtgattcgcacggcgaaattttgtcaattactgccaatattggcacaggtgggtgcgatgtttttcaccggaattaaaaagttcaaaaagcactaaaacatgatttttggacatattcgagtgtgttgggtgcattcgtggcaaaaaatcacatcgtgattcgcgcggcgatcttttatcaattactgccaatattggcacacgtgggtgcg

SEQ ID NO: 66148 - DNA, 976 bp, Oryza sativa
caatgcaagacacgcacttctcgggtctcacttgctagctaggcctaaaactctataaggacatgagttttcacatagccatgtgatttaggagcgggggcgaccacgaccgtgaaggcatgatgtgataaggatatgacctccacaatgcaccctcacaattctcttcctgcatgtcacacgccatcgtttcgccacgggagaacgagtgtcctattttggcttcgcgttcttcaccgggggacaacagaggccgatatggcgtgaaatattacgagccggatgccacgtagatatgcagtgaagatcctaggtaaaagaagtgttatttatatacataaataaccaatcatacttaaaaaaaagttaaacaaatgaacacaatttgttcaactttaagttactctacacgtaattgtcgatcctttttgtttttttcttttgcaattatcttattttattttttttcttttagaaacaagctagtatatctatatcactatatgaatataagtcacttagtcacgtgtaactggaattatttttcatatcaatagtacatgcctatcgtcgaataattaaagaaaatcttaagacccaatcattgtggtatctaaaataaataaataaaaacgagatatatgcacaatcaattttgtttggttcaccaaaccatactaataacgatctatccatcgaaaccactatcatttggtaataataactttaaaataaacaagtcaaactaaccaaaccgtggttgcatttaaacaatcatctcactgttctaacacactttgtttacgaatttcgttgcaaaatttgttaaatttttacacccaagtggattgttctgatttccgtgggccgacaaaaccaccccaaattggcccgaaagctgcaacatttttcctcctcctaaccaccgctccggcctctccatctcccgccgctcgccgtcgccgccgccgcccgc

SEQ ID NO: 66149 - DNA, 1712 bp, Oryza sativa
tacggatgttatacaatttatttatttattcagtggtttcttttgttttatcacccctattttcctacaaattgtttttctcatgacatttcccctcagacttgcattaggtgtgatctgataaggttatcagcacattaatgggcatcattttcattctgttttggcctgttgatgaatggtactactctttagcgtgttgcatctaaccttgatttggtccctttgtaccttttgtgtcactgttcagtttagttcattccactcctgcgtgatcgaactggactaatattttttccatgttgtataggaagctccagctgttattcagtcatactacaacaaaaggattgttggttgtcccggtggtgaaggaggtatagtacctgtgcatgctaatttccttgttttgacctataaagaagcttctaggatgaaatcttctcctgcatcttctctataaatattcatcgactaaccaccaatggaattaacttaaactgcaaattgcaatgattgatattttcagaggacgagcatgatgtcgtgtgttttggttggagaaaggcaagccacatgaatgccctgtctgcactcagtatttctcggtatgttggtactttctgttgacaaaatcgcttgccttgtgagagcaatttctgcatgagccactaaatcgcgcatatgttggtatgttgtcctgatgttcgctgagctatcaacttgcaactttatgttcacagcttgaggtgataggagaaggaggagatcctgatgggcatgacgatgacgacgatcaccaccatcattaaggttgcagaagtcacctctagcaataaaaacactggatatggccatatccatgtcaactctcaattcagatgacttggagcagcagtggattttggaaaaacaaagtttgtctttttagagatttgttcatgcaaataacaggattcagtaaacaatgatatgcaattctctttttcagcacaccttagtcgaattcaaaataggtatgtttgtttgtttgtcttgatggatgattccatgttcaatggccacctggaccatttattttggtgtatgatctgttatctgaacatttcacaaaccttggtcctgttcaattcagtttaaacaaatgaagtcagcattctgatgatccttctccctcctatccagttcagttatctttgattataaccaagcagttggatgaaacagtcaattgcttttgtaatttctttatatgatccttaatttcctactgcttacgtggtcaatttgttgctttgatgagtgagacagtgatgcattcaaacttggatttggccaaaccagcaccacacacttcaccactcactgatgtcattcacgtgaggatgcattcaaccaaagtgttaactttaccacacaaaataccgaaaattttggacggattcggcgtgacagaattccaatttgcactgcatttaatccactttattgatttgaaccattcctgatctccacacctacatatcttttcccttcatttttttttgatcaggtcagctccttactactgcaagataattagataaatccaatagtgatgcactaggcacaaacattagttgaaatgtagctatcactcttaagatttcagtgtgttttctcacatgtattaattgctaacccatcatgtcaaaatccgaaattaactcgcg

SEQ ID NO: 66150 - DNA, 1612 bp, Oryza sativa
tatatatttttaagatatatagttagattttgtattgatgtatattaagatagccactatataatacccaagcatggtcatggatgccatcttgtttgtaacatagattttagcgttgtttggttgtcaattgcagttttccatgcatgtatattaagactgaccaattcattatgtcttcttttgaaatgattaatcacatcatatataatatattgcagtatataactatagaacacatagagatctacaactaaccaagttgtaaaacgtacacatgcaggacgagagcacacaaaatcatggcaccttttactctagcttgttgatcatggcgcacatgttctgtgaacaagagccatccattttcatttctctctacaccagagccatccaattggtgggctaatgattacctacacaggcaacggctccgatttttttgtctaggtgaaaccagatggctactgagaatctaccatggatatcccattcaaaactggagccatgtcttcgcaatccaacaaaggcaagaggttctttttctttagtccagaaagcacaaatcttgcatagtcaaatacaagatataataaatatttatttcttttctcatacatggatggggaacaaactttcgagttccacacaattacacaaatgattgttgttggagtgatcttttagttgtaccctcatattcgtttgacccgagcagaagtactgcactcagattttaaaccccataaataaaaattctagtaatattccaccaagctgtactacatgcttccttttgcccttatataacaaaatcgatggttctgagttcaaattaattggcacaacatgaagagagcgtagttcagctggttagcttatggtgcacctacctatccgatctaattcgagtaatagacttgacaagggtgcttgtatttatggctaattattcttttaataatatatgacgtacttgtcgagtgagacgtttgtgatgacttcatcaatctaaaattaattatgccaatggtaacttcatcaatcttaaacattccagaccagcttctcagagatgctcatatggtcgattgtgtgtctgtatatttataggagtgagtctacacacatgaaaatgtgagcattgcatttgtactacgcttctaaacgaaaaatttgttggcacaacaaactgaacaaataaatattccatggagtactcgtgcttgtcactactatagaaaaggggattggtgccaattcagaactggccataggtgctagatttcccaattgacacccaacagacaatacatttgagattctaggaatgaaaaaaaaaacaaaaagtcggcattcgagccgaagcatcgagcagttgtccatcatcactaagatcaacatcatccccattaaccaaatgcaatcaaaatcatcactgacataccatcatcccatcaaccaagctcaatcacaaaattaacaaaatcgcaaacgcaaacacacagagaacgccaccgtcgccgtcatcaatccggacttctccatcgtcatggtggtgtcaatcagatggaaaggaggagtaggaaagaggggtggcggcgacacataa

SEQ ID NO: 66151 - DNA, 758 bp, Oryza sativa
cggtaccgaagcggtcccgcacttccattctgcgcgatcgagggtgcgccggcccggtcctgcggtacatagcgcacgcgcacagccatcgcgcgggaccgactcggttccgcaccttcggcctgcgcgatcgagccgatcccgcacatccagtatgcggcatcgcgttcccacgctgccacgccgcgctttcatcctgttcccgcgttcccaacgcgcggaggcggtatattttcgccaaatttccccacacatgtatataaatacaaattatgaaaaaataggtatatttttaaaatttattcaatgttagcataagcgttggttttttaaaaaatcataataatattataggcactgatttttttttatctaaaaccggcacccataagttcttaaaggtgccggtttttttaaaaaaataccccataatggtgggaaacggtcaatatgtgtcaattttaaatgaaccggcacccatgagctatcacctgttaagattttttagtagtgtgttatttttgtcgtgtaacatgtacaaacaaaaactttcgcatcctcaatagatagctggttcagatgcatggttaagtataaattcagggatattattgtgtggttaataaatcgcactaagtatggatggatttactttggaatttcttatcatccccagttggtagctggttcagaacttcagatggtcattcagagatattattgtgtggttaatacgtacatcggtacatggatggatt

SEQ ID NO: 66152 - DNA, 979 bp, Oryza sativa
ttcatttatcacaaaactacatatttattgtctaattttgtgagaatggagacactaaatctgtagttttgtgataaatgaagatattaaacctatagttttgtgaaacaagttcttacatctgtagttttgtgatatactattcaaaatacctgtagttttgtgataaatgaatacattgaatatatagttttgtgatagattatgcaaagtatatgtagttttatgaaatttactaaaaaaaattcaatatagtactggataatgaatctggacatcctaatacccttgtattttttactgtgcagggggctgcctataaaaatgctacccctcgcatacagtagaaaatagcactcctagaggactaaagggggctaccaggcagccctcccagcccttttgcaggtggccccctagagccaaaaatcgcctttgctatgtcctaaaaatcgcctacaaaatttcagcgccctcggtggcggccgttatgacagagcaaacagccgtctgccacgtcggaaaaaatgccctttggaccctcccagatgacgatgggcgactatttgtaaaatttttaaatcgaaaattatttctgtaaatattttaataaataaaatttaaaataaaaaaaatcggttgtaggcccacttatggctggttagcttgggctcagcaagccgcgacggaaaaggcgccaacgtaaccggttcagtgttctaacgggtcatgagggtggaactcaccttgtaaattgtaatttgtaataaaacagtaaatgaaccttctctcccaaccttcctatgtcccaaagaaaaaaaatataagagaaaaaaataattaggcagctgatatccatatagccttgttgtttaaaaattaaattacctaatttttcttcaagttaatagttttgttggtcgctttaacttacatgatagtttgtttggtacttataaataaactataagtaaattga

SEQ ID NO: 66153 - DNA, 580 bp, Oryza sativa
agccccatgcaccgacctgtagttgcattagtaaggccctgtttagttcataaaattttttcccaaaaacatcacattgaatatttggatacatacatgaaacatcaaatatagataaatgaaaaaaattgcacagttatggagaaaatcgcaagacgaatcttttgagtttaattaatccatgattagccataagtgctaaagtaacccatatgtgctaatgaggggttaattaggctcaaaagatccatctcgcggtttccaggcgagttctgaaattagttttttcattcgtgtccgaaaggctcttccgacaacaggtcaaattaacatccgatataacattcaaaaaattttctttttgcggagccctaaaaaccatccctggacgcgtggacggataggaatacatcgagcgaggcatatggaatggaatccattcagcagatcatcgaggcaggcaacggccacacgtgcacacatggtttcgcccaaaaaccacgtcccgccgcttctccggtgctatctacctagttcgatcgtccaccgatttcattccgcttcgtctcgcctataaatt

SEQ ID NO: 66154 - DNA, 539 bp, Oryza sativa
  unsure (1)..(539): unsure at all n locations
gtccaatgattctttcttcttccgctacatcgatctcttgggtcttggctggcctgcctataaattcgcaggcccccatgcctcttcccaatccaatccatccatctcccttgcttgccgtacactcgatctactctctcacacactcgtgtgatctctctctctctctctcgctagtcgattggcttgcctagctctctcaaactgctctagtgcagttcagcanaatctaagtgtctgaaactaatttacatggcaacggtgacccgtgcacacctggagcagaggctcgccctcgccaagcgctgctcgcgtggtacgtgtagtagtcatgaactacaatgttcttcgtctttgcgttaattgaattccatggcacttattaactgaatatatatcgactgatgcatatatacgtgcgtgctttgtgaatctgcagaggcaaacattgcaggggttaaggcggctgccgttgcgaccatcgcttctgcagttcccaccgtgagtaaactctctttatatatatatatctctctctc

SEQ ID NO: 66155 - DNA, 1532 bp, Oryza sativa
  unsure (1)..(1532): unsure at all n locations
gttgttgcagggtacatccactattgacagtagacatcacatgagcaggttattggttgcagtttacagagtagaagacaaagatgtctgcagactgcagccatgtggtgctgcagaacggctgcatttctgttacaacagaaagatgaatggaatgagtagtgctgatttaagcccattctggcagtttcatgctaacttctttatggattgcanctgtgttgtaaaatgaaaaggccaacatggttaaatggatgtaatgctagcccataatcttatctgctgggtagtttcaaaagaagccgatgatcacaaccttcaagaaagagttaaaacaaacagcgatcctcttaggctgtcatcggttcgcctaatgctggttataagcagtacggtttatcaacaagaaaaacgataatttgtgggtaaaaattttatatatgtgtccacataatttatttcctactgtttgacgcggtccacagatttctgaaatctgaataatctaacacagaatttccaccaacatgacagggcagagcaggaaacagtccatccaaggatgcttctttatttccaaaggccattacattcatttgataaaataacctggaggtgaaggctaataggctgtgactttgagcaaaagcttagtaatggatgcgaaaatatcgcatcaaataattcaatgtcgacaaaaggaatgagcaatggggacataaaggtcaggttacataatagagggaacaaagctaggcttaacaatgacagaattctgtgccaaaagaaagacaaaaactacagctatgagttgtcgaaacttaggatgaagatctaatctaaaaagcataatgggaccatgggtcctagttctgaagcataaacgtttgcaagaagtggtgcagcttcaagaagaagttagatcgatggcccatactctgtaatcatgctctagtgtcaagggtgctttgatgctatatcaaaattccaaggtgacgataaaaccaaagctgtttatcctcaagcanngattcactatttcaccgtgcaggacatgaggtggtgtaagtgtctctcatgcatgcgaatctcagcatcaggtatcatgtgatctagaaattcctcggcgtcgctgaaaattggagagaacaagataaaaacattttagcatagtctactcctgctacatatcaagcaaaacaatgtagagtctaaaaacaaaaaagttgtcgctgtctgtggttacaaggaaagacatgaggaccactttggggaataaggacccacgcggttgtgcactgacatatactggatgcaagaacattgcatcaactagctcaccgtaggacatggaaagcgataggtctagtaaagctttagtaataattttcctttttgtaagaatatagcatcaatgtgaagttgtggatgtctaattaagactaaaagtttcacagggaaccacgtcactgacaacttcaaagtcctaggaaaccttgcaaaagaactaggactctacatatataagtaaa

SEQ ID NO: 66156 - DNA, 803 bp, Oryza sativa
cagcccgttttccttaaagttctggtaggagtttatcgctacccggcgataaccacacggttaccaagaaaaacacgaggtttcagaaactaatattgacggagcgtggggctcctcaccgggagaccgcgcaggcccccctttaccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctctttttttgtggggacttacccccccccctttttcataaatggacggagatttgtatagttgccgtccgagtcaccttctgatgagacggcccacaactaccttcactttcgccgggagcaggtgcgacgtggaatcgtggctgtctactaacgacatgaccggtatcagaccagtcacgtcggtcattcttgccaccacgtgtcagcttagcaatctacatgctcgcccttcttcacacaacatcttgcctgtaatggttaggatgaagcctggcatatatctgaccaggactaacgtgccatctctaggaggtaacacgctagctccagctggggacgagcgcctagaagccctcgtcctgacgggatggg

SEQ ID NO: 66157 - DNA, 3702 bp, Oryza sativa
tactccctccatctcataatttaaagattttaagtttttgttggcactgtttgaccactcatcttattttaaaaatttttagaaatattatttatttttttacttactttattatccaaagtattttaatcacaacttttcttttttttatatttacataaattttttaaataagacgagtggttaaacactataagcaaaaccttaaaatcccttatattatgggatggagggagtaaggtttagtaggctgtgaggcgcagcagaggccggccatcgttgacactgcgtgtgggcccatgcatcttgaatactccggcttgccggcggccgagggcaaaagcgtaaatatataaagactaaaaaaaatacctgattgatccgtcgttagcataagccaattctctgatacgcacggtgactggagccggccggtggacggtggtcaccgacagctcctcccggttaacctgaagctgcaccggagtccggtcacctccctttataaaaatcaaaaagagagaaaaaaaaacaacaagatctcctttcttttcatatctgtttctctcttttttttctttgcactaatgacttagccagaagaatatgttcttccactttttttttgaaaaataatattagtataattgagattgtgctctaattggtgccaagggagaacgcatattagacctcacctgactgcatctgcatgcaccagaagggcagtaggaaacaaggaacaaacatgaacatctgggcccacttgtctgtgaatcacatgcagatgtgcaatgttggtagtggtactgaccctcatcggttacccgtattccctaataatctgttttagcttattaaggaataaaaattaatttataagtaaaacttttatatatctgttcgtagcgatttaaagctaacactgtatagaaattatgttgcggatatcttaaaatttgacttcaaaattaaactcgaaaatataaaatttaacttttgctttaatttattaggccaaccgatgaactccgtggtacttgcataggagcagctagtgtgtgtatagaaaattggttggggctcttgtgtactggcaacacagtagatggatccagattgtcacagcttctttttttttttgtcaacggcgtgcagaatgcagacggatgtgtgtaaatatatgtgtcgtgttgcgtgaggtggggactaatcaaggacccatcgtctcgtaattaggtgatttggtgatgatgagaggagggatgtcttctggccggtgcacaaacaaattttactttattagaacttactactgttagagcacaatggtacaaagtagtgtacttcaccgttttaaaatataacaatttaaataatggatattagatataatctagtttcacgaatatggttatatctgatctagtactatgttgctactatattttagaatgacgggagtatatgctattctagggccaaattgaaatttaacgttgttatagattaacctcaatttttcgtgagcacatttccttaattgctaaatgatgattttttaaaaaaagcactacatattttttttctaaaaataaaaataaaaataaaaatatatttaagtttataataattaatatttgattaatcacacactaataatttatctcattttgcgtgctgtcaaatatcccctctaaatgccagaatggatgtagccttaatttggttggttattgctattgtatatgtaatatcatagctgataactagttgaatactccatccgtcccaaaatataagggattttgggtggatgggatgtatcctaatactacgaatctagacatactctgtccagattcactcgtagcactaggatacttacatccaataaaaatcccttatattcatggacgaatggagtatgtatttagagaagaattaacttcgtaaatgaagttatgggttcttttctcccctaaatatttgagcaaaagtactacccacatactccctcccttcagaaaaaataaattgctggctatgtataactagtagatgcccctcgcatcatagcaggacattagaactcctttgataaaaaaaaacattgatatgatagttgatatctcatagccacttcgatccaatggctgaacaatttatgacagggctaaatttgagagctcccatataacaaattaatgtatttagtgagtcgtgactatttcatagaaataggggataagctattcgattcataaaaataaaataccagtacaggagtgaggctaacttttaaaggggtgtattacagattagtatgttaagagggattaaggtaattaactagatgttttttcaccaaaaaaattgaaataaaaatggaataaagtagtgagacaaaaaggagaggcggaaagcatgcgcctatccaagacagaactggagtgcacccttttataatccccacagttcaacgtgcaacaaaggtaacagtatgcacctaagcaccgcacaagatcacatccaaagtgcacttaatttcatagcatatatagcataaaaattattgcctcacttgtacattgtttttcttgttgacgttttatatcgccttttgccatattagaacccatacagatcttcttttttgtaattttgaggtttttagccttacctctgtacaacattgctttacataattaatattcatacatatcggactttattcatacatttaggcacatcaaaatccatggttgagagtctggccggggaaaaaaataaagcttaaaatataaaaaagtacatactccttttgttcgaaagaaaattataattctacgttgtttagcggaggttaagctcgggtaaaaatgacttggatgctctttaataaatgaggtagtgttaagggtgcttttgggcagttcatttgggaatgaatttaactgtaaagtgattgatggagaataattagtattatgaacggtggtaggactgtttatatcatcctggaattaataacggaaatagaggtaaataaatataactatatgttaataaatttggccctcttcacgccagttttacaggttaccaagcccggtttagttcccaaatttttttcacaaaaataccacttcaaatctttggacacatgcattaaatattgataaaaataaaaactaattgcacagttaagaaggagatcgtgagacgaatcattcgagcctaattagttcatgattagccataagtgctacaataacacacacgtactaatgactgattaattatcctcaaaagattcgtctcgcggtttccagacgagttatgaaaatagttttttcattcgtgtctgaaaaccccttctaacatccggtcaaacattcgatgtaacatctaaaaaattttcttttcgcgaactaaacagggcccaagtactactataatgacccaaaaaaaaatctcacatacaccgccactgatgtcacttgtgagcaaaagaagctaagaggctcatcggttgcccacatttcctaataaatcaaaagcaacttaaaagctaacgctaaaaagaaatttatattgaaaatatcttaaaattaatttaaaaatttaaaatttaacttttactttaacttattataggtctaccgatgggggctttaaaaaaaattcctaagaactcac

SEQ ID NO: 66158 - DNA, 8125 bp, Oryza sativa
  unsure (1)..(8125): unsure at all n locations
attttaaagtgcctatatataacatagtctcaaattataggcactcttatgtttaaaaaaatcaaactcggtaacttttcactaataactatacgaataatatctacaccagtattatatacgttaagtcattacattcatattttaaaatacttttatgtaatgctaattttatagttgttgattatataatacaaaataaattaatgattaaattatgttattgaaaaccgtgtaaaaatacaggtcttataatttaggacagatggagtaattcataacacatacaaatgtaatttttaattactaaatagatatatgtctttaaaatatgctaaactagcgctctcacggggcagggtgcatctttagatatttcaaaaacgcaacaccaaaatggatacatactggaatatacatttcttttctagaaaaaagaagaacatgcattttcaaaaataaaaatcctcagttccattggctcaaatacaaaacgtgcaaattcataaaaaagaattacttattaacccggtaaaccctagctagcagcgtttgttactatgctttccgcacaatatagaagttaaacctcaatgtagagttttgtgaagtgtgtggaactgaattataaatgtaaaggtcatatctattacaagggaccataaataaaaatagtatgtttctgctacaaaccaatagatcgatcgatgcttttttttatcagtatttaaacctaaaatttaaatcccattaaataatactagtatgtgtccaaattcatatggatattaatgaacctaaacgataaatttatacgataaatttatacggatgccagtaaacctaaaggggagaagccaaaacgttgttttatgacgtgaaacaatgggggagaagccgtggaacggagagagagtaccatccaaattttgctggtggtatggacgggattctcttatctcaaaggtttactgtatagttgacacctcaaagcagagttatccatcaaagtaacataaacccatgatttataaaagtcatggcaaaacatcataccatcaaatttatcccatgggcctcatgtatgaatatgacgagcaaccacaggcgatttcccaaactggagcattgagtaccagagcttataccagaggcaataatgaacactacatgaacaaaaaggtaaatccatggaatatatacgaagatagacagcttgcgatgtgctatagtccaaaacttctgatttgccaaaataaagtttgatgttgcaatgcaaactaaactcattctaaagatgcagagaaggtaaagcttaatccgtttcgtcaacaaccttggttcccagccccttcaaaccctcaggagggacctcggccacagtgaccagagagtagagctcttccttggcatcctcctcgtcattcctcttgcgggcgatcctcacacgaaccctccgcggcacactcctgatcccactgctccagatgtgcttgttgagcttcacatcgaccctgacatctgtagtgcccatagccttctgcgcaaacttcctgatctctttgatggcattgggcgccttcttcttgaatgtactattcaacataagagaaaaccattagagttatccatcagaacaggttgtgatattcatgtttatgaacagtataatgtagtgatggcataatgttgtgttggatgagaaatcacagcacttgatttctagaggttcagttaaataactacataaaacaaggttaaggcagtaaaaataggtcaccatgccaagaaaataaatatgcaggacacgaagttaagatcatttcgtgttcagataaatacattgagtgctgattaaattcaaaagcgagcactacgaaatacacaaaattcagtatgaaaatttggtaaaaggaccaaagaagcatttccttggtcttcattatcaattattaagtttgtgccacatttcaaatattagggtaaacccagtcagtgcatccactagaattcaattaacaagtttacagggtactcaatagttgcatccaaaatgcaaatgcgactcgcattgtgcccatcaattagctatatacatcttcccaaggaaggccaaacgagttaacgactcattgaacagtccttaagcatagcttgataactagataacttgttgggatgttgttggtgagcaatgacaactagttgcaattccgacgagcactgggcgtggtagtacacaaatagaagccaatcttatcttaggaagaaaacacacgagaacaacaatgagcacatttaccaccgtaaattcaaatctaaaactactgttcagggcatgcaattcagatgtaataaaggaaaaaacaaaaaaaaaacaattgagtgatccatccatcgtatcagatctcacagttgacgtagcggggaacagaagaggggaggaaacggaaggacgtaccagctgtggaggcgcttgtggaggttgatggtgtactccctcgtcaccacctcctccttcctcgccgctcctcccttcttctccaccatcttcttctccttcttcccttcgccctaggctgggtttgccgctgttccggcggcgcgagaggaaaccctatctccgacgcggtggtgcctttcatacctgcacctcgctgagtaccctgtgggccgttggaaattccactcatgggctgggcagggccacgctttcgagccgagcagaggcggatgggccgcgtttcgcgtgtgttcatgggtcccgtctgaccgatatgagaccaaaggcaaaaggaaaaaaaaaagttaatgggatccatgccactgcaacttttgcgaaataaaaaaaataccactactatttgtcatatcggctacatgccactggaaatttctaaaattgaaaccatgcactcccatccctttttccatctccgttcccgtcctcatcccctccctccttcctcatctccgttcccgacttcatcaccctctccggcgagcggtagagcttgaggagggattgcgccttccctttccctctccgtcgtcaacacgatctcctccttcccgccactacatattcctcttgccggtgaacttccaccgcacgcgcacaagcacagtcatcgtagactgcggcgatctccatggctccatccggcggggtgatgatggggtgcgcgagcacgttacacttgaacgcctgcgcgtgggcaacgcacacggctgcgaggcacgcgaagcctgcggatgggtaagagggcggggaagacgacatgcaagggcggcgaggagggagaagatgaacggggtgggcggcgaggcctccggatgtgggagtagagggcgagggaggcggccgcgggggcgcagcggcgggctagcgtggcgtggagcgagtagccccggaagggcgctgacgagaagacggcggcagaggaggaagttggggtccggagctaggggaggaggcagcggaggcggcgtaggagctcgggagccgccgccgccgtcgttgtcctcgatccaatctgtggccgtcgctgccgtcctcgatgccatctggagctcgggagccgtcaccgctgtcctcgatccgcaacgggaggtctcgacagatgccgccgccgctgtcctcgacaccatctgtggcgggagtgcacaggagccgctgccaccgtcgtcgccattgtcctctttgccatcgcaaggatggaggaaaagatggggaagaaagaggagggagatggaaacggttaaaccggggggaacgaaacggcgtgagagaggagacggaaaaagtgacggaagtgatatggttttaattttagaaaattctagtggcatgtagccgatatgacgaatagtagtggcatttttttaatttcgcaaagttgaagtggcatggatccaattaaccaaaaaaaaacctacataggggatccgcatcttgtcaccgaatgccaagatcgtccttgaaatgtaaaaccggatacaacgtatcctctaacttacaaaaccagtacgaacgagatctctcgacaacggttttggttgacgtggcttctacgcctcctccaccgccgtgaggagcccatctgccgtcgttacacctcctccgccactctgcctccgccaccgcattgaggagctcatccgccgccgctatgcctccttcatcagcgatgccgctctgtctcctccaccgtcgtgaagatcccgtccgccgctgctatgctggcatcgccattccgtcgtccgccgccgctacgcctcatccatcgtcgcgacgagcccgtccgtcgcctctacgcgcctccttctctatcggcgtcgttgcttcgcctcctccaccgccgtgaggagcccatccgccgtcgctacacctcctccgccgctccacctctgccaccgcagcgaggagcttgtccgctgctactacgcctcctttgtcggcgatgccgctccatctcctccaccgtcttgaagatcccgtccgccgctactatgctggcgccgccgttccgtcgtccgccgccgctacgcctcctccgtcaacgtttctgctccgcctcctccaccgacgtgaggagcttgtccgccgctgctacgcctcctctgccggtgtcgttgctagcttcgcgtgctccaccgccacgaggagcccgtccgccgctgcttcgcctcttccacaaccaccgctcctttccccgatcgcataggttcttgccatcattgcatgccggaccagagaggagaggctgactagtgagtcccacaccagtttctacccagcgttcctatgttgccatgccatgtaggcaaaagtgacaaatagttaagaagatatctcttaagaggaaaaaaataagtgcaaacctatgaggagcatttggataattgtcgaatctaaaagtgacaaatcgtttcccggggtgggtgggggagagagactcccaccgtcttgtcattcttctctactcttttcatcctataatataagggattttggttggatgagatatatagctaaaattttaagttttataatattactatatatttcatcaaaccaaaatttcttatattatattataggatgaaaggagtagttctctgcatacattctgagttgtcccctgatcccgaatcatcatgaccacggggaagcaaggatggagcctcctgtggaactggaagcccaatcctccggcctatcctacattcctcagcatgaccacctgccggcaatgttagaaattaatctcgttcttttctccaataagagttggataaagattaagattttcatggcacgcttttccaattgctaaacggtatgtttcgtgcaaaaacttttatatgaaagttgctctaaaatatcatatgtatctacttttcaaatntgtaataattaaagctcaatcaatcatgcgttaataccaccccgttttacgtaaaaaacttaatcttcatcttcaagaaaaaagaataccatggcccttgttgggattctccaggctattaaatacccatctggaatattgctatttagaagtaataaacgtagattactgacaaaacccattccataacctctaggctattttgcgagacgaatctaacgaggtatattaatccatgatttgctacagtaatgttacagtaatcatccgctaatcatttaaaatgttacagatagacaaatacacaagggctttgttgctatatctctgtaactagctggtgttaatgagaagaaaacagagaaaagggcgcacgttgtttcagtgccacaaagctcttgtgtatttgtctgtgttcgtgtttcttcctcgctgcctcatctagaaagtgtagcctgtattcccgtgagttgctttgatccctacaggcaagatatcgagctgttgcgcgcatcgatgagaagcggcgtggggatggtgagtggcgacgggagcgggagcgagagcgaggcagccgccagatcgggcgaccatcgctggatccatcggctgccattaacccaccacgctaggcttcacccagtggcgctgctccttgggcgagagggctccgtccgtgttcttgctttccttgcggagaccaaggccgcacggacgcatgagttgagctcacctgacctgagcggctctgcttgaagctgatgctgggatccaatttccccctgcattgattttacccattcagcgggtgtttaaattcaggggtgtaaagttttggcgcgttatatcggatatacggacacacatttaaagtattgaacatagtctaataacaaaataaattacataatccgcctgtaaaccgcgagatgaatttattaatcataattaattcatcattagcaaatggttactgtagcaccatattgttaaatcatggagcaattagatttaaaagattcgtctcgcaaattagttgcaatatgtgcaattagttactttttagcctatatttaatacttcatgtaggtgttaaaatgtttgaagtgacaggtaaaaaaattttgaggtgggatttaaacataccctcatagtgtggagagctagctatgtacagaatattcagttagattaggtctcaaatacaaataataaattcaaaactaaaattactacgaacttagtgtgttttgtaatagatctgcaaatatttctcgagattttacctgacaccctttattttcataatttttattttactagaaaaaaatacccgtgcgttgcaacgggtaaatactatcttaaatcttattattgttatacggtttagctaaattaaaattcactgtaggaatttgcttggatattatttttacaagatcatgaactataattaggagttcaatcgttaaaaattagcatgtaaggttttgaaagagatttcttatatgactccttctatatttctaaaagcaaacgaatttaaaaacctacttaaatataaatctgtaatttcaaaaggcaatgaacttaggaagaaaaaacacgagaacaacaatgagcacatttaccaccgtaaattcaaatctaaaactactgttcagggcatgcaattcagatgtaataaagaaaaaacaaaaaaaacaattgagtgatccatccatcgtatcagatctcacagttgacgtagctgggagcagaagaggggatgaaacggaaggacgcacgtgtaccagccgtggaggcgcttgtggaggttgatggtgtactccctcgtcaccactagggctgggcaaaaagctcgaagctcgttagggctgggcaaaaagctcgaagctcgtggctcggatcggctcgtttcaggctcggctcggatcgactcgagtttggagtcttaacgagccgagccgagccagctgttttgctcgttaagcaaacaagccgagctcgagccagctcgcgagttactcggtaggctcgttaaactcgcatagctcaaaaatcagacatgcagcccaacccaataaggaagcccaagttcctagcccaacagcccaagtacccagtaaaaaggaaaaaccgtagctttgaccatcctcagtcagccgagggcccgaggcgcctctctcgcgcatgccgttgcaggctgctgccgtggccttctcttgcgccactgtagcgctgcctcgtgccctcgcccttctccttgcaccgccggcccgccacaggccgcaacattgccgttgccctgcccaccggctcctcctcccgcaggctgcagccgcaagggccgcaaggccacggcgacgactccggtcgctcctcccgcagccacagcgccacgccgacgatgccgatgaacgccgtcctcccaccgcagccgccaggccacgccgaccacgccccttctcccgcagccgccgcagggccttcatggatagggagcgccgattggcaagcatggagtccaagaaccacagcaaggggaagaaatcatcagaagcttgtccaggcagcagccacctcgcctctgttcagaagccaccaagacaaagacctaaatcaaatccaccaacctcacatccagtgctgcatcaatttttttcacaatctgtagcaattttgtttcctcattttatcactgattgaaccat

SEQ ID NO: 66159 - DNA, 10887 bp, Oryza sativa
ttttccatattgttggccatattcaccaattgttattaaaccaccagcatcttcatcatgcatgtaaaccgttattggcatcctatgaacagaatatgatgttagatctctattactctataagacaacagctgaaagcagtgttcatacttctatgctacctgatagctacattttcattccaccaatacaagggtgtacttggttttaaaaatccaactaccctaaatttaatcaattcgattaaaaaaatccaattcatcgtctcatggtgatattgttggaatttaggtctcaaaatgatttgacttgatcaaatcccttttctgttcacacagacatctcacactacagtaaaaacaaaggtttctttttcttttcattatatatatgtatgttgtgttatatggaactctataatacctgaacgatataaaattttagctggcaagcacaaatataacattttggtgtcattaccgacagtgatagctatgaactatgacatctttgaaatcaatgtaactagaacacataatagaccctactacttactcaagaacatgtgaagccatgaataattctggttcaccgccccacacatgtggatgcctaatatgggacacatatgtgtcgaaatctccctcaataaacctgcaaatcggtattacatcaaaacacagtaatcgaaatatattgatgataacaacttacagcagcattaaaaatgatgagaaagggtatcaaatcaactaaccattccgattcttcccgcctcttaacaaattcatcagcaacctagaaataattaaattatatctgagcttagaaaagaaacaacacaaataaccaaaagtatgactatacacaagaaacaagctataccattgccctcaattcgtcagctagctttctctgaagatcttcatttggtatgggtcttcctgccctaatgcatgccccatgaatcacagagcggaataagcatcttccatctccaggaatccctaggggttttgtaaataaatcacatgttatcacatactactattctcaagatccaaattaacccccaacaagcaaaattgctaaacctaaaaaaatgaatacccacctgttactgaataatccgtatagacttctttgccatgagttgaactggtagatgctgctgaattgctgatgcttatctccacaggaacctcagcatttgctattccagaaactgcaaaacctaagcaaagtccactggttgtacctcctattttttgatgcaaacctctccatttccagctcatactagagaaattgtcacgggaaggcatgtcgagcttcatatttaaactaccttctttgcctgacagtccacaacggaactgccgacccactaagctaacaaagtacctcagactaggccggtcagaagattttatattcctatgtagagaacaatcgacaagacccagcttcacattataactggatgtctgcgagcgtgaacacttccgtaatcccaaactctgtgttaatcctccatgaaactgactagattgggaatacatggtacgtttagaaggtcgccgcaaattgactgcagatgagtagagccgcatccggtccaaccaatatcagctgtacacgaatgaccaaattcaatgtcaaaactcatgcaaaatggtgacatttttatttccaacttgcttttgttttgtttttcaaaaaaaaaaatatgacacccgttttattgcattaatatgagaaacacaagattagggtcttccaactaaagtagatcaatcagttcagcaacagcactactccacacgatgttgttcagccaaaaaatccatacaaaagattttgcgatgacaaagcgtacactcgaaaataacgaagtcgggaactgatactacatggcttttgctaacgataaacaacgcgaaactattagtattactaacaaataaacatatccgacctaccaaaagcaacggaatatcaaaatgctgcacaaacaaaacattcaggtacgcagcaccaaattctccgcgcacaatctctcatctcaacgatggtatacacatacaccagcatagaaccacagccactatagacgagggatcagaggcacataccagcgaaccaacctaaccaaatccagcgaagaaaaaagaaagaattcccctcaattcctgctaacaagacaaggagaagcagaggggggatcacgctgacgcccccctgggtcctatgtaagctaagattcccccacctttgcccttcccttgggcggcgaggagaagtgaaggggaggtgaaaggaggagtgtgtgcttcgatttcgcttcgacgcgggaggaggaggaggaggaggatctcgcgaagtgtatttgctgcagcgagggaaggggatgccattggcgatgggggaggaggaggaagctgaaggctcaagtttcccgacggtcgagaggattccggaacgaacacgacagagtacggcgattgtggggctttgttatataccattccatgggcccatcacgcctgaattgggtggtttatgggcctattgtttacagccgttttagtccttaatgggccttgatttttgctagccaggaggacctaatgcgtcactggtaggggagtactccgtaaaaaaaaaaaaaatcaacttcggactgcgagcctatgtttaaatttataactagaaattaatttttatgagatgaaggaattaatattaaagagattgtctcaagcaatcaaacatatacatctctagatctggatttatgataaccttttgatggtacttatctgtccatatagcccatgcgaattttttgataaatatatgtgccccttcggcttggtgccaccgctctgaccgccccgccccgccgctccgtccaccgcactccactctgcccgtcgccgcctcgttcatctgcccgccctgcgctcctgctgctggccgccgccgccgtagcgccggcggctagacctccctggtgcctgaagagaggagaggagagagagatgaagtgaggggaggtggggaaagaggaggaaggaggagactaagaatgacatgtaggcccacgtgggccccaccatctttattttttagctgacatttaggcccacgtggccccaccatttctttattaatttatatgtgaaactgacatgtgggtcctacgaagtttattatttttctagatcgaattgccacgtaagtgtcacgtcaatgccatatcagataaagaccaagtcaaattagccacgtaagcgccacgtcagccaaaaccgccgagggacctcatctgcactggttttgacagttgaaggacctgttgtatctggttttctggttgaaggacgaaaatcggattcgttgacaagttaagggacctcagatgaacttattccaaagaaaacaccaactgactatgagcctatgggcctgtttgaggagcttaaaattttaataagcagctggttggtagctagcttttgagaatttcttgcttctcattttctgaattctacaactacagcttcttagaatataaaaaaaacaggactgtttgagaagcttctaattctgagaaaaactgcaacaactataagtttcctaaataggctctatgtctagattcacagccagaagttaatttctacgagaggaaggaaatagtactgaagagactgtctcaagcaatcaaacatatagtactccccctagatccggattcatgataacattttgatggtacttgtctgtccatatagcccactcgaattttttgataaatatctgtggccatgtttggaacgaatgaaaactatattgttcgttcctgcagaaactaaagtaatctagcacgtatccaacctttatttgaaaatcttgtatgggaatttattgatagcaccgtaaaaatcatgaaaaacgaagtaactatgtgattttccttcttaatctgatagtcgagctatggccgataggatatactagaaaagaagcagccaaagataaattacgagtaaaacttttaggctgcgttcggaaggggttcctggcacgtaaaacgaagcacatattcttacataaataattaagtattattatttttgcaaaatggattaatataattttttcaaaacaactgtcgtgtgtgtgggtatatatatatagttgcataaaaacacgccgtttagtagtttaaaaaacgtacgcgtggaaaacaagagaggtgagttgaaaaaagtggcataagaacacatccttaatctatattattattggattaagaatcaatgaacaataaaaatctaaaaccaacttcaaaatttagtttcaaaaccaagatttttagtcgtggttaataaacaacataccgacagagttatagacgccgagagatgtctagctgaagcatccaggcttggtatttgcttcgttgcttgtggcaacacatggatcatggatgcacctgagtccacaaaccgaaaaggaacttcgcaaagctccaagaggaaccatgttccatgaaatggcctactggccctatgcctcatgtggccacatgattaaagaaaatgtatttgtaaagccagttaccttctcctttgctatctgctttagcaaaggacactgtcacaaaaccatctctaacttggtagaaaaaaaattctaaggcttacgcctatgaatcccttttcgatgggattgaaggagattgaagtaataaaagttcatataactgttaaccctttttccgttgggattgaaggagatatgaagaaaaataattccatatctattgagacgtggaactaatcggtttagattctttagtattaaccgaacgagctctaacaagacattacaaaaatgctaaaattcgtgcgctgatcaggctgaaataacagtagacgagtcaaatgcatgcatgtcagcatgtgatctgatacatgaaccctatactgaactaaaactacttgtagagctatagggcattgatacggatgaatgcacatcacgagtcaggacagggacgtgcctatggttcacatcgtttggcttatttcctaataagtcaaaacagcttattagaaaataaaaatgaatttgtagatgaaacttttataaatatgttttttgatgacttaaaagccaatgttgtaaaagaaactacgttaaaaatatctcaaaatcaattttaaaattaagtttgaaaatttaaaatttggctttttctttggctgattaggccatccgatgggagcatatgatcagtggcattcagcactctgtctgcgtggatttggttattagattatccccaatcgatcaatgtaatgctccatcagtttaggctaattattaggtgccgacccttaactccgggcccgcgcaacgcgcagatcacaagagccatgagtgccaggtgggcccaccggtccagacagctgtgctgtggtgctgcagcccggttccccatcacccacccctgtctacgatctgacctggtccaccgccgcattcacgtcgttggctcgttgcatgtggcgtggtcaatcactggtcaattattatcaccattttatctactagtcccggtcaattatgagtactcccaccatactataatacaaggatattttattaaaaaaaccttttagaattattatttattttatttgtgacttactttattatctgaagtattttaaacataaattttcgttttttatatttgcacaaatattttaaataggacgagtggtcaaacagtataagaaaaagttaaaatcctttatattgaagagagtatttgggcagtcaatctccttctcactcctcgagaggaaaaaacaaattgtgctgaaataacatgtgcagagatgagaaacaacaacttgtagatgaatatttttctcacaccagtcaaatacggatgaagatcctctaacttaagttaaaagaacggatgtctctctgatatatgagtcataccttctagactggtagggattcatgtttctttaactttaaattagtggagcttcttccgttagatattgtgtttggttctttaggctcctattggatagcctaatcaatcaaagaaaaaactaaatttttaatttttaaatttagttttaagattgatttcgagatattttcaacgtagtttctttttcagcattgacttttaaatcactaagaacgcacatataaagttttacctacaaatttatctttatgggcctttagactgtactccttacaacgtgctccatgatatatgtatgcttgcgaattaaccatccaaacagcaacaagttcttgcatatgcgacagtatgcttgtttaatcatgggagtaattaattaatcaaagtttcgtcgtcgtcatgccgttgcttgcaccccgtacgtacgtgcaggatacacagtgatcgatctgcatcgatctagtcgatcgatcgccgagccggcagatcgatcgaccagccatgtgtccgagaacgaaccagcggccgcgcccacgttggattgctgcaaaccaatggatcgatccatccatgcgccaagtgatcgatcgatccatccatgaatcctcacctcaccggtcgacgctgcggcgcagtacggcacgtccatgcgcttacacagcggcgagaatatggctgcacgtgcccatgcgcccggctcgtccctgtctgcaatctctctagcttaattaagctatcgtcaatcacaatgaaatttaatttgtttgctaactggtttattgattactagtagataatgatgtgtcggatatggccgtagaggaaattctacagcgtccacttcgacttatccgttgtaaaaaggtttaaagagtttttcatttaatagtagtagagttgagaggggaggatccatttcgagtttagggctttaggctatattattttcttcaactctaaacttcaattttcttgttttccgttagtacctttttcaaaatgttaataatatattttttaaaaaaatttaaataaatctatttttaaatttataatagttaatatttagtttaatcgtgtattaacgagattttttgtgtcgcgtacgtgaaatgtttctctccaatttgaacaaacgaacgaggaaacaagattgttagctgcacgcttcttaaaaatacattcttcccaaaagaattcctatggcgactaattgtttcaaattatttgttaaattcatttccaaacatttaaattattcatcatataatgagtacatagtctgcgataataatctgatggataatatgtttcaaacagaactgactaatagtgcatatactgtatacttgaagaagcagattttttatgtcagcctattttaagccaccaagtatttctatttctttacaaattcgtcctatcaaatccctctcaaggcttttgtgctaaattactgtgtttcaacaagcagtagcttaagatcggcgagaagcttctctggtcccggccggccttcccctagatcttcagattggaacgctttaagatagaacaagaaagatgctgctgctgatgtataacttagatccatacacacgtggacgacgggtgatcgtgcaatcggagaatccaacggctcgcatggcaccgtgcattgaatggggttcggtccgaagcagatcgcgcccatcatttgcactgccaacaacaccagtgacgaaaccctgtctggcgcacgcaatatggtgcgcgacgagattaaaggcgccacaccggcacggcacgtgccctgcagacgctcgtgcccccacctcatcaaatgactcttctacccctccattgcccggtctagctctagccaatcaccccatcgtctgatttaactaaggtcctatttagttcctacaaaatggtaaaagtttaactattttagtgtaggttttgtcaaaatggatctaagtagtaaaagttaacaatttgttatttgtcatttagaagtttagagtagcaaattttgctaaaaagtacggtgagaaccatattgtctctctctctactagtaaaataacaaaactttaccatgtatctaaacaccaattaataaaacttcaatgccaaaccttttatcactaaattttttttaaaaaaattgccacagtaaatttatctaaatatgccctaaaagcctacttattatgctgttgttagcccaagggtaagatgggtattttggccactgtgaatgaatgctccatcagctatagattctctggttttgattgcttcgtaggctaaagctaaaaaaactgaagaatgcttaacgaacgcgcttggtggagggtaatacggtcatttcaacactctgccaccctctactaataaagcttagctctgcgagctcaccactctcactctgcagtgcagtgcccacgcgagccgagacgagacgatggcatcatctcccgctccaagccccgccgcgccgccgctcctcctcgccgcgctcgcggcgctcgccgtggtcgcgtccgcctccgccgccgcgtgctccgcgggcgaccgggacgcgctgctggcgatccgggcggtgctgtccaggcccacctcggggtgttctcgtcgtggacgggcaccgactgctgcaccagctggtacggcgtgagctgcgatcccaccaccggccgcgtcgccgacctcaccctccgcggcgaggccgacgaccccgtcatggcgcccgccggccgcccggcctccggcgtcatgtccggctacatctccgacgcggtgtgccgcctcggccgcctctcctccctcatcctcgccgactggaagcagatctccgggcccatcccgccgtgcgtcgccaccgccctcccttacctccgcatcctcgagctccccggcaaccgcctcaccggcgagatcccgcgctccatcggcagcctctcccgcctcaccgtgctcaacctcgccgacaacctcatcgccggcgaaatcccaagctccatcacctcgctcgcgtcgctgaagcacctcgacctcaccaacaaccagctcaccggcgggatcccggacgacgtgggcgacctcaccatgctcagccgcgcgctgctcggccggaacaagctcaccggcgccatcccaacgtcggtcggctccctgacccggctcgccgacctcgacctcgccgagaacggcctcaccggcgggatcccggacagcctgggcggcgcccacgtgctcacctccctgtacctcggcggcaaccgggtctccggccggatcccggcgagcctgctgcagaacaaggggctgggcatcctgaacctgagccggaacgccgtcgagggcgccatccccgacgtgttcaccgccgagtcctacttcatggtgctcgacctgtcccggaacaggctcaccggcgccgtgccgaggtcgctgtcggcggcagcgtacgtcggccacctcgacctcagccacaaccggctgtgcggctccatccccgccggcccgccgttcgaccacctcgacgccgcctccttcgccagcaacagctgcctctgcggcggcccgctcggcaagtgcacgtgacgtgccccaaccagagccgtccgatcgatcgggagagcctgatcgaacgtgtggtgtgcgatgtaccgtgtacgatgcaacgaacttacgtgttcgtatatatggttaattagttgctgcttaagtattaactcacttgggctatagttttgggcttgggtacatatagaacaagatgagaatttgtgcctagtgtgtgtgtgtgtgagagaaagaggaagtggttaaggaaaagaagaatgttttctctttcctgcctttctcttctttatacttttaaccttttttgctagtgatttacttgatagttctactttaaagtttgtattgtacaagtgacaaaagcataagaaatgctaaagatcttgtatgagaggttgtggtttcatatttgtgcgcttgggtacttggcccaatttgaaaggtcataatagataaatggatgataaatcgtatgatttggtgataatgtttgataatacaaacgaatgatgaattaattagtatattgcaaagttaaaaagttgtcacagaaaaagtattctatgcaacttatatataaaaagatttaattggcggcttgccaatttgttaaaaaaaatatatggttttaaaaaattacaacgatttggagtttagaaagcatgccatgataatctaaaatacggagaggaaaaacccggtcttagccttaagggatttaaagttgtgattgattttgggggtatttttctaaaaaggggttgctatcaatttacttagcccacctttaattcaaaggaaatgaatcttctatggaatgcttcatttcatataagttttgaaggaaatttaacgtgaaatagaaccttatgaaaagttttctatgagtctatcttatgatccaatcaaatggttatttatgtgtttttctatattttgtaatctctattttaatttacactacatttctgttataattttgtgtttttcctattccctttaatttaaaggggccttagttatattgggtggcttgattagttggtacatagagatgcttcatatcaaacgacatgaacatcagaacatatgaacaagatacttgttctgcataataatcgcatggtgtttttgtcccctctgccattacgttcaccggttatgtagccccgtttcctggccactctccgcgttcaatccatctgtccccgttgtctcgttcttaatcaaagctctataataaattagcccagccgctatcaactcgattgaaaatgttt

SEQ ID NO: 66160 - DNA, 2354 bp, Oryza sativa
tggtcctcttccaggctgatctgcgaaggccgggtttcttgttcttcattggtgtcttgggtacagtctatcgcataatgtccgaattgaccacaagaaaaacaacagccatctctccttggttgccatgggaaactccttctcggtccaactctcaaccttctttgggggcatttattggcataatgtcctttctcaccacaaccaaaacatgtgacatttgccttccgtcttgccgtagtcagatggcagcttccatttgcagggtattgctttaagtgatttagaccgatgctgtagtcttcaggctttagtgaggattggactcgttctttgtcactagaagcttggggaggttcttcaaagagcattatgggttgttttatccccatattttgcaggccttgtaagttggaaggattcttgtgtcttggtgttggttgatccatgtcttcttgtcttgtggtaggtttattctgttagaagttagtaggttgaaggttagtaaactaaaattctcggggcccaatagtagcatgacaatgctgaattgttgtctttcttcttcatctgttcactccatttcttaatattatgctataaatcgtgttggtgagagccgtggttgtatcttgtgcagtattactgtccaatggtaccgaatctgctcaatttccttgtccaagggtgaataaaccttgatatatagtattccttatccatattgttctcacaaattattgattctcttgaggtcttcccataataggctaccccccttaaaataagaatgtttgaaaataatttaaaaaggtaacaacataaaaaaaaggttttgtacaagtatcctttgaaattgatgtatgcaaaccatttaaagttttcaagagaggtattttctcacccaatataatttgataacagatttttcaaggaagattttgtataatcatacatttagcaaaatcaatacggcaactagaaacttctgcaaccaaagcaacctttgattttattttgcaaaagaaaactcttgccaacagggcaaaatgccatatagtttgcatgcacggttcatagttgaaacaacaatacttttgaatatcccaaaataaatctcctgaaagtaattttttttggacctttttcagaaattgcaatattttcaaatggaaacaatcgcttggaaaacagttttcacaaaggttttggaaatctttcacaataatttcctttgcaaggaaagctttaggcaatagttctagaagttcagctttgcaaaccttttggaaaggatgtttacgaacacatgcgttcaaaatttgattttgcacggaattttaatttttggaaaattttgcaataaactatttagaactgaaattcacatatattttacaaagagatatttattttgaaactaattttgaccattaccagaatttaaatataatctcaaagtggttttggagacaattttgcaattacattgttggaaacaaacactcttttctctttggagaaattatctttgcaaaactttatttaaaaatgcaaaaattaattctgttttgcaaatattttttaaagacaatccccaaaacaaagttctcgggggaattaagccatatcagtttgacttgtccttggaattttgaagcaacccggagctgaaatccaacaaatccatattccttttatccttcgtccatgtatccttatccaaaatggcgttccttttattaaatttccaaattcgcatactatcttaagtgtgatacagatccatacctttgaatccttctctgtttatggaaataactagcaatcttgcatggttttctcatagatatgcagtctgtttgtcttctttttattgctctttgtgatattcccatgccgaaggtagtacatttgtggttactaacggcttagtcgatgcttcactcctactgtacgagagtgtaactagaggaaaccagttctaaaaatggtaagttctcatgatcgataagttagtttctgatcttttctcttttctttactttgtttttgtacaatatgatgcaatcgtctagtttcgaggatgaggtttcgacagcaatcaataatattcctatggcgtcttaatttcttacggtcttatcctacaattttgaagtacatgtaagaatatagaaccaatatttttcaatcacaaatgaagtagtaagatagccttttcaaagaaagggttgagatgtatggtatcaaaataattttttttcggcgcatcggaattaaacatttttgaagaggtaagatgggaaaacaacatttgaatgttttcacatttttttttcttttcagcactt

SEQ ID NO: 66161 - DNA, 7514 bp, Oryza sativa
tctcgaactacaatcgatatactctgataccagctctgtcgaccacccgattttggaaatcggaaatctcttgtgtttatcagtaccaatccctggatcagtagttggtacacacatacatagccgaatcacaacatatcacgaatgaattcaggctaaaagagttaaatgcttacattagggccaggcaggccaacaactatcagagaaacaacagcggaagacaaaataatacaagggcccggttgacatgccacaagtagtcgactggggaacgagacctagagtggaactgcactccgatcatcttgttaggtacgcaagtgcactaacaagggcttctcttcaacactctgctagaagatatatatagagcaacaatgagtacaaaagtactcagcaagccaccacacaaattgcagcaatgtacatgataatacaaggagtggctatggttactttgcgtaaagctgagtttttaaatatcatttcacaaacctaagacctagcataaactgatcaagttttaatttcattgttcattaaacagcaacgtttctatccaccatccattgtgttcccaagaatagcttcccgccactgccgtcatggttttctgtggtctaccccttctcgcctcccgagaagttgatccaccagtacaaaatcatcaagcaatatcccatcccaatcagattaagaaattcgagtctagccaagtgtaatacatgtcccggtgctcattaaccgcgagcacgactattcaaaaagatttggtttactcacaatacagtggatgtacactttacccgtactccgcgattgcccaacacatgagcctcatcccaacacatgagacgcgtcacggcaaagcctttcaataacctcacattggcagtacccgctccatgaacttacatcctcatgcactctaggcgtcataagtttctagcaatgagaggagttctggcgctcccgggaagggaagactcacacatgcattaagttatagttaagtttaggtttacacatggcagtcctaccgatggcaacaccgctgtaggcacccactcctcgcggtcctaccaatggctgccccaccgtaggcccctgcctcacacacattaagaaaaccactatgcagggatactgcctccgctcagctatttactccgctaggtctatacacattcgagaagtacggttgtacgggggtcgtttcatgcttaacttcatggctcggtccttaattgaccaggggcgcactagcctttaccagactccacccaagtcatccagccgccccagttgaaaacatttgtttagttttaatttttctttcacaaatcatctcatcaatatcttggcaatgtggcgctcatgtctccacatgccgtatctcaactaccttccctaaggtagttgcccaagcataaagcatttgataaacatgagaatgcatgaatctaaattagcattactaagcatttgccataagtgactagggactcatacgtaattatgggtacaagggaataatgagataggcaataatcaaaggcatggcataataacaagtaggatattcatcactgcatgtaattttatttgtaaacaaaacaattttacaattgggatcaacatgctcaagggatggggtgatgacttgcctgctcaggatagttcttattcttgatataatcttgatcaaccttcacctcctggaagttgcatacgttgcctcacgactaaccgatatacaatttctataatacgcgagaagaaccaatattcaacaacaaacaaatatgcacaaacaaaatataattgttggggttgaacctagggttgttcatactactcgtgtttgctaacggatagtttcttaatcattcttattgtcatggcggcttatttaggagctataatcatcataatataaatgggatacacatttcgttaattcggagttgatctatctattgagttatggaaggggtatgaccacatatgcttctaattagtttacatgggttttacagtgataaagcatgttaaagagaattatcctcacacctactctactgtacaatatcaattttatttattagcacactatttaggttaaccattatctaatcatttgatattaattatttaataattatgaatatattttattgaatagtgaattatataccattggaaaccttatgaatttagatgaatttaggttcaagtttcactcaaatccgaggtaaaatgagcaagttatgctagtttaaatattcaagtttgaattaattcgagaaattgtgaaagggtactgttcgtaactgatttatttttaatccagcattatccacaagctactgtgactgacaggtgagaccagacaaggttgactagggtcaaaccggctgtttttattcactggtgggccccatacgtcatagagaggaaacttaattttaattttagttagatttctaatcatccggacccatgcgtcataggctgggctaatcatcattaggtagaggattagtgtgcgctaataacatgtgggtcccacatggtttctctctctccccatcttcttcttttgtctcacccgttaccgagcgaggcagaggcgcggctcggcgcagctggtgtggtcggcccgagccgggacggcggcgggctgctcggcaactgccgggcagagacgcggaggatctccggcgatctcccgccggcggccaaggcgcgtggcgaagcggaggcgagcggcgcggcatagccgccatggttgagctcgggaggtttggggcttgagcgataggtgaggcctccgaccaaattgatgagtgcagaagcacctagagcgaccgagtgttcgatttcgctaataatgtggctaggtggagttgtgggatggcatgtccacggtgagctcgctggcggcgaaacagcggccgggacagcacgccgaagggctctaatagccaaaattggtgggggatttagcttctacgtgactaggaggagctataggagcgaggttttaccgagagacggcaggatgacgaagttcggcggcgcgcggctcagtgcggacgaaacaggggcggctagcggtcggcgacgcttgcaggtgttcgatgcgtggttcccaacgtccagcggtcctcgactccctcaatggcgacggcggcagcaaagctcttcctccactccctccaacctccagctccggccggggagcctcgcaatggtgatctctagcggtggtgagagagtgatcgcatgatgttcgatgaaatgcattcgagggaaaaaggcagagagggttggggtttgtatgggggcttggcttggagataagccaggatggcgtggaggataagatcggtagctggtacactcgatggctgcctatacggcctaagttagggaggttgacgtgggtaagtttcctcctctctcactgactcggggatttggggatccatggagtaatggtgccactaggattgtaggcgtcgcagctagacggctagaggagaagccgtttatctgatgggcacgacgtgggacgatgtgacacgaggagatgggtgagaggacaatgatgacaaaggggcgacgtggtggccgttatccgtcgatggcgaggcgacgggtgatgggatcgtgacggcgcgacgagacgtgcggcgccgtgtttcccggaaggaaaccggagcgagagagcgtggttaggcgtcgcgtggcgcggcgcggcacagaggggatggcgcaccggcacagacacgatgcggtgcacgggggcgacacgagatgcgaaggtggtgtggtcgatcgcgtgcgcggcgtccgggcacgagcgcggatgcggagggatgcggcgcatggcctagaagcggcgcatgacctgggagcgaatggatgcggcgcgaggagagggaggcgcggcatgcggcacacgggcaggacgccggcgcggacatgggaccggatcgaataggtgatagcccataaacagtgaccgacagaaaaagaaaagaaaaaggaagaaaaggaaaagagaaagagggaggactaaactgcaaatagctgagatttgatttggagttgagatgtagctctatatattttgcatttgagaattcaattatttgatttgaatatttatttggttattcattaattcccaaatgaatttgctttccattagattatccaaaaattatccaatataacttctaggctttgatatttcttaaaaactaattaaatattctattgtgacaatttatagtttggcaagtaatagcaaccataacatccagcatgatgcaaaagttttaaaaagttcaaaattttagtgatttttattgtcgggaattttcaggatgttacacgctcgtggtgtctagttttaggtgatgctttgtatgagagcctgccttgagggattgatttctattcggatatcgatttgctagcctccttgtttcatgttttccattaacccgccttcgcaaaccatttaggtaggttgcaaaaccacattttttgtcaattgccctacatctctagccttcttgatagccgcatgacctatttgcaagctcacactaaaaatagatccatcttacaatctctaattctctaagttccatccccaccactgatattgcaggcaaactatctgctataaaaggcaccccaccaatcgtgtatgacaaacaaagacagcttgctacagataatctcgtgtgacctaatttgcatggagaaggtaagcatgaggctggtcatggtggccttggtgttagtgggcatcgtgctggcggcgagccaggaggtcgtcgatgcatccacgtgcgtggcaacagattcccctgaacttgctgaagaaaggaaaaaacttgagaagctcacggcaatcttctctcggcctcgcggtgtttgccacgcaagcgagggttgccgcgatgaaccactactaattgatgactgatgccaccaaatgtaccagtccacacaaaatcggtgtgtgtgaggcatttcccatcttccccgacctgtgcaggaggccaaaattaggaaccggcaaatatatcccttgcaccgatttattttgctgagaaccgacgcttacagatgtttgtctatgtgtcagttctcaacagaaaccagcatatatgtactttcatatgtaccggtccttgaaaaatggcactaatgatgccactactcaattgtgctcttttgtacgtaacatttttttttatctcaagtcgtatgttgacaaactttgtgtttgtttttatatctttattggcatttcttaatcggcctcatatgcatcaagatatctaatttctctactattataaaattgaagatgtttttgccggtactttggtacgtcatctttgtttgagtcggtttttaagttcatttgcttttggaattacagatttgtatttgagtaggtttttaaattcatttgcttttggaaatatagaaggagtcatataagaaatctctttaaaaaacttgcatgctagtttgagacgattggagtcctaattatagctcatgatcttgtaaaaataatatccaagcaaatttctacagcgaatttcactttaggtaaaccgtataataataataagatataagatagtatttaaccgttgcaacgcacgggtattttttctagtaagataaaaactatgaaaataaatggtgtcaggtaaaatctcgagaaatatttgcataactactacaaaacacactaagttcatagtaattttagttttgaatttattatttgtatttgagacctaatctaactgaatatttcgcgttatagtgcttaatagcctatacaatatctagccaggtgttaggacaaagttcgtatgtatactttttttttttgccaatacattgccaactaacatttaaaaaataaccggcctcaatatcgaatgggcaaaaagccatcatgtaaacgacatgcgtccatgggccacaatgtcttcgttggacctttggctggggcattgaaagtgaaaacatatattttttttccaactaggccacgtgtagaaaatgtaggctacccgcgtacgtgaaatcgtgaaataaagggaattttttttccaaatacacatagcatccagatctggaaggtgcatgtgctgctgattttgtcgttttcttgatcgtgcatgccgatggcgcgtgaacattcacgtattagaccggtactatttctccactctctgcttctcgacaaaaggtcaatctgttaggttgggaggcggagaagaaacgattatgagggcaccaagccgtacactaatttgatgcccaaaccaaataagttctcaaaccaccactacagatgtgaggatagaagatgaagatcatttctaaagctgatcaatcagatacaacatcgcgtgcctctcaatcccttaatcatcggaacaaatccaatgaaactgcagctcgatgaccaccattgctcgcttctcctcttgaccatgcgcgctcccggctatgatcctaacagcctatgtcctcttggaggatccatcgaatacttcgatgttgacgccttgcagccatggtcatcacttgtcaccttaaatctgaagtgaacctcacaattcatttctcctaggaaaacaaacctcgaacatgaagaggagcagagaaacagatgttttttcttcaaactcataggacttgttcaaggctgtcccacatcgttgaggtaggactcttgctaagatggagcagcgacgtcgtgaagttttctaagtggcacccatttggttcatcggtacacccatatagccaagttttgtttttcaacatgttcagttttcaagttcttatatctaatcgcacccacgcgtttagtgcttatatcaccagcgcaatctacaccaaaaaaatacttcatgttctccaagcatgtttgtgccatttgaaagtttaattgcagtttcgatttactctgcgtgtgtccaggatcaagattgctcgcttttcaagtgtggcgctcgtggtgtctagttttagctcatgctttgtatgagagcatgccttgaggcattgatttctactcagacatcgatttgctagcctccttgtttcatgcttccattaacccgccttcgtaaaccatttaggtaggttgcaaaaccacattttttgtcaattgccctacatctctagccttcttgacagccgcctaacctatttgcaagctcacactaaaaatagatccatcttacaacctctaattctctaagttccatccccaccactgatattgcaggcaaactatctgctataaaaggcaccacactaatcgtgtatgacaaacaaagactgcttgctacagataatctcgtgtgacctaatttgcatggagcaggtaagcatgaggctggtcatggtggccttagtgttagtgggcattatgctggcggcgagcc

SEQ ID NO: 66162 - DNA, 9664 bp, Oryza sativa
gttggcaaaaaattaagattgtcaaaataggacagtaactaaagtggcacatgactgagccctgaaaacaagaccaaaagcttcagttagactagaaaaccatgctatcaactctagccacattatgacataaaaactgcaactacagaagctacattgatgttcttttttctgatactgagcagtaaattgttttggtgtacaattttaaatatctggaggtcacagtgcagataacagattataataaataccttagaggaagctcttttcgataaaacaagtctacgtgcgcacccatccctttccatatagaagcaaattcaacagcaatatatctgcaatatagccaccacatgaacaaatgcaagtctgagatagttggaatgacataacaatatatagtacataaatgcaccctagagtgtagacatacccgccaccaaggattacagcacgttttggtagctcctccaaacttaaggcctcatctgaagtaatagctaactcctgcaagcgggttcttatcagtgtcagccaaaataatacaccaaaggacatttaaaaaaaaactaaagggaaaagaaaatcagtgatgtaaccagcacatatatatggctaagtataatttgttggattaaagataatgctttgtccctcttgaactggctcaaaggaagtcttgtaatgtcaaatccacaccaactgtgtcatggctggacgttatggtatagtatatcagcggcggcgtaatagagataagtcagatttggcaagtgcttcagcagttggaaagtcctaataagctccttatcagagtttcatagttttgttataagagtcctagtagtatcaggttaatagtttgtatccgtttcccttatctagaggcacctcagtatataaaggtagcctagtactccctccattccaaaatataaggcacaaccaccttcaatcacctcatagtttagattaatctaataaatgtaatacatgcacccaataaaattagagatcttgatagtggagaatttaaataataatattttagtggagaatatgtgttagttaatggcatgcatgcatgtatgccttatattatggaacagctttaaaaagtagttgtgccttatattatggaatagagggagtattgtattttgggtcaagtaataagaaatatctaaaggggattaaccctaaaagttcagccatatcaaactggctatcacaaataattattgatgtgcaacagtatcacaacaaatacagaagatggcatggaaatcagcatcacgaggtcaatccaaaggtttcaggcacaaaagttggggaatataaagaagttgtcaaacaagtaacaatgctattaactacttgccagacataagaaacaagtttgcaaaggctggcagagaattttgttaccttcccaggaatgttgacacgttgagctcggctaccagttgctatcaatatgtgctttgctgtatatctttgctttgaaccatctggctttgtgacttcaactgtatgagcatcaaccaaactgcctgccccttcaatcattgtcacaccagaattgccaagaatcctctggtatactccatttagtctaacaatttcttgagtctgcagagaacggtttttacaatattgggttgtaagcatttataacgagcaaataataatgcaggaacgttctcccaaccaaggttgcggctctgaccttattttccagcagccttttccagttgaagttaatgtccccattgatttcccacccaaaattctttgcatcctgcaatcatacaacagtagcaattccaataagcaccccagaatgacacttcagtacatgtactcacaaagatgcaagcaagctaaatgaaatagtttgtataaaaagatgataacaagctctcaaatggataggttattggatttcaagtcagtacgcagaatgatgaactgttgatcaaggatggaggctgtaaggcttagcaaattttgcaaaaattgagtaaaggaacataattcagcaagccacagcacattgaacctaaacacaatgcttccaacttgtttttcaaacaagtaatagttggctccataagttagtaagatcagttacctcaaattctccgcggaaagatgaaccatacaccagtatctttttaggcacacaaccacgtatcacacacctagcacaacatgtacaataatgagcatgcgggttttaggatgcagcaacatctcacattctcacccaggggatgaggagagttggtttaaatcataatcaagcattcaacgacagaaatgtaaacgcagacaagtaatcggcagatgcttacgtcccaccatgccctccttgccaatccgagctgatgggatggaacgggagctcgcaaatcgcaacctgaaccgcgccacacaccgaatcaaatcacacgaaaaaaaataaaaatccaacacgtttcctcgcaaaaatggggagcgggggagaggagaaaagtcaaaccttagccccgaaggacgcggaggtgcgagagccccggacgccgccgctcccggcgccgatcacgaacaggtcgtagtcgtagctcccgccgtcggtgacggccacctccacctcctcgtccttgagcatcttcctagccatggatcctcaacaccacacgaaaaaccctaacgcgcacacgcacaacagagagaaacagagcccctcctgagattgacaacaacttgcaatccaaatccgatgaactttagcgcgaggaatcacttgatgagacgcgattgccgccccgcgacgcgcgtggagcccaaaatccaccgctaaaaacaaccaaaaaaaaaggaaaggagaagagagagaagtgagcaccgtaccttggggttgggttgatttgccggcggcttaagcgagcgaattggttggatctgtttcttgtgtcggattttaaaggggggctttggtttgtggatacgtggtcgttggagttcctacgccgccatgtcctggcagcatctgaggcggcttttacacggccacgttggcacgcacgcaggtgcttagagcttatttgatacaactccagcttgagatttagttttttttagactaaagcttagtcaaacagtttcagtttcaaagtacagttgaatgagacgcttttataaaataaactggagaagtagaactggatttggactgcttcacaactttactccaaacctaacttctgaagctaaatttaggagttaaaactttacctaatagaccattaattagttagttaatttttaaaaaatgttaagttaaatcatctgactaagttctttttataaaaaaagaatcatctgaccataatatgcttacatcagccgtgacaattcggggatccactgtggatgcagtgctcctaaaattctgcaggcagctgctgacgagatggaacttaacagctactccaaattacggaatactgtaaagaacttattattaccaaaaaaaataaattaggtgctcagtttttatcttggcacttgtacatgttgattacaacagggagaatgcagggtttgttctaccagagattggctttgtttcatgttcagttaatcgggatagcttctactgcagcagattccatttcagaaaagcaaaaggagactttcagtgattcggtctgtggtgtaaaagccatgttcgtgccgtgtgtttgtttccagatgcgaacttgcattcgatgaatctggacgggacagaaatgccttcaaacgtggaacgtggacgcgcgtggcgagcaagatggagcttagcagaagtcgacatctttggataagtagctttcgattttcgaactgtcaagagccaaagaaggccacgtatactgtttagttcttgtgaactttctgtacatgtgaaatacaccgataaaacggaagtaagccagtaacctttctttacacatggaagacaacagataacattaaagaatttaactgaaccttttaaaacaatcaaagaaccaagctctgtctgtccctttccggtctttcagagaggtgacaacaattaaactctgtcgacgaagtcatgcagttgagcccccttcatccttttgtgttttttattatcaattttattttcttgttattgccaatcctaacacaaggggtggtggcgcagttggctagcgcgtaggtctcatagctatttgagttatcctgaggtcgagagttcgagcctctctcaccccaatttcttttttctcttggcctatatcattttttttaacagccgttatcatttattttatatttttctgttaccaaagtacggagttattctcttggcctatatcatttttttaacagccgttatcaattaaccaaatgcacaatgactctgattttttttaacagccgttatcatttattttatatttttctgttaccaaagtacggagtgagtggtaagccaaatggacaatatgctttctttccaagtggacaagaataggctgtacggatttactactaaaattttcgttcttgcgtcaaaaaaccttgagaatgcgtggactgggaaacaccatcgtctcgccagggtagaaagaataggatatgcaagtttacacagattttccgcgatgttacagaagcagtggctccaagcctccaagcaccgaactgacaaattagttaatgttcagataaatataaccaaaatactccgcagccgcaaggattttcaactgaacaagatttaaaatggcaaccgcttcttttaattatattttgcaaaccaaatgtaggctattatcaagcatcgcactatggtattttcttctcggcagaaagttcagtttgcccgcaagaaaaaagaaacacacctgtagttttgcacagcattggcaacaaaagccaaaaccacaaacaaaaaaaatggcgcattatgagtcttatttaattacacgcgccttgatcttagaagttcatcagccagatttcttaagtctgatctcaatgccctgcacaataagacctctcttccaattgcctcccttggtctccatcaggctgaagcacacctctccatcttcaccttcctcgttgatgaactcacccatctccagctccatccactcgtcagtccttttctgagggaccgttacaccttcatcaagaactagacgacggtctcttctcctggcccttcgtcgcagcaatggaccaatactcataggccagtaattctcaggcacctcctcatcttcgctgtcatagctttggacacaaacaatttttgttgatcccctacctcccaggctgactgatgcctcctggaatggagcatccagcccatagaactcatcagctatcttaaacaccatgtatgcggcataagttgagtttggggagagcatcttgctgtgtatcctgccacggatttccaaccagcacacatctatgagttcagcaccttctgcaaacctgtcgtgatttgtgaacaatgggttaaaacttgtaacaaagagaaatgaacaaacattaagttgcagaggagcattcagcaccagaaccaaaatcccataacttctgtacagaaccctgctatacacccgacttgtttgtttgactgatgtacaactgaacggcggaacagaccagtgcgtgacagcgtgaggcagcagtacgggttggtcctacggagatcgacgttttgcactcccgtacattacggttgtccaagaatcggataagctggttgtgtgtatagcattttccttttgtttattaaccaagccgttcatcagtactaccgcgtataccatttgcacgactataatgaaggcacacaacaggtcaattatgtaaagtgcctgccattctataatctattgttgcaaataccatgcactttactactttgctcttgaaaagtaaatgaagaaagacacttcaatccatgctcagagagaacactttactactttggccgctttcgttatcatcgaatttgcataagaatctgcccttgttctgggggtaataatattcggaactacacttcaccacaaatacatattctagttgattcatcatactattatgtagtatagtctattctcccatcagaccacataatgcaatctattctcccatcagaccggataataccattgcaagttgcaacgagattgcaagtccatcactcaacgcacaggcattgcctcattggatcaaaatttccacatgaattggaaagatcagcacggtttaagttcaggaaacggacctagagtcggtgagaggaatccagcgccagtagtgcggtgtatcgccccagataatcaccaacgatctggccgagagcatgtagcacttggccccagtctccctgtccaaccacatactctgcacccaaaaaaaaacacaaatattagatcgccgatgaatcgagagaactgagatcaaccatgcttcgattaatccgtcaaccgattttgttggattggggattttcataaaatagaacgcaccatgagccggtctgataggaggtaggggccatcggagaggcggaggaagagctccttcttggaagccggcgcgggggagagctcgccgtcggcgagatcggggagattgcgcggcaggaagctagcccagacggcgtcggagtcggcggcggcgcggaacgccggggagacggcggcggcgtggcaggcgtcccgcggcgaggcgcgtgagatcgcggcggagaggagctcctccggcaaccgcgcgatctcgcagaggccctccccctcctcctccattgatccctccgtcctcgaatccggcttgatggcgaaggaaaaaaaaaacagagaaggaaaatatcgtcggagagtgtgtgtgagtgcgcggtggttgaaaataaaactagaaaagcttaactacgaagcagaagcacatgcgggtggatagggtcatagggatagcgatgcgtttcaggagaatcagaccaaaaggaagattacttttgttttctgtactgtggggcttacatgtcatactaacgcggagtttagttccaaacttttccttcaaacttccaattttttcatcacatccaaactttcctacacacataaacttttaacttttttcgtcacaccatttcaatttgaaccaaacttccaattttagcgtgtactaaacacaccctaagagcaagtttaatagtatagccaactgatggttccaaatcatctttaggtaatctgatagtacattcataaaatagttatctataaaaatatactacatcattaatatccgatcccacctctcatacatatataataatgtcttaaagtccgtgtagcagctggctacaaatctgtagcccgctttcttatatttcttctcgatatatggttatagctggcttagagcaggtacaatagcaggctataaaccagctataaacatattttaaagagataaatgaagggagagaagagcagtgggctacagatagtacggactccaagacgtaatgtgtgtatgataggtggggccagatattaatagtatagtaaacaactattgtatgagttattactttggctatagatgatttagagctaatagtgtgatatactatgctcttatagctattgcacctgctctatgcatactcggatgctcccatccttgcggtgctctctcgatggtgtccaactgttccaccgcgggttgacccggcgcttgtggtgtgtccatcagtcaggtgtcgtctcccgtgtcgtcgtgtatcattagcgcgatcgtccaattcaactatgacaacgtcatatgttctattctattattacatgggaatcttgcgattatgttactattgaatatagattttgcacaaataccacgctgtatatattaattaatctatctaaacgtcatgggaatgcttgagagttagagcgccacgttagcaaacattttacaaaaacgtccccaagtttacagttaatcatgcattgctcccagctgccatccaccgcgaaccgtcttatcacactccacgtagaaatgctatcctaaacaaaatggtctttggatttgtcttcttctaatattctttcctctaacagacaccgcactcatgacttcggggaataaacgaaacgatatatttacaaacaaaaaataatctatgaataaaattttatacacgtgtttttagtgatttagtagcaaaggcttaaaaaataaacttcaataaaaaaaaccccaaaatcaactttaaatttaagataaaaaaaattcaaattttatctgctaaacataaacataccgggcacaggcacactagccccaacatgccgacctgaccgttctccttgaggccttgttcggttgcttgggaattaatccccaagggatcctatccagggagggattgagtgaatccctcctatctcactcaaaccctgtggggttcgaatccctgcccgtttctaatccctgtcatataaaccctgccttcgtttagcacagggaaatataaagcagcagctgtacgttcccaagcaagcaatgaaacaatatgcattctcccagatcaaatccataggacgcagtaaaaaaaacattgttttagcacagggaaaacacacatgcatgccgtacgttcacaaatgcatacatgaaagtgtcacaaagtaataaaaatggttacagttcagttgttttttttagaataaatagaagtagccagctaagagctaaactacaaattgaatgcaagtgtttaagcttagcactaatgccaccatgagcttcagtcacccagctgcagtgttcccatctctgaaaaaaaatggagcaacattggatcaattccaaaaagaaatacaccatatatgttctttcctgtcaaccaaatatcaaattgaacaaatgcagagtacagattacataagagcaaacaagtaaagcaaagagccacactaatatccaaactaaggctgatgcactacatggaatgctaacagtctgatagaaccaaagatgaaaagagacctaaaagttcaggaactaggaagctaacaaaaaaatctaacaattcagccttgacaacatagtaataatgaagtacataactagagccacacggtaccttaaaaaacattcttttatcaggagcaaagcagatgcttcaaagtaaataaaattgcactgctatactgcttaagtttagctttttcagatgctaaaagtagtatcagttcagacttgagtgagctcatcagctcaagaaaataaaaaaaaggtgagtagcccataatgtaaatcctggtttatagccctaaacaacatgcatgtaactaacaacagagagtcacacaggacagagtgaagcccatcttactcgcctagcagaccaaaaaagatttatatggaagagaagcggtacctttcaagccatctcacttcttaaccaactcaaggcagattctgatcctcatcacaagcactcacaaaaatctctctgttctctgcattcttgaagacggtatatgctttgaccttttctgcctttctcacatccatcgaattcagaacagatatgcacctcttgattgaaaaatcatta

SEQ ID NO: 66163 - DNA, 8202 bp, Oryza sativa
ccattctgacccctatactcaggagtgttgtgctcatgcaataactcaacaagaatcttctctagggctgggttccaagaggctcttgttttttctacacaagataagaattgatgtataatctacatttaataatttcaaacatgaatttcacatgttctataattgcatacctattggagaacctccatgcttttttgtaggacgacctttcggagagttcttcttttgtgcagctttcgctaaaagcatggtcaaccttggagaacctcttccaagcatattaactgagaaaggatgcataacacaatattcataacaaaagcattgtagcaaatgtatgtcacatgcaaccaccatagttcatttataacataatatttgtaatatgtcgtagttattcagctcacaaaacataaaaaaaaaatcaaatatactacttattacaacccactaattcctatgctgtcgatagtcattccacatttgatgtgctatcgtgtccctcaaaagattcccttgattagtgctttgatcattgccttcatcaccatctggcaggtcaacataattgcttggatggatattatgtggttggttatttaaccattgctcatccccattcagtgatcgaataatattatggaacactgcagcagccactggtatcttcacttggttcttgattttgtggaaagttgcaactttgagaatagagaagcgcttttttacaacccccaaagtcctttcaacatgattcctcaataccgcatggcgatggttaaataactctttgtagttttgaggtttacgccgacctgccccatactcctttagatgatacctgatttagatatggtgcaaggaaagaattggtgttggcatatccaccatcaaccaaatagaactttccagggggtacttggaagcctttgtttactgcagaggtaagaaccctggcatctgtagccgacccctcccacccagtagacatgaaagtaatcttcagatcaaaatcacaagctatcatcacattttggctaagagtatttttcctatttctaaatggagctgctttgtcagatgatatagatatgggtatatgggtgccgtcaattgcaccaaggcaattctgcagcaaaaaaaaaccacatatgattttctaaaaatgtaaaacaacatattaataaggatataagtgtttaggtaagaaccttgaaatagggataaaatctaggatctttttctattttccaatgaacttcattaggatttggaggcttcagaaaccgcttcgagagcgaagggacaactgagttgaagaaatgctttacgtgacgatgaaagctatccccactgtgcccaaatttctcttgcaaatcctcaaatgaagcattgtgactaagcatgtataagaagaatgccaacttctcttcaactttaatcctagtatcatcgaccaacttttcagttctaaggtaattggccaaagatataaatatttccggctccatcctgaatgctacccggcaattttttacatgcccttcaagcaactcccgaacacgctcctcgcctgttatctttgatgtatggcgtcgcttcttttcccttgctccactagaactcaacaaatgtagtgcagggaaaataaacaacatcatatcatcgtcctcctcttccctcctctttctagcgcggtctcttgctctcatatccatagtagtactatagatagagcacaaattatttacaattttgcacttagcacagcaacaaaagatctagaaagataatcacaaaagaatcactaaactatgggaattaatcttaagaagtccaagttatgaagcatatttaaaaattgatgggaaaaatgaaaagaacaataaggatctttttttcttaaagagtgcacagtgcaacaataattgaaggaggaggttggtcttctccaactctaatgggtgcacgtgcaatctacaaaacaagcacaacttatacacatcactgacaactcaaattcagaactagaactagagttacataaaacccagaactagtgctagctagcatcaaagtaggagctgctgtttttcaatcaaatagaaggatctcatcatcaaatacattataacatgggtacagaattaatcacccaatcagctcatttaacactagacatattagtgcttgaatagctatgataaacatgttttatacaagtatcatgttgaggaaaacaaatatgttagtctaatgagactaaaagctactgttgttagtttaaaataaatcagtttaagtatacattactgtatatactgcagcaatttgttgctagtttgtttgtgaaacaatgacgatagaattagtttacaattcagaaatgttaaactaattacagagtacctccatagctctacaatcctcaaaatcaggacacccaacccttgtaatttccaaacagaaatataaccaacaaccacaagttgggactccggaagcaccaagaactgagtacttcactgtaaaaacttgtatagtcaattttacaagacatgctcaggcaagcatcacagcatcagtcacactaagcaaaactaatcaaggcaagcatgtttccatagccaccgtacagctctcgctctcaccatctgctgcctcaaagccaccgtgaatcaagaactcaaatcaagaaccagagttgggcggtgcggtggcggcggcaaatcaagaactcatccccacccaaccaagaaaaaaagctccacgcccaaatcaagaactcaccagatcgagcaggatacgaggaggaggacgacgaatcgctaagcgctcactcaccagaaagctacacggcgagaagagagatggcggcgacgacaggaaagggagaagagaagaaaaccctaaccctagctttgcaagaggagggaagaaggggaaaggcagcgtgctcactggagacaaggtggcggccggaggagagagccgtgtcgtcgccgtcgccgtcgccgtcgcctccgggtcgcaccgcgcgctgccccctccgtcacgtcttcgttgcgccgccgcctccactcgaggaaattttccacgctccaggagtagatgattttttcccgggcctagagaagagggaaaccccgtggtgggccgggctaaaattcacggcagggcttaaccgaacgcacaatttcgcatgggccgggattttttcctcgccggggtgatccatggggattgggccccgatcccggccgggaacaacccaaccgaacaaggcctgaagccgccaatcaaccacgcgatgttgtctacatggttgcccagggcagcaataccaccatgcttaaggatgcggttaaggaggtcacgggttattttgttggtttgacagtgtacattccggaggaaggaagaagaggagcccaaagggcaatgtccgaaatagtatttcaacataaaaacgctggttgagagtgatattttatcgaatcttttttacagtgtggtatttaaacaaagcctagctagcataacccaatattcctcattgtacagacatttcagtttatccacaagagcatcaatattagcaaaagcaaatgctataaaaatacgcatcatcacaaatcttaggccctatttgattcagcttaggattattataatctagattattagtagtaagctgaaacaaacagatagattagcatgatagattattataatctgtaagccagattatcataatctaataagctcctctaaaggagcttttttcagattattgggtggctaaagacccactacccctggatacttgataaaaattacccacccataccatcaaccgaacaaacagataggcctctcctctctcttggcgagcgcgcgaactcggctcctcctctcccagtcttgcgcgcatccggcctcctaatctcccggtcgcgccgcctttcccaatctgcggcgtcgcctcctcccctggtcatgcactcatgcgtgtgtgagcaacctcctccaccccctgccgcgccgccgcgttccccactgcggtgccccgtctcgcgagcaacctcctccaccctcgaccgcaccaccgcgttccccactaaggcacctcgtcttcttccccgaaccgcgccgccgccgtttaggcatccaaaaaggccaagggcattatagactttagcctttcaaacccaataatccgtgcctccaataatccagataaacaaataactcacagcttattttatgttaacttattataattcagcttatagtaatctggcttaataatctaaattataataatcctaaactgaaacaaacatgaccttatttaagtactccaagacgcttgttgatcctagaagctcatctgccagatctcttcatcctaatctcgattcccagcacaataagacctctcatccggttaggtccttcactcatcaatctcatgtacaccgctccatcctcaccatcctcgttgaagaactcacccagctccacctccatccagccgtcagctcttctctcagggtaccttcctgtgaaggcaacctcgcgtctcgattcattctctccgatgctgaccgtcgcatcgtgtggtgaagtgtccagctcgtacaacccatcggctatcttgaacaccatgaacgcagcgtaagtcgagtttggggtcagcaccatgctgtctatcttgctacggatttccatccggggaggagcatccatgaattcaacggcttctgcgaacctgtcgtgaacaaaggggtttgaaacttgtaaggaaatcatgagaaatcgaaagtaaccatcacttgaaccatcgaattatcaattatgcaattgccgattggagaattatgatgaacgtaaaggcactggacaacacgataaccagtcgtgtgatcctaagaaacggacctcgagtcggcgagggggatccagcgccggtaatccgacgtctcgctgcacttaattaccaacgttctggccgagagtacatagcacttggccccggtctccctgtcgaaccagatgccctgtgaatgagagagcagcagttttgaacacgagaagagatcatcaaggaagcagtgctcttagtcttaagtaatcagtaattagtttagtacgcaccctgagcctgtctggcaggagggggacatttccatcggagccggagaggcggaggaagagcgccttgttggaaggcggcggcggggagagctcaccgtcggcgaggtcagggacatcccgcggcaggaagcgggaccagacgtcgtcggagtcggcggcggcgcggaaggccggggagacggcggaggcgcggcaggcgtcgcgcgggcgcggcgccgcgcgggagatcaccgcggagaggagctccaccggcaggcgcgcgatctcgcagcacgacggccccattggcaattcggcaaatgacaaggagacaagaaaaaatacagctggggaatgtgagaataataccaccggtgagcatgccggaaggtcggtcgagttccacttccgcccatggttttgcagtccaacatgttgtagtatatgtgtagagccgtagactagtagtagaaaattcgaagcagaagtcactcctcacttgacaaatcaagcaagtggcagtatctgatcacacatctctgttctttttcacttggttattactcggacatagttcaaaattgctactccgtcaagatatcttaggcctaatctcgatgccctgaataacaaggcctccattggacagccatctgcctgccttgggcttcacgaggctgaagcatacctcaccctggttgttaccctcttggttgtagaactcacccagctccagctccatccaaccatcagccctttcctgagggagaatcacactcccatcctgaggcacctcaatctcgccttcgtagtagtagtcattgcggttggagctgtccaagcaaacttggcgagtggattggcgtcccccgacgccgacggttgcaacccacacagaagccaacccacatgaatcttcagctaccacgaacacaatgtaagcagcataatttgagtttccggagagcatcttgcaaggtatcttgccgcagacctccacacggtatccttttaagaactcaacaacttctgagaacctggagtaaacacgtggttaatactatttgtaagttgtaacaaatcattagaattgaatacatacaagtaggaaaaaaataggacacgggaagtcaggaacaaatttccatggaactttcgagtcaccaagcttttgtacacagttttgccttagctccataccgtgggggcaagagatatacatatatttttatttttaagactagcaacagatataactcttttttcaatattgacaagagatatatagttcaagaactccattgggatcaacaagatacaagaaagctattttttcggtacttcttgttactctgtttacaaaatcagagttggtctttgctcttcagaaaaaaagaaataaagaaacgctcaattaaaatcctaggagccatcagaggagcagctactgtatagcagaatatcactttccaaacaaaaacaacttgaagtttggtcttagcctttcgatataatcagaatctcttcaataaagtttgtgtatgtacggaaatatcacgtgtaatttctcttaacaagttcttatgcatatttttgaaaacaacaacaactgtgatttcacatttctattctgaaagcaatttcatctatcatcacaacacatactccaccaaagttacaatatggcaatttcatgtaccacagaaagcacaagagtataaatgctttgcaaattttgcgaaatggaaaacttcgcagaggaaaggaaggggcatatagttcaacaacctggagctgccggtgagagagatccagcgccagctatgcgttaagttcacaatctgcagcgccctggccgacagcatgtagcacttaaaaccagtctccctgtccaaccacatactctgtgtacagaagcacacatcaccttattagaccgatcgatcaagaaacatacaaaaaaggcatgcaaagaagcatttttcatttggggagctagggccgtactgtgagcccgtctgagaggaaaatctcctccatgcacgattgcaacgttgtcaatgttgagcaggagggtttctcatgggagcaagcaagagagttcaggggtggacttttcttaggtctaatctcaataccctgcacaacaaggccactcttccagtggcctccttttgtctccatgaaactgatgcacacctcaccatcgtcaccttcctcattatacaactcacccagcttcagctccatccaaccgtcagcccttttctgagggttctctatatcctctgcaagaacaactgcacgtggttctattctcttgagccttcattgaacgacactaacttggcgggctgttatgcttcctccgatgctgacagatgcctcctggaatgggaaatccagcccataggatctatcagctatcttgtagacaaggtatgcagcataatttgtgttttgtgacagcttcttgcccggtaacttgccacggatttccaaccagcaaacagataagagctcagcaccttctttgaaccttttgcataattattcatgacaaagtaagagatgagttaatacaaacaattaagccatacagaaccaacttcaaattccataactcttgccatcaaacaagattctatgaactgcttcagtgtagcataataatggcatttaggcatgaaacatgtagcttatcgaactcaatttgttgtatgaacaaactgatttatgttccatgtgtagcttggatgtgttctatgtactgatccctcctcacttcttcatcaatagaatgatatgcagttctcctgcatattctctaaaatatcgcgccgcaagagcaacattatttaggtgaagtgacatcgatctatatgtttaatttatgcatcctacgtgctcaagttgcaagtaaaggggggggggggggggtgcacatgtgtataaactctgatttccaaataaaaaggacttgaccattggattcgatctggtgatacaaccaaagctgctaggaaatttgtttatgcttgttctgtaatatagtatgac

SEQ ID NO: 66164 - DNA, 8629 bp, Oryza sativa
aacgttaacgaacacgaacgagcgtaacgaaatgcgaacgaacgcgaacgaacgtaacgaaacgttaatgaacgcgaacgaacgtgcacgaaacgttaacgaacgcgaacgaacgtgaacgaaacgattacggaacgcgaacgaacgtgcacgaaacgcttacgaacatgaatgcacttgtactaaaagtgaaagtgtgagaacgaacgcgtttatactaatacgatttactggtaatacatatataattatatatgtaacttggcccgtttagactaatacattttcctggtaatgttgcagagaagacatcgtcgtcgtccctcaagccgaagtggtagctagccatcgaaggaattcgcgcaggcaagtgatgtaaagaagtgattgttagatatttaatataagactgttagacttagcatacatgattattacaattttaatataagattgttatcgatttaatataatattgttagacttagcatatatgattgttagagatttaatataatattgttagacttagcatatatatatgactattacaattttaatataagattagtagcgatttaatataagattgttatacttagcatatatatatatgattattacaattttaatatgagattagtagccatttaatataagattgttagacttagcatatatatatatatatatatatatatatgattattacaattttaatataagattagccgcgatttaatatgagattagtagagatttaatataagattagtagcgatttaatataagattgttatacttagcatacatatatgattattacaattttaatatgagattagtagcgatttaatataagattgttagacttagcatatatgattattacaattttaatataagattattagagattaaatataagattgttatagatttaatataagattgttagacttagcatatatatatgattattacaattttaatatgagattagtagccatttaatataagattattagagatttaatataagattagcatagttttaatattacggtacgcaaatacatcctatatacctaacaaatattttttgtatgcacagatggctgatcgcgatgaggaacagatactatacgatacaatcgcagagggaagcagccagtactagaacgaaggagaggggaacgaggatccaaaccagtacttgaacgaggaagggaacgtggagaggaatgcggagggaaacgaggaggggaacgatgaggaggaggctagtggaagtcatccctccgttggatagaagagggcacacggacaacgaggtgccgcgaagaagatagagggtcggcacatcataactgaggtggacgaagacggccgacctagtgccccggcagaagcagccaagaattttgtacgccacagcggttgggttgtgagggacaacgtgcctgtcagcacagtgtactggcgcagaacaagggcatacggggataatgacagctttgtcccggactcagagaaagagatgctgtggaccacaatgctcgagacgttcacgctacccgcgggtacggagaacatagtgaaacagtggactctgaagaaaatggcagaacagttccagagcttcaagggatcattgggacgagttcgttgcttacaagacagggcaacaagggcaagcaatgatggccagaaacaaagacaatgccgccaagaagaagtaccatcaccacttggggtcaggcggatatagcgtcgcaatgccgaagtgggaggagatggaggcaagtttgattgagaggggtatcgaaccggccaccactaaatggccggatagatcgaagttttggtactatgctcatggtgaaacgcttaacctagttgatggctcccttgtcttcagcgatcagatacgcgaggctgccagtcgactaacgtacgcagtggtagcctcttctcagggcacattccgacccgacagagagaaggatgagctgtcactcgccctacagactcccgagcatccaggacaaacacgagggaaaggcgtgattccctggaagattggatttaaggaggacatccacacgtacaggagtcggatgaggagcaagagagatactgaggcgaagattgcagatcttgagtacagggtatcgagctacgagctcaacatgcaagaggaggtggcaaggaaggtggatgaacgtatggccgcacatcggtcccaggatccccagccgtacattcatcctgcaatggtcagcccatcaggcaattgtagcagctgcgcctcaacggggcaggtcggatcacagagcatggacgccatgcaaacccatgacgaaaccacctgccccgttgatgagatcacgcaacggacaccatgtgagctgcatattcccttcaagaacttatcaatcaaggtatgctcgtagtttgatgatttttgacttgtacattccgcaagttgctgcttaggttgattactaatagataacctctcatcacgtgaaggtggcatcgggaatggccatcccaacggacccttccgggacttaccactgcaggccgattccagcaggatactcgagggtcgaagttgagctggtggaagccgcgtacgaggacctcgagttggactacccaggaggagacggtgagacgcatctacgagacacaagccacaccatcatactatggcgcaagcggtacatcatccttcctgggcgacaagcggcgtctcgtgcaccatctcctacggctccgccatctcctcctgcaccatctcctccggttcctccgccacgtcctcctgcaccatctcctccggctattccgccacctcctgctgcaccatctcctccggctcctccgcctcctccgcctccaccgtgtccgcctgcacctcccaagacaaggtctcgccaagctccaccgcctgcccgcacaagggcaacgaagaaggcgaaagttgacgccaccaaaaacaaggagccaccgtacgattgcagtcaagaggagcttgatgctaatgtggcaggagaggtgaagaggcaactcaagcctcggagtcctaaaaagaagatacctattgacccgagcgtgaagaacttcttcaagggaatgtccacaacaaacaaggaggcattacagatatcggactatgaccgaacacttcagagagcctatcacaagaagtccaaaccagtccctcagtttggagaacaaccaaaccaagaggtcgagccgttggtgaccggcgaagattttggcataatggaattcatttcagacaccggtctaactgtggatcagttggttggaggcgcaccaatcccgaaggcggaagtggcatacaagtttgaactcggtaaaccgcttgtcaaacctgaacagctgtagtccctaccgacacagatgtacaaattccatgaacggtacatggaaatgagcgccaagggtagagagatgttcggagcgaggatcagaaaccccgacttcttgcaaggagaagatgttctctagatccatttcaaggatctcttcgatctgtaccagttggacaccctcgacgtctctcttctgagcgcatggattttgtgagtatctttgagttcgatttgtttcgttcaataattaactcttggcatatatgtaagcaataatactttcctttcatcgttgtagaatggagattcaaagggcccgacggcggaggttctacgatactgggttcatcgaccctcggaaaatcaacaccgaaatgattgacaagtacaagaaagacacagaggacaatctcgtacatctcctaacgcagcagcatttcaagacgtacatactactgccgtacaacacagagtgagtttttattgtcgttcgaacaaatttcgttcccatacatatagcatgtacattttcgatcatatatatctcatctcacgcatattccagattccactgggtcctgttattcttcaacttggacgcatgcagagtcactgtgtacgactcaatgaataaagaggagaagatttttgacaaggtcttcaaactgatagacaggtaatataatgtcatctattccaaagtcacggggaatctattgctattatgttgatctcaggtaataattaattaatcatagcttgcaactgcatatgtagggcttgggataggttccgtcaattggtccgcaggacttggaaagaaaaacttggatggaggtttcattttccagtgagtacatgcatgatccaaaattatattgaattgaatctctaattgcagttaatataaatagtatattaaatctctcattgtttctcatgtagtgtgcaaagcaggaccagggaactaacttatgcgactactacgtatgcgagtatgcccactgcctatcaaaccaaatatgcacaacacgagagctcgatgtacgtatacataaaccattcaaaatttcattgctcgatttgttaagttgtttattaatttcatatattgatacgtcattatttttcgaacgatagcgtattcacatgagggataatctcccacacaaggattttatcacggctgttcaagaacaactgatgggattcatcaacgaagaagtccttaatcccgacggtgaattctactacgacggatcgacaattcataacgtcggtccttcctcttctgacataacgccggtgtcgaagtcgtagctatagctaccgagcaaataaattgtactatatatgcatgtatatatatatttatatatgtacacatttacttttgtgttaatatataatttggtaacatatatatatatgcacataaaatgttaagtgctttaaattatacatatgtgtgtgtaatatatgatttatacacacacacacacacacacatatatatatatatatatgcctatatattatgcatatatatgtattgtaacatatgtatgtatgtgtgtgtgtgtctatatatatatatatatataatcaaccatgcagcaaacagggccatgcaaataaaaaaaatggtgcaccgatctttagtcccggttggtaacacaaaccgggactaaagatggtttggccggccatgtggctgatcgatctttagtcccggttggtaacacgaaccgggactaaagatcgatctttagtcccggttatttcacccaggactaaagatagctatctttagtcctagattcgtagtcccggttggacaaccgggactaaagaggggttaccaaccgagactacaaacagtttctcccccagtgatataggagtacctaagagatagagacttgtagtacaatacaaataagagtagatttatctcgattctatctctaggatatatcttatctctatatttgtatttgactcttatccctaactaccatatttgtacttctaacattccccctcagtcgtaacgggagcaaagcgaatgattgcgactggatttgaaatctatttcttcatctccttcgagtcaccatcatcaattgcatctctgatggacggcccttcacctagtgcctacgcccccttctatgttgtcccttgactctcctctgttccctcccgcagtcatagtgggagtttcatggacgatagcgatgacacagacgctttgactggagttgccacagatgattcttgttgtagatgttcgtcaatgtagccgatcatgaagtagccgtggttgtaggtgtagccgcatatagccgaaggcgaaaaaaaaattacgccatggtgtgaagacgatactacaattagtagcatcttgcaccttgtagatgtcagaggatgccattaggaacgtcttgcatatgtcagaggacgtcgttggcgatgaggccaccactttggttggtccttctgcgtcgtgtagtggtcatcacaatagtgatgccgtgttgatgcagtcgttgttgttgtagatgatgtgatcgatgccctcgttggtgacgcggtcgttgccatcgtagaggatgcagtcgatgtcatcgatgaagcgtcttgcagattaatttgtcagagcacgcgaggtgtccatctatgtgtacgagtcagcagcggcaagttgatgaagaccactggtgatgtagaatcggcgaagacgatcacatagtcatacaggttattgacacagcagttagtatgttgatggagattgaaggcagcagcactgctccaggtagagatgataattgggttttatttggctgtggctaatgaaggaattgatctaatgctaatattggtaaaatctaatctatggattatttatggcagctaatgatgcagagcccctcctaacagtgtttttcgcatcaacagccccagggagaatatggtgatcatctcatctccccagggcgatgcgagcggaaggtaggaacggatcaaacgacgttggtcttcggctatgataccatgtggaaaaaaaatctaattgttgtattctgttgttttttgatctattagatcgaccctctcgtagggtatatataggagtacataggagatagagacttggagtacaatataaaagtagatttatctctaggatatatcttatctctaggattctatctctaggatatatcttatcgctatatttgtatgtgactcttatccctaactaacatatttatacttctaacaccctcctcccttcctcggttgatttgccttcgacttgctagccattgggcacatcgcactccgctgagcttggaccgccgccgcccccacgttcttcacacgttacgtcaccccaaacactcggtgggagcatagaggggaagatatgagagagatagtggcacggcatgtgggtcccatgtctaaatttttatttgcttttaagactagttgccacgtagatgccacatcagccaaatccaatgaggaagtcattttacaccgattttaataattcgaggagtcgttatacccaattgtaccattgagtgagtcgaattagattcgtcctatattttaggagtcatattggactgtttccaaaaggcattgaattgacatctaaaagacattttcctaacaaaatattattgtagggataatatacctatttgaactttgaagaaataaggttcataagatctattttatcaagaattatcaagaaaaaaaatacatctaatgttaagtaataagccattgaattgaagaagatactagagtcataaaaaaagcatgagtcaattttctaagaaaataatattctagtatatatactgaattttgaacttagagatattagatgtactagcatattacgtgtgtattgcaacataattttaataaaaaaatatcattaacccattataactattgctttttattatatatcatcttttaatttctatatatatttgttattgacaagtgagcctctagtctcatacgtcccttttcattaaaaaaggtaggggttagtaataaaggtggttaatatgtgggttctctgatccataccgtcactttttcattctttgaaaagtaaagagttgtgggtgtggataattcatttttagaaagtaaagagttggtggtcctcgttatgccaaaatcaccgcttaccaccatcaccactttttaaagaagtacagataaaaggtagagagttggtaattagaatagtgacatactcatttatcactactccctgttttataaagaagcgtaggtaattatgagagtgccctcttattatatgtataatttaaagtaagacattaaacggaagatggtgagaagttatcgcacttctatagaatgccacctgcgccactagccaacccaataaaggaagtgtcacgtacattacatgcaaagcataggaacatgaccatgttacgcctccactaagctccatcttaaaaaaaaaattgttcggttaatttaactgtataagaagccaattattcagactacaaaaagatctcctttgaacaacttacaaaccttacgtgctatggtactattggcatatttcaccttaatataaaattgaagatgtttttatcggtactttggtacatcctccatatataaatcggtttttaagtttgctcgcttttagaaatacatatatgtatttgagttgagttttaaattcgctcgtttttggaaatacaggagtcatataaaaaatctcttaaaaaaatacatgctaacttaaaatgattggactctaattacaacttatgattttctataaatatatatatccaagcaaattctcacagtgactttcaccttaactaaaccgtataaaataaaataaaatagccttcacccattacatgcacgggtattttttctagtaaagtaaatagggaaatatattacaatatgttgataatggtaccaacaaatgccaaaaatataccacaccttgaaatgccatacgatatatgaacgaatacgataatatcgatcaccaacttccgttcctcaggcaaattagtcagcaaacgtctaccaaatatctgcgacccgaacctgaaggaaataagacagtaacaaaagctaggaaaatagctagtacaaactaagcagttgag

SEQ ID NO: 66165 - DNA, 13684 bp, Oryza sativa
accaaatctttgcaatttcgattccttcaggaaaaaggccaccgctgcgtgaaacataacaatgttgagatttccataaaacgaggtgtaacacagtcctgtttctgcaagtccgaacctgttattccgcagatccaacacaaaagacttcacattgttctcccttaatttctgaagtgcttccttaacagatcctgggagaagacaatcaattaatatgatcagcaggacataacatctggaaatatatggtgttttataaaggcattagaaccactcaaagtcactaacctgcggcgttttggttgaaagttgtcaatttaatgtaaccaacctttgaattgtcttttgcacctggaatctcacacatcctcgaccttaccggatttaaagtgacagtttgtcgcctatgataaatcaaacaatgcaatgaccaatgaagtaaaagtaactgtttgctttcaagatctacaaggggatcatgggaaggaacttacttcagaacaacatgcctggtattggacccactacgaatatccaaatccactgagcttccttcaggacccctagcaaagatgtaagggaataacttactcaagtagcactggaatgcaaaaaaaaaaaaaaaaagaaaaaaaagagaaggaaaatctaagacagacaacttcgcacttcagatgcagttcagacactgatcatgatagttagtagttggtcttactgtaagcgttgtgctgcatcatatatatccatatcttccgtgcttctgttgtcaattgccaatattacatctccaggaagaataccagaattttctgcaggacctcctggggttgctgacataacagaaagccctgaaggagatccatttagcgccattgggtagctaattgataaacctacacctgtgagtgttccttgcgagccagacttccttcaaaaaagataatggtatgaattaaaaagcggtttatgacacacagctatgatttctctgacaatcaaagactgagtttcatacccgcaaactcttgaatttctcgggttccaagaaacgagtgaatgggtcatccaatgttgaaagcattttctttattgcagcatctgaaatgcagttgtgctcaagtaaactgactgaacggcatcaaaattcaaacaagttctcatttctcacatatttatgacatatttaagttagattttctgatctctgaaattagttttaacctaaagtgctacctactccctagcccatttagatgctggacccctccagccttggcccacctaactcgaccagcctagtgtctgtcagaactcaacaccatataatatgtaaacttggagccttatagaaaaaagcctctggaagaactctttatatcctcactgacaggcgcactttgaatcattacttaataactgttcgacatgtttatactttttccacaaaataaaatgatctatgatgtatcagaagtaccctaaagcttcagcttggcacataaaagtaatttttgtcacagagattattgaagggcaatagaaaatgttaaccaagaaagagaaagaaaagcattaaaaaaatcatacatgtttcttcccgtgtattcattggttcattgcggagagcattttcacggtatctaaaccaactctgcccattgaaagatttgtcgtaatatgcacgatcaactgcacgccaagcctccagaaaaagcaaattttcctccgtgagtgccaatgcttggatatccaacaacaaattttagacacaagtgtcagtagaagtaggacatagagcaagaatgaaagctacatattgaaccaaagctgagaactcacatgaaggtgctgtataggtggctgcagatacagacatgacgagcaccatccccaaaaccacacggccaaagccaattgacaggaagggcttggctgccttgtagcctcgagcaagattaccacccaggctggtgagcagggaaggatagcttgacagtattctctttattgcccgcggcaatgcggagataggatgtccagtagttaaaccaccactggacctcctcgttgccttacagcagaggctcatgtgagcacgcagatgacgacgaggttcccatatcgagacaattgccacctaaagttcaggaacgaaaaaagaatggcttaaattgctgatgactggtacaatgaataaacataaacagaagcaaaaggtgcagagcttataggttgattggggagtgaagcagaagcacatcatatccatctgaagcaagcaaatagttgatgattatatatgacattagttgattaatttgtctgaagcgtcttgtatttgtgactagaggtagtactaattaggagccacttatggaagaatcgcctattgctccatgaatcactcactgaaaatgactgcaacctaacgagatatgcatctagatggcataatttgaccagcagcaattgcaggctgcaacctccacacacccgctcatactacaagctaggtaatcaatcaaaaaacagcggaagcacgaaacaaccagttccttcccacgtcgcacactcgcacccatccacataaaaacactacacggatcggcaattccgcgtccaaatgtttacgaacaaaaagaaaaaaaaaagtagcagcggccatagcaggagcgacagagatggaggatgggcgagagcgagcagttaccgcgtgcaggcgtacgagaggagcgccccgacggcttgcggccggcgacggcgaggcggcggcggcggaagcggggacgaagagtgggcgggagcacgtcgccatcgatctccccttctccgcacccgatgagctctcctctccaatggcgatgaagcaaactggaggcctccgtttttctcccggctcacaagtcgactagaaattgtaaaatcaaattaaaattcttttttggaaaattttgagaaattttggggctgagagatgaatggataatggccgcggagttggcctcccttccacgtggcctgcacttttttcggctgagtggatgtgtggttagccacgcaactttccctggatcgaaagcgatgggccgttggattgggccccagcgcgaagcggacggcgatcgcggaccgcgtgggctttttgccttcctgggctttctgcccacgtgtccggcccaattaatttcgtgaacctttgataccctctcttctctccttctggagaagcaaaccctcgcgccgccgccgctctctcccacccgccgccgccgccgccatggacgccggcgagacctccacctcggactcgctggtacttgccacgggcgccgcgcagggaccaaagaggaagccgccccgaagcgcttcgtccacacgcccatcccgccctccatcctctccgacccaaccctcgccgctgccgccaccggcctcctcccggcggcgtacaacttcgagctccccaagacggcgcaccgcatccgctcctccggcgcccgccgcaccgcgctgcagcttccggagggtttgctcctcttctccctcccgctttcccacctcctcgcgcccttcctcgagccggacccctccaacgacgtcctcatcctcgccgatcccacctacggcgcgtgctgcctcgccgaccgccccgccaaggcgctcgccgccgacgtgctcgtccactacggccattcctgcctcgtccccgtcacctcctccctcctccccgtgctctacgtcttcgtcgagatccgtgtcgacgcccaacgcctcgccgacgctgtccgcgccgccttcccggaccccgccgatgcgccccgcctcgccatcgccggcaccgtgcagttcatttcggcagttcacgcagcgcgtgagatcctcagtcacgatggttaccagggcatcgtcgtgccacaggcaaagccgctgtccgccggcgaggttcttgggtgcacagcacctgccctgaaaaggtccgagggggtcggagcggtggtgttcgtcgcagacgggagattccacctcgaggcattcatgattgccaatcccggggtcaaggcctaccgctttgatccattcctgggtgtgcttgtgctggaggagtatgaccatgtcgggatgaagcaagcgaggaaggaggcggtgctggcagcaaggaaggccaagagttggggagttatactaggcacccttgggcggcagggaagcgtaaaagttctcgacagggtggtggagcatttggaggagaaagggctggaacacacagtagtgctcatgtcggagctgtccccggcaaggatggagctgtttggggattcggtggatgcgtgggtgcagattgcatgcccacgtttgtcgattgactggggtgaaggattcaagaagccaatgctgacgacattcgagtttgatgttgcactgggctatgttcctggatggtgggagaaggggagtagggaatgtggcagtggagatgccaccggttgttgttcaggatcaggaacttccacagattgtggttgcagcaatggtggttgtgctgacaaggactttgggggggagtacccaatggattactactctcaggatggaggtgattggaacagctgctacatgaagaagaagccctctactggagagagaaagctgcgagttcggattggtaattactcaaattcatagtagtttacatgtggcctttttgtctgtcctttttcccctgtatactggggcgaaatgcttgtgtaactcttacattctgaatttttcaatattaccggcatatctatatgttttgtcaatcattttaaatcaacaaggaaatccttgttatgttagtgggtgttataattctctgcttaattgcaacatggtgattttttttttcaatgtgaaatgtccttagcataaaggcagaatcaattcttttttttttcagaactattatagaacttcaggatatattctttgatgaccaagattggagtgattttttttttatgatagagcataccttaatgcaagaaagttatctattgaatttgttaatttattgcacttggtaatttactatagactagagagataagaaaggactattagttaagctctgaataatacacctgaactatgtggatttggacatagtgagcatctttcttgtgacaatcggtagtgcaagagttatccactggtggctatctactgtgtttgtaaactcctgccatcatggtcaatgtgtatggtttggtcaaaatcgcactcgtcagttaatttgattgatactccatagcaactattgcatgttaatgtgctattcaccttttttttttgctgccatttgttagattttgacgtgatttatgcttaccattatgtgagcaggcagcaaagttcaagttgaggataagcaacaaagctaatatcgttgaaacgagatatcaagagcagcttcatgtttcttcagaagttttgacaccagagttgaatagtatttttgatcttagcactgccgttacgagtgctgtgatatctgtatctgtacacagatgtaaactactcgatcctgcgccacactgtaatgctgtgatgttgtcttcccataaaggtgaaatgattctaagtttatggagcacaattttgcattctcgattttgcctactgaatcttgattatcttattgtcggctctactgttttagataaatcctaggatttgaacttgagatataaaagggaacaacgtccatggctctactaggcgtacataatcatgtaatgtgaatcgtctagacgtcaacctttggctagtgttgttgtgctgttcttcctcggtcctaacatttgaatctggacactatagagctccatcgtttggccggtatatttgtaaacaaaaaataatttgttaataaattttttatatacatgttcttagcgatttaaaagcaaagactgaaaaataaacttcgtgtggccgataagcataagcacaaactctaaatttaaggttgaaaatttaaattgtaagcgaaaaactgatgtgtacaaaaatatgacggtgggagtaggtctaatggtaatagtgcagaacttctactttagaaaacatgacaaagaggcgcttattcaacaaaatcacggcaatgttctaacagcaatcatccccaaagatccaaacagcacatatattattatagcagagtggtgtcacagttcaaagtgcttctaagcgaaacgagcagaataattcaatttccaaggctggtagatctggattacaatttggcgtgacatagctcagaagcacagccaaaagcagatgaaccatcatcggttcatttatcagttgccagaacacaccgcaggcagccaccttcatgcagcaggtcaaacgccttgttgatgtcagtcaggttcatgctgtgagtaacgtactcgtccaccttgatttcctgtgcggattacatgagaattctggtcagatgaatcactacagattgacgaaacttctgcaggtttagagtttagacagtgatgatttgttaccttgttcaagtacttctcaacgagccatggaacttggcttcggctcttgaaaccgccgaaagctgttcccttccagacacggccagtgacgagctggaatggtcgtgtagagatttcttgcccagaagcagctacaccaacgatgacagaggttccccagccctacagtaatacccacagaaatttaacagttgaaagcgaaaatattttactttgtgatgggtggaaaacagtatgattgatctataaatggaaatataaaaacagatacgctgtatttcaaataaaagcagtttatccaaatgacaatgcaacacagttaagatatgattcagatcaaatgtcattaattcatttagaaatagacattaccgcaccaaatgattcaactcaatttattaattcttttgaagtttgtcattaatttgtaccaggcgacaaaattcacaaagatgtccgaataaaagctgcagccgtagcttaccttgtggcagcactccaatgcagacctcataacagaaacatttccaatgcattcaaagctgtagtccacaccaccgtctgtaaggtcaactatgacctgttggattggtttgtcatggtcctttgggttcacaaattctgtaaccccaaagttctttgctgcaaacaataacagcagaaaaagagttggaaaataagctatgtttgatttgcagacaatttttatgaaataactcatgcaatgtaatacattctttatcattcaataacacatacaaagcatccaatttgtaagaacacatttgtggtgcatatgggcggaaataaacaaataataataagtttgatctctggacctgatgccgaaaagcaatgtgatgattaataagagcaaggtgcatgcaagcaaaagaggataaatggtaataacaagttaacaatggatcacagatcaaaatctttcctatcacaactcagacaaatacaatggtggcaaattcaggaattgttgatggtgcatcactgcctttgcaagtcaaaaacgaattactataaagggatagtaagcctttggaatttattctagtatttgttgataatcaaacaatacgtagatttgcactttcaggttcgattcaagagagaaaggtctattagcaagttgcaccaccagacatggattgcctgctttcaccagatatacttaagagagtggaatatgccctttactctaccaaccaaaaggtgcaataaacagaaaaatggaaattatgaaacataccgacatcaaactttttgctatcaatgtcgatgccaataatccgagaagcaccagctgattttgccccctcagcaacctaaaatgaaaatcttagatgtcaaagctctctttccagactaacatgttaaatgtgcatggacatattttgacttactgcaagtccaactgtgccaagtccaaaaatagcaacgatggaacctgcttcaacctttgcggtattccatactgctccgaggcctaacaatagtaatttgtgagatacacatacgaatatatcataattatctagaagagaataacaagaatgtgcgaggcaatggtatgtaatattgtatccagtgtaccaaaagaaaagtaataattggaaatttggaggtatcattgacacagatatagtgaggctttccatatttatgaaatatggtaaaaaaaatcaagcacaatgcattcaaacaacccaacgagctctgcatgtaaggtttgtaaagctacaaaatgatagtaggtacaaaaggaactataattggtgaataaaagtttggcctccaatgaagaacctaccagtagaaacaccgcagccaagcaggcaaactttgtctagaggtgcctgtgggtttatctttgcgacactgacatcgtgcacaacagtatactggctgaatgtagatgttcccatgaaatgataaatgggttttccatttattgagaaacggctcttgcgatcattcatcatgacaccgacccctgtggcagcacgaactttgccacagaggttggtctttccactcttgcaaaacttgcattctctgcattctgcttggtaacaaggaatgacatggtccccaggctgcacctcagttactccttccccaacactttcaacaattctataaacataaacagaagaaacatatcgatgctcaattatcttagctgtgcatgatcatatatgtaattagcacatctatatgcttacccagcagcttcatgaccaagaatgcaaggaaatagaccctcaggatcctgcatggcacgtaaatcacttgataagggcctgtttggttggtatataataatgttgccaacatttgccacaaggtacagtaatctactggcggtagaatattgtattatactagtagaactcaagtcaacggtttagatgctactactgacgagaatactgatggtctactgcttgccagtagagaccactgtagaaatactcaacacttccaggtttctgccagtaattttgatttcctacagatgattgccatcaatctacacccattttgcagtcaaggaaaataaaaatataggacgaactcatgcaacgctagctagaagcctagaagaaacccagagtcctctagtacaaaattgtttaatcttcccattcataataatctgaagaaacacctaaatccttgaaacaataacataacgatgttacttgacaattaaatactaatccactaattaaacaaaaaaatgaatcgggttccatccagtgcggtcaccaactaccatcaccagatacgtggttggaaagagtatactaccctactaccagtgtaaatggcgagttcgagaaatctagatttcgaagaaacacggcgagtaagagtcggtgggacagagagagagaaaccttgccgctccaggtgtagtggtcggtgtggcagagcgcggtgaagaggatcttgacacggacctcgccggcctgcggcggcgccacctgcacgtcctcgatcgtcatcggcctgttggcctcccatgccaccgccgctgcacccaccaccacaccggggatcccccactccagatcaaaccaagaacactccaagaaacagcaaccatacatccaactctagcacactagcaaatctaccaccacgaatccacgatactaagagaggggaaccaagaggttacctttgcaggtgatgacctggccctgggtcgaggaagccattttcacccccccccccccccccccctctttgcacgctcggtggtagatgcgatggagaagagaagggaagaggatgtgattgcgaggtgagaggagaggatagggagggggagaagagcagccgagaaggggagaggaggtgggcgtgggttttggttgggttaattgggccgggtccactttggatattggaatattgcatttccaaattattagggctagccagcttggcagatcagcatgtgatgctcgttttgttcctaggccctgtttagatcccaccctaaaatttttcaccatgtttgaatatctgtatggaatattaaatatagggtaaaaaaataactaattgcacagattgcgactaatttgcgagacgaatcttttaagcctaattgctccatgatttgataatgtggtgctacagtaaacatttgctaatgacggattaattaggcttaaaaaatgtctcgtagtttactgacaaattctgtaattatttttttttattagtgcctgaacaccccatacgacaccctatataatacccgatgtgaaacaaaaaaactttacacccctagatttaaacaccccccttaaccatgtagtagtagcagggctgtttggcagagctccaactcctaaatttagttctaggagtcgggtctagaatgtagttgtgaagcagcctaaatccagctccacctctctagttcattttgtaagagagttccacccaacttcgctctcattttaggtggagttgaaactgtttggctgagcttcagctccaggagaggtgagctgtgccaaacaagcccgcagtagtaacaaatttaagcttttcagcatgtataaatattaatcaatttgttcttaataatctagttgatgtgatatttttaggatctcatcccaaaaccactgaagaactaactgttagtgcgcaagagaaatgaataattcacatcctctgaagttgtaactgtaagtctgtagtcagtcagtcctgagctgcttcaacctttcaattcaagatcttgagaagtcactgacgaacaatgtgaacttaaaattcttgtacagaaacattccgtaatttatacacagattatccagttgcgttgctaattacactggtacaacagaacgctatgaatgtgtcatgaaatcatgatccactgattagagcacacacaatggcacatcgacagtttcagacaactggtaggcagctactccgttttgtcatcagagttgatctgctgcgccagcaacagcagcccgattgatgtgaaaacagagagggcagtagatgtgtagccaagaacaagcagtgagaccttgagtgactgcattggatggaagagcatagcaggggttagcaggatgcagaaatcacatggaacttactacacaatcttcaggtgtttatgatgctttgttaccttggccatctgcaacgcgttgtcgtttgcgtactgcattgagccgtctggaatgttttgtataccacgtgctagttgccatgagagaaatctgttttacaagaagaatttgagatgctgtaagtcttgaattcacctccaaatatatatggtagatgtactgaacctcaggagacatatgataaaccagctactgcctccatctttttatatttgacgacatcatctaattaaaaatggagggagtatttgactattcgagtgcagcactttcttcagagagaaccaataaagaattaacttagtatggaatgggtatgtctgaactattaaatatgaccatccatctgttggtataaactaacagcccccagggtgtttgacgctgggaaaacaaatctgtcagcatggaaccgtatcactgacatcagatttgtcccccctagtaagtatcatagggtgaattctttaacatatatgcatgggcaagcgttgacgatatcaaatccacagacctgtggatgatatttcacagtttcaatagaaggaatgccaagtgagtcagctcttacccgaaaacaagtccaactgcagctccaatatttgccttttctgctgtcaactcaaactcaagttctaaaaactggcaaagtaggggaatgagaactatatcattcagaataattcccttaaccattatttaactgcagagaggctcttaccttcaatttcctttttactttcatagcctctacttcagattgaactactggacgttttgatagcagcttaccggttttgctcattgtttcagcaatctacagagatataacaaaaagaagtgttacatttgcacacatacctatgtggtcataccttttgacaattcagtaaatcaatgcagaggggattttccgatagtgactacagagttgtaacgtaatttagcgatgagagaaccatgacacaatgaatttcacaggttttcttctgcctccataggtaggatttttgccattaattcacccacattacagatgtttccatcgaactggaaccagttttacctacatgctcaatggaagcaacattcctactgccctgaatcgcaacatactaacctctacatgatttatgtttgaacatatgatcaaatgattagtgaccaataagcaaatgtaccgaaacaaattcaacaaaacaacagcatggatagaatgtggatagggtcagtgcctagaccttcttcagctctcccttgccgtattgtcccatggacgtaaacctccttccagctgacatcagccgcttgccaaatgctacactatgtaatgcaaacagcaagggacacatccttcaatcaagaaactatgctacataaaacacaactgttgaagaaatatgaatccaatccatgcctgatttggcactgccggtcaagtagggttccattgaaggaagttgcttgacaaggttgtttgatgtcgatgtgtcagccatctcccatgcctttgcaaggttgagcagcagatcacctacctcttggccacactatctctccacagagaaaaacgaaaacttcttgatacaaagaataggccttcatagatctaataatcatcgagttcttgcttgaaaaggacatcgaattcattagtacctacggacctacctcgtcaagaacaggcccattggagagatcaaatgccgcatcattgagcttcaacaaacaaccacataaacctttgttaacccaaaatagaatttctcgtgttcacaagttacactttaaactttgtatcactgcatcattgctgctattcgagagtgctaagtttgaaataaaaaagtagccaaatcgtatcactagaaaacataggcatgaattcaacggagatagggcaatcgctgcttacatcgaggcgaaggtcgcggggaagctgggacaggaatttgggcgggagaaccaagcaatcctacaaagagaaaacgcccgcgaattcaaaactttcgaatccaaacatagatttgggccactagagtgctcaccgcgagttcttgcaagaggggaaggacaggctcctcgtcggggttgtcaccgccggtagaagaggaggtaaccggctttggggagtcggaggagacggcgaatacagggggtgggtatctacatcgccggagatggaagcgggaggggcggaaggaggaggaggtggaggagacggcggcggcggcggcggcggcggcgaggagtgggcggcggaggacggccgtggccattcgaaaacgctctgcttttttttcacctcttttttttccctcaattttcgttctaattttacatgttgagatttttgttttggaaaccgaaacatctgggcttggagtggtggaagggcccacgctatctctttgcttccaatggaatttgtccaaaatc

SEQ ID NO: 66166 - DNA, 14528 bp, Oryza sativa
tcacaatctcgatcaactctttcacttcatccacttccctcctcgagtctaccacgataagagggatggtatgcaagatgttaaggaactgcctcagggcttctgggaacttaccttctgtggtggccttgtaggcagccttgagtctgtcttccatttgtgagaaggtgaaaacaagtgcaggagggcctctcacattaggacttgcagactcactccaacctttctcaacagcaaccggaataatgggggcagttgcaagtgcacgaagatatgagtggctgcccatgtgcagatcgagaaataggggcttgagaggagcaaagtttttgatgcccaattgacggctaagcaatctcattgcagtgtcaaagtttcctgctgctgcgtgctccccagcaagagaagatttctgagtccaaatctggctgacaggcatgcctggaggaggagcaacaaagaccactgagagtgcattaccggcgtttttaggggtctctgcttcaggcggaagttccaggtcttctaggtcccagccaccttcctcaccatcctcctcatttgcttcaccctcctcagcatcaaaaccatcaccaccattcgccatcgcttcgcttgcatcaaccatatccaggtcctcatcaccccagtcagcaccagcagcttcatcgtcttcctcaagttcagccttcccagtagcatccagtccaccctcaaagataccacgcatcaccctaagcaatggccaatcaccactggctgtgagaggtgcaggggggatcaaaagagagcgagtttttccttcaggtagagaaggaatattttcacccaattcagcagcaagcctatcagcaatttctgtgagtccatgggtggcagcagtaatataagcaagaggtagctgtccagcattctctaggatctcaactctcttcatagcatcaccaagatacagagcattgtggaattgacccatcaggttattgttctgtccagcaattttgcacatgaaccccaccttgtccatgtaaccagtaataagatataggaaagcaagcctctcaaaattctttgtacgttggtacgcatattccacaataccaacgtttccctgcctcagggcctcgattcccaaccggtaccagtgatctttgtcatcaatctctttggcagaagcaactgcaatttggatgttaccactctcaagagctaggttaaatcttgtcttctcatctttcacaaagtggagggcaacttctggaaagcctttctgttgcaaataagaaatcacagcctgcccacacagctgggaattcttaatcatactcatcacatgatcgtatcgtttccgtagaagggccagcttgaaaatgtattcagaagcatcaactgtgatcagcttgttctttccatcacgatctaggcagaaaatattattcccaatagcccttgttatgtaaataggaacgtcaagggttttaatgatcccactatctccattgggaagacaatacttgatatggttcaaagtagtgtaaataaacacaccattctcatcccaggcaccacttttcacacggatggtttcatggagcgtacaacgatggacaagcttcttgtttgctataaccaccgcatgcttgctcagcaatgcaatagattccatatcactcgaccaaacaacatatttaacagcaggtgcctggagctcgccaagaattaacctttgctgcagatcaaagatggtcactcggtcttcagctttgcacagcaagttaccagtcccagcataataaattgcatccatcgcaataggaagagggcttttctttacaatttcattcttaagattcttcaccagaacttgattgctactcttctcgagcactgcaaacctgttgcgtgcaacaaaaacagctgacccaccagctcccttctttgcctcctgcaaataatcagtcctgccagcagaatccttcggaactatatagagttcataggagcctccatccacatcagagcaaatcaggacggcattttcagttggactatacgacagtgtcctgggtgactgattcaagctgaccgatccaggtcttcttattggagccaactgaacctccttctgtgtggagtattcaaagaaccgaagaaaacggtccttcacatagaagacagtatcaccactcacagagaaagctggacgttccctctctaatttaaacacaatcataccattgtcatgaccagcggcaagaagattcatctcagggtgggcagcaagaatccagaaacgatcatgttcccgcctgaatgtttgaataccagttcgcttggtggcatcccagacacgaatgcttttgtcctctgagttggacacaatgatgtcttgctttgcatggaacatcacgcaggacacattattcatgtgcccccgcaaagtatcaacttcccaagccttggtgtctgtccaaaaatagcacacttagattgcatcatttcaaatacctcaatagtggtatgcatataatagcgtttggccagtctaccaatgtgcagtagaataaagtgctacgcaacaagagtgaccacctttagtcccagctaaagtgatatactctaggtcgggagctagttactaattgagtaattgtgaaacatgtttcttgcattcagcttgtttggtgacaagttagttacttcttctgtatgataaattgaacaaaacaaatgaatttatcatttaaccaaatccattgttttgtagtactgttatatggaaggatgaatggataaaaacataaatatgtaagtgtttatcgatggaaaatgataatcaaaaagttcagggcgtagtagcagtattaccattcattctccatagcttcacttgccggtcatctgccccagaaacaatgagcggcaatgtggggtgaaatgacgcccagttcaccccacggtcatgcccttccaacacatattttacaactgcatcaacacctccaaacagatcagtgttcatctgggtgaggcgcaggatgtcatccgcaggtgacaccgtcttcttcctcaaagcaccaatatcccatacacggacagtctgatccagtgatgcggacacaaccagatcctccttgggatggaatgatgcgcacatgacatagtggttatgtccagtcagcacagccacacatgtgcgtgactgccagttccatatccggattgtctggtcatcactagcacttactatccatgggtactcgtggtggaattgcacggtgcgaatgtagtcaaggtgcccatgaagtgtgaagaggcagcggtgtgtcttgtaattccacaccttaatcttgtaatcatcacctgcaatgcatcacagaaatcttagaatctacgattcaacaattccatatcccaatcgtattagcccacagctatcccagaaatacaaccaggcggaacaccagtgtgacttaggccctgtttctttcagcttgggattattataatccagattattgggagtaagttgaaagaaacagacaacttattgaagtagcttattataatctggagcccagcttattataatctgataagctcatttaggtgagctttttccagattattgggtgaaaaattacccaccatgccaccccactcctctttagacttgcaaacccaataatctaggctctaataatctaggaaagaaacaactaaccgtttattctactacagattacaacaatctagcttatagtaatctgactcaataatctagattataataatcccaagctgaaagaaacagggccttagtttcaagtttcaacagatcccgaaattgaggtttcaacaaattccaaagttccatgatggcacctcgccattgctaacttgctatggtatcagattcacaactataaaagctgcttctctctagttaaggcctacacgtcgactcatatcttacctcttgtttgaaaggattgcggaaatcaatggagatctcggtcataaatagaaacaaaatgtcacctgaaggtcttaaaactaacaacaattcaccaaacagttggtcttaagctagcatgatagaagaagcaacaccagatccgaccaacaaaatggcacttgcacaaccaaagcagacctaatcgtagacctcgggtgttgccattgcagcatgcagaaatctaacgccctcaataccgacgtggatccaaccaaacgcgcgaaaggcaaataaaagagcacagcaaatgggcgagatctaggaggaatgaatgattgactgacctccggagacgaagagcggctgggtggcgtggaagtggacgccgcggacggggccgtcgtgctcgtcgaagcggtcgaggagggtgcccatgcggtagtcccacatctggatcaccccgctgtggaggctggccaggatccatggccgccgcgggtggaagctcagccccttcacccggttgctcttcgtctcgaacttggtcagcatcttcgctagccgtcccccagcggcggcggcggcggcagcggcaggcgaaacccctagccgctgaggcgagcggaggagagagagagagagagagagagagagagagagagagagggcggtggatctgatctggcgcgggaaggaggttgggggagaggacgatggtatggccttggcccttgggcgttgggtgcccaggacggagacggacgaaggtggggaggtctgggtttcggacgcggtcggtggtccctgccctcatgaggaggtgggagcgcgtgtccgccgttggatctggagaagggaagatctggaccgttggttcggtgtgaccgggttgtcagcgggagagagataccttgccgtaatgcccgactaaatattagtcatctcacatcaaatcaaatgtttagatactggttaaaagtattaaacgtaaactaatgacaaaactcattccataaccgtggattaattcgtgatataaatcggataatgcttattatccgtcgcccagtgcgggggagccggatcgggcgctccccccgcgcgcccctccccgcacgtgcagatctgggccccaccacatctctgctactatatgtcattgcaacaaattactcacatattttggaacccctctattaagagaattcggtttatttttttgttccaccaaaaatgtttcacctagtgttctcacaatgtttcactatatatagatctaatttgcagtgaactgaaatactccattacaacaaaaataaccacatattttgaaaccccctattaagggaattcgttttattttttgttccactgaaaaatatttcacctagtgtacttataatgtttcactatgtatagatcaaatgttgcagtgaactgaaatattctttcgctatttgctaaaacattgtttttatataaggtgaaacaacacccgatttaaacgagtgaaacattttcaatctactcagtgaaacaattccaatatacctagtggaacatcgtgcaacatttaaaaataattcaataataagctaattttttttcatcggaatatatccatgtgtggtcttgttttgaagatttaattgcaacgaatttaatggtgtaatcgaatcatgatttggataagtaatctgagagaaaaaccagtttaaagtagtttcgcacataaatcgagcgcccgatttttgaagattttgatcgggcgaccgatccctagtcatccccatataaatctattgagtctaattaatccatgattagcatatatgatgctacagtaaatataacctaattatagattaattaggcttaaaaaatttgtttcgcgaattagctcttatttatgcaattaattttttattagtctacgtttaatacttctaattagttccaaacatccaatgtgacagagactaaaatttagtccatgatataaacaccacctcagtgtttggggtatttatatatatacaagaaaaataccattgcatttgtaacgggcggcatacaacaatgatgaaaagtgcagccaatttactcactaaattggtacattgatcatccagccaatttacactttcatccttggaaattgcgtcttcgactgtaaaaattaggggctattgcattcttacccctacttttaaatttaattgtgattttacccttgtttttttagtgtttgtgtttttgcccctcttttttcaaatgaaggagagttttacccccggttttggatggacagtttaatggtgttaagttggacgtgaaaatgcatatatatccttgcttaccagtacttttacccctattttgtatatgaaacttacaattattttgaactgagattttgtgaaataacttaaatctgagccgaactagaacaaatattttggcaaaattttgaccacctcaaccatgcaggcctagcttgtttaattcatgcaggattgcgcaagcatgaactacatgcgtcaccacggactcatcgagcacaatccaggagtatcaccgttcggagctggccacgcggtgaccacggcctgcccgacgacatcctcagttcctcaccatcgaactcctccgccgactcctttcattcccgatgccatcgcggtgtccgggaggccatcgatgtgcaggacacgatgactctcccaccttcatgctcgcatcgagccagcgccgccgcgcgtcctggtgctcgcgtacccatggcgaggagcttctgctgcctggtgctcatgttgagaagccgccgtctccgcctcgcgtcgtcgtgccgacgagccgccgatgctgcttgctactcgcgtagccgcgccgcctgaggagttgtcgccaccgccgccgcttgctcgcatagccgcgtggcgcgagctaggagtcgccgccgccgcttggtggtcgtgtcccgcgctgagtagctgttgcctgttgccaccgcgtagcactcgtcgccacgccggctcgtcggagccaccgccgccgccggctgctctaaccccccttgggtttggggatgggaacggtgggtaagatgagagcgaataggtgtacataatagtcaggggtagaatggtaatccaatcacttatggagaaggggtttttactccggttcgtaaccccctgtagtcccggttggggaatccatcaccaaccaggactaaagataaagataaagcatttttattcccagataaagcatttttattccccagttagtgttaccaaccgggacgaaagatgctagatccggttgctctttattcttttcttttcttcattgtttttaatatatattgatttcaccccattccgtcccggcgtccccaaaatcccaaatcaatcatcctcaaattacctccaaatccacaatcgatcatctcaaatactcaaatacatcacaaaatcttaaaaaaaaaattacatcacaacttctacaaaattacatattcacatcacacacaaatcaaatacatcacacaacaatctcagatccaatcaaatacatcacacaacaatctcaaattctccaaaaaaaaaaaaaagaaaaaaaccaccggctcgccgcaccagccgggcggccctccgcgccccgccgccctcgcgccggccgccgcctctccgcgcctggccgccctcgcgccggcctggccttcacgcctcgccgccctcgcaccggccgccgccgccgcgccggcctgttagagaggagaggagaggaatagataaggttgaggagagaagttaaaaggagaggagataaggttgaggagaggaggagagacgagttaaaggagaggaggagatacctcgatccgatcgcgcacgcctcaccgatctcagcgtcgatattttttcccggttgggactataaatagatctttagtccgggagtaaagcgtatgacgatcttttttcccggttggtgttatcaaccgggactacaaatagatcgttagtcccggttggtaacaccaaccggtactaaagattaaaaagtaccctggagcttttaaaccgggactaaagatgtttttagtcccaattttttatacaactgggactattgtgaaatctggtcgaccgaccaaagatggtttctccaccagtgaatgtcttgtagattatttttcccttctcatttatgtttctttaattcaatatattgtgggacccacctaatgccatccatagtaggggcaaactgtaacttcgtttcaagaaagcaggggtaaattcgcaaaccctaaaaaataagggcaaaatcacagttgcagttaaaagttggggtataaacacaattatccccgatggctttgcggaggacggaaaaaaaattaggtgtggtggtgtggcccatgggctatcgcgagaattaggccatagcaagaagaaagggaaaaaaaacaatctcaatgcacgatattatatgaacaatatcctatcatgatgcaatctaaaacatgccaacaagcactagtcataagctcacaattcatcatccatttaccaaaagtttaaatagaagaggcactcagaaatacctcaagattttagctgtcaacaatacatcacatgaaagaactagtgtggatagatagacatgtagtgatgtagaaactgcaaaacaaatggaaaagattgattagtatactatataattgagaattgagattaataagataaagagtaattgagattgactctgcctgctccctgctgcccctgcctgcgggcagctctacctgattgctagctagccgcctgcctcccgcggccgccacgcagctgcctgcctggccggctggccgccgcctgcctccccacgccggcacatcgccgcgccgctgcctggccgccgcggcgccgcctgcctccccgcgcggcctcaccctgccggcttccacgcccctcctcgagcagtgcccccaccgaccaccgcagcgccgccgctagcccccgtcggccgtcgcttgccctcagtcagattgaggatttggggggattgggaaattttggagttagggtttcatggtcaacaaatcaaaagccccatttaacacaaaaaaaaaaaggcccaatgggcctaattaggtggccagtggcctgttcgcacgcacgcaggcacgcggcttccgtcttgcatttgcaggcagcgatgccgccatcgccatgccggagttgtcgccgtcatgccgcctgggaggctgggattcgccgcgggggggaggggcggggggtccggcgggagagcaaggtatggcaaacgccacacctcggcctaccgagccctccgcccctgattatccctaaaaatcatataaaatctatagtttttgccgttgcaaccacagccgtccgacattgtacgctactgttttactggttcactgttgcattatgccaggaactgttcgattgtttgcttgactagatccggccgttcgttttttccttctttgcagccgctaccagcttccagatattcctctggtcgttcgcatgtacgccgccgccgcggcttgcccttgattccccatccgctcctgcgagttccttcgcatctccgccatcgacgctccaccgtgctcgcctccatctctaccacgccacctcgaccttgctcctcgatgacctctaccacaccattgctcatcctactgaggaagcggtggcagggccgcgccgccgccaacacccggcgcccatgggtgcacgccgcgccgtcacgaacgcgggacgtcgttcctcgcatcgcctcaacacctcgcggggagccagcgatggtggccggctctctccgctctctggccgggcggccggcggcagtccggctctccgcgactccgcctgtccgccattcggacgaggcggcaactccgtgttgacggtcgttgttatcgattcgaccatcaatattaccaaaatagaggagaactagtgatgcttgcaatgcataaatatgttagaataataatattccactagtagtaggtatactaatcttttgcagagaatgacactaaagtggaggagaatcgacatcaacatagaaaataaatcaatcggacgatgttgagaatcagacttatgaatgaatgggccaaggacgcagaattgacacgatgaattaggccaaaattcacaagtctacgaagtgaagcagcggaggaggccaccagccaaaatgtgggctggttgggccggcccctggttcggcctctgccagcgccgatagatgcagggttttgagggaacggtggagattcactccctatggcggttggagggtattatcgacctttctaaccgccataaccgtcattaccggcctatttaaggagttcactctcttcacttcaacacacacctcaagcaatagctctctcatttctctcaagtttagtttagtagtatctagctggtggaataggaatagagtagaaatcaggagtctggaagccttcggaagagttcgggtatggctcaagtagcttttctcttctcttttgtaagctttgtacttttattagaatactcttctaaatatatttatggtattgaaatacttttcgagtatatgaatacctattttacattatgttcatgttatactgaatatacggctagcctatctaggagatgctttggtgcgggtataatgtttgcttatgcaattactccatatcatgacgatgatattagagtagtatctggtagtttaggcgtggtgtctagattacaggatatcattatttggggttatatattgcggatgagaggtgaaccgctgatggtgacagcgcagtactggtattcctccgcgccggtatataatcctaagttaattccctagggagggtattcctccgtatttagcctcggttgtatggtcatgacgggctgtcgtaaggaactcggtagtcagaggtggcttctcgaagtcccaggagggcatcagatagagggtattagctaatgcatatatactatgtatattagaagtataggaatatattttctttctcttttctttccactgagcttagatgatttattatgagaatgaatagttactgcttgtgtgtcactctacccttgaataatcttaacccctgcttagaatatgattatcacaagtaatatataaattattagttgacttctctctacatgatcttcccacgggataaaataaatacaatacccttggaatactctcaggtgaaatgctacaatggtatatccgtgcacttgcggatgaactctgtaaccataatataccagaagtatttcagcggcattgctgagaattatatttctagtaatgtcgttaaaaaataccaacaagcatttctagcaccgttgccggggaagattcataatagagattacttgaactaatactttatatttacctttgtgtaatcattttcctttgcagactaaccttggttgttttcactttttgttgtggaaacagggtagtgcatgactggtttcaatatgccggaaaacttcaaagaaaatccaaaagctttcttccggagcatcagaccgcgagtcgttgctctgcagaaaactctaccgacagagaaaccagccgtaccagcgccaccgaccttcaagactatggccagcaagactgttcgcgagttcgctgctccctatgctgacaatgtggccattgggccgcaggtcaacataggggacgtggatttcgacttaaagtccagccttatcacaatggcgcaggctagcccgttctgtggcaagcctaatgaggatgccaatgctcatctgcaacagttcctggagatctatagtacgtacaccatcaagggcgttagtcccaacgccgtcaggctgcggctgtttccgttctcacttttggagagagcgaagcagtggttttatgccaaccgtgctgctgtcatgatgaggacatcaacaccatcgatacatccacgtccacccatatacagcatgatggtcctattacccgcgctcgtgcacgtcaactaaattatcaggtgagttctttcttgagttcatattcctcatctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctactttcaaatggatccagccacatgtccatatctgttctggagcggccgcaattgtcattttattcccgactattttctgtccatggtgctgcgtcacctcttttggcccaatgggctgtgtatccatattgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatctcagtgcttatcctacttgttcttgcttgttcttcgattgcttgcaggatgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcaggtggtatcagagcgtggttcatcggtgagtgaatttacccttcccttcgtcattaatttttttttcctatagtccagaaaagaccaacaaaaaaatagtagattagtttttccatgatcctatagaccattgtgccttttcactagtactgcttagttaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccaccgtcgcagtcacccaccaaatcactttatatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacgggcatctacaaaaaaagttacatccgattctccccagctttggcaaatttaaaatcgccaaattcctcttgcaaaattctgtttttgtggcgagaagcttcgggacctattcgcatagaactttgaaaaaattctacaagcttcatactttgtccgtttgagataagattttctgtggttggttctagtgtgctcctggttgtgaaaaaaatatcaaaaaaaaaaataaaaaaaaagttgtaactcctttcattggaaaatttgtggtggtctactttgatgatatcttgatttacagcaagtctatgggtgaacattttaatcatttacgtgctgtttttaatgctcttcgtgatgcacgtttatttggtaaccttgagaagtgcaccttttgcacagatcgagtttcttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagggaacgccttccacatgttgaaagataagttgacccatgcacctctcctccaacttcccgattttaataagacttttgaacttgaatgtgatgctagtgggattggattgggtggtgttttgctacaagaaggaaaacctgttgcatattttagtgaaaagttgagtgggcctgttctgaattattctacttatgataaggaattgtatgctcttgtgcgaactttagaaacatggcagcattttttgtggcccaaggaatttgtcatacattctgatcatgagtctttgaagcatattcgtagtcaagggaagctgaaccgtagacatgctaaatgggttgaatttattgaatcttttccttatgttatcaaacacaagaaagggaaggagaacatcattgctgatgctttgtctaggagatacactttgttgacacaacttgactacaagatttttggcctggaaacaatcaaagaccaatatgcgcatgatgctgattttaatgatgtgttgctgcattgtaaggatggaagaacatggaa

SEQ ID NO: 66167 - DNA, 796 bp, Oryza sativa
gatacgaacttattccaaacacccatcggtatcggaggtttgcaacaaagcctttcccaagccgacccagggttacctcatgccacatagaagaatcaaatcctcacataaatataggccattttagttttcacaaatcaaactccaaccaccttgatcggtaatctggcaagcttcgcgtttttgccttaccaggaacccgggttggctccaactgaccccgccccggcgttcccaactattggcatgcgaggtttccctgaaccgactagttacttagctagggtgtcccataccaccttgtggttgcactttgttatgcttgatgagtttcacacaggaatcggtccttatatgcgaatacgggacagcgccacgcaggcaccacccccgcatcgcgagttttcacaattcattttatttttaaacacaccgacaccatatgtcgggttttcaaggcttctcaaacccatttcccaatttttcgacaatcaacggtgtatatgaggtattaggtatacgcgctcagagagcacggataccgaggtaccacaagagtggagcgacaaagaattagggtagtacagcctacaggaatttgtgcgactactgggtaggtccatcggattggcacgcaaaccgaggccaagcaagttaagtgtgtgattctactaatgcaagttgaaaacaaaacaataatgagtttccaattataggagcaaatgatcaaacggtgacttgccttgctcaaggtcttcacgaagcttcacgaatcttcgagaaatcccacgatcga

SEQ ID NO: 66168 - DNA, 7869 bp, Oryza sativa
aaataataaaaaaaaattgttactaacatcactcattgcactagtaatcgtcaccctggcttgccggtattcaaatagagcgcttactccccttaattctaatcacttcatgtcagtgaaaaattgagctgtaagcggtgtgtgtcatgcacatatgtgtggcaatggaggatgagacaatcttctccttcttccctgatggcctctgtctcatgattctagatgacgacatgaaggtcatcaaaaccgcaacatcggcaacgttgttcgaactccactatccatgtagattttggacgatttttggtgtcctgcgtgcaatatacatcagtagattgtgtgtacaacacgcagatatctggacgggtatgggtccttgatgaaatatttttgtttgtgtaatctttcaatttttgtgggatttcttgtgaatgaaagttttattgtttgtatataggtgtttttttgtaggatttgtttggaataaggaacttttgtggttctttcaacttctttgataccatcttgtttctaaatgttttggtcgcttgatttgagatgcaaaatgtgtgtagtacattttctgattttcagcaaggtgttttgttttacttttgtatgtgggtcggctatagtctacgggtaaaggggcagtcagtgactcattgcatgttataaaaactttcttttttaatgaaactgaagataatgtgtcccttgcatatcatctactcaaccacctccccctacgaacacacaatgcgatgtttttcagcagaatgaaatggttcaaaaagaaccaaaccgtgagttttcaacatagtggagtggattggttgcattcgtttcaaaaaatccctcagtgactcacgtggtgaacatctgtgcattaaatgtcaatattggttcatgtaggtgtgatattttttatcggaacaaaattttttaataaccacaaaaacatgtgttttggaaaagtctctccatgactcgcatggctaacatttgtgcattggatgccgatattagcccacgtgggtaatatttttttcattggaacaaaatatttcaaatagcaccaaaacatgatttttgaatatattggagtgattggggtttgttcgtttgaaaaatctttccatgactggcgtggagcaaagttcggaaattaatgctcgggcttagattgatgtgatatttttcaccgaaatgaaatatttcagaaaacaacacaatagattcttatcggtctgctcttcttctttcatgtaaatgctattgtgctttaactatatctgtagcgatggacccgttatgatcgtgtctcaccaagatatttgtatatatttcttattttcctgatattgtagaataaccccatatttagggtgttgtataaactaatgtataaaaggactaaaatactcccaagataatgttgtacatatatagcaaatcaagagaaagatgtgatttccgtttacatatgaatacaatgagccctcctaggacaagaggggaggggtctccccattccatccacctctctgagccttcatcctcttcctgtcatctcctcacaggaccaagcttgggctgcctcccattggagggatgcccttgccatgcatgttggattttgttccaacacctgattaatatgaaaatttctaaagtccataccaccattttattatttaaaattttaatgatttttcagttaatcattgggggatttattttatatttattcggatggtaattaatctcatgtggggttctatgataaaatggcatttaaatattttttattttaaataaattttctatgcatgcatgtcgccgttaaggacatcaccctgatctagtgatcttccacccccgtgcgtgctttgagtcatagctcggtctgccgctcgatcctattgcggagctcgatctggcaccatcgaagtttgattcgctgccgtcggcaccccttccttgccactggagctccatggtccgtcctcaccactacagctctcctgtcattgtcaagctcagtctacacatcggagctcatctaccatcagtcgggaggggatgggagggtacacgaggaggtggcaccggcgaagatgggagggggaagaggaccaaaagcagttgaatgcgcgatgggggagaaagagaatgggacgagggggttccgtcgataagcaagggtactctatatgtaattttttttatcttgataaagagtctaaatataaaagttgagttgatttgttaatatacaatatgaaaatgactaacatacaaggaatcgaggcctgagacgaaatagaggcacaagttccgctccgccgttcgccatcgttgatggtcgggttaatttctgtcgggctcggcacaccgtacgtgacgcgtggtcgcgcgcgcgcttcacccgcacctgcgggggcgcccggcgcaacgctcgaggaggatacacggttggatgaagacttggtgagttggcatgcgacagtaaccgtgacgctagctatctcttgctacctgatcacttcttgtccatttgcacttaggtgcagcgtgcaacgttggtttcctctgcatagtagcacgcacgatcgacgtggggagtggggactactttttattattttttaagttgcttttgttctttcctccctattgctgcaatggacgtcagtttcgaatgggtgcaaagtttttaaagtatacgggcgtatatttgaagtattaaatgtagactaataacgaaacaaattatagattctgtctgtaaaccgcgagacgaatttattaagtctaattaatccatcattaacaaatatttactgtagcatcatattatcaaatcatagtgtaactagactcgaaagattcgtctcgcaatttacatgcaaaccgtgtaattgatttttttccatatttaatgcaccacgcatgtgtccaaacatttgatatgatgtttttggctaaaatttttaagaatctaaacaaggcctaaggtaaaaaatatttttccgggaaccatagttatagtagctggtagttgcctacatgaaataggggtggagatatttcgatatatatggacctgcatgcaaaacatagaaacatagaaatgattaaactactcttgttcaacaagacttaggaatgattaataaaccactattgttttttatttagtactccctccatactggtaaaatataacgtttaggacaacatttagcatactaaggggtgattaattagggggtatttttctatatctgtccctattaaatacagttgtgcgtagcattccatttgagaagcaaacttaactcaagcggctagtgcggtgaggctggagtccttgggatgattttgcatgggaaacgaggtgagcaggcgtgctgcggattaattgtggaagcttggctattgaatagacaagagcaatcccgtccacaaggcctagctacggttcataacgtcgtttaaatcgcaaacgaggttaggggctagaacgaagtttttttctatattgagagagtacgtgctgtatttcctatcatcgttttagatgatatttttaaagttttatattagtatgaaagttaagtaaatgttgttgagtatgcatatgtggctaatggagctagcgtgccataattttgtacggttcatctcaatatttgtgttcataaagatggcttcatgtataatactaattgtaggaataagcacgcactcgagagtaatttgtgtggacatgaataagtaatttgcgggcccatacaaatttactttagatgacaagataaattaatggtagtaataattgatatcaggctgacgttgtagaaatgaccgcaacgaagagaaagggagatggtatggttgatgacataaaattttagtaatagaaaataaatggagtatgatgacaatagtgatagaaacgcctgtagcgatagtaacggtcaaaaggatgacgattggatatgagtgctgattggccgatctttgtcagcgaggaatattctggtaccgacatttcaagattcttttccaatgtgtattatctatatgtcatgatagagttaacgaccatatatatggcggcgggaaggttaaaagtaccattattactttaagagagctgaaaaacacatatattcccacgaaacaaactataatttccatattctaacacaaggaaaggaaatattttttaattaattggaagctgagagtctatcctctcatatctgctagtaccaattttcacacccctatccattaacacacttcaatacatgactacagtaagctttctccggtgcactgcaaacgtaagcgagaaatggagcttttacgcctgacccagctcttagcctcttaattattgtcctcacatggacacgtttggcagatgatgttcccatctccccaaattttcaccaggcctgttttcctccgttctcctagaccgatgattaatgtcctaagcaaaattccaatttggcagatatacgatgttgtgatgcaagatagtattaaaaagcacgaccattttgttggcgttcctccgctacgccgtgcgtgcgccatcgtcgatggcccgacgaatgcacgccgtgatgtgtgggcgcggcacccacgcagccggtactcgctcgccttgcgcgcgcgcggccgcccaaagttcgaggccttcgaggatatacactggcaggtgcgttggcgctcgacagtgtgactatagctttctatctctggctggcgacctcacttctcctttgtccatttgcacttagctgcagcgtgcgatgcgagaagaggcgtacgtcggtttcctctacatggtctcaggcaccggatggatgatcgacatgggggccactttctttcttttttttaaaaaatatatttttcagatgctatgttcttatccttcatgttgttgtatttgggatgttagcagtttcattggacactggcgacatggactaggtgggtgaaaaatttgaagcgaaacaagcgttaaactatttctatagttagtaggtgtgcaacgagagagggatggagatatttcgatatggaaatgcaaaacttgggaaaggactatactacttttgcgctcttgttgaacaaaggactaaacaaatcttgttttccattgcaagtgtatcgaaaatcaagtaggtgttcttgagtgagcgtgcacaatgtaattaacggaattagtactactaccgaattgatttttctgaatgagatccctttaggttgcaggcagaccataactactaccacatgcaaaagccacttccccgaatcggttcaagggctgcatgcgaaaatatattcactctgctacttctcccctcttctcccacttcctcttgatccaggccggccacctgctcgggctggtggcgatgacggcgggctcgggcaacgacaggagtggtagtgccagcgtcgacgcaggctgcgatgagctcgggtatggccgcggactctgcctcggaccacacggatcccgccgtatctcctcactatcttcctcggcttcttctctccttacggccaatgggcacgggatccgccgatgctagcgaaagagtgggagccgcaaaacacaaaaccccagccagatccattggtttttggcggggggcttgctcggggcggatgcagtagcagcgggaagcagtggatccggccgaggtggatccagcggcgacaggctcaggagccaagggtgtcgatgagggctgtgatgactgacgagctcggctgcggatcccgccttctgtcctatatctctctctctcccctggccttggcatatcctctcctgacggctggtgggcatggatccgctggcggcggaggcttagggcccggcgaggtggagtgcgacgacgaccgagtggtggcaaatttggcttgggttttgattttgacaattttttcgaccaaaattattttcgcatgcagtaggtataggtgaccgcatgaagaaattccgtcttcacatacggttgcgctggtcgcatgcgaaaatattgattttcacagatacctggatgcaggtggctactttgcccatatgcaaaaataggttttggccgtctacagaaacaattgtttactggtgtagtatgccattaatttgcattgttaattcatcccagtatttgtgtttataaagttgggcttgtggattcacatattcgaatgcaccacattgcatggacacgaattagtaatttgtgggctctaataaatttacttggattacaagataattaagtgaaaaggagaaagggtatgtcgttgtgactttaattttctttaaaggatctatgactttaaatttaattagtagtaaaacatgcacagaggatggcgacaagtgaagcgtccgtgctatcataacggtcacaggacaacggttagatggaagtaatacatatatggctgttcttcgtcggcttccaagaaacattctaatagcactatcacttgaagattctttcaatgtctatatatattatccatgcgctatgatgagtcaatgaccgtatacatatatggcggcgaaaggttaaaatacaattatatataaatagtggaactgaaaaacacaaatatttcaacagtaaactatatttttatatatctaataaaataaaaaataaatagcaagtctgagtatatatccatatctgctacctacttccacacccttatccattaataacactcttctatacatgactatgaagtactccaccccgttgttattaccccggggcatgacgaccatcgatggatcaatataacccttgtctccaccgactgatccgagccgattcgatcgacattgaagaaagtgtcgacataccccgcatcacttcatcgctgactgcgcttgcgacgacatcatcaagatgactagatgatcaacgctcgagagtttagctacatttgttcatgtatatatccatgcatctatggctgcacatatatacaagcatgcatatagaacagtccaagtcagtcaaagatcatatatatttatatacgaacaaaaagcaaccacttctcgtcacacaagaaagttcaaacgtcttcacggaagagatagagatcagagaaaatggatgcctatttgttttctcaaagtattaatgtacaatgagtaatgtgcggtatcattttgtttaaaagagtgtagtaccatttaccaatggggtagatttttaaccgggatgttcatgcgtatatgaagcacatatacacttttttgaaaaaaaaggccccaagaacgtataataacgtgtataagtgcaaaattgaggggctttcaactttgtgcaggaagtgacagtcgtaatttccggctaaaaatgcatatagaaggacacgtttcacctttcacaccggctcaaatgtggcagtgaaacttcagttttctccacaaaaataataaattaaggaaaaaaatcgtcactacacgtcactcatccccatctcccaggcttgtccggcctataaatgcagcctccctcccctctattctctaatcactcaaaacactcatcaatgaaatctgatcagcggtagctttttttttttctttctgaaggaacaaaagtgagcaatagctagcggtacatctctctctgtggcaatggatcaagcgaggatctcgttcttcccggatggtctccgtgtgatgatcatcgacgacgacgcaaaggccgtcagaagggcaacggcgacgttgtcccaactgcagtacgcaggtagattaatttggatgattttctgtatgagatttttttt

SEQ ID NO: 66169 - DNA, 11150 bp, Oryza sativa
tgtaaatgtacatcacaaaacgtagggaatttcgatatgaactgcaatacagtttcgccattacaaatttgcaaggccagttccccgcaaaaaaaaatataaaaaaataaaaatttcaaggccagtttaaacatgaacaccaccatgatccatcactctatgacaattaatttacacccacagagtcatcagcagataatcacatccagttaagctcttcactgaaagtctgaaaccatccatggcctaaactacagagcactacgcatgcagcagcagagtgatctctctctctctaggattcaggcctcaggatgccattgacgacggagaggcccaccacgacgccgagcgcctcggtggcggcgaccgccccggcctgcacgagcccgtctccggcgagctccgcgccggccaccagctgcaccccttccccggcgacctccgccgcctccttctccgctgccttcaccgcctccccacccacctccgcggcctccaccgccgcctcctccacctcccgcaccgcctccgccgccgcctcctccgcccgctccagcttcttcctgatgccgaagagcccgatgccagcggcgttggcgggggagggggacgccaccgtcggcgccgcacccgccgccgcggacaggagcaggagcgccgcggagcgccggtcgaaccgcacggcggaggcggccacgcggcggcggcgggtggtggtggtggttggcgcggcgcggaggacgaggttggaggcggtggtggagacggccatggtggtgagtggcgttttgctcagctcagctcggctcgtctgctcggagcctcggactcggagtggtgagtggcgcggagggaggcgtcaagtgtggccgaggatgtggtggaccgggaagacggttgccccggagccaatcgtttggtgacatgtggcatgattattctcatttcttttttttttctttttccaaaaatcttgagatttggagtatattgatttgttctgtccaagtgtcaatgattgaaggccaaccttagcccacgttccgacttccaaattggccacacttctgtcaaggttatggcccaacatatattacctctgatttttttgaaggatttagactgttgactcataaaataacatttggtcatttaactcattaaaaagttaataaaaatatgctaaattataaattatacctaatttttttaacgataaaacataaaaaaatgataaatgatagtaagacgaatgataaaatactatgtcaaatttcaatgacgccatctgttaaaacagaacggagtatatatggatcttttttatggctgaatgcatggcccagtattaagattttcgtgaactgaaaaggttacatttttcgtaaatgtgttctgggatatcaattagaaccaatgcaatttctgctggagttcagataatcaaacagataaaacagactgaaaaaatgcagctccaagagaatggaactgactgataaccccagcagactaaaactgttcaatgttcagtcaagcttctatcagataaacgactgatagaaactaataaatttcccatgcatacaaaagatacatctgattcgttaaaaaaaagagatacatctgctgtaactcagaacaatacattcttcctgtgcctgctcttgccgtcttgcgatgcgctcaaacaagtaatcgctgcatccatggttgcctgaaaatcgcatctgaaggcagcattgcattgtattgcaagtttctcctgtgcatgtgaagtaaatctattactctttgattatttctttccaagggcgaggttgacccggatctccctgccttctagttcctgcaaaatacgttgtcgttcagttaactttgtaaggatgtcaacaaccatcttaataaaacttgatttaaggcttttcttcagatacatgagaagacaggttaagcaaatctcctttcgagcctaggactgcattcaaggttcattccaagaattcttttgcgaagttattagtgatgtgaaccacttaacctctacacatttaactggaattcatccatccgtttatttggcatttggaagcttaacaaatctactctcactgtcatgccaagctaagcaagcttttgggtgtagagtatcaaggaggaaagaaaacggtggaatgaaggtgcatttaccgttccattgagcgaggaaagagcttcatccatctcctccttggtggagtagcagacgaagccgtagccacgggaccggccggtctcgccgtcgtagagcacccgggcgccgaccacgttgccgcacttctggaacatctccgtcagcatctccgaggtgaccgtccacgacaggttgccgacgaacagcttgtgctcagtctccgggtacagcggcagcttcggcttgggcttgtccgcgaagttcaccctcatcgtgcgcccactgtacagctgaaacgaatcgaatcgaatccttcaggaacagaactgaataattgatcgattgaggatggttggattgatcatgagagattgagagtgctcacgctgccgtcgaggttcttgatcacttgctcgcagtcttcgatggtgctcatcgtcacgaacgcgaagcctcggctcctccctgtcgcccgatcgtacaacacctgaagtcaaattgcagatgttgagataaagtttaatttgtctaatatattgatatgcaaagcttttgcatgttcgtgaaaataaaagagataaaatttaatctgccgatgtaggttctggtgcatgtctcaaaaataagcaattagtctgatgagccatgatcatttacttacgtgtcaggtgctcgggtatgtatcttactcttacgctaggaacagacatagaacggtgcttgtgtttgttaattagcattgagttggattgttggcttgttgctgcaacaaaatttcaatttctctgaaccccaacattgggaattactattgagttcatgtcggtaacaaaaacaaaaacaaacaaataaataaacaccattttttttcgttcaccaactgaggaacgaattaagcacaagcaagcatgtgtctactgcatataagttcacttaagcatttaatcaagcagaagacggtgacggtgtacgatacctccaccatctccggggtggcgtagtcctgcacaatgccggcgagctgcgcgctgtcgcagttgtacggcaggttcccgaagtagagcttggtggtgatgcccgctgcctccgcctccgcctcgccgccgcccgagctgccctccaggacgccgccctgctcctcctcctgcacagctgctccgtcttcctcttgcaactgctcctcttcgacctcctcctcctgttgctcctccacagccgtggccgcggcctcctcctgcgagaccatcgccgtcgccgcgcgcatgcgcatcctccccaccggcacggtgacgggcttggcggcgacgtggtcggagaccgcgagcaggaggcgtcgctggtggtggtggtggtggtgcgcgcgcgccgcgggcgggcgggggaacaggggcgcgtgctggagctggagctggagctgcatgatcatggcggagtccgggagcttggggcgcgcgaggcgtagcgcggcgggagaggtggaggggcagctggagttggccatggcgatggcgtcgtgtgtgtgatgtggaggggcgcgaggccagtgggaagagatggaggacgagaggggataagaggtggtttactatgggccattgacatgtgggcccttggttctgcttcttgttcatcacctccacttatcatgcgttttctgttgagattttttccccctttttttcccttctactgtgtttagcttagcaaaggatcccttgtttagatattaaaaagtaggactggatatagtatataatctttttttctgttttgtactctgtatattgagtaactattattatccatctacgccattattactatatcagacctgtcagttgttgtaacgttggtgcaatttactcttttttttaactactacctctatattttaatgtatgacgccgttaacttttttcccatttgtcttattcaaaaagtttatgtaattgtcatttattttaccgtgacttgattcattgtcaaatgttctttaagcacgatataaatattttcatatttacacaaaaaaattgaataaaacaaagggtcaaacgttggtcaaaaagtcaacggtgtcatatacattaaaatacggatggagtatttctaattttatcaatttttacgtgtcctaaggcgtacattcaaaataatacatccaggaaaaaactcactccattaccatggtgttttttctttttgcataattcagtttattgaaaagtaagcataaaacagctcgaaaacagcaatttttacaaaatgaaaataataaggctgtagttaatctatacccaaatgccgctagtaaacctgcttatttatttgtccatcgaaagaatatagagcttgatttggacacattttacataaccttttttttccactacagaactgcctgagcagcattttattctgcccttgctgcttaatgtcctgcaagttctttcttcttcttcttcttcttcttctttttttataaaaagaaacagagaatgaacatctctggcaaaaataaaaaataaataactgctaaaaaaaaccctaaacagatgggcattcgcagcatgcagtcttgcgatcagacgatcagtacacgtgaagcacgggtgatgatcacctctcccactccgcgctgccgccgccgaagcaggagctcctccggcgatgccgccgcggcccactgctccggcggctgttggccttctccttctgctggtccggcgacagatccgccttccacttctccagcagcagctccagcttcctctgctccacggcggagcccctcgtgtccatcgccccggagtgctcgacgaccgccgccgccgccgccggcggctcgtcgtcggcctcctccgtctcgctcacctccacgatcctcgccagcgacccgggcctcctcaccaggaggtccttcacggagaacgcgtccggggagtccggcgagctgcagagcggcacggcgcgcgcgtcggtggcgtcgagcaccgccaccgccacgttcacgatgccctgcggccgcagcgaccgcggccgccggagctgcagcgccgccacctgccggccggtggtgcctcgcgcggaggacgacgccgacccgacgaacgtgctgaccacgatccgcgtgacgccgaggacggcgtcaccgccgaacctccgcggcgcgcgcacctcgacggtgacggcggccgtgtcggaccggaggaaggcttcttcgacgcggaacaggaaccggtcgttccacgtcgggtcggcgccgccggcgaggtcgacgccggtgcggagcttgtgggcggcgtcggcccaggccacggcgtaggcggcgcgcacgcggcggccgaggcggcggtgcaggtcctgcgcggagatgacggtgacctcgagcaactggaggagcgtggagggcggcggcgacggcgacggcggcggcgacgcggagcagtcgtcgcggtgccggccgcccgccgacattgtgcagatcgaacgaagcaacgacacgagggagagcaggttgagacgccgcgtggcttttaaaaggagaggcaaatttggagggaaccaagtatggcgcgtacgagttggctctacagctcgatcttgcagatgctgcctgcctatttggagcggtttcaattcaggtacgattcgttattgtttgaaatctatgtttgtgagctgtgacaatgatccgatttatacacccgtagcaattgtcaatttcatttatttccttttattttgcactctttttctaaatctcagacaggagtattttggtgtgctttgaattattggaattaaacgatagaagaaacgggaggagttcaaaccatgctgtttggcagtactaagtgctatctgtgtatggtaaacatattactgtagcgcaaatttagccttgcacgtgatacacaagaaacatgagcacatgagcaatagaacacaagaatgtgcgatacatgttggactagggaaaaatgtcatgaaggcgagcaaacagctaagctctgtgcctgtgcagagacagggagtagccaactagcctgatggaccatgcacaatccccacttctgaatactgattctagtatttcacgcatcaccaaaattgcaaaccgatgcagcgagttgcacatagacaacagcaacgataaatgcgtatgagagcgatgataacggataaaacgatctaacattcaaaactcaaggattaacatccaggatgcaaaataacagaaaaccagacatcgtttgcctcatttaggaacatagagttacgataaattaagcaacaaaaagacactggtctcccagcttagcgcaacaagtgcagtctagttgctagcagcagcccccttcttccttggtgcagcctcagtccctggacaacatttgcaataatcaattaacaagtgctacagcatttgcaatatacttcctccgtttcacaatataagtcattctagcatttcccacatttatattgatgttaatgaatctagatagatatatgtctagattcattaacatcaatatgaatgtgagaaatgctagaatgacttacattgtgaaaaagatggagtagtaaataatcagtgaacaagtgatagaacatagcaagaagagatataagcataccctctctgaagttactcttgaacctcttgggcacgtggcgaaggtacctcatcctcccagttccagtggtcttcctcctgatggccttcacactccagttgtctgtgtttcaaatttcgagaaagaatcaaagtagtcagaactacatatcagaggagctgagcagattctatcaaacttcatcaatgaaaacagcaagagacctgctgcatcaagcagcagcagcagcggtctgcagccaggagccgagcaggcttagggcttatatttggggagcttctagcagctgcagcttctcatagaatctctagctcccccaaacagtccagattaaatgcaaacacactatgataatctacctaaccacaacttcgtaattggacacaagggattggccaaaagatgtcaactcgagtaatttgattgaaacaaacaagaatctgaaagcacatatccccacacaaactgcttcctttcaatcagaacagattgcaagtcacaaagaatctgccacaattatcaacagtagatgtaacaaatactttgacaatgcaaagtaacatataggaacaacaactatgtacaccggacaatagtaacataacagaatgaagtaattcgataatgacaaacgctaccagttaaccagtacagttttgcatttcacgtctttacaaaatctctcgcatgttcagaacctactagtattatcgcaaatgcgacacaatataagcaaacgtataatgataaatctcctaacccacatcaaaaaacaaaataactcggacgtgatataccacaagcatagcctaggcacaggaacagcgcaatcaacatgcctgaactgatgggagcgcgaaaaactcatcaacatcgcaacaagctagcaaagagctaattaaaggagagggtgggcatgggaaaaaaagagagaggaggatctcgtcttacacttgcggatgcgggccgcggggtagccgcaggaggagcaggtgctcttctgcaggtggaagctgcggcggccgcagcgcacgcagagcgtgtgcgtcttgttccggcgcttcccgaagctccccgtgcccttgccctgcgcaaagaagaacaaaacacaaagcaaccagatcaatccctgtcagatccacgcgaggagaggcgctacaagatgcatcgatcgccgctcgccgcgattctcctcaccattttcgccttctccttcgcttgccgccgccgccgccgccgagggagatgaggaagaaggagagagcgcaactgctcgaggttaggtttagtaaggaggtcaagcccaactaacatataggccttcgaatgaaaaagcatgtaggccttttggcccactaagtagatgaggcctattaagcagacaaggcccacctaggctattcccaacttaggcccatgaagcgacgagctcgctctttcctcttccgccctatcgccggcggcgcggctccagcaaagctcggcggcgtgctccggcgaccaaggaggccacggaatactgagaggatcagtggaagtgagggccggacctccttagggcggagtcgaaatttcgtagcagttgagaatcttcgcaggtactggagggcggccatggaggagctggagttgcctctccccacggagaagctcgccgtggatccgggcaggtagcgagatccgatcttggcttgttgttggttgcttgatgggtggtctcatccttccatgtatctcttgattcgatcttgatgtggtagggagggaggaaagcgaggtgtggctgtgctcgtggccaccgggagcttcaatcctcccacctacatgcacctgcgcatgtttggtaagcctctaaattttgtttgattttttatgcctataagcttgtgttgtcccatgaacagcttgataattacagcaagaaagttttttttaattattttttcccgtctgatatgtttcatttagaactggcaaaggatgaattgcagcagcgagggtattctgtcttgggtggttacatgtctccggtgaacgatgcttacaagaagaaggtaatgtgtggcatcaccactgttctccttgtggtgtagaggccggattcttaatccattatctaaaaaatatcaccactgttctcttgattgagtttaagatttggaacggattagggccttttatctgcagcccaccgaattcgcttatgcgaactagcatgtgaaagctcatcttttgtgatggttgatcgatgggaggtaactttgtttcattcagcttatacgtcctggtggattctgtagcatttcttgtacagaatgttgtgtgtccttggtgtaggcaatgcagaaaggtttccaacgcaccttgactgttctctcgagaattcggaatgctttgtccaaggatggtttagctgatggaggtatctagcaaccagtttttttagaagataacaaatcctttttcaacatactgttggataatgtgaaccagtgcatctttgtcttggatacaatcaattatgtccaagtccaacatgtactgacataaaaaatgacacaggtagtcccaatgtaatgcttttatgtggttccgacctgctcgaatcattcagcaccccaggagtttggattcctgatcaggtgtaaacgtcgaactctggtgtcaatatagagaacttatgtgctcattttaactcttagtgttatatctagtttctgtgtgattcttattcacagaagagcttgctttgatgacaccctcttctgtatctaggtcaggatcatatgtaaggatttggtgttatttgcatacgtagagaaggaaaagatgttgaaaaaataatatccagcagtgagatactgaacgaatgcagggtaagaatgactagcttatggagcttatactactacagagattagtcttcttttctgatgacgtttgcattatccctttatggagtattttcaggataatattatttcagttgatgagattgttccaaatcaaataagttcgtctagagtaaggtattgttctttcatgcatttgtttgaggtttatcatacggcattctaatatccccaacatcctctgttggatactgacatgtgagtcatgtgtttatgcacaatcaaattgcagagaatgcataaaaaaatgcctatcaataaagtatcttgtatgtgatgaagtcatccagtatattggagaacacaaactctacaaggaagctgacggcagtgatacaagaaaatgacaataaagggtccagtgcaggcaatctgaatatagaccttaatatattcacggttaaatgttaggtgcctgttttatagctaataggcaaatgttgtaccctgggcatctgttttgggatatacaactgaattggatgatgagaagcatttgttttatttacaaaaatgaaacatttcgaaataaaaagagcacctgctaattgcatgttgactggaagttgtatcataatacagatagatgagatacttgtcagcagttgtactccaacatgtaatgctggacatatttcctacaaagcttcattgtgtccatgttagtatggttgctgatcacaatatttcagaaataacggctacttgtatgcgtatttgaccttgtacctggttgtgcaacagactgtggttaaacttttactaacatgtgttcagggatatcacttttcgaacaaatgcaaatgcaatttctgctggatttctgctagattagttaagaggagcaaccatagtatttgcaaacatattagacggactgcagttccaagaggatatgaactatggaactgattgataaacaaacaattgtaaggtgaataatagagatcaagttgtctttcctgttcctcaacaatcagtatatacatacatggaaggagtaaaagtataatagagatcaaattgtctttcctgttcctcaacaatcagtatatatacattttaggatggatagtatgatgatcctcatgcagcagcagcaatttcagttgatttacaaaatcttacactagagtcgtaataacaaagaagcacacgaaaatttactgacgaaatgttgcacttgcacaactactgtctactgccactagttggaagcactcgttgcttcgagctgcctgccattgccgccaccaccagcatcagcagcagcagaagaagacagcgcctccctgccatgtggctccaggagcgcctccgggctgcagctcgccggcacgaggggcaggatgccgccggggttgagagggaagagggcgccgaagtagccgtcggcgatggcggccatgtcgcaggtgc

SEQ ID NO: 66170 - DNA, 7241 bp, Oryza sativa
atctttatctagcaatctcagtgcttgtcctacttgatcttgcttgttcttcgattgcttgcaggatgagtgccctcatggccgggttgacgcgtaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcatgtcaacacctgggacaaatgctctacggcattcctctcgaaattcttcctgatgggcaaaaccaatgcccttcgtggaaggatttccagttgccagcagacaagggacgagtccattctagaagcatgggaatgactacaggagtacgtggccacctatcctcatcatgggatggataactggttgatcctgcagaatttttacaatggactcaccccaatctcccgcgatcacctggacacggtagctggaggagccttcttctctaaaacggttcaaggagccgttgaactaatatagaagatggtttccaatatgggttggagagagaaacgactccagacccgacagcgaggcatgcacaccatcaaggagacggaattacttgctgccaagctggacctcctcatgaaacgcttggacgaccacaagaaaaggtcacaaggcaccgtcaaggccttggactctcatgtcacgtgtgaggtctgcagcaacacggatcattctgggaatgactgccagaaaacccgtgaggaggcgatgtacatgggcaacaacaacgggtactgtccacaaggaggtcaggggtggaaccaaccacgcccatattatcaaggaggtaacaataactgtaacttttctaaccagccctccttgaaggatctcgtttttgcgcaagctaaaactactgatgcattaagcaaaaagcttgctgctaatgaaaaggtcctagaaaacatcaatgtcaaactagatggctttgcttctgcttttcaaaatcagctgagctttaataaaatgatagagacccagttagctcaggttgcatccttagtccctgcaaatgaaactaggaggatcccggggcaacccgacccctcaggtgaaaatgttaaggtgatcacgacgaggggaggtaagtccctcgtgatccgccatatcctaaccctgcaggaaccaatgggatgtcaaaagaagcgtcatctaatgactcggctgacaaagaggttcagccagaaaagactctgccgcaggagtactacgacacacggttgctgccgtttcctcaacggcttaggaaaccgtcagtagacgagcaattcgctcgttttgttgaagtaatccagaagatccacatcaacgtgccgttgttggaggccatgcaagtgccaacatacgcccgttatctcaaggacatactcaacaacaagagaccgctcccaacaatggaggtggtcaagctgacggagcactgcagtaacctgatactccacaagctcccgaaaaagaagaaagatccggggtgtcctacgatcacctactcaatcgtggcacaacaattcgaccaggccttgtgcgacctgggagccagtgtcagcatcatgccaaaagatgtcttcgacaggctcaacttcacggtgttggcaccaacaccgatgtgcctccaactggctgattcatcagtccgttacccggcggggatagcggaggatgtgccagtcaagatacgggatttcttcaccccagttgacttcgtggtgctggatatggacacgggaaaagagacgccgctcatcctggggcgtccgttccttagcaccgcgagagccaacattgatgtgggaactgggagtatccgtttccacatcaacgggaaggaggaaaagtttgagtttcaaccgaggacggaacagtgctctatggtcagaatgaagtacgggccgaacccacagaatattcaaatggtcgaggtggagccacccaagacggacagcctggtgaagttcatgcagaatttcctagagaaggaaacaacgattcccaggaaccgttattggaagacgccggtaaaatgcccaataccggccaaaaagctagagcagccgactcagaaaaagccgccgtccgcaccaaaaccaaagaaagtgtggagggagaagcaaaagacgctcactccatcacctccggagatgggtagaaaatccgtgaactaaatcagaaggaggtacggtcttgcacattggactttaaatgacgcgaccttcaccaacaggtaaattggtatgtatccgcatatttgctttcaacaatttgaatttttgcatcaccgcatgtttgaatttcaaatttgcatttaggatttttgaattatgaggaaattcttcaaatgaattttttttgttagagaacaaaccaaaataaaattttcagtgaaaattcgctgtgctacgaccacactgaccgttggattccaacggccgaaagtgggggcgattgggcccaccaggggttcggccgaacaccctggttcggccgaaccggccaggccaacggtcggctgcctcttcctttgaggcaacggctagtgggccccatgggtcagttgtgaccgttgtgggtgcgctacttaagccaaccggctgggagaggggacttcaccccatttcaacacattttcattccctctccaaagtttgctctcaagttcattcaagctttgatagtttccctcaaattcaaatatttagttgcatatatacaagttgctttggtaaaactaaccggcggatgaaattcttgtcattcctaacccccgccgggttagtccgttcttgctccattgtgtagaatgaggaggcgactgtctcgtctgttcaaagggtctggctcttcactaagtcatcatgacgagtctagtactcgttcatcagccgatgtctcaatggaaggcgccgaagctccgcgacgactcctgaacgacaccgacctcgaccttgtcagtgatcaggagagacaagcctactacatgctgagcgaccgggagtatgctcacacacgagaatactcatcagagctgctgaaaaagataggtatggatgttgaatttcgttctatttggaaagctgttggttggcagagatttgctgtggtagatgagcccggttctcgtttgcttactttgcaattcctgtgcactttgaaagaaatagaagatggaattttctttcgctttttccataaggagtacacacttacatggaaaggcttaagtacacttcttggttttcacgattcctataagatcgatatgcagaaaggaatttctgggttcgagaaaaataggttttgggaacacatttctggtgctccaatttgcaagaaacataggacgaatgacattcataatcctacacttaggctcatgcacaaatggattgctatgactttgtttcctagaggtgatctgagacccattaggggagataaattgattatcatgtttgccatggttagaaagatcaaaattgaattgtatgataaggcaatggttagaaagtataatgttctctgctcctgttgagtgcacttctctgattactcggatagcaaaagggctaggggtcgttagcgaccaaattgcttttatctcagccgctcgtccgcatattgatgcttatctagtgcaaggcatattctgaaacatggagtagatggatctttgatatactttttccccagttgtacaaatgaaatcccgttgccaaatgcagggtatcatttgtacaactgccatgaactaaccattcccctgcaaaccatagaagaatctcgtgcaggtggaacatacagggagacgtgcaacatgacaagaaacgaactagaaagttcatcatcctcgacacccgtgcagatgtatgaggcaggttgggcaccaactggggatgcacccggatggacccaagctccacgccatagcatcggagtctcaacctgggcaagtgccagtgaggaccggtggcatgcgcctcatgatatccaatggggggggacaatcaacctcctaggtcaagtggtgtgcctccatctccaagtgaatggcgctcgagttcctctcgttgggacttgggtgaaatcactaggagaatggacacccttgatatgcagacaggggagatccagtacaacctcacggaacacatagcttaaatgcaagaatggcaacaatctgctaatgcttagttcgccaacatcaacaacatgatgcagcaacagcataatgaccttcaggcgtactttcgtttttaggggttcaatccttatcaaggaccctgagcgaaagccaagcttggggggggggggagacatcgttccccctactaaggtaacttgtatcacattacatatttcccgttcaattgcatatttgctttccaaatgcatcttataaaaatgaaaacaacataaaagtttgcaaaatagaaaataccaaaaagataggatatgtttgagtcatgctaggtaagataagctagttctctttgttgaaatgatgaatagtttctctgttatatatctctgatatatgggttcttggtaaatactttctcaaaagttaaatataagtagccaacaattatccaggaacctgaggtaaatgggctgcacttgcttatctaagtctaggttgttgtaagatatgagatagtaaataagagttactatgatcctgatcctagttcgacttgaattccagatgttttgtttttcaaaataataagtttgaaagttcctcatttgatataaattcctaccagagccaaaaatgtgctatcataattaaaccatatacattttggttacttgccattccattgaattttgtcaaactcttgtgatttgtgtagatacttctcatgctctatgatcaaaatcatacacccacatttatgcacatgctaaactcctacactgggagctaagcactatttcattccattcccattttaccaccaaaataaattctccatgctttcatgtgctttcttctcctacaaagagaagtccttttgaaaaaaaaaggagggaaaggcatggttatgaaaaaaaagttatgctccgtcaagcatgagcatgatgttgaaaaaaaaaagaaaaaaaaagagaatggtagccatgctctctcctaatcaataaaagaaggattttgggagaaggaagtaagcacaaaggagaaacatttttttttctttttcctcatataccacacacacattttgcatgatcttgatcttgagtatgtttagttatctgctctagtctaagtttttgacttagtgataaatgtgaatgcaagtatgccatgtttgatccctaccaagctccacatatcaaaccttagagtacgaataaaataggcaacaatttggtgaggaattcaaattgatacacttggagagactgagtgaatcatttgaggaacttggttttcttttgcaaaatcgtttgaaaacttccagaataagagttgaagaaagatggagtgattggtactcgaaattgctgttctgtctttcaaccgcccaaggcaaggagaagcagtgtctcgtgggtaagggtaagccaccgtgccaaagattatttaatctgagagagagtacatatacctcgcacctgtatctttgagatatgcagcatagtagcaactcctgatcaacaaccaagtctttgttccctttcgtccttcactcaggacgagcaaaggttcatggttggggggttttgtagacggtcgttatcgatcagtttcgaccatcactattaccaaaatagaggagaactagtgatacttgcaatgcataaatatgttagaataataatattccactagtagtaggtatactaatcttttgcagagaatgacactaaagtggaggagaatcgacatcaacatagaagataaatcaatcggacgatgtcgagaatcagacttatgaatgaatggaccaaggacgcagaattgacacgatgaattaggccaaaattcacacgatgaattaggccaaaattcacaagtctacgaagtgaagcagtggaggaggccaccagccaaaatgtgggctggttgggccggtccctggttcagcctctgccagcgccaatggatgcagggttttgagggaatggtggagattcactccctatggcggttggagggtattaccgacctttccaaccgccataaccgtcattacctgcctatttaaggagttcactctcttcacttcaacacacacctcaagcaatagctctctcatttctctcaagtttcgtttagtagtatcctgctggtggaataggaatagagtagaaatcaggagtctggaagccttcggaagagttcgggtatggctctagtagcttttctcttctcttttgtaagctttgtacttttattagaatactcttctaaatatatttatggtattgaaatactttccgagtatatgaatacctattttacattatgttcatgttatactgaatatacggctagcctatctgggagatgctttggtgtgggtataatgtttgcttatgcaattactctatgtcatgacgatgatattagagtagtatctggtagtttaggcgtggtgtctagattacgggatatcattatttagggttatatattgcggatgagaggtgggccgctgatggtgacagctcagtacgggtattcctctgcgctggtatataatcctacgttaattccctggggagggtattcctccgtatttagccccggttgtgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaagcagtagcagcggaaaaaggcgatcctagcggggcttcagctccactccacaggcaaaactcaactgtggtctgagccttggtcctctaacttcatcttcagctcagaagcactacacttctgaaaagggggaataatagcaaggctgagtacaaccaccgtactcagcaagccacaccaacgatgcagacatgcaaggggatacaaggatggtttgtggctattt

SEQ ID NO: 66171 - DNA, 30295 bp, Oryza sativa
aaggacctggggaggatgggggagaggttaggagggggagagagggctcccagcggcatgaatcgctggtcggaggggagaacgggcggcggatgctcaccggcgcgaggggaaccgtgttccggcgggatcccggccgtgaaaagcggcggccgaggtgctcctcggcgctgcgaagcgagcggcggcgacagcgcgacttggggtggctaggagcggcgccaagcggcggatggagtcggcggcggcggtggaaggaggtggtgcgcgtggcgacggtgcttcggaggcggggaggggaaatggagctgacgccggggtgcggcacgacgcggcgaagccgctggtggcggtcgcgtggaacgacggtggtgggagcggctgtggcgaccggctggagggtcgtcggcgagcggtggcgggaggtgcgacggtggcggggtggtttttgtgcacgggagggctcgggagaaaggggaaaatggagagggaggtgcggggaatgtttttataggggaggggaggcgggatcgagcccgagagaggtagaaaccggccggcaacgtgggaggagagagagatgcgggaggcggcgacgtggccggattttgcggggagagtggggggaaacggcgcggacgtgggcgacgaccgcgtccacgcacgcgcgggagagggagtcgcgcgggagaggcggcgacgtgggacgatttggcggccatggcggcggttggggatggagctggaggtaggagatgacatgtggggcccacctgtcggaaagagggggaggggaaaacgggctagggaggaaatgtagacttgagagagagagagagccgagcgggccgaggaagggaagcccggcctaggaaggaggaggggaggaatttgggccgagcccgaaaggaaggaaggggaagattattttcttttctttttattctaattggttcaatgaactttgtgctattgaaaattatttcttgagctccgaaaattcacgggaaatttcagagagtattttagggcacaaagaatattgcaaaatattcccggccaatgatttttaaggaaaaatttaattctcccattaattcactcgaataaattgcttaactttttatttaatttctaggtaatgcattattaaatgatttttaatcccgaacgaaaatcggggcgttacaaatctaccccccttacaggaatctcgtcccgagattctgggatggctagaaagaaagctggtgtaggctagcggtctgactgatctgcacattgaactgccacattctgcttcgaactaattgattgactggttgatcaaacctgcacaattgaaatggctggattcgacctttctgttcctttgctttgccaaaactggaccgactggttctgcttgaactgacccaaccagaactgtggctgctcatgaaacttacttatcttgatctgaactgttgatactagcagtttgataacctgacaattcaccaagctggctagagaagggtgaagttgttcctaagacttgcatctggcatttgtaactcattgatcctacgtccgcttgaacgggtcctggctcgaatgacacgtaattccaggaaacctgcttgacctgtctttcgtctgaactgcaaccgtccctaatgctgcttctcaaagctgagctattgacctggcctcaccggtgtacctcagaattcaatcagataacttaagatcggtgtaactctgctgacaccttgcaactggcttcctcaagtactacccggattgttgcactgggttgaaccttcaactaaaacagcgatgaggtgagccaaaactcatctccgagacctacccccctcataaggagtagtcttacttttgcctgactgggaacaattggactattgtccttgaaaaaaataaccgacacttctctgacttacaaagaccctcacttcgaaaactgaaacttcgtcgattcatcaaaatagagcaatgacgacgcactttcatcccagcaagatttggaacttaaccctcagttgctaataggaaattccacataaagaaattctcatttagctcctgatcttactaactcttgactacttccccaaacagttctaactgctggtacaactgtcttgcttctgacttgatttttggtgtcatatgcctaaacagattgcatagttgacattccttgaaacaagcactgatcacttaacaaatccaactcaaggggtccttcccacggcatgacatttcacttcttcgaccatcctttgctgactcttcctgggttgacggactatagatcctacaacagttttccggaaaatactgcaatctgaacaactattggaaactgactttgatgctaccaagagtttctgctctttgatcataacaacttcgcttccataccttcggtaaagatgatctgttgaatagggattctgtgccatataccttgctgactacacatttctatttctggacccgactcatgtatcttcctgactcgggtatggaacaatttctttttcaacttctgggaaacattgagatggtatttagaacttatattggttgccttgaactaagcaaacacctactgaattcatgatcgcaccactagggtataattgctgattacaatcctctaacaccttccacggttagagagtttccaagattctttatatgatgtcactttcaattattccatcactcctttcatctgagtgccactgatgctgactttagagagatctcatcatgtcgagtgttgagggtctaaccattttcactccgttggtaaaccattcctctattggctcgcaaatcggttttgggagctcaacaaaattgcgatgagttagaagagaaactcttggtttcttgtagcactgacagatacacaagttaacttgctttggcatgatcaagatggaccatataagtggagaacaaaactaattgactcatactttattcaatattcccttttcattagataactgccataaacttctatgtacaagatgaaatgcgacaaagataaacacttgaaggctactgctgggatggaaaagtaaagggcttgactagagctgcaattgcttccattattcgaacatgaccgacttgttctttaactcctactagctgaagtctcaccgggaacgttgccctgcttgctgatctttgatggtggagtggcaactgtcttgacagctgtaacaggtaggatcttctttcccgtggggttaccaagcggtgatttgccgatggacctccgaattggagcaatacgaggtgcattgctagaactgacaacagtcgggcgacctggtgctggcgacacttgctgcgggtgctgacgaaggagcatacttcctctttgtaactgtagcgagctattgttctcctggcattgcttaccctgctggcgctggtgctgtaggcttgaaacgatggccggtggaacaatgcggcctctgacggtgcccttgacgatgattcgttgaggcggaggttgcacattcaggtgtcgattggtgtcgtgggcagtgctggtaacttgcgaataacgacgaactgcctttgctgctcttggaagaggacaatcactgaaacaatgtcctggcttacgacagttgcgacataattgacttgcttggtctcggggtgcaggcttctgattatgcactttggcagctgaaactggaacaagcagtgatttatgaacatccctagcgatgttgcttcttccatggttggcttgcactggggctggaattggaggaagagcagaaggattgtgactgatgtcgtctactgccatttgttgacgaatgggttgcacggttctcccttgttctttcttggtcaaagctaggaccgagttccgctgacaatccttaggcacatgatctgctccctcacacaggaaacatgtgaccttcctcaaagggcattcatctgagtaatgggtgtattcaccacagcggcatgtggggaggcataaactagcagtgtgtccgactaccccacatctagtacatgctttgaacttcaactctctttccctgaaactgtcaagggtcgcgtcatcatcgtcatcattatcatcatcatcgtcatcagcagaaaaccactatcctgattcatcatcttcgggtctgggcggaccgtactttatgagatgtcgggttagctgacgtgctccacggaagttatttcttcctctctgacgcttgggtatccttgctgcgtcttcaggtgtaaattctgaaccggtgatgatcatggtcctgccattatccatcttccatatcactgtcctgttcgctccagagttgggctgcaaagtaccatccttcttgtcggtagactgacttggagcttggttacttccggggtgctgcttctcgtcttcttcaggtgacctggcgaacaccttccatggacagttccttacataatgaccttgctcaccacagtcataacaggtagcacttactttcctttggtctgacgatgacttggctgtcgttatcttcagggatctggacagcattttgacaggggtcttcggtgccgatattgggaactcctgactctgactctgattcgggtttcgggctggcatctggactcgcacctgcggttggtgacattgacgcgactcctgacattgccgttgcatctgttgcatctggtatatttggtaccgacgtcgcatctgttgtaataactcttccactgtcttagtttgattagccatgacttggggttgaggctgatcttcaagaggctgatgtggaatactattagaattgcactgagttgccccatgaaactgacagggtcctgattcgatgaaattgtccctcatgctgaccatctgctgcaggcaccagagagagggggaaatgggaggggttactagagatgaggtactaaaccacttgcctagtgatatgttgtgagtagatttttatggtttaagttgcttaagcaaacaacctagtatggtcgcatccccaccaatgatgcaagccatacccctacacacaagcaaacaacacacgatctagaagctaacgaaactactcttcatggaaagattgggtttaggtcatctccgggaaaactcctattgatcttcgcggaacgacgagtctggacagatcttctcgctctttgcacgaagcttgaggcttagcttgacttgacttccaaacatgcacaaagctgatggcttgtccttcaggtttgacagctgtcacgcccggaatttctatccaaaattccaaacgcttacatgtgtgtgaaccctcgtccaggaatcagccgaggcacacaataacaaattgataatagagtacaattattactccaattaataggcgaataaaatgtcattacagaggtagatagttcctcacaatcaataaagatctaagcagcggaaaataaaataaacggcgcggacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaattataaaacagtagagtaattaatcatcaattttaatcaacactaaacagcacacccatgctgctcaggcccaaccatcctgaacaaccatacccggctgtacagatctatctccaaaccaggaatataccattccaaaccaggagctaaacaaattattaccagttatagcatcttttattatggtgagaagtgtgaaactaatcacaaaagacattgttagacctgcccataactgcgggcgcggctattcgaatagttttactctgatcagaggtgtaccactgtacccacaagacacaaccccacatcatgtcaccatgtgcctcaataccaccacggtacctcggaaaggagttgtgacaataccccttgcataacacaatccactacagcgcacctttcctggatcataatcacccccttaaaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcacattcattaattaaccaatcacgattggccatcgtgaactatcattaagccatcattaaataatagtgagtcataagttatcccaatagtgtgctaatgtttctaagcatggctaagcaatcacatctaatatctagctgaaccaatatgtaaagctcaactagtcaagttataataacccaaggtatcaaggaataaagtaatcaagaacaaaagggctataacaaacaataggttaattccacccaatgacattcgaaaataaatgcaatatttgaatagaaacagtagctttaaacgggatcaacatgctcaaagggttgtttgggatctgtgtgacttgccttgctggccttggaactcttcaaactcttctcctgcgaaaacgggctctccggaaacgacggaatctaagcaaaaaagagcaaaatcaccaaaaaagcacataaacaagcatgaacagtacatgtggatatttttaacatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacgggcgacggttcacgcgaacggacggccgagatcgatccatccaaaacggacggccgagatcgatcggtctacgaccggctcacggaagagggcgacgatgacgtcagcgatgacgtcaccaccggcggcggcggctcagcggctcgggcttgcatgctcgccggcgaacggcggcgcttcggcacgaacggagagcaccaacgggtagagcgcgacgcggcgaactcaccggtgaccaaaggagcggcggaagaccaacggacggcaacggcgacgacgaagaaacgacggcggtcttcgggtcgacggcggcgatggtgctccggcgatcttcggcgacggcgaaggggcggacgaggacggcgacgggacggcgaccacgacggcggtcttcccgagcgacggcgacgtctggaacggcggcggcgcacggctggagcgacggcggcgctagggcacacggcgctagggcgctacggacgacgagaggcgaaggcgaaggtggcggcgggtagagaagagctcgggggtccttttaaaggggctaggaggtgacggcgaaggcccacggcggctggcgacgagaaggaaagatcggggtttgaaggaaagagaccgatccgattcgaactcgaatcaaacacattccaaaccgatttagccgatgtttccaaaggagaaaaggtagaagagatcccaaagattgtttcccctcaatcaatttcaccggaaacgaaaacgaacggccggattttggaaaggaacggcggcggcgcgaaactagggtttcgggcggcggcggccggaggttgacgacgaccctgacaggtgggccccacctgtcagcgggcggacgcgcgcgcgcgcggcggcggactgggccgacatgggccgaggagagagagagcggttttgggccgactttcggcccaaagccaaaagaagactttttaaaacctttttcaatttaaattattcatgaaatgcaattccatttattaaaaatacttccttagctcaaataaatcccagaaaaatctaggaattatataattaagcaaagtatttaatgaaattttatctggccccattttatattggaatttattaattaaaattagatcttctcttcaagacttttaaaattatttctaaaaattccaattaaacaacaatttatatattttgaattttcagggtgtgacaacagctaaaagaattggagggacagggaggagaattttaaaaaccgtttcacaaggaaatgccgaagggcgagaggagacattatgcaaatagggttttcagaaagtttgtccttaggttttgaccgtttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaagcagtagcagcggaaaaaggcgatcctagcggggcttcagctccactccacaggcaaaactcaactgtggtctgagccttggtcctctaacttcatcttcagctcagaagcactacacttctgaaaagggggaataatagcaaggctgagtacaaccaccgtactcagcaagccacaccaacgatgcagacatgcaaggggatacaaggatggtttgtggctatttgcataaaggcggttgtaaaacattttattgagcaaaacagtaaaactgttgagtaattagagtaacattaaatctccactgatcaacgctacaccacgttgaacaggcccaaccaacccacataaactacagtgtattgggtcgatttattaagtgtgagactaatcacggtgaatctggtcgaccgcccataaccgcgggcacggttattcgaatagttttactctgatcagaggtgtacaactgtacccacaagacacagccccatgacacgttaccgtgcgccgacatgccaccacgacataccggaaagaggccgtgacaggacccttcgcataaccccctctagccaagcacaccacacctcaggtttcacccccgtccccagcgggcgacgggtagtcccctctcgtgcctaggtgaatccggaagtgacagaggccgtcgcagggcccgccccgctccatcacgcccacccttgcctggatgcgtcagctagaggaaagctacactacaagcccaaccgttgcccacgctggcttgtggtaagtacgataagttcttcctgggcatcccgcgaaccggtccttaattgccatgggtgcgactagcaaaaccatgcacccacagcccaccattcagtcgcattttagttggataattacgaccatgaagcatggccagatgtctcgagcacgcagctcaacaagatactagaatgtctaatactgcaattatcccatcgactgagctagtggtaattaagcatggctaagcatatagttctagctaggtcatcaaagtaacataagctaggcgatttattacccatggttgacaaaggacatatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgattttccgaactcttttcctcgcgaccgcggacttccgaaacgacggattctacacgctggcatgcaaaacgaggaaaaactataataaaaaccaagaaaacagtacataaaaactaaacaaacatgtagagctcaattttagatgaattttgcaagttgaatggctcaattcggagttcgaatgaattaggtatgaattttagaagttttgagccatttaaatgaatttctagaattaaactcgatttattgtgcaattattatttattttctcaaaggaaaaagcttaagcgctgacgtcatcaaagaggccggcgccgacaggcgggccccacacgtcagcgggtcaagggaatcggtccaccgtggaccgggaccacggggtggcgcggctgagcacgggcacggctcaggctggcccggccgagcgacggctcgcggcggcgcggcctcctgcggcgacggccggtgcacgcgagaaagcggcggtgaggcgcggcaaggggatccgggcggcccaggcgagcggggcggtggcaagccggccggccgacctaacggcagcggcgcacggcccggtgggcgccggcggcggccaccggcgcggcagcgcgcacgggagacagaggagggaggcaaggagggagaggaggagctcaccaaggacgcggcgacgaggggcggggaaaggcgggggggggggggggtggagcttggcgtcggtgctcctcgggatgaaggcggaacggcggcccggcggcgttccgcaagcgggaaccggcggacggcggccggaaggacctgggaggatgggggagaggttaggagggggagagagggctcccagcggcatgaatcgctggtcggaggggagaacgggcggcggatgctcaccggcgcgaggggaaccgtgttccggcgggatcccggccgtgaaaagcggcggccgaggtgctcctcggcgctgcgaagcgagcagcggcgatagcgcgacttggggtggctagaagcggcgccaagcggcggctggagtcggcggcggcggtggatggaggcggtgcttcggaggcggggaggggaaatggagcggacgccggggtgcggcacgacgcggcgaagccgctggtggcggtcgtgcggaacgacggtggtgggagcggctgtggcgaccggctggagggtcgtcggccagcggcggtgggaggtgcgatggtggcggggttgttttcgtgcacgggagggctcgggagagaggggaaaatggagagggaggtgcggggaatgtttttataggggaggggaggcgggatcgagctcgagagaggtagaaaccggccggagacctgggaggagagagagatgctggaggcggcgacgtggccggattttgcgggagagcggggggaaaccgagcggacgtgggcgacaaccgcgtccacgcacgcgcgggagagggagtcccgcaagagaagccgcgacgtgggaggattggcggccatggcggcggttggggattgagctagaggtaggagatgacaggtggggcccacctatcggagagagggggagaggaaaacgggctagggaggatatgtagacttgagggagagagagagccgattgtgccgaggaagggaagcccggcctaggaaggaggaggggaggaatttgggccgagcccgaaaggaaggaaggggaagattattttcttttctttttattcttattggttaaatgaactttgtgctatttaaaattatttcttgagctccgaaaattcacgggaaatttcagagagtattttagggcacaaagaatattgcaaaatattcccggccaatgatttttaaggaaaaattttaattctcccattaattcacttgaataaattgcttaactttttatttaatttctaggaaatgcattattaaatgatttttaatcccgaacgaaaatcggggcgttacaggttgtatggtcatgatgggctgtcgtaaggaactcgacagtcagggatggcttctcaaagtaccaggagggcatcggatagagggtattagctagtatatcagctaactagaatgtatgtatactatgtatattagaagtataggaatatattttctttctcttttctttccacttagcttagatgatttattatgagaatgagtagttattgcttgtgtgtcactctacccttgaattatcttaacccctacttagaatatgattatcacaagtaatatataaattattagttgagttgtctctacatgatcttcccacgggataaaataaatacgatacccttggaatactctcaggtgaaatgctacaatgatatatctgtgcgcttgcggatgaactctgtaaccataatattccaaacatatttctgcgccattgctgagaattatatttctagtaatgttgttaagaaataccaacactccgcctctcctcgcgtgttgtgcctcgcgggtcacagccgtctctgctcccactctgcctctgctcgcccgcataaatctctgctccaactcctgctatccatcacaccgctgccgcctagccagccaccggccgctgataccgggagctagggaggccgtggcgtgtagcacagcaggcagtagcagtgcgctggtgccaccttcggccttcgcccttcgattccggccttcccctgcaggtactttacaggtctgctcctttacctaatttgctctatactgatttttgattgaaacttgctctatgctatcaatttgttatttttgattgtcgatttgtgatcgtctattagactactatcataatgtcattgccgatttgtgattagtgaatatgcattttttgtggtccattccacagtcatgaatatgtggttacaacatatgtttgcttatttacacggcaagtttattatatcgtgtgccccagtgccaggaaaaattagtgcgctgtgtttcttccatcatgttggtcgcaccagtaagatgggaagtgttttacctagcctatagtgcttctttaatcagtagattgggagtttaggactttgcttttctgaatgctcaaattgtattctcagattgcatttcagtgcattcacaatcttttatggcaatatgtcatggttaattacacattctgcatgtagcatccaacctgaaaatcatttgattactgcagcatttattcccagcaatagagcatctgtgcgagcagacgatgacatatttgtgctgtaaactatttctgtagaagtatttgtcttaaaagtaatactatttggtaatgtttctaaatctatccattttcaaccttgagttcaggtttctgcagtacacgatcccttcaaacaaaattaaatagttaataatttaattaccagtattcagagggcactttgtgtcgtaggctcttcagaccttccgttatatttgagagatgaagtgaataattcaagtcatcaaacaaacataatgaaacatccgacacctcgcgagagaaatattggagacattgctgagcccttagcctgccagtcaacttcagcctgagatgtgcccgtcaaaccactcgaaggcggcgaccagatatgttacacattcagaagacttgacaaaaatggctaaagatctacaacctctcaaatatttctaactcatactcatgtgaatatagtttccaggatgtgcactagattcacactttcatcttaagcatgattatacatagcaaacacaactaagatgaaagaaacttaagacttacaacaacttaataattacataggccgaccggccaaatagacttattagagaacagcggaagcttgactacccaatcacaagcacaccgactaggggtttaccccattaagttctcatcctagaagaagcaatcaaaacccgcatcacttaaagactaagtctaaacctgcaaacaaaaggttatatcaacaacaagagtcagtacattaaattgtttaatggcaagtacaagtcaatcctactatactacatgtaaggcatatattcaaaggaaggcaatatgtagttcaatttcagtataaagcaagttttgtttcgcaattcttttgtaaaggagttgatgcttcaattaacaaaacaaattttaagtttcaatattaagttcatcataattccatcataatcaatctcttgttgtcatccttcgacaacaagtcataatatatcaccacacacacacaactcaacacatttatcatttcaaaccaaggtcatatgttcacattttaaaacatagtctatactcatgacacttcaccaaagcgctcttgaccgtgaacacggctaatcaattagtttaaagaactctgcaaaatttgtacacctttatccacatgatgtgatagaagcccagaggctacactctagttggttcagtgccggccaagcaccccacactctacattatgagtgcggactagaggtcacaacgaagcctttacactacttagaatctagccttgcaccagcacgatacgtgttcctccatcctaggcatacttgaaaatatgtctagaaccgttaagtggcgggcccacgccttaaacttaatgccgtggtggcggacacaacgggaacccacccacgtggcacaataccgttgtattggacagacttagtcccctaaactaccacgtcagggcaaataggaagttcctctgaatcatcgactaattcctcagaattatcgactaactcatacacaccagcctaccagaatgcaaggctagttctaaatagattaatcagcttaggccatcccatactagcacatgtggatgtacgaataactttaagttggtgacacaagttcggtccttacggacttggccaaacactccccctatcggcatgcacctaacaccatatgcacatcacttgccgcccaagtctaaaatcacattttacacattttagttcgcaaatacccatcatattcattttattccagcaaaggttcatgtgtcaaaaatcacattttaattatagatggaatgaacatttgcatatttctaagcatggctaagcaagtagttgcatatagagcatatataaacccatttgagcacaaagagtgtgctctaaccatttctaggggttcaaacagcaagaggatcaattattcaaggtagggaatgcagcaaataggtcataactaccttatcccaatttcaaataccgaaatagtctaagttcacatgcaactttgcaaacaaatattttcattcctcaaatcatgggattcaatgtgttcaaaggatgggaggagaaaacttgccttgatcagagaaatgttagcacctaatccactccttcaccgattatgcaattatctagataaaggacacgttatgcaattaaacaccgaaatagctgaaaatctaaaatgctctaaaattcatgatttatgcacagtgattaggtactggtcttataatgaatttaggtgaaagaatttttattttatcttattccatttgggagttatgaattttagaggttttatcggtttatagtaatatagtcttaggtagtgttacaaaatacttttgtaaagtgatttttattagattagacttcacaggggtgtggagatgtgttttctaagactaacacatttggtttcacaaattttggatttataatgaattctttatgcattttacaagttataacgtgttagagttgttggttcagaacatgctacctactgtttaagttgaataaaagaagtaatttggttaactaaaacatttttagttcacatgtttatggtttttactactatggttcatactttataaactaggggtgctctgatctagactagcaatacattatattaacctagaaattattatatgagctaagttcttttaagttttagtggatgggaaaggaactatgctccactgttctaacaagttttatttaggtttattcatagctagagtgcattataaatacttctacacatatattttgcttaaccattactaagtaattaactcctaggttatctatttaaagattagagctatcatttgtacaaaaggtgtcttattttattttactatgttgaagctaaccatttgctggttctatagaaacttggttcatttcatttggactaaaaatgaattttctacaaatcttacaaattaaaggcttctctatgttggtaaatccttacatgattagagacttttactacacagtaagtatataattttatttcataacctgggaatacacattttgatgattctacagaacttaagtttactaaaattgaagctaagttgaattttatatgaatttctaaaatttagcttatctaaaactagtcattttaaagataatagttttagaggcttttgatgcaaagtaagtaattacttttatttcacctaatcagagagtgcatgatgatgaatttgtagaatttgagtttgtttcaaaatgagtttagatgaattttctatgtgttttataaatttgtatatgctttatgtatgacttatcttagataaatgttagaggcaaagtttgtacagtgagtgtcaagttttatattcctggaataaagttcataaccttaagaatctacagcaactggaaacacttcaaaataagctatatttgatttcttatggattttacaagtttgtgcatttttctgttaaacatatatttgtttggcattgccttaattattctccagattttaaaggatggggtccacatggctgtgagggaccaatatgcaaaaaggcccttgaggtttctaggaatcaacccgcagtcctaggcccatatgtcagtgtgtttctacaattgtaaacggatccctgcacttaatctaattcacgggagtcatccctctgctctagacagagcagagctagccatggctgagctcgatctcgagctcgccagcggcaaacgttggctcgtttgaggttgaggtcaaaagataaaatgaagagcaagctctcgcgattccattcctctagttttcttggtttggggacatcggagtagcgccgatggctagtgtgagcggaaggtgttttcgggtgatggtgcatgtgcatctacagtcatgtattggttaagtgggtgcatgcatgtgagtatttgaggttcatgggtatataccatggtgttggccagagttgatgaggtccagacgatggcggcagcacacgaaaatggcttggcgacggcgcttcactccgggatgacgtcgacggcttgatctaccaatccatctggcatgaatgaggtcatacgttgttagcgaggtctcagggatgcttcatgtgcaaagaatcagacaatggctcaccggagaaggcggaatcgaccatggcgacggcggcggattcaaattggcgccggggaagaaaagatgcgttctccgtgttctagatgtcttgggctggggttcttgaggcgttttgaagagtaggtcgaggtgagattcttggcgcagcggcttgctccgagatggtcgaggatggctagacgacgacgatgattgaagcggcggtgctccagtgcgtgctccagggcgccgtcggcgtggtcgcgttccgatggctgtgatgcacaaaacgggaggtggtcaaaagagaaatggttcggcattgtgtggagataagggaacgcgaaaaacatagagatgacctcgacccaatcggcgttggcgaaggtcgtcgccactacgaccggcggcgaggttgaggatgacggagaggctgaggacctctccctcggcttcttcagctctagagtgatgtgcggagttgggcgactcggtctggaggagatggaggcatgactcagtgacttgaaggcgtcgacacgtcgtcaccacgcgtcgacgcgtccaggactcggtcggctctcgatctctccctctctgtgtttcttggtcggctgaggatgagggacagaggaagggcaagctagagaggctgccaggtgggtccaggtcgtggcaaactaggctagggtgagagggttgggtaagattctgggtaaacttgattttcagatcatttttcggaattattttcttctctaactttgtagcttcgtaaattaatgtgtagaccagattatctagtgttgattttactggaggtagatgattacacctagattccattttctttggttgcacttaaaaataatgggtagactgctcacagaaattaaacaaagatgggctattagaaagctagattgaatttttaggaggcttaacagaggaggaaaattctagaaaagttatatttattcatgataaataatttagtatttgaataaattattttccatgttcacttatgtgcagttaaatgtacttttggatgaaatatggttttagccgattaaaatttaatttgatttcttttagttgtctgctttgactgattagttcgaggtatcaacttgaatgttaacatgttaacaaaattacagaggataagtttgtgctaatcactgttcacataaatttttccatgattttatcttgcacaaaatattttagagaattaggatgacctttgtttgtatatgtgttcccacttcataattgcatctaatattattatagggattacattaaacttcttttagactgagaagatgatatttgagtttaatattaagtccacatgctattacccaagattaactataggtttgtttagtgaaataattcttttagattatgctcatgggaccaattatggaatgcaagaccaaaactccaaatgcacaaagaactcgagcctaggcatacattatgtacatgtatgctcatatgcttggtgacatttcttgtataacgttgggaatgaaaagattttattttgctctcaaattttaatcatgcaatggtttaagttggtcatcacctaagtttaaaacggaaatttttgcctctcaaaattggagaagttaacctctaattattttgataagaaatttctgagtcctagaatttcgggtatgttacactttgacttttgtacttatcactgatggaaaattgagaacacttccctttttctagatagaaaaatctctgctttgacctgataactttattataacatgttaaggtatagtattacatatacacattgaaaaatattcccgagataaccaaacatggttactaatgaaaagttcgggaatttacaacctgtctatggctattccctacatgtcttgctaaaaaaaatcgaccatccaattcaatatgtttgtcaagttgtggcacttcctagctttaagaatttttttggtgtctactttacatggtccgctgctgattaaccacggcatatatattatatagtaattgcttttttttatctggcttattattctcttttcctgaaccattcattatgcagttttactgccataaatcaagctggaatcatgtttgcctgcaccaaccatgctctgtagaatgcttttaacaggcatacaacacaccattagggaataatctacaaggtttgggccatataacttcccttttatatactttcttttgcacttattttccaaatttatctgttgtatgtacatgatagataatactgtcccagcattgactaatgtttgaagttcaattgtaacaggtccaatgcttgctttgagtacaaaaatgttttatgttttgtcggtgctttttttcaccagctaaagatcaataggaactacaattatatttcattttgtcattcacaccttagcttccagttcactaaatgaagatgaaggctgaagtcaacagagatatgaactgtagggaaaatgtaccttttgttgctttgattaggaagattgaatgttaatttcaagatgcaaatggagatcgattttcagtctttcatatgtcagcttaagtttgttctgttaaaaatgaaatgaaacttaatttcaatgcaaatgctgaggagggaatgcttgatctcaaaataaaatgctatctttgcttgctccatatgcgcttagcccccatgagcgatgatcttcatgtaccatattactcacattacctgtatttttttcgaatatctactgtagttttagagcatatgtgacagtgcaattataattgttcattcttgacatgcactatgcaggaatattgcttcaaggcaaaagaaccaaacaacatattaggttatcccattatgaacagttaggttaagctgcaccttacatggtgagatcactatccatattttattatacacatgtaatctatttatttaaactaccctgtcaatccaatctactttatatccttattttggtgttagctataaattcaaatagctttgcaatatggatctatgctgattaccacttatcaacgaattgacagaatggacatatgttgacaaggtgacatcacaacatgtatatacaacgtagaatctatgtacatcaactgtgtcttgtgcttcacaactatgtgtggagctttccaagtccacaaaacatttaagttttcttttaccaatcagcatatgctatattattctaatatgtgcatagatatatcttactccgttacaatgtctctttgaaatttcaaatttatttttgtatagttcaaataactaatatggttacaagcattatacccgcagcaacgcgcggggccactgactagttatatagaactatcgagtggccgtgtacattgcagagaacgttggacggcaatgcacaggcctataaaaagttttgtggttccgttgtaactcagacctaccataaaacccacacatctgcctcatacctcgtgaaggtctcacagcccccgcgcacgtataagaaccatagccacatccgcgcgtgggtcggttcgcgacacacgaagccacatccgtaggaggctgacacccgtgggatcggactgacggacggacgaaccaaaaaatcatcgtgcaatgctttttggtatataacggactcataagtgagtacataatcatctttaattttttactagtaaaaggcacctgcgttgcaccgggtaacattgaggtggataaaatttaactaaacgctttttaagcaatttagtatgacaataataatcacaaatgtattttttttgacatttagtatgacaataataatcacaaatgtattttttttgacagttatatcatgtgtacgtgtataatatgaatgttgtacttgatgcgttagcgtaatgattgtactacgagaggaacgagcggtgagtttttgtcactttcatgcaagaggcgatgtaaataaaattgtgtgattaacaaaaaaaattcatttgaaataggtgactttatcataatactaatgatgatcagaacggttcaaaaatacgtttgcatatttactcataatcttgtagtggtcacgcgtgctaattataaaatgtgtacctaaatttgtttgcgagctgttggtatttcttaacgacattactagaaatatgaattttcagcaatgatgcagaaatagccctgatatatttatggttacagaagtaatccgcaagtgcacggatatatcattgtaacatttcactcggaagtatttgaaggtatcgtatttatttaatcctaagggaagatttataaaagagagaactctaccaatagcttatatatgttacatatgacttagattctctcacttaaataattcaagactaatgtggaagaaaaaatagaaaagcaatcattcctatacttttaatatacactcaactttagtttagatttgctagtatacagctgtaacgaccattaccccctaacagtgccctcctggtgctttgagagaccaccccggattgtcgagtttcttacgacaacctgtcatggccgtccaaccagagctaaatatggaggagtactctccccagaaaattgtcttaggaatatatactaacatggaggaatgcacgtactgagttgccgccatcagcggcccacctctattgtcccgtagcatatatacccaattaatgatatttaataatctaagcaccattcttacattatcaaatattactctatatcctctagaataacatagagcaatcatttgcatgaacattaaacccacaccactgcacctatctggtaggctagtcatacaactatatcagcacaaatataaagtaaatccagtgttcggacaaagcaaagtaccaaaggtatataaagaaaaatattctcttaattccaaaagtcttacaaaagaagatagaaaagctactagagccataccgaaatcttccgaagatccgatgactccgataactatcttattctactccacttagcactagagcactaacaaaacttgagagagagatcaaagcttcttgcttgagtgtgtgttgaagtgaccccttacatagcctctcaatgatggttatggcagttggaattgtcagaaatgccccgcaaccatcattgggagtgaaggtgcacttaaacctcctagtgggtttcggtgattaatgacaaggtggttaaaggggactaacgtgtttatcaagtttattcacaggagtttagtcccaaagcaagttgtgatggctaagaatgcaaggagaccccccaatttgaatgttcctaagtgcgaaaaataccgaaggtgattagactaggtttttcactttcgaaattgagtttaggaaaaaccgtactattaagaggggattcaagtgtgattctagggtatacaaagtgctcttagtcatatccatgagtcaaaatatttttggaatcatttttgaaaaatgattttctccccgggacagagagggctacccggaggttctggccagaactttcgggcaccgtttctttgcaaaaaatttcctaagtgctgcccggaagctcctggcacttttgcccggaacctcctggcaggcttccagttcaaacttgtgagtaacggctagatgacgtcacctagccgttatatatatggatttcatccccaggtcaccctttggccattccacttcagctctttcatgttctagggttttctagccactcccaagcgtcctttgcttcctccactcaaatctagagcctatcttgtgagattgagagattatatgagagtgtaggagtgttttggagatggattgaagattaggtttgtttgagcactttggatacctcgtgggctgtcacttggtcttattactcttggagatcttctcctagacggttaggtgtcgcccgtgagcttccaaagatcttgtggatgtcccgggaaagtttgtgaaggttttcctcacctccgcaaggaaacgaggtaaataagtaaagattcttgtgctgagttttcagaggttgtcctaggtagagcaacttgcacttgtggtcttttctagaaggaattgtgagttggatcttggtggtcactcaattctagaaaacgacctagaagtgttgagttgaaggctgtggacttcttctgggatctttgcataagtgaggcaaggggttaattgagacccggctctttgagcacctcaacggagagtaggatccgtgtgatccgaacttcggaaaaaaatcgcctttgtctctcttgtgtatgatctatgtttgaattggctggtatcttgtgtttttcatcttgtgcaatcttgtgcctgtttttccctagctaggacctgtttttcttctcatattttcgttatctctgttgcccggaagttcctggctcaagaactccggaagttccgggctgctcatcactgccaagaagttccagtgttcatcaccaggaggttcggggccctgtcaatttaaccgctgcgtttgttgagaaaatttcaggaaagcctattcaccccccccccctctaggctacatctcttcacgttcagggagtgcatttggagcgtctacgtggagggccaagctgagccggcgctgccagggttcggccaaaccccctggttctgccgaacctgggccggcccagcaggcctccaaatttggtcagggggctgacaggtgagtcctcatggcggttgtggcagttatgatggtttccaggacggttacacctgacatgtgggcccctctatccttaagcttgcttaggagtgaagtttttcttcatttttttctttatttatgtgctaatctctgcaaacaaataatactccatgtacaagtagaaatatattattctaaaataaatatgcattgcaatcataactagttctcctttattttaagtatattgacgtcgaaattggtctataacgaccgtcaacatgagccatccttgatattgttccccttatatatccttgtttcctgagtctattacttatgcgtggtcaattatcgacactgcttagctttgcctatatagacatttgcaccctccatactcatgctatatggatgtgattgtgatcactagatgggagtgaatgtcgggagtcgggtggagacatgagtgccacccgtatcacgaaaatcttgtgaaaagcaaaaacctaataaaacaaatgttttcgattgggacagcatggatagaatatgggtggttctatgaaacaactacttgccgaccctagtcaaccaaggactgagtcaggaagctatacagggaatgaaccaagtatgatcgcatttctcgaatgggtagacccgatggactaggaaattctcgtgggggcggcaccccagacatggtaggttctagacgatgatgattgtgttgatgcagtgttgtgattggataatgacgtctaaaacctaaaatgcaccctataagtataagtattatgtaacccttaatcccgggagtgccaggactcccctcactttcggttcgaggtagggattgtgtgtcggggtgcaatggaggctcatagtccttggagcgggtgccgcaacgcgagagtgactgaaaagttgggaagtgacaagtctcatgtgttgggtgcatcatggagtgcgggattaaaagcgtacatccactgcagtgtgagtaaactaatctattcgaatagccgtgctcacggttaatgagcactgagacttgtactactcttgattagactcatacatctttaatattgtttagaacagggctggacaagattgtgtgaccttgcccaatgggcgggaaggtcaaatatggtaaacaatatgaatctggatgtgagggtaaacctgaccaagcgaggctcgggctaggtcgatgaaccctcactgttcaacttaacgacgttttcagttaaaactgctaggtttacaaaacaatttgtgaaatctatctttattcaaatgacccaaacccttcttgtatcctcgtattcattacatttattctagtggtgacttgctgagtacggttggtattcacccttgctccatcaccctctcttagacttagatgatgtggaagtgccgctcgagactactcccgaggaaggagaacccgaggagatgccctagggactgatccccagttgtgcctatggagtttagtagtcccgccgtaccttcgctaccgctaccttatcttatcatttggttcttggtattgtatctgaccacacatggtctatttggggacccactcgggctttcattgtaataatgcgtaccgtaagactatgcgatgcagactatgtcataccaaatgtgtaatgtgtgtataccaacctactgatgcagggatttagtattgtgaacacatgtggtttcctgtgtcttaaaaccgggggccgactttcaactccatcacgcccaccctcacctgggaacatcggaaagggaagagccatactacaagtccagcagttaagcactgttagtcttccagggtttcccgtgaatcggtccttaattaccatgagtgcagccaacaataccatgcacccacagcccacctttgagccatattttagttggataattacgaccaataaaatatggccaaatgtatcgagcgcgcagcacatcaagatactaaatgtaaaatagtgtgattatcccattatgtgagctagtggtaattaaacatggctaagtatatgtaattttagctaagtcaacataagcgacacaagctagtcaaattattacccaaggttcgacaaagaatggatcacaagtggtagctgtagcttacttaactgatcaaactaataatctagttttccttttcaaagttacttactatatagatacattttggtgacaatgtttctaatgatgttaactggttagaaatatttaacgtttaaatactcacttcgtttaaaatcatttgtcgttttagtttgttctaaacattataaatctttaaccatgaacttctttagacatatttgactttagacaaatttaaaataacaaacaatttgaaacggatcactagtgcaaaactgattttaacaccgattgggaacctttttggtactggttgtagcaaatcaagactaaagatctcgactttagtaccggtactcaaaacaattgtgtaggatgtgggatttgaacactactagaaaaagcatttttgccgacgtgggggtcctatttttgcaggcggacatgacccttagagccaaatgaccgcctacaaaaatataagtcggggtgaaatttgatgtctgcctacgaaaatctattttcgtaggtagaccacataagcggctcctgtgaaaatcaggcgccacttaattggtccgcctgcgaaaatagacttgaatataaatagacttgcgtgccctaatttttttctaagtcctcacacctctcccctttcccctcccctcacctttcctcaccggcctctcatcccctcccctcacctctcctactctcccctcccctcacttctactcttcccggcggcggcggcgggcggtggcggcgacgaggaggcgaggcggcaatggagaagggcggcgcggccaaggagcgcaatggagaagggcggtgcggcccggcccgtccctcccagatctggaggggggcggggggagtgcagcgacgactgcgggcggtggcggcagagggcgaggcggcgtggctcccctccccccttcctcccagatctggccggaggagggaggggggaggtcggcggcggcaattacggcgtggagcagcgacagcgcgggccgggcggcggcggcggctcccggcgcgggccggcgatttttttttgttcgtttcctccattctcgcaggcgggccgttcgttgtggtgcaagcggacctctctcccgcctgggaaaattagttttggccacctgcaaaaatgccttttctagtagtggaactcgagatctctcaccttatctctcatgcttactaccctacctatcacacacatctaaatagagatgctttctttttaaactaaccatataggcatatttagtacctgttggtactaaaaatagtactgcctcctcggttctacgaagatctcttcgtacttgtctagtctaggataactgggatcttccggtctccgtgcgcggaagtagttgaaacaaagaagagtctgttccgctcttcatttaggcatggcccgcccatctgctgctaggtccaagaatgagttggtaacacaaacaagttcttccgtctttagtcttggttggcagaggatctattggtgttactaactggaactaaagatgttttggggacttggacttttaaaactggtagtaaaaatatcgtaccggttctaattctaaccgagatattagtatttttggtatcacgataaaaaatcagttctacactcgtggatagtataagatttgatcaacttttaaaactttgacaatcaattctataaaagaataattttataaaacttaataagtttgtaatattatgatattactccctccggttccatattaattgttgttggttgaggtaaaacttttataacttcgaccactaataacttcaaaaatatttagttcaaaggaactagaacaacatatataaatttgtctttcaaagcactataataaaagtaaacatacatttatttattatatatattataataaaaaaataagatcaaagatatatttatattttgtagaccatgtcattgtccaaaacgtcaattaaaatgaaaccaaccagaggaagtacttgttaaattaaatatgcacgtacctttcttttttaactaatcatttgagagaagttattaatgctcaaagttccaaagtatctaaaagtcaatatttatgaacggaggaagtattacttttatttttcggcaaaaagtttatccatttccctgtttctgaaataaacgtatactttttctaagagtaagaaatgtataaattagaaaggactatatcgacgagaatatgtaccggatgcatttgccctatcgaactaaagaagcttactatacaatctacagttatcctatctatttatgtacaaaaaaaagtaagaagaaaaggggtcaagacatttcccggcaaaaatttctacaagcaagagttctcaagccaatatgtaccccaatagaataacactccaactccagagttgctccgtcagatcactcacaagaagtgaggaaatgatgagatgcgaggcaggtgcgtcaggagatccccaaacgattcttgcctcggcggcaatgaggtgttgcttccactgtctgctgacaccggaagcgcataaggttggggcttcctttcttgcatctcattgtcaccatgaatgctgctgctggggtttgtctggcctgaacctgaatctctctgaatcaggctgcagagggagttgacccttgacatgagcatcctttcatcagctgcgttggttatctgggaatcattgaggagttgtctggtaagctcatcaaatgtcagtttacccattgagccatcgccatccccatcgccgatgatctgggtgctgcccaagaggaatcgggttattccatctaatgttactttacttgacgtggaatccccacgatgaactgcaggtaggttccctgaatacatctgtctgtagatatgattcccaatgtgatttgcaatctcacttttggacatggagcgccttatccccggtaccttgataccgttccaattatagatgctttcttgccgttcacaatcaccagaagcagcatcttgtttaatcacttgagtaccactaactggaatggcgaaagacacattattagtaaaattattcccactagaaatacggaagtctaatattcttaatattatgtagcaaatatactggcgaagcaatttgtgaaatagatcaaacaaattaaatttgacgaatattaacagacttgtctggtcctaagcagtgacctccagtgagtgagaaaagaagtcattgatagctaacaccattatagaaatatagcctaatttgaaaggcatgattttcatatttcattgacacatctggatgttttcatatttcaatggaatataagatacaagtatggattttgaagttcacctgaacaagggaaatgttgaagtaacttgtccggtgttcctgagagctgtctggcttcagtatctatcctacctgatgcagaatgaggcggtaacagttctgtaaatctttggggagctaactgatcgccatcatctttatgctcaaaatcttggccttttatgccctctgcatcttcaaatatagaagactttgattcaaagtacggattatccaaattgatgtcgttctgctggcttagtgaatatagacgtgggtcacaatgaacaagcttctcaacatgcttattcatcattcctggcgggcactgaagaaaatgcctccttacataaatgatagtcaaaagtcaactcaccactcggcagtattaggaaattagtcagcataaacaactgtgagagactaattcgttgtgataattgtctgatttttttttcacaattgttcctcatgattatggggtaaattccaaaatgctatcaaaatttccctagttagacaaaagggaaaaataagcaccatatttgcgaacataggggtatacattttaaaattaagcacgcatgttaccaacgtgtcattcatttttactacctgtgaatgcttgcttgtccaccagtgaaatcagatgttgcctgccataaagtgtgtttccttggctgtggattagtttctcgaaagaaaagtggctgccgggacaactgaacagagcacaaaagagagaattagcagaagcaatgatatgccaaaaaaaaaacactcataaaggccaaactacacagaaattttagatcaacgattagcat

SEQ ID NO: 66172 - DNA, 1981 bp, Oryza sativa
ggggttcacaatgactccagcattgtctgcaaatgtgacaccaaaggaacattagaattgaaccataacccataaacctgtgattaggtaattctgtagacaaaggatcaagagaacagcaggtaacacagaaaagtatagacatcctacgaattaagcaatttacaaataattcacatattatttacaaatgaaagagctgtacacttcattcacatattacttatacaaatgaaagagcttcacaattcactcggacattacatacagttgaaagagcaaaagaagaccacaaagtttgtaagttccttcatgaaacacatgcctaatgataaatgtggcataatgcaagataataacatactatgatgtctatttcaggtcaaattgcattccagctctatgctaactaatgacaatgcagaaacacaatctaatttatccatcaggaggttctctctaaattgaacaatgacactaaaactgaatcctatcttggtagacagaattacagaaactgaaaaaaaaaagtctggccaactatcatgtaacatgctcaaagtcgtgtgcaaatgccttccacttaggccttgttcggtttggaggggattgagggggaataattccacaccacaataggtgtgcaataaatcccctccaatccctccctcatgaggatcaaccgaacaaggccttaagcaagcaatttcagttataattcaacagtatatgaattaaaaagaagcatgcagctagttgactgactaaataactaacacaagatgaagcgcaccaaaacatggaaacagaaagtaccttcaaagtacatgtagacaccatcctttcggcgccacggcttgcgctgcctcacgatgacagctggcatgaccttcttcctcaggtcaggcttcccttttttcacagtagccataaccatgtccccaacacaagcagaagtaagcctgttaaggcgtcccttgattcccttcacagaaatgatgtaaaggttctttgctccagtgttgtcagcacagttcacagtggctgccactggcagacccagtgacatccggaacttgttaccagcactacctccacgccctgcggtcaaagaaagagcaatagcagccaggtaagttaggtccaaaacatctaaatcattgatgcaaaatagtggtcattcaaagggtatatgcttcgcctcattctcatttgataataacaacacagggaaaatttaaaatggtttagcttgagaaatgtgactagccacactatttgaataggaagtagaagaatcaatagcaactgaactagtaaagatctataaagatgcagcttcacaaacatctaaaagaattcgtgctaaacttgaaggatgttcatttccgaaggtccttaaaagaatttaacacatacagggatctaacaaacctaagtcaacaaacagctaaacaaaaatcttctccacatctaactacagataaccagactaaatcattccttgtaacactaaaagcaacacatctccaaattatacaacgcatcactgccttcaaaatatacaacgggtcaccacccttgaagcgacaagcagactaaatcatgctactcgaacacttgcacaagatcctagcgacacagcaattgacgcatcgaacaaccgcttctgcatcttagaaacggtaatccacagcagatgtctgcgcatccaaatcgaagcatcacgccgcgcaaactaaactagcatacgagaccagaatcgaggatcatgtgggagaagaaatcatcgggagggagcaagagattttacctcgcttcgacatcttggaaacggaaggggtgacaagcggcggcggcggcggcggccgagggggacggcttctctttcttatatagtcggggtttctagggctttgctggtattattcactttacccccttgacacactattatttttacttaacttactatactaac

SEQ ID NO: 66173 - DNA, 1677 bp, Oryza sativa
atatatatatatatatatatatatatatatatatatatatatatatatatatatatatagtaaatttgtttggtgctccatggtgcccgggcaccattgttgaaattgagtatatacccaattcaaatgagtatgaaactttttcaattactcaggtattaacattaactatatatatatatatatatatatatatatatatatatatatatatatatataaatataaagcttccaagcgcgctctcaccctccattccaccattcttagtagtagtgactttagcctaccttgcatagtatattgaagcaaggagttgtgttataacgctgtgtaaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatctttttaagttgcttctaaaaagatagataggtgaggcatacggtgagtaccgagtaggactttacatcatctgaaacaagcttctgaggctgtctaaataggattcgccaccctgcaaagatcctaaagttaaaatatctctcgaagtgaacagtattgaacagtaatttaaacagtaaactaaatagtgtttttgaacagtgttttttgtccgaagcatatatatatatatatatatatatatatatatatatatatagagagagagagagagagagagagagacacacacacacacatacttttttttgttaattgaccatttagttgaccgtaaaaaatttagttttaccctcggatatggaaggaacatagaaatttgtgagtctaccaaaaagtagttgtttgaggaagtattatacatacaaaatttaatatatattaaaaatagtaagtgtagtgtatctttagacagtaaacataataattagtttagtttaactttttttagataatacatacaacaggtggcaaatttgttatactaccatcaccgaaatacgctaatatactcttttaattaataaaaataaatattactaaattttatcattatctaaaaataaattggcatgaataatactcgtacctcacacaaactcatcaatataatagtttcatgtagtaagttttctacacttccaataatgttatacacaaattttatgtttcttctatgtctaagggtaaaatagacattttcataaatcataagcattaaatgatcaactgtcaagtaacggaattggcatgtaagggattaaaccgaaattcagtagtaatataaaggaagtgagaaaatagtagggccatatagaagtgatcggctaaaattttaggacatatatactgtacaagaaatctttttatgctttacacctttggccgtgtttagttgtagattttttcttcaaactttcaacttttccatcacattaaaacttttctacacacaaactttcaacttttccgtcatcgtttcaatt

SEQ ID NO: 66174 - DNA, 864 bp, Oryza sativa
aaggttgaggagaaaagactttggtgcccctcaataaaggagggatagtggttgagggtagaacggaaagaaatttgaacggaaagtgattgatgggacaagtagtgtaaatggtggtagacatgcttgtgttgtggtacaggatatgaatcctagaaatgcttatattttggaatggtggtagtacacttgaactgtcagtactatcaaagcgtcattatgtcaattattgagggcactactctgatgttgcaataattgtgaaaaactacttttagaagttagcaattgcctattggttttgttggttacgatcaagcagcctttctgagatacctgaggaaacaaaaaaaatatttagcgggcataatgttggccagatcaagtcctttcatgtgtggtcattatttacctcttattttttcagtgggcaagaattgtttaagttctttatttctcaaagctgttaatcgctgttctttaaagaaagtaatattttaactgaacctttgaactccaataggagatggatatttgtgagtatgcaaggcaatcattagagagcgaaccgtacatattatggcttctacctccagttcttactgctgcagcaatgccgccacggtgagctgcttgcttttcaccttatgctatggcctgttctgtggcatcattattatggtaatttagcctgtaatggatcctataggtcaagcttgtttaagatataccttgttgaaatagataagcaactcggtgaagctgcttccaaagaccggtatgttaccaacagctgagtctatgcaggctatgttacatttgcaaattgtgatatcagctcttatccttcatttcacagaaaat

SEQ ID NO: 66175 - DNA, 3483 bp, Oryza sativa
cataatagcgcggaatccaaaatttaacatgggttggcccacattgactcctaggccatctgctcacaggccacacggtctcatccacacagggaaatgcacgaatcatggcgcaaatcctacggatagaaaaacgacaaatattgggggtgaaaatctgttgacaaagatctagcaaaatcgtttgcgttttgattgacgaagatggattagttacgggcctgctgctgcggaggctgaaattttattcggccctggactaatacctatcagcccaagtaaattacctggaaattgggcctacataatactggaagtgggcccttggtgtttgtgctctaggagctgcaggcccatatataatttctcaatccttttaggcaattaatttcctccatttgtagcacataactacatgagaagatatgtcacgtgaactctatatttagcataaacctgaaaactaccctgaaaaaaagtaaacgtttaagttttatttatctaggatttaaaagttttactcatagtgacgtgaatacattttagacgttcatttctgtcttctaatataagggattttgacattctgcttgtactgcttgaccacacgttttatttaaaaaaattgtgcaaatataaaaaacaaaaaaaatatgcttaaagtactttggataataaagtaagtcacaaataaaataaataataatttcaaaattttttaataagacgagtggtcaaacgttgcaagcaaaaactcaaaatcccttatattatgggacggagggagtaggaatcagggttggggaagagggaagaggggactccctcgggtttagaggaagatcgaggcagctatggctcgacgataagctgatacagatagaagtgaggcatttccaaagccaaagtgatggaggaggatgatgagcgacgatagcgggggccgtggatccagtaataggaattacaggggacggagagatcggtattaagaggaacatcgttgaagatggggaagaaggcacagagtggttaggctgcaatgacggattcagcatagtgagttgtgggagaaggagaaattgctgggagtggtcaaccgcatgcaaagatcagttttggccgcttggaaaaaccattttttaagtagtgaccggcacataggaggagtcagacaatgagattggtgtgatgcgactgacgactgtaatagttatctctttttatatatgtctataggagttggtttgaaccattgaatcttgaccgaaggatgaaataaaaaaaagaccgaataggagatctctcaattggcaaccatcgccggtcatccggttgctacataacatccgtgaattttatggccgaacatttgtagtagctattgatggacaaaatccacaattccctgttctccatttctattgttctttattagaatttagaaggtactaagcaggtgatgatgggcctactttcgaaggcattccattttgcgctttatatgctgaagacacacgatacaatgaaaaatgatcttaaagtatgatggtccaaaatccatattgtggcaaaaacaatataaaaataagtaaattaatttgaaaagttaagaattaatatggccacggcttataattaagacataactcaaagatatattgtatacttcctctagtcattaatatttgatgtcgatcgggtaacacctattccctccgtccaaaaaaactcaacttctagagtttgaattttgttccaaaaaaaccaacttttacccttctacctactctcagcacgtaaaacgagaaattttattgcttcaatactctttacctacatatcactcttactatttttttaatgattaagggtattttagtcattttcactctccactagtttcacctagggatgctaggaatggactgtttctgggagggaggaagtaactagtaggaataaaatccggttgacatcaaattaaataatcaaatattagtgaccggagatagtacgacgctgaggtaacggtaactctcatgcaagattgtaaaaagaaccgtatatctatcttcttttggaacctcacctgactgaaaagctactccttccgcgctttgcaaatgcatgcagccgtcactatatatgactacacacatatatatatacaccacacacataacctttaatttattaacttctcaaaaaactctcgacgttcggtggatttttttttctgacaaaaacaaaagagcacttatcgtacccatcagcacactgtccatacccacccttttctttctatccaaacgtgagaaaaagtgcattatttgatacgtacatctcatggtatgtatggtgttccatccatcaaactttggctgcagtacacactttggtcggccatccctccgatctctcaagtgcgcccaaaaagtagatttcctcgtaaaaagagaaggggaaagatggctagcatcgatccatccttgttttgttttctttgtttctacctgcaggagctaggtcaatgctccagtgctgcacatatccaatcaacttagtttttttattaaaaaaaaacaaatcaacttagcttaaggccggctcctttccaattgaccacacgaaatttataggaatcaatttaatttctgtacaaattctctaaaagtcctttgttccaaagtaggcctacactagtacataaataatttctccagacggccaaaacaaattttcacaaacaggcctctggcccatctacacctaggtttctgtgaattaaaatcgctaaatttccatgcggttagtgcaaccgcatgcgtaaacgtgattttcgcatgcggtcacatttaccgaccgcacacgaaaatagtttcagttaaaagaaatccagaaaatcaaaatcacccgaaaccctagccgctaccgccgtcgtcgtcagagcagctgccactgccatcgtcgtcagagcagccgtcaacactagtcgtcatcgttgcgctgccactacccaccgcaatcgctcccgagagctaggggcggaggcatagtatattagaggagtgtctaggaaaccggccaagaaaaaaatttagctatacctcacctatttttatcatgtgtgcacccccctcaatacaaacatagacacccgaatcagcttaaactcgatctaaaatagagtaaattaagcgttaaaaccgaatcagctatacctccgtttcgttctagctccgcccctggctagagcggggacggcggatccacgcgccaccatcgcttcctagggtggggacagtggatccatccattcccatcgcttgtcgcccgtcgctcctgaggatggggacgacggatccgtgcgccaccgccactcacgcgggcggggacggtggatccgctcgctcccaccactgacgccggccgttcactccttctatcgccgccactcccgagggggtgggggggggggtg

SEQ ID NO: 66176 - DNA, 3025 bp, Oryza sativa
gtcgctgtcgtcgtggaggagtaggaaatccgagatcctgacgagcttcttctcgcgcgcgccaatggcgggcgacgacgccattgcgcgcaagacagagagagcgcgcgcgcggtggagaggtgaagaagaaggaggaggaggaagaaggtggattctaaacactcagtggatgtccactcattaagtacatatcatcatgaaaacattttaaaaaatttataagatagattgatataatatatcactacataaacatacaacttaaaatttaacttttataagttgtaacaaaataacaaatttaactggaatatacgtatactaatcagagtttgatttattatttttgttacaacttatagaaattgaatttaaacttgtatgcttgtaggatgatatattacatatgtatctatcttgttaaattttttgaatttttttcatacacatttagttattatgcaaggtgattaaaagtgtttcccgaagaagaagaaggcggtgggcgttggtggtgggacgatccacgtcgacgacgcgcgcggctgttggtggcgatggatgatgtcactccaactgacgaccaactgtgggctgatgtggcaactgcccctgaaaacaacgtaagtacatgggtagatagatgacaactgtcaggtccatggatggatgatggatgaaactagattaggcttgagttctatggcaaatggaagatagaaaagatagcaaatggatatgggtaaagctaattatgaaatggtaccagtctaaaaagaattatgaaatggttatgggaaaaattgggtatgaatataggttacgtgtatacccttcctagcgtcaggcctaatccataatgacggcctcatattttcacttatgcatgtttgtacttatcagctaaaatttaaattttcaatcttaaatttaaagttgatcttaaggtttttttcattgaagtttattttttagccattgcttttagatagctaagaacacgtatataaaaattttattaacatttttttttgcaaatatgccgtttcgcttatgcttaaaattagccaaacgatggcttcctgagatggttttatttttttccaaaaaattactagtttcaaattttctaggccacaattaattagatgaagctctcatatctattcccttcataaaaaaaaactaggcccagttaaggatgagatattatctagtccaaccaatctgagtaaacaactattcagatttatgggactaggtgatatctcaactagattgggtttttttttttaaatggagggagtataccgaactatgtcctcttgtactacctccgtcccaaaataagtgcagccatgagtttccgcgctcaattttgatcgtccgttttatttgaaatttttttataattagcatttttgttgttataagatgataaaacatgaataatactttactcgtgacttatgtttttaatttttttcaaaaaaatttcaaataagacgaacggtaaaagttagacgcggaaaatcatggctgcacttattttggggcggaggaagtactatctacggagagatggacatggagccctgtcatctgatcccatcccaagtgacacatcatcaaatcagtggctactcaccaacaactattccattccccaatgattgatcaccgatgcagtagggaagaaagccaccactacaactccacggagaaacaacccatctgctcgcaagcatggccaattggatcgccccatcatccatcgccgacgttcgtcgcaaatcgcaaagtgccatatgatgctcccaaagtcccaattgggggccatggcttctccgccccctgccagcgacgacacgacgacaagcagctgcagaccacaccaccacatctcggcaacacatctcctcgatcagcgacgtgaccatcgcggtcatgtgttgtatgtactcctgctacgctcatagtcttctaaccatgcaaattatgagaaatacctgggggtctttcgactaactccacaagacggtgggctagacgacctgcgtttgaacctcacatattctaattatttaatattaggtccttccctaatattcgtatttttaccatgcaaattatcagtggcggatctatgaggacggtagctagggaccgaagccccgtcatgatcagcgttgatcgtggaagccctcattattatttttacttagttatacatgagatatgttggtctagtttgtttagccatcatatatatatggcatcactaatttttttttcatagatcgtacatcttctttggaagatcaataatccatgctacaatgaacttgtgaatgtcatgcgaggctatgaattaattaatgaattaggccgagagcttgataggaatataagatgcccacgtgttggctcggctaaagaggacttttctccatcacatactaatttttagaataaggtggtgtcgaattatggtataataggctattatgggtaataggtggtgttgatttttcttattgtctttgcaggcgagaacttctttagcttatgccagctaaagaatttaagaatttcgaaagattgggtcaagagccactgggtagatttagaaaggaaaaaatatgaattaccccataaactatcgcagtcgaccgaattaccccctgaaccctaaacccagatattgctcaccctgaacttttaataccggacgaattacccccctcgacccaatccagagcggttttgtcctacgtggcttacacgtggcaatccagtcagcattttatttattaaaaaagtgggacccacctgtcatactctccttcctctctcttctctctctcactcttcctctctctcgctcgggtcgaccggcggcaggcgttcggcacgcacgacgggtaatgggcagcgcggcgggacgcggaggcccccgccatgcccaccgctggtcattgcgtcgctgctcccgacgactagcgctacagagagagatagg

SEQ ID NO: 66177 - DNA, 4858 bp, Oryza sativa
cccttatcgaaactagtgaaattaacatagttagatttgttcgggctttaaaaattttcaactaacgccgctgaatcaagaaatgccgtggcgtggtcgttgtgagatgatagtgagagagagacagagagtgtgtggtggtattgacgtgcatagatttggatggccggagagtttgggattggtcgttgacgactcgcccgccggggggggggggagcagccgaagcagaatactcggtaggatgtactcccttcgtctcgaaaaataaatctagaattagatataatatatttgagtataatgaatttggacagaagtatgttcatattcgtagtaataggatgtgtcacatccaatatcagattggttttttataggacggagggagtagggactagggattacttgggatatatatatatatagtgggtgggtccgtgggggagtgtgtttgtcgtgctggattggtggggtgcaggagaattgaatggcagcaggagaaaatgcaacattgctcccggaaactgactgctcaaccgtctcgtgtgcagtaatgtgtttcttctacacacgagaaaccatttattttttttaaaaaaaaagatttacttgaagaagttaagtatagtattttgttggctgtcaacatcaaggtggtcgtgccggagtggttatcgggcatgactagaaatcatgtgggctctgcccgcgcaggttcgaatcctgccgaccacgattgtttcttttattttccttttttctttgggacgccttgcattgcgctgcgcatgtgggataacctttttttttttactactgtacatttgtcgacaaattttctcctaaaaaattgacagatataattatagtacaaccgtagtgtaattacactgtaacttgcatgtaactacagtgtaacttatatgtaagtttcacataattttgaatcgttagatctattacaatatttgttttggtgaggaagaaaacaaatcatagcacacacatatagttacgacctccattttaccgaaataacatgtgacggagagatttttgaaagttacatacaagttacactatagttacagtgtaattacatgcaagttacagtgtaattacattacgattgtactataattacatctgtcaaatttttgggggaaaatttatcgacaaatatatagcaaaatcgttttttttttgcatgcttcattgggctgtatatttgggcctcaatttcatgggtattgggctgggcatgtaggacaactccaggatgggaaggaactggggcccacccaaacgagggctcccgtgttttaaggcatggaataagtctataatttgtccttcaactcttgctcctgattaaatcgtctccctcaaccgcaatactgggtataacacatcgattctcttaaccgcaataccagatataacacctccctaacatttgaaaaccagaaggaatcgagtccctcagctttcataacgctcatggcccacgcatgtcagtagaaaaaaaagaataaaaaaaataacagcccacctgtcagccatctctttcttttctctttatcttttctctcccctctctggttcttggtgactccgggcgagacggccgtcagctcttgtccggcggggtgcgagggccgggtggaggagtatatcgctggtctcaatatccgcatgcacgtcgtgctcgtggcgcagggtgcgcgtaataatccatatggcgatcaacgctcgactggacgccggagatgacgaggatgacaatcggaaaaagccggcggtgctcatcgccggctgcgccaaaggcgacatcagctacgagtactgcaaggccttctcctccctcggctgcggcgtcgtcgccaccgacatccccgaccgcatgccctgctagctctttgttgagaatactactatcagaatgcagcatgaaaccaacacacacatgaaaaggattcatgaaccagcaacacaatgcaattgtgcaagcaagacaacgttatacgtcgccgtggtgaatgtgggcagcgtggagggcacggtcgcgaagccgtgggctggaccctactgtgcgccgaaggcggcagtacactcggctcggcgagagctgctgcgtatgggtgaaaatattacgaaaactttccgggaatctgtcggtctgaaatttttcggagtttttttggaaatggaaatgaattcagaaatattttctcagaaacggaatcgaaaatgataagggtagtttccgtcggaactaggaatcggtcggaaactttccggaaattttctcggaatttccagatattttgtgactgaactaccctgtattccttttttatgacactaatgaatcgattttctagattcgccactggctgcagcctgcttcgccttgcgttgctgggctttcgccacctggtgcttcagtagttcagtccgttgtttcacctagcttcacgtcgtccgactttcgtcctatgtcgcttcgctaagctcacttattaagggtgtgtttggttgggcttttcaacctgcttttgcttttgcaaaagccaaaagctaaccaaagggcccaaaagccacaagtgcttttgctccaaagctgcttttagtgtagtacaaatccaaaagcagcccctacccctgctttcactggcttttgtgggaaaaaattacccacatatgccattacggaagaaaacgattcgctctttctttctttcccgttcccctttcacgaggccaagcgctggccatgggttcgacgcggcgctagggtttgccgccgccagcgcgcgccgccgtgctcccaccgccgggtgctcccgcctgtggtcccgccgtcgcgcgccgcatctaccggtgccggcttgctccatcgcccgtctccccgtcgcccgcccccacgccacccgacgtcaccccaggtcgcccgacggccgacggccgtctactcgttgcctgcccgacgccggtcgacgccgccccatgccggccgatgatccccgacgccggccgaggctgccccaggctgcccaaagccacccctgcccgacgccgccccacgccgcccgacgctactacgactccttcgccactgctccggccggcatgaaaggtgaggccgaatgctcctgctcttgtgttgatgcatgtgttgcccctagaatgttacagcaaattgatttttggcgtgcaaattgattgaacaaaaatttatttggttcaagaatgggtgacaaggcagattggggtgatggttttgtaaggcatttgtttgatgtttgcaaagaagagatagaagctgggaatagacccatgggaattttcaccactacgggttggaaaaatgttgtttccaagtttgcagaaaaatcgggtgacgagcgaaccaaaaaacaattgaagaacaagttagatgtgttgaaaaaggaatatacaatgtttatggagttcaagaattgtgccactggtcttggatgggatgaggcaaaacaaactattgtcttttcgccggaatggtgggaagaacaccttgatgtaagtactattctttcaccctgtgatattttttttctattctttgttgtagtgtgccttgctaactttatttatttaatttcagagatgcaacaatcgtgagaaaggaatcaaatgcgatcatgtgaagtttcgcaaacaaggaccaaaattcctagatgatttgcatatcatttttggcaagtcacatgttagtggggcttcagcatcatgtcctggaaatgtatcctccgatgaggcaagtgatgatgatgtggctgaggtaccaaaacctgcagagacagtgaaccccgaaaaaaataaacgcaaggggtcgtccactattgttcgagataaggatgagaagagcccattcgctcgtatgtacaagaacacttgtttgaagatagaaacggcggcagaaaagatttgtacaagtgttgaagcatcgtcagcttctccatgcaatgtagtccctaccattaaagaggctatgaagatgatgaaagattgtggggtagaagaaaaaactgctctaatgcacacagccacaactttgattatgaagcctgaatttagggaggtctttagctacctagaaacaaatgaaggaagactcgatttgatcgagagggagcatgaaaaggagatgatgaagcgttagtgattccctacattaaaattttatttttatcgattgttgccttgtttatgtgatatttgcttccctatgtgagaacactttgagttatttatttctatgttgtaaaccaatatttgcttggacatgtaaaaccgttatttccatgttgtgagctaatatttacttccctatgtgatgttatgttctgtacttgttgttgtacttgtttgccgttaattgttactatatcttctgtagatggatggaaaattagtagatgtagccaaagaagggcaaaagggatcattgatgctagctgaccttgcccaacatgcttctattaagggagaaatggccaatttgtacactgagcggtatttgcaaaaaggtgcatacagacaaacgccagaaactggaattcaatgggtgatgaggttgatggatcgtccaaggtatttttataagatgtttcggatgagccctgagatttttcatgcacttcatgacttgctagtctctacctacggattgagctcgagcaacaatgtttcatccattgagtcattgacgatgtttttgtggatcgtcggagggccacaatcattttcacaagttgaaagtcgtttcacacggtcactttggatggttcacaccaagtttcatgaagtgttg

SEQ ID NO: 66178 - DNA, 2771 bp, Oryza sativa
aatccacatattttaaaggttaaatcatcctatagttatcctagtaaaacttctaaaatatacgttgtttggcaaataaaattagtgctaaatttgccgctttgttatattatggctaaatatgtagttctatgctaactccgttataaattatgggagtgtctagattttaagcacatggaaaattttcaaaaactttaatcacaattctcacctcttagatataatccactggttgttatcaatacctacttatgcaaacaaaatctgtttctactaaaagattgacaaaattacataaaccaccccataacctattttgtcgcaaaagcccacccatcaaatattgtgaggccaaaattacccaaatgcttaagtcggactcaccacaaaccacactacctagcttggcttagttgatatggtccgccgggattcaagtaaaaaatggaccgaatcagttactcatgtgtcagggagagggcgagggtagagtggtttttccaacacaatgggttatgcgatggaatctcaaaacagggtgacaattataatgatttatgcaatttctcctaaaagattaaacaataaactattctaacctataaaaagaattacaaaactgcatgagataaacttataactaataaaaacttactaaattacatgaaaaaaaatgtttgaacttagataaaaataaaactctaccaaataccttacatgacagtttcatagtattgtagcctaaggctgctttcatttgaagcaccgtgagaaaaaatagtgcatcgtttttcgcgtgcgcagatattgaacggttaaaaggtatttttttaaaaaaatatataggaaagtggatttaaatatggtattatccatttttcacttttgaaataattaatactcaattaattatactctaatgactcatattgttttacgtattttcttaatcttctacttttcccttcctttagtgtttttagaaggagtaattctacggttcttgagaaggtaccaagatgtaccaaaaatttagtgcaaaatttaccaaatttacaattgaaaaagtggtacctcatggtacattctcaaggaccgtaaaattgctctttagaagtagctaggcttattccttttcatggttttgaacggttgattttgtgcttaaaatttcctctctcttaaaaagaagagtaaaattcacaaaactacatgttttattgtccaacttgtataacaatgtacatattttaacacttatcacttaactacatatattttagtattgaagtttcacaaaactatactatcaacgaacgaatccacctgcaagacgacgtgattgtttatctacatatatttacaatgcggacgtggcatcgtgaatgttcgacctcggatgaagcactcaagttcgcatcctaggtgaaacaaccgcacatcatctcgcgggtggatccattctctaatagtgtagttttatgaaactttaatatcaaaatatatgtagttaagtgttaagtgttaaaatatatgtaattttctacaacttgaacaactgaaaatgtagtcatgtgaaatttacttagaaaaggttctgcatgaaaaaaaaagaggttctacacgatttttgtgtggttaacgtgcgattaccgcggtaatcgtcctacggcaggggtgcagtaaccccggtcaaaacgaatgggaaaccctgcccttaagaacccggggtcttcagtacaacccagcaccggcgattgaacaggtccagaatccagaatggtgcgattgattgctcccggtgcgtgggacgcgccaacacacaaactggaaaaaaacccaaacagtggctacgagcgagcgtctccaaaacgaaccaagtactagcgactaaacgaaactttttgctcccgcgactcccgactcggctctcccgggcaccgcgggacggaaacttagccgcgttccgacgaccccagtgaaccagaacgaccggttccagctgctacacgcgagcaacaagttgaagcagagagtacggttcagagtgcccgaatgtccgattacactgtggacctggtcacctggacttcatcttggccggggccgctgaccaagatgggcgacccacccaccggtggcgcggctggagcaactggcgaggatcacaagattcagggcccgtctagttccccaaaaatttttcccaaaaatatcacatcaaatctttagatatatgcatgaagtattaaatatagataaaaagaaaaactaattgcacagttatgggggaaatcgcgagacgaaccttttaagcctaattagtctatgattagctataagtgtaacccacatgtgctaatgacggcttaattagtatcaaaagattcgtcaaacggtttccaggcgagttctgaaattagttttttcatccgtatccgaaaaccccttccgacatccggtcaaacgttcgatgtgacacccaaaaatttctttttccccaactaaacacacgcacaatggatctcctgagaaattaacacactgacagataacatggcaaaatctgcaagacaatttcccagccatgctcagttgttctaatatttccccatgtatatcaaaagtttggctgtcctgttaaaaaaggacttgttattattcccgagggagatgtaatcatagctcatcatgcattgtgtttcttgactttttattctataaataaattttcatgagtctaatggtgtgtttggttaggtaaatgg

SEQ ID NO: 66179 - DNA, 5834 bp, Oryza sativa
catctcagaatgtgctagctatttgtgactttgacatgaggtttatctttgcggttgctggttggccaggttctgcacatgactcgcgcatcctcagtcatgcattggctaattttccttcatttcccatgcctcctacaggtataaatggttccttcattaattttaatatttgtacactagtattattatttgcattactaacttagttttataggaaaatattatctcgtcgactcaggttatccaaaccgaatagggtatcctgcacctttcaaaggaaccacataccatataccagaatttcggcatcgttcgggacctcctcaaggaaagtatgaggtgttcaatttcttgcattcctcccttcgaaatgttattgaaaggtcttttggagtcttgaagcaaaagtggcgtattttgaagggcatcccaagtttctcacctactactcagaagcatatcatcatggcttgtcttgctatgcataacttcgtccgtgatagcaatttacgtgataaggagtttgagagatgtgatgctcatgaggactacttaatagaagatacaagtgacacgtcagacgatgagagtgaagatgcagagaatgatgataccatgaatactattcgtactaggatagctgatgctttgattagtgcaagaggaggatagttatttttagatatggcatcattgtatgaaccatttatcttttgctctgtttatgtggaccatatcactttgatggataaaaaactaatatatgttgatgaaaaactttgattgatgaaaaaattatacattttttctttaaaaattgggcattcaaatacaaaatattgaacatattaggtttgtatgagtaatttgcatataaacagtcccacatgccattaggggtattacaggtatttcttctacaacctacagtttcacagctgctctaaccaaacgggcttctgcttttttcacagctgattttcaacagctgcttttccacaggcacagctcacagcagcttttctaaaaaccacagctcaaccaaacaccccctaagttattatttcgcttagcttctcgtcgtctggccttggtcttgcgctgcttcacgatcgaggcccatttgttacttcgacaggacaatgaaaagttcccaagtgtgcctgcaacacccacggacccttctgaatgtcaaaagttaagtttaatttgattcttgtctgattaataagtacaatagttgctgtcttaaaatactactatgatgtgttcacgtgcctacaggattactacactcgacgaagattcatggctatctgtgagttaggaacgacccggccgtcgcggccgataggcaagtaacaagaatattgcctgttgtctatttattcatttattttctttcgatcacttaggcttatttagtttccaatttttttcctaaaaacgtcacatttaatctttagacacatgtgtggatcattaaatataaatataaacaaaaactaattacacaatttgcatgaaaatcgcgagacaaatctttagaacctaattagtccacatgattagccataagtgctataataacccacatgtgctaacaacggcttaattaggcttaaaagatttgtctcactgtgagttatgaaattagtttttttattcgtgtctaaaaccccttccgacatctggtaaacatccaatgtgacacacgaaaattttctttttcaaactaattatttagttccaaactttttttcaaactttcaacttttccattatatcaaaacttttctacacacaaacttttaacttttctatcacatcgtttcaatttcaagcaaactttcaattttaacgtgatctaaacacacccttaatcaaacaaaggtagagacgtcggagagtagctaggctagtagaacgaaccaaagttgccgcctgccgtcgtgcgcttgactagacgatgtaggagtacgcagctagtgccgtgcacgaccacggaaccagctgctctctgctctaagtctcacaagataagctaattattatctaaagctaattttaagtttaagcttttgattttgagattcatttatgatgttttctagcttgttactgagaagattaatttgacttgtgttatactccttccgtctaaaaaaacgttagatttaacataatatagtatgaacaagctcatatcctaatttgttgtactaaattgtgttaaatacaattttaaattgattttttagggcggtggaagtattacccaacactcctttcattgtttttaaaatgacaagacaaaaaaattgtcaaaggctaggtaatttaaatattaaaacataaaccataattacgaagttgatttcttatcttatttttagcatttgcctttaaaaaacatacataacgaagtgaacgtatagcttaactggttacgaatcttatcataaatttaacacggtgctcgtatttatgactaattaattatctatatgggttcaaatcgtagatttaacacgatgctcgtatttacggctaattattgttttagtggcaacatacgtacccaatcggtagtgaggtacccatggcgactttgtcaatttcatgatttaccgctcagtctcgaaggtgctaagaattagggtatacatgtatgtatttatagggtgagtgtatgtgttgtgagcatttacattatccttggttttttaaagagaacacatgcatttcatctcgaaatgaaatatttgttaggtgagtacaggtattataaaagtaagtggaaatgattgaagaaatagataatccaagaaatgattggttaataggagtaggtagatggagattaacaagtttgctattatgtttaattttgcatgccttatcaactgtggagcaagatcaagatcaagataaaaaatctttatgtgttacttgcttaaagaggtggtgttaacaaggataatttagcaagacggaattggaatggtagtctaaaatgttgtttctgtatgaaaaatgagactattcaacatttatttatggagtgtcattatgcaaagtttatttggatagcagtccagttctcttttggattacaccttcctagtagcatatctgatattttttatggttggcttctaggggttgacaagaaaaagagtaaactgatacttgttggagcctctattttatgttgggctttatggttgagcaggaatggtagggtttttgataaatcaccatatgtttactatatgcatgcaattttcagggcattatattagctccgatagtggacacaattacaaaagtgtgatgatgatgggaagttcctgattgttgcacgtcgtaagcttgaaacgatgattatgcaaactttttaccaattatagatggagattcaccaatatagaataatgttttccttgtcctgtttggttttcttctattttggtttggtgtgtttcttttattttagcctacactcttttaaagtgctagattataataattggttataactcaatctaaagaccagtatgttttatttcattatctaataatcaactgtggagcaaacaatagatactccacacacgacacgatgcattggattggaatgtcctcgtgtatccatatactccgtacacgatgcattggatgggatcagcattcagcataattttgttacggtgggtcccgtcccattgaccttgcgaccgagctcgcgtgcatctcggtcggccggtcggtcggtcggtcggtcaggtcggaccgatcgagctggatccagcccagcgaacgaacgaacgaacaggtgactgaggtgagcgactggttgacgcagccggccagtcgtacgcaccaccgcacgtacgcgccgctgattgcgacgcgccacgacttttacactattcatatataaagtttaaccattcgtcttgtttaaaaattttttacggttaatatttttattattattagatgataaaacatgaatagtactttatgtgcgactaactttttttttaattttctcataaattttttaaataaaacggacggtcaaacgttggacacggattttcgcaactacacttattttgagacagagatagtactacatactccctccatcccaaaatgtttaacaccgttgactttttcaaacatgttttaccattcgtcttatttaaaaaatttaagcaattattaattctttttctatcatttgtttcattgttacatatatatacttttatgtatacgtatagttttacatatttcacaaaagtttttgaataagacgaacggtaaaacatatttaaaaaagttaacggcgtcagacatttagggaaggagggagtatatatctatggctgtttagattatggtgaaaaattttggtgtgtcatgttaaatatatggacttatatttaaagtattaaatatagactaataacaaaacaaattacagattccacctctaaactgcgagatgaatttatcaagtctaattaattcgtcattagcaaatgtttacaatagcaccatattatcaaatcatgaagcaattaggcttaaaagattcatctcacaatttacacgcaatatgtgtaattagttattttttttatttatatttaataatccatgcatgtgtccaaacatttgatgtaatagagtgaaaaattttgtcaggggatctaaataggccctatatgcaaaactaatttattttttaagtaaaattcacacattacaaataattgagctaaactattggaaaactacattcttaagatgatatattacaaaactatacatttaacgataaatttatcacaaaactacagatttaaggctaaatatcacagaactacaaatttaataaaaaaattatcacaaaactatatattttgggtttctctaatattatgctttgagttataatggttgaaattttatgattaaattgatctaaaacttgtaatttgtgatagttatgtgataaattactttaaatatgtaattttataatatattatattgaatctatagttctgtgatagtttgactaaagtacatgtagttttataaaatttacacttattcttctcgaccagttatcaatatatttttgaaattggatgtaaaataatacgtttaattggaaaatcacaagataatcccaagcttttagaaatgcaggagcagaatgtttctcactgattttcttagcgaaaaatagtctccaaggaaaaacattaaaagtcgcggaagaagagaggaggaagcggcgagcgtggaccgggcccccgccgccctgcacgtggttgaccgcccaccgaggtgggcccacccgggccgccgccgcgcagcccgtttccactcgccttcctcgattcccccgcctcccgcggcacccgccaccgcctgccacgtgtcccgatcgagtcctcgtctcctctcgcctcgttttgtcgcagagcggagcgcgtcaaccagcttgtgtcagtagcctactttcgcagacttgtcttcagtaaaaaatgtatacggatgggcccacatgtcagcgtctctcctcgttgaatttcagttcactcttgatacttcacctcaagtgagacagtgaagtgtacagaaagtttggggagtttgtctgatttcgttgaattgttcgggaccgaagcaaatttgggattaattttgctcaaaaggactgcactacgtacacttcaaataattttcctccctactctacatgttacaagcgtcttttgccgacgcaaatatctgaatttttt

SEQ ID NO: 66180 - DNA, 4315 bp, Oryza sativa
  unsure (1)..(4315): unsure at all n locations
actatttttggatgtatggattatccatataaatcaattgatgtatggcataatttactatcattcatatggtacatttaattgaatatcattcatatgctaattataattgactagaaatttttaaaaagtattaaattattcatgtggcatttacagatgttaattagagtttttcacaatttaatttactatctttcatatgctacttatatatgactattcgaatttttaaaaggtttaaatcatgcatgtggcatttacatatgttaattagagtttttaacatttaatttaatataattcctacgctaagtacatatgatgattacaatttttattaattttaaatcatgcagtatgtacatacatatcttaattagagtttttaccaatttaataatatcattcatatgctaagtatatatgattattggaatttttattcattttaagtcatatatttgcttattacgatttatccacttaatttattatagacaaaaataatttttcgaagtaattgtcattaatatttgtactttaaataatgttaatgcattaacttctattttagaaacacatatgtaagcaaaaataatatgcagtgctataatctttagtcccggttcttaaccctaaccgggtttaaaaagaatttggaaatagcgggaaaagatctttactcccggttgatgagaacaaccggcactaaagatcgagggctatatatattcccgatgcgcgccctcgtcttctccaccaacaattaacgttttcggccgatcgatctctctcggcctctctccttcgccgtcactgcctagggcaaatccccgcgccgacgccgccatatctcgccgtcgtctcgagcttatagacaggtaccgtcataagttcctctgttaattaagaaaatcttgttatgttaattgctactacgaatcatagctttaaactccatgtagggcttggtatcggttccgtcatttggtccgcggcaaatggagagaaagacttaggcggaagttcaaatttcctatgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtccaaataaattcaaaatttcattacgtaaccatttcttgtttaattactaatcaatttcatacattcatatagtttattcgcacgagggataacctgaccacacacaaggaatttatcgcggcggttcaagaacaactcatgggattcatcaacgaagaaatccttgatcccaagggtgaattctactacgacggaaacacaattcactggtccttagcttctgagcntagcagcggagttaactttaagcttttaacccttccgtcgaaatcgtagctagctaggaaatataatggattgtaattaatacatgactacatatgtttctatatgcatgtgtacacattttctataatgtaaatatattttggtcatatatatatatatatatatatatatatatgcatgggttatatatatatatatataaaccatgcacaacagggccattcaaaaaaaaaaaaggcccgctgaagcatttttaatccccggtggtggtacccaaccggaattaaaaaccatatttaatcccggttttttccacccggaataaaaaatagcgatctttagtcccggatttgtactcccggtttgaaaaccgggactaaagggggttacaaaccggcactacaaagggtttctccaccagtgattagtagggatggaaattgtgcccgtttgcccgtttacccgcgggtaaaaaccctattaagggtgggtttgttctccatttttataacccattgggtttttttttgggtcaaaagctttccccaatgggtaaatgggcttgggtttaggtaatccctacccttgccccttttgcccgtttaccccgaaaatctaacttacatgtaggctaggagcaaaatccacttaaatacataagccacgttctttgttttctatggtttcccttttattccccttattatttctctcctcttactctatcgctgccagaggagagacacgacaccgaggcggagaatatttgatgttttaagttcgattcgaacttagtagcttgtagactttttgttccactgcttttgttgtggcgggtaaacgggcacgcctccgggaataagacacccgtgggcaatgggcatgggcaaccatccttacccgtcatgtagtaatgggtatacccacgggcacaaataatctcacgggcatgggtatgggtaggcactacccgtgcccgtcgcgcccgattgccatccctagtgattagtcacattgtgcatgcctccctcaggaacagttacttgattttcgtgttaatactaataaaattaaaatttcctctacaagaggataggaaatgcaccactagtagttcagtccttcccaagttttgctgaacacgagtaaaaaaatagtttagtcattttcaagttttacagttccatatccaaatatctccatccatatctctcatggcactgcacacctaccagccataccaaaaaaaaaaaggttgaaaaaaatagatttggcttatttcgcttcaaatttttcacctccctctccctttgcacccacatgaacctccaagtcgccaaactccaaagaaactgacgtccctaattgcaacagcagggaggataagaacatatagcatctgaaaaatatcaaaaaaagaagtggtctccacttcgatcgagcatccatccggtgcgtgcgaccatgcagaggaaaccgacgacgtactacgcctctcgcattgcacgctgcagctaagtgcaaatggacaaaagcagaagtgaggtagccagccagagatagaaagctagtcacggtttgtcgcgagccaactctcaccccagccaatgtatccttgaacgttgggctcacgcgcgcatcgcacggatggcgagcaaggctcgctgcgggtgcagcagcgcccacacgtcacggcgtgtgcagtgcactgtcgatgatggcgcacggcgtagcggaggaatgccaacaaaatggtcgtgtttttttcataccatcacaacatcgtactatctgcgacattggaatttgttgcttagagaacatttttccgtctagggagaatgaaggaaaacaggacgatggtcaaaagttggggagaggagaataacatcgtgccaaacgtgtgtgctgcatgtgaggacaatattaagcgctggctcaaaacgtaagagcttcattttttggcttacgttgcagagcaacggagaaaaaccgctttataataaaaaagcaacaggcaaagagttggtaggcttgtggaaacagtagcacacaaggcaacagcttttactcaggtgcatccgcgaattacgatgcgttacaggaacagaatactggcctctaccacgcaaaacatctccagaaaacggcttcatgctgcacctgacactcggtgattcgttttgctaacgggctgatcggtcatcaacctcttgcaagagcatgtagaatttgaaaagcaatgtgaccaaaatgatacagttcactttctttcaatagtttggtactttggtaatgtaacgttggatttttcataacatgaacgaatgttaaacactcgaatgctaatcctctataggatcatctaattgatatcagcagagagcagggtaggcttgcaaaaatattccctgccagaagctacagccaccttcaggggcttcgacatcatgactaagctgaatggctagtttaatgtaggttatcatgggaactaaagactccccgtttgcttcagtatattcccttctatcccaacaattgtaaccagcgaatttgagtggcctttcaggaaaacatctgtgatctggaaagcaacatgaacagatcaagttagataaaaataaatgtgaaattgatggctcatgacactacctagtcaactatgaaccatacgagctcctaagtgaggtttgtttctttctgcataactgctggcagtagaagatcgagcatagaacatgaaccaaaaaaaaactgagcctttatactaacatcctagtagtggcccaggaaagaaaaatcctggtaggtatgcacaagactaaaggatagcagaaaaacat

SEQ ID NO: 66181 - DNA, 1514 bp, Oryza sativa
attgcacacaagaaaatgatatttgcagattgttttggagcatactgtatttttcaatatatcataactttcatttgcagatgtccaaacattccttgtgactggggggattacctaaagatcaaatgctatatctttatctattattactactatgatccatacattccttagatgttgatggattcaggaggattaaatatcacttcacattgcctgtaggtcacacaaagaaacatgtaaggatttaacacggaacaatcactatcttggtggataatttccatataagtaaaactagagaccaataattttgatcttaatgaatgtatgacatgattaagttagtaaataagtccaatatgcctacaaaaacaacagagaactcaaatttccgaactcccaaggttaacaaaagtacttacttttgcaatgaaagtattcaattcgtaggtacctacaatcttttttacatcttgaggaaacatttcgctacaatgttcaggcccagttgcaaggcataagatgattgataactcagatttttctgtcaaggaaaagataatcaaattataaaagtaaacagaaaagtgttcaacataattacccaggaactaacttaaaacatttgtaggctggtcagttttatgtccatattctagcaatggatcagcatgtactagcctactcttgcacttcttcttaagcagaatcaacggaaaacactatgagcttctagattttagttcccagttctgctgcttttttaggtaagactaagtttcttgaaaataaggttcagcatctcacatgacaatatcagcattaaagattgaagagtatcgttgaatgaggaatcaaattatatatttaacttgttgaagagaaagcctgctgataaattccaccaaggttataatcatttatagggttggaaatccacatttaagatagttttgttacacttacactcatatactataattctgggggcaataccacccccaaccccctggtattcacaatgacagaccaaattaagctcaatctgaaaaggtggagctttgcatgttgaattgatgatttggcttcatataaactgccgtgcacatgcatgcacaagtttttacaacagtagacccaaagctgctacaaaccatctattttgtttgggtgttggatgtgtggccagtattacagtgtatggatgaatggtgaagctggaccaacttataaagtagatggacatatcatggaatcgattgagaaaagaaaaaagaacatttaccaccatattcacagcaccgacgcacccgttttacatgccgaagattctccaatgggcatgcttgactcaattgcctgaaacccagtcacattgataacatcactgctctaaatatagcccacttgttaattatagtcaaaccgtaacaaaagaaaaataacagcacatgaaaagaagagacaaacatgtcaaataaataagtgaaatacatggccggtccttaaac

SEQ ID NO: 66182 - DNA, 9866 bp, Oryza sativa
cgccgttgttggcgctggcggtgaccatgtcgctgaactggctctgcagcgcctcgtacttggccgccaccgccgccagcatctcgctcagctgccggttctccgcgcccatccgcttcagctccgcctccagcgccgcaaccttcacaacaaaaaaaaccccaaatcagctcaagaaattaagctcatcacgctcccagccatggcggccgtcgatcgtccgtgcacgtatgcttaatcacatgacctacctctgggtctttcttgagaggctgctggtgaaagaagtcctcctcgacgagcaccttgggcttaaccatggcgacggccgccgtcgccggcagcccgacgcggaggtccaggctcagcgaaggctgggtgctaatccacggatccatcggcgaacgatttatcactgatccgacgacctagttagctagctcgatcgagcaaacttttctgctgctccgacgatgtcaagctgagccaaggagagaagagaggagaggaggagacgaggtgagaggaggagctgagccctaatatatatagagaggcgggaatatggcgaggatggtctagtcatgggaggagggaggaagaggaagaagaaggcgcgcgcggggatgtcgcgctcaaacgcatgtgtactcgtcgtcgtcgtcgtctggggtcacgcaggattaggaagcggaggggaagggaaatgagtaaagaaatggagggagggggaattcgagcatgcggatgtggcggaagaatcggaaggagactggagggtgaccggaacagctagcggcgccaactgaattattattttttaaaacaaaaataaaaaccacatccctctagttcttgtgtttgtcatctcgtcatttcataatactcgttttaaaatattactagggtttttgagtggataagacgttttataatttaacaaaagatggttatgattatttgaaataaaatatatagagataaattaaataaaacattgttataattgtttgatatgacatagcacaagaagaaatagctatattttagataaagagcctgtttggcacagctccagctcaaccaaacaatttcagctccacctaaaatagaaatagagttgggtggagctctctcacaaaataaaattaagagttggaactaggtttaggttgcttcacaattctaatttagacttaattacttctgaagctaaatttaggagttgaaactctaccaaatagtccaaagtataaatattagaaatctctatattttagagaaaggtatggtttatcttgtcaaaatagaaatgattaattaattaggggatgtaataacgagtgggtgggagactagtcaggatgtcggccagcagcatgatgcatggtctttgggctggatagtggggcagggtccaaagtcaagaaaatacaccacacatgcctgctattaataaagatccctatctgcatgccttgcaattggcaaagaagaagttggaggaagaaggggacatgcaagacttcttgaccccctactactaaatactcccccgtttcaaaatatttaacaccattgattttttagcatatgtttgaccatttgtcttatttaaaaacttctgtaaaatatgtaaagttatatgcctatataaaaatatatttaacaatgaatcaaatgataggaaaagaattaataattatttaaattttttgaataagacgaacggttaaacatgtgctaaaaagtcaacggcgtcaaatatttcaaaacggaaggagtaccaccttttggacccttgcttgtcagtgagcatgcacttgccaataataacttagctggatcagtgtctaacctcttaattcttccccttttcaactctactagaaactcattttcttggctttatgtgttttattagaaaaacactctctccatacacgaatataaacattttcaggttttaaattttgtttgcaaatacaatagctacatttattattcactggtagttaaatcattaggcgtgatttttctaatcaagtaaattatctgaggcatcaattaatttccacttaaccttaaattttgctaaaataacctaaaatctcacatatttgtggatggtgtactccctctgtcccaaaataagcaatgtaggaagggatgtgaccctcctactaccacgaatctagacagaggtttgtccagattcgctcctaggttgctttttttttttttttgactcccgttccgatttcatttcccccctatgcttaattcctagtgcaactgggcaaagtagctatagtactagagtatcttgtagagcagggtaggtgtgatgcacatagttagtacagtactatgttttcttggtgtctttcctggtttggtgagctccaaacttgaggggccctagattaacctcttaaattaaatcaaatcaaacatccggaaagagctttttgtactatacaatagcttaggtttttgccaaattttgactagaaatacttttggggaagactactctcgccgcacgagtcaatactgcatccaaaataaaaagtttgtttatgacaactaatagcatgattaatccactgttattgaccggcgggcgccgttgggtcgtttactaagcttaattatgcaaatgatcccaaattttccagttcttgtactactccaatgtagggttattaggattggaacgtctggtgttgacaaatctacaattcagatgtatcagagacttttcttttcgtgatgaagaaaaacggaaatgactctgtaattgttactgaaagatatgcaagattactgcagaagttgcagaagagacttgtcattgacaggaacaaagaaagaacgggttataaagtgtacttggcttgagccacgcacaacacaagacttggaccaagtggtttggttggttgccaagaacgagttggctatgttctctggcacacacacagcaacgggcaattcaagcaaccacatgacttgaggtcattgtgctgcaactagctactgtcgacttgcaattttgcaatttgtcctctcctgtttgctggacgaattgatggtgttaatttctttttctgagaatagtttggttgacaacttgacaaaggtatgtgtgaaaaaaaaaacaaaataacctcactgttgggcagataacagtaacacttattgggtttgcttttcaagatttttttttttgacttgtggcttataacttataagcggatgacaaattatcattaaaaacaattatttttaaagcaagagatttgcacttgtattattagcggtctaaaatccaaaatccaagaccgtagaccgggtaacaaaaataattataaaattaaaaattaactacgccggagttcaaacaagtagtaacactgtaacacgcaactgaaattctatatcgtgtaccagctagtatttttactattgtgttaatacggattatttgaatgtcgtctggctgaaaccaaaacgggacatctggtctttcagctaggttcgtttaaatcttccttgctgtacaccatatttctatttctgttcgtatcagaatcagctcaaattggccaggctgtggtggaacctcttcaccgaggttcgattcgatccgactcaccacgaatctcgcattttcagtgtattatgcagttatgctttaggcagatgatatatacatgaacaagggtacatctttatcaataataagatatactaattcagttctaagagctgcttagaaaaataagatatgcttataaaaaacgagtgtgtccgctcctggtgtgcaatattaatcagtgtacacggttctaaataggcaacggctacactctccattctaaaaagagccaacttttaagtatgaattgtttgtccaaatttatttataaaaattagcttttctttttatggttggattagacgttaagatacagatttatcttaatttttgttagtaaatggtacattttctgtaaaaaaaaacttttacataaaagtggttttaaaacatcatatacatactttttaagtttaaaataactttaaaaccttaattaactatgtattaataatctttttacgttttttaatttaatttactacctccgttctaaaatgtaagtatttttaattatgaatctggccggaggtagtagtgaactcaaacgggaccttagtcagcgacaatattcaaccaaactaatatactacggagttatccacagagagtgaaaccgatggagatcgaggcaggcaggcaggtgtctttgtcggagcacagtattcgcccacatgtgaactcggtgcgccgaaactgcaattccggctcgtgacaccgaccggacgctgctccgtcaccgcggtttgacccccaccatgcggccctttgtctccgatcgagaaaaccccaaggttcatcgcgacgaaaaaaacgttgcgacttaccgactctgcacgctgcgaatccgtgaccatatatgccactgcctcccggcggcgagaaaggtatccggtaatatttgacattatttgcttcttccattctacagtattccatctattaatttcattttataagtcactataaaaaatgcccgtacgttacaacgggtgaaggttatgttattatcgttacacggtttagttaatgtaaaattcactgtagaaatttacttacatatatttttctagaaaatcatgagctgcaattagaagcccgatcatctcaagttagcatgtaaattttttatttagatttcttatacgactcctcctatattttcaaaaagaacaaacttaaaacccgactcaaatatggatctgtattttcaaaagcgaacgaacttaaaaaccgactcatacacagatgatgtaccagagtacccgtaaaaacatctttaatttttgtaatagttgagatttaacatttttctagttaaacttatttgaatttgattaaatttataaaaaagatatagtagtattttcaacacaaaacaaacatattataaaattatattcaatgttatatttaatgatactaattttatattttagatgttgttaattttttttaaacttgattaaacttaacaaagtttgactagaaaaaagaattaaatgccttataatataaatggagagggtacttcttaaatataaatccttttccccttagatagctagccagatattcttatacttaggccatgttcgtaacaatgttttgtccagccttaacaactgcctacgaaataagatggattattagtttatgattaattaactattataaatttttaaaataaatttatttaactttttaaaaaaaacttatacatatatataaagtttttcatgaaacacgtcgttagcagtttagaaagcgcgcccataataaacctctaaatgaaaagaaataggccttatcgatgaagaaagaatttctatttaattgtaattttaaatatgaaataattaaaataaaataaaaaagtggaaaatcgtgaagacaaggcttatgttgtgtaaattggaagagatgtttggagaaaccaaattaaacacatcaaatggagcatagctcattcaattagttctttttcttgctcgtcaaggtttaaatcccaaatttaacactgttgcttgcatttttaattaagtggaaatgctatatgtgtgtatgtgtgttcatttgttaaaacatgtgcccttatatgaggccaggtttccaattttgtttagacatgtgtgttaaagagtattgacgtggatatttgtataaaagggttattggttatattcatgctcctctaccttgaaaagaagtattctaaaaaggttgacgaagttctcattatttggagagaagaggattaacttgtagtcttgtactacgtggtttagggtttgccaggtagaaagccaaattaaggtcttaattggctttcaacatctggactgtggattgaccgtataaaatcgatcagtggagttaatcgcagactatgatgtcgttgatcatcgagttgttctagaagctagaaggtgtacagataagattgtcgcctcgtgtacaaaggcatggccgcatgagttgagttgattccaaaacaatcaaacttttgctactttgactgaattgattccaactactaattaattcccctgtacacaaaagcatcccttcgtgattatactcacgagccggtatctgtccatctcagagaggttgtaagttatacgtagtatattcttaattcaccggtccatgtgtaatttacatttacattttcgctagttttcacgtttgcataggcaaaacgttataggttaattacacaatatagtaaatttaaccagatttgtcttaaaaggtaaattcatggtgtaagtaaatttaatagcttgttaacatcctttatactcctatatgatagcgagaagatctagcacaggaggccacgaaaattttattataagcgaggaaaatatttggggtgtgcttagctcacgctaaaattagaaatttaattgaaattgaaacaatgtgacggaaaagttaaaaaattatgtatgtagaaaagttttgatgtgataaaaaaattaaaagttctaataaaaagttgtgagctaaacaggcctgggaatgataatccagctcgtcaaagggacggttggaaaatcggagcagcagcagtgaacaacttgcaatatgggatcttcatagttcaatagcgtttggacaaattaagagaggaagaacatggacgcttttatggagcttgttactttgtcttagggcacccacaatggttatctataggctctctacaagagatccatgtcagcatattttcctacttggaaggtattaaatgaagagagagagcaaagctatctactaacttagagatagtctatagagaaaaacgaggcaatacatgagagagttatagataccaatgtagacatactattaaggtggtttactattaatcgagtctattgctgagatgtacatgttttatagatagcaccttactttaccattgcgggtgctcttataaggctacgatagatccaggtcgaaagaggatcttcagatttatttctctttgactttcagtcattgatacgtgggtttatttgatagagagctcatatatcagtgacctatattaaagaagaatctcaatacgttgaggttattctccaacggaggaattatgtagactaccatgcattctaccaagaggttgtgtttgttgttgtatggaatagctcaatgtttgaatgtttagctgatttgtgataattatggagagtataaacgaattaattacatattataaaattaagaaatgaatttaaaacagtttttataataattttatttttaactataaatttatatagtattccattttacgaaaatcacactgtttatggctcaggaagcatgcacatttattcaccattatattccctggaattgtcaaacggccacttgatccaatataattatataattcctttgtggcattagttaatttctccaacaactgtgatagcaatatggaattgctaaaaaactatcgtaagtttattcagaaaaaaacttttatatgtaactatagtataattatagtttaattataatataattatattgtaactacagtgtaattacactgtaactatattgtaatctctatataagttagatataaagttgcacatattattttagtacttatatacaagttatattatagttatagtaaaattatattacaattataatatagttagatttaaaagttttcctaagaaacttgcgatagttttttaatactcccttgcattaattaattaccgttgtgttaagagttaggtcatttttaggaccacggacgttttggcttgatgccataaaaaaattgaaattgttcagtaaagattcagttaagaggaaattaagatttcccttcattcaccttattgttcaaaaattgtagtttggattctcctcctaaacatttgattggttaaaaatacttggattttgagaaactactatattgtgcaaaaatgtttaaatcccggaaagagttagtagtattatatttgggaattagtggagagaggaggagtcagtaatgagcgctacctatcgaaactttgacgctacggaagctggaagcaatccaaaccagacctacttgaccaactctcaacgatatactcaattcgttttaaaatattgacaccgttaactttttattatttgtttgaccattcgtcttatttaaaaaatttaagtaattatttattcttttcatatcatttgattcattgttaaatatacttttatgtacacatatagttttacatattttataatttttttaataagacgaacggttaaacatgtgctaaaaattcaacggtgtcaaatattttgaaacggagggagtatatactctcttcatcttgaaataattgttaatttacaattttgattttgtctaaaaaaatcattttaggtacttttgtcacatcaactatcaataatttaaaactttctccatcatatactcaactatactctcactatcaactttacatcatttaatagctgaaactatttttttattagaccttaaattttttaaaaaacctagaacgataattattttgaaaatggaggtattgtggtatttgtattttctctcgtcgtacatactcgtagtagataggatacctagaaggtgaaaatggtatataaattttctgaccttaccgatattattttcataaaattaatattaatataataataacatctttacctactgtgactatattcaaattttaatttttttttcaatttctgtaaacgtgatactacataaatccataaatatgaaaaaattttcgatcattttccttgacaatgaaataatatactatttcctaccattttcgatcatttcattcttatttcctccgtctttaaaagacaacctcacattagaatgacacattcttactttctccgtctcaaaataagtgcagtcataaattttcgttttcaacttcaatcattcatattatttaattttttttgaaaaaaactaaaaacataagtcaagtataaaatattatttatattttataatctaataacaataaaaatactaatcataaaatttaaaataaaacgaacgataaaaattggacacgaaaacttatagctgtgtgtttattttagaacggagggagtatgcgttttattttttttacggaggagtacctgaaacctggatgcagttgcatggttgaacccacgcgtgcactctcagggaaaaaaaaaatgaagaagaagaagaagaaggcgacgacgacgacgcaggcggagatcgtagagagtaccccgtctgtcgctgtgtcgtgtcgtgtcgcgcgcggcgcccagcagcgcagcgggatatccacccaaatctggggactcccggattcctccggcatgcagccgcgccgcgtgtgtaccagccacacccacaaactccttctcccccacgtgacgcgcgtggtgcaccgccccgccgccaagcccaatgcccccacgcgtactcaccctcaccccgccgacgacgtccacgcgttggtaccaaaagagaagtgggcccccaagtccggtcaccctcttccaggtggggcccacgtcctgacgccgacgtcgtcgggacacgtggaccactggcgtgttcgtcggaggaggatgaggttggggggggggggggggggaataaaaa

SEQ ID NO: 66183 - DNA, 5550 bp, Oryza sativa
  unsure (1)..(5550): unsure at all n locations
gcaaaggagtgcaataggacttctccaaacgaaccacaaaagtggaccccaagtaggttatttcatccagcaaggtttgaatctaagagaggtagcgtatttggctatccactagatgggctcaatgagcagccactatagcgtgtggtactagtacaagtacagcagtagtttctgcttgctcttgttcttctaaaaaaactactgtttttctgctctctacttcattgaataggcagagcgcctgacattttgtttcaagaatatactaacgccctagtacttaatatgtgaataagttatcatacctgggtacacccaaatagcttgagaattctcaatgatgagcagctgtcgacaatcagccccaacgcttcattggtcagttcacgcaaaaggaaagatccagaacctccaagtgcgttgaacagttgcgagcaattgcataagcagtaagatttccagcctaaagtaaaagcagtagatattattataagcataagatatatatgtgcaagacttataaggcatcatacaacagtccaagaaagcaggaaaaactacccaatggtacaggtttacatgaagcaaacaaatgcataggaaatggaggcaagggcaacgccgcaacagtatttaaaatgaataaataagaaattagaagtcaacaattatgtgctaacagccagggaataaatgattatacatcagcagttaaacatcagtgactcagcaattagttttgcagtacagcaattcaatgagtcaattcaagtataccatcatatcccaagaaatgcatgaaaagaacccatacaatgtcctaattccaatcaacacaacgcagagacaggcacacacacatccaagcagagaaatggaacaatgggcagagtaccttctcaacattgttcaggcataactcagttaggtatcctccagactgttccaagaaccgatacacagcttcatcactgcaattacaatcaacatgattacagctcagaaacaactttgcacgacctcattacacaaaaatcatgtgtcatcttcatcaatacaaaagagtaccaagtattaatgaagagtcacgctaaaatgaaataaaggtccaaaatatccatcagtgttgacctgtgttgatatgttaggctgacacggcaaatactatggaattgtaaaaacatgtggatattaccatatgattttgaccatctcttgtatagaactataaatggctaaggagggatccattcctgctggcctaaaaaccaaggaaattttttggaactgaactttgtattctatactccctccaatcagaaaagaatgttgttttagcatgtgtgcagtcaacaagtgttnaaaaaancctctttttncgcccactaattattgtttacaatgcaggttatgggcatatggaaatgaagtggctaagtttgtgttaacaaaagttttcataatattatacctgtaaaactttttttatttatgcaaaagaaataggtggtcaaaccgtcaaagttatctattgttgactttgaaaagtacaaaacaactttttgtgacaagatagtaatttcaatgtttccttaatctacaaaagaaaaaaaagtagcagctcaattttaacaaacaaaacacaatgacccccctaccctgattacaaatatcacatcctaccagaatttccaataaataatgagtttacagtaggacatagaatcctgtcagcattataagtaagaatgaagtaatccgcatcacatcaactatgttattaattgtctctaactgtaagtaaaatcaggcagaaaagcgtataaggctataggactttacagtacagaggagaaattcatttgaaaattggtaacagaaagaaaaggaattacaaggtaaaaacaaacagatacatgaacatcataattggggagtatggtcagaagcaacccaacaagcaggttgtcctagacagttagactcccagtcccagccaacaaaggaaagtgtgggttcctttcacaagcagtataatcaggatatgtaattgtgtgcaaaataagggagataaattcagcttcttttcacaaggttaaaaacctttttttacatagagaaactgaaaagacaccctataccaagaaataaattcttattgaaaagatgataagtagaacactagtcgaaaagataaaactcattcaatgatcattatgtaaaaaaaataaagccatggatgtacatactaacaaaattatcctgctaaagaataaaaacactccaaacagcatcagaagagaaatacctgaatgtattcctttggagctttattttttttataagccggcaaccattgcgaagatgtctcattgctgaatcccgcaatctattcaggttgcgaaggtccaatgaagataattgtgggcagttccccgcaatagtcttaatggaagatgatgtcagttgcctacatatagatgacacaaacgtaggtagtcagaattacaccctaaatcatgtatctatacctgcataatatgtcatattatgagtataaacatttatggtatcagatgattgtgacanaacagggggccttattagtttactatacgagaataacttattaacaatatgctctcaaatgtgacacttaaataacaacaataaggccagtgccccagtgaatacaattattaaataaatatttaagggattgatgtcaaaaggctttcaagaaggtaccaaagctattggcagcctgcaatatcatgttatagtttcattttggtcaggactctcatcagataaaaagttacagatccacatttaaaatgctggccctatattgatggataagcatttccctagcccctttactgatggaaattggtgctgtattaacacataggacagctgtcatgtactgatattgaggtaaataattgtcttattactgttgtttctctattgtagaccttctagttacattagaatcagcttttggacttatgctttatatggaaaatttgttttgtatgcacctgattcatggtgtagtttgggagatgaaagttgtaacctaaaactagtgctgataaagtaataatacaataaagaagatattcctcataattaagtagaatgccatgaagacttacaagcaaccagcaaatgccaactccttcagatttgaaccgtgtacaggaataagctcattgacaaacttattgctgacagattgtatgccagacattgataaaacctctaaatgcttaatcttttgtaaggaaggaagaatcatcatggcatccacgtttaagcagtcatcaatatatagttccgtaaggactaaactcaacttgttagcaagattctcgattccagttgaagtgagaagagaacactcgcacaaatttagcgaactcagagaaggggctgcagagattattgtgtctaacccactatcagaaagacggtaatttcccttcagagatatttttttcaataatggcatgctgttaggaacctttgctaaggtagcaggcaacatgtagtcaggcatgcatcgcccagataagtcaagctgcaaaacctcagtaagagcaaaagggagggaaaatgagtcctcaataggtgacttaaataagaaggccgcaaagttaacaaaatatcagtgatcaaccctaagacccaaacactgttatggtcataatctaaaaccgacaaatttaacaacttgtttttcaacgacaaatcgagacatggcacatggacgaaatggtgcttctacatgttttaatatcttattcaacctctaaaattctagttaatcacggaataatctatggtaacaaaattttcacatatatatgtaggataaatgataactttactattagaatgtaaaattgtcatgtgctccctgtaacaaaaatattaagggtgtgttcaatgaaatagctcacaatttttttacaaaaattacaacatgtaattcgtttttaattcatatcagcgcacggcatttagctataaagagtaaaaaaaatattacctgcaagatttctgtcctgcatttcccaaaaatggtctcaaagtcatcctcactcaaccatgaacactcactgagttgcactgtcacaggattatcacacatgagttcaccaagaagatggacattcatctttctagaatggcatagactagataagagtctattttttagctcatctggaatgccagcaagtgattcgatagcttcagcattatttgaaagagtttgcaagcacaagctagtaagcgatggagcagatcgcagtggagatttcctatctttggaaggtatccacgaaatgaccttattagcagacttgttcaagttggaagaattcaactcccgagctctcagtttagcttctctgtcagtaatgatcctcattgcagttgaaaatggacctggccagtcctgaggatcaggaaccggttccaactcttctgcattgtcatcatcatcatcaccatcatcactatgtccatcttcatctgctttgaagaatgcaaacctaggagccatttcaatagctctctgtcttgccctttctctccgacgtggttcccaatgatctgctgggaaactctgcacctcttcagaaatcactgagttcaaatccatttgatccgcacctgagctaacagacaatgaactctcttccacaaccatcttagcctttcctttactatcgggactaaacttaccaatcccggtaccagcaccagaatcatcgttccccaaatacagcttccctttgcctttaacatcatacctagccttctgccttctctcctcttctgtggaatacatacctgcatggttttcgcctaatgcacttcgcataggagatgctaatagctcaatactctcaccaattgccgaactctgtccgtgcacatgctcgtcaatggggatgtcattttctcgaatagtaactccactagctttctttttacctgtcttcacagaatcacccattctcccttcatctgtcctgcccatgctcatggtgaacagattcagttcaatcaaatcagaagcagcgcataactgtaccggcatcctactgccatcctcccctggaagtatgcagtcatcatcattgtcactctctgaatcagagacgtatgggatctccatccctatcttacgacgcttccccgaactatccacattccggtgtggcatttcatcatgcacctggcctccagccccgccacctccattcgatccgagacccatctccccacccatttgaacaccaagctccatcgaccgtttcgcaaccctagaccccgattgcaagcttatgaatgccgcttcaccactacggattttaccgccgccccaaaccctaacttcgccgccgcccccaaactcaccagcgctggtcggagaagcaacgggggcaggaatcgcttgtgccctccccttcctcctcccggacgacgcggaaccagagccggaggaagcgccatcggcccccgcag

SEQ ID NO: 66184 - DNA, 10972 bp, Oryza sativa
gccatttagacatcggaaattaagcaactgtgacacataattcaaacttcctatttgaagaaactatcaacaaaacaattaaaattccaatttcatgccaacatacgaattgtaatcaatatatgtacattctttacaattaaatcattatataagcttctgttaaattagttggggtttagattctgaatcccaatgattcctgaaatgaattaaacaaatatgtattcagtctttttgacaagaaatattcaaattaagatttttatttaactcttagacgatgacataaagaaaaagtcctatcaagagaaattaaattcgaaatgtaacattataaaattcataatacagcgtaacctaaaacaatgccatctctctgtttttttatcgactaaattgcgcagaacagagtaaacaatccattcaagttcttggtaaattcagttctaaattcctgaattgaaatttgtaaatgagaatgctataattagcattaaaaagggagaaaatgtggagttccagtcctttaccgaatgagactgttggctaacttgggctcaatcttggcagcaatcacttcaactgcccaagaaaataaataagaaataacactatgaaactagcatagggaaaaaataactagattgaataaaacagaaacctgtagagccacggagggagggagttgggttgcctgggacctcagtgagttcccatgccatgaagaccaattcgcaaggtaaactggagtcgagaacaagagatcttaggcagaggttctaaggtagatacgccatcaaaaatgaaaaaaagcaaggatgcacacattttgcctcagtaatgctaaatcgtagatcaaagaatcaactgccccctgcatgtttatcaagtgcatcagctctgttccaatttctccgaccacccttaacaaaattactacttccccattcctattcatgtcttgcccaataggccaataccaaaacatacaatgacagcagcgacttacttgcatccagtcattcacaaatctagtattggcatgtggcctgtgggcggcaggatagcagtgggattttttgtgaacaagggatcctctacacatgaaattcacttattttggctggcagtttttgttctatgtgggaactaataagaagataagatcttttgtgcagaataatgtgtgacaccatatgtttttagtgttttactgactataagagtatgttatatttgatgatatatataatattttcactaaaaatatatatatatatatatggggcgagtccccgaatccttttttttttcagcttgccaagtcggacactcgagtccgagtcggactccgacacctgtgtccgtgtcccggtaacactgcgttgagtaggagcctcggatgtggaggcatgtgccggagcggggagtagccaggattttttggttgggtagtcctacttcaaaggttcacatcacatataaaaaatttccgaacaccgcaaatcccatatacaagtacaaatttaattaaaatgtgataaaaataaatcaataatatcttttaacatcaataatcgactaattttaaaaagcacgttcaaaatgtgcaagttcaaacgatgcaatatccacattactcttcatcagaatctacaaatcctacaaactacaatggcagcaaatcagcagcatatcgctgactcatcatagatgagcaggcccaggattttaaagttgtgtattcaaaacgtaaaagggtaggaatttttttttagagcaaaagactaatgtttggcatgtataatatcacacaattctaaactattagttgtgtatattctatagcggatataacacaaacttgagcataattttgtatattcatagaattttcatataaaatcctccacatatagaattacaacatttaatttacaatttttcaacatatcaatatctagaacatggcaaatgataataaataaatcttacaatttagaggacaatttgccaatgcttttttttaaaaaaaaaatgaatgatgctgtcctcatccttaacttgagaagaaatccctttcaataaatgtaaccaagcaaccattcaagtttttttgcccttgcttcttaaattgtttttatatagttcattgaagaaaatcccttaatgactctagttctattgatgcatgcaaacttacaaaatgtaaagtcgcagcacatacagaattggagccgtggaacaaacctgagacaagatagtgaggacttgaaacagtcaaacgctaagatagatagacaaacagacagagtcagtgagggcgttgggcggctgctggcctccaggggcgggcccaggattttcaacttgggtattcgaaattagaagggataaaatatttttttccaacccacaaagtctaatagttgtatatttataacggtataaagtgttcatagaatcgaccaaaaattgaatgtgttaagcatattaaagtacagtactaaactattaattgacagaacatatcaaatttatagagcatagaaaatggaaaaatgataagaaatcttacaattcagaaaagaacattccgcttcttgatattttgaaaatatgtgcactgataaatactacaatatggtcttccaatttaagtactgaccatgctaactctgctaaatatgtgcactgataaatactaactctgctacaaagcttcagaaatcagtgaatcacaagtttcaaagttcaattgttcaaccatgaaccatgaaccatccctggatggctggattcaaatcctaaataaaaaaaatgttcaaccatgaaccattcctgattcctggattcaaataaactaatcctaaatcctaaatcaaatgaaccatcctagattcaactgtgaacaattcctaacccaaaatgtttctaaccaaagtaaccatcctggatttaggcagtacagagctgagaaaaaggacaatatgccactccattcggtgggtttagataaaatgccacccaatacattgcaaatgataaaatgccactcaatatattactttcaggatattttgccactttgagggattttaagaccaaaataccgctggctgtggatagagaggaagagggaggagcggaaggttgacccggacgacgctcatgctcgccggcggcgggtggcgagcgcactggggcgggctgcgacgggcggacagggggaggaagacggcgacggcgatggggaaggaagacgccggcgatgggggaggaagacgccggcgaagagggaggaagacggcggcggcgatgggggaggagggcttaccggcgtcttcttcctctcctcgtcgccgctagcgggagcacagacggcgctcgttcttccctcgttgccgcccgccgccggcgactacagccgacgccgttcgactcccctctccggctctctcccccttcctctctctctccatggtaggggcatatttgtcttaaaccttcttaaagtggcaaaatatcccaaaaataacctattaagtagtattttatccttcgcaatgtattaggtggcattttgttaaaaaccctccgtatcatatgagtggcatatggagtggcaggggaagaattaccttcgtgtggagctccgggaggcgtcgcggtgcggggagtggagggtggcggcgcgggccgcgggacgccgggacagcgtggggaggcgccgagtcgacgacggcgcatcggcggtcgcccggtcgctctcctggctgtggcggctggatgggttaattagattttgggatgttcttttgggccaatgggcctgaaatagtgaggagagaaggaataagttcatctgaagtcccttgacttgtaaaggaatccgatttaagtccttcaaccagaaaaccaaatacgacgggtacctcaactatcaaaaccgatgtaatataggtcccatggcagtttggatgatgattttagctgatgtggcgcctacattgctaatttaactcgtttttcatctaacgtggtattcacgtggtacatgaagcaaaatttaatctttattattataaaaattgaagatatttttaccggaactttggtacgtcatccgtgtttgagttgattttttaattttatgttatctctatcaacatttccgttgtctgttaataaagaaaaaaaaagtcctactcaaagaggtaaaaacgaaaaaacaaagtccgactcaaaagcaataataaaaaaaacttctgtcgacagtaaaataaaaaaaaaagcatcttgcgtccgactcccataaaaaaaaggaaaaaaaagtctcgccaataaaaagaacaaaaaagaagtccgtttggtttctttggcacgggtatttttttcaatttttttttacgcgaaagagttttttttcgcacgcgcctaggctcttggttttttcatctttttttaatcccatcgcgcctcccggcagcttttggtttttttatcaatttttttgtcgccggttttttctcctatgtgcttttggtttttctcatctggttttttaatccgatctttttgccgcacgcctcccgagttgaaccctgtagccgcgccgccgctatattgattgtgcgttttctcctcaaaataaaatcgattccccactcctccctcatcatttcctccattattttccctttcgattcggatttaatttgtcatatttaatatccgtttaacatttgccgatgataatagctatcttccccggtatttttatcttgagttttacactctgattttagaaaaaaaaatataaagaggagatcgagtggatgaaacaccctcaactaatttattttgggttatcgagaaagattcgactgatttgacgaggaacaaagagttttacgctctgattttggaaaaaacggaaagaaaagattgagtggataaaaaatcctcaaccaattttaagtgatcgagaaaaattcgaccagatttaatgggggaattttgcttcggtaaccatccagccacggactatcttcgaggggttgaagatggtagtagactatgctagctgagcttacggctacttggctacaggccaaacagagggacgtagcagactggcctagggcaaaaatgaaaggaaggctatctaccctagacccaggaaagattttcattaactttttcaattaaaatgtatatagcgatcccaatatttcaatttattgctcagcttttaatatataagtgaaaaaacgtctttacaagttgcaacgcacgagtcgttgcaacgcacaagcattttttctagtaacttaaaaaataaaacaaaatatgtgggccaacatgtcagtcaaataataaattttaaaatattaggacccacatgtcagtggcccacttcctccacctcatcccctctcttctctctctttcccttctccttctcccctcttccctttcttcttctccatatgcggccggtagcgcacggctgaggtggtgggcggcggaagagaggcttttaatggacctagtgcggcaggtccaccagtcgatggtgaacccgacgacgctatccatggctacgccgccgtagagggaagggagcaacggtagatggccttgagagccatggatccacgtcaggtggacaccttgtgccctcgtccgtcgttgctcccgtggtggcggcgtcggcaggcacggtgttgacgcccttggtgccgtggctgagcatggagagggccttgaggtcagtgaggctcagttgcggtgacacaaccccattcttaaggagtggtaccgatctgaatcccctgaactcatctcaccggtgtgtggctactgtgggcaaccggcgaagaggggccttcggtggacttgatggccgacgagctgctctaggagatcctgatacgcctgctgccccgcagcatcatcagtatttaagctaatctacaccatcgccgagatctagaggcccgcggcggctcgtctccgtcgccaacatgcgccgcccgtcggctgtattgctgcatcctgccttctaccattttcaaaaaaaaaaattgcaatttggtcctcggcgccaatgtcgttagcgccgtcccccttcacatttctaaattaactttcatcggggggctagggggacggcgccaacgtcattggcgccgtcatattggaccacggcgccaaagacattggcgccacgaaaaggatcattctagaataaggttttttaagggtctatttgtaggataagtttttcaaaaggattaaaatgtgaaaaatccagccttgcatgacacgctcacagtgttcatggaagttgactcaaattatcatggggtgcgcaatatctcagcaccccaaagcaccatagcccttgcacactctagaagcaattgatatctatacttctatatctacggcctgtttggcacagctccagctccacccctcctggagttggagctcagccaaacagtttcagcttcaccaaaagtatgagtggagctggatggagctctctcacaaaatgaactagagttgtggagctgagtttaggcagctccacaactctactccagactcaacttctgaaactaaatttaggagttggagctgtaccaaacaggcccctatactagtataaaaaggaggagttttaccctccaatcctacagccaaatcacacagataacgcggtatccggcatctccatcatgttcaatccatcgctaatcctcgccgcgttccccgcctccgccctcgcacccaaatcccacggcattcaatccatcgcgcaatctcgccgccgcgacaaatcctcaaaaccgctgcgctcaccccgccaccgcgcatccatccatccatcgccatgtcgcgcatcctccccatccctcaccggtgagagagaggaagaatgtacacgccctctctcccgcatctcgcggtcagcctcgcgctcaccacctgcccttgattgccatgccagtccgggctccagcgccacggccggcttctgtcaccagatccgcctcgcctaaagcagccgacgcctgattctctcttgtgcaacttccatgcttgtatggatccaggcaggctttcagccgccagcggcggccgctggatgtggcttatcatctctgccctcgctgctggatcgaggatgccgctcaccaccatagccgttcaagcaggggaagctggtcacttctgtggtagcaccggtaatcatcgtggtaaagtatatgcacgattggtagattgattgatcaatcagaagatacgctcgcttggtctgatggtcttgttcagtgttcactgttggctgagatagattgattggttgttttctcgggaatttgcaacagaggggaattttcatgaagctcatccataggtggacgatggacagcaatgccacggaaggcgaaagagcacgccgcgacaagaaagctcatgaaccagcagatggacccttttaatcagacattgctttcttttatcaggttttacagcttgcttacacacatacagtgcttgctttaacaagtagtatatgtttatcgtgtttaacctacagctttacaagtccaggtgttagattagttgattcgaaggtaatcatttagtttctcagggatggtaatttgaagattgtaaaaccttctatatttaggcctattatatcagagttaataaaatgggactggaagagggatttgtgttctaatatgaatgtcgacaagaaggcaaaacttttggaaaggaataatgagtagaaagaagagcaacatctggtatgaaagatttctgtaacatacacctaatttatatgaaaccaacctgaaacaacaaattgtgcttatcaaattgataagagtacttgcattagcctatggcttgtgttttttttttttggctatgaaaagctttggtatacattatattatttgtattcttccacggtttcagcttattttggtaccatatttgaaggatggattaattcccccgagcaccccaattgatgttgcacaacataagcaccagctgttaaactatgtcacgtaaatggagatcttggcctcactgtctgcttgagtacccctacaggtgaatcctctttcaatattatataatctatcaacaagttcaagtgaatgattgagctattagaggatggcacatatctagccttgagcttaatcgatatcgtgaggcaaaggggttcatacaagtatacactagaggttcagtcgatatgatctttatatatgcccggtgggtcaatatgttctgctaggggccgccgttgacgcgtggaccgaaaaggagttttcgggtttcaaccgagtgtacatgaacctacagggtcgcacgcttaatgggccggaataaggggtttggatggagatccaatatgagcttaattcggatagggatctgaataggattcctacgggccttggaggcccgagtgatggatcctatatattcgtgaggggtgcgaccggcggaggcattgcatcacgtaagaaaccctagccgtcacttccctccccgagcaaaaccctagccgcgggcgggtgctagcacatctgcgcgtggtgttccgtccctgtacgtgtggataccggtagaggcgccgctagtttgcggtgctgatcggcgtgggagtacggcgagaagaacgcacgaggaggagaaggtcgagccggtgcgatcgactactttctctacatcgccgcgcgctacttcgcaagaattccttcgacttattagcgcctttttccgttgcgcagcgcgtcgagtggtaatgatctatgatctaatacttgcatggttcctggtttacgcgatagaaaattttgatttatgctgtcgtagcctacgcgtatcccaacagcttgtgctctactttggcacctaccgtcctgggatcccttcgccggggtgttatctggtgctcaacacctgggccaactcggtcgccatcatcccgcctctgcacaccacctgcgttaccagcatgtcgcactgcggcattgggaccggggtcaccatcctacgccacaacgactactacgactacgtcctcgtcgagctcttctcacatcaggacacccgaacccatctcgcctccaataaggtcactctcttcttgtggtggtctcctagctctggcccgcggtcagtggatacagaaagaggtgctactccccatccctgcttccaatcaagaaaaggacgacgtgacatggccacccacctactccttccgtgcagacatggtgtttgctgttttgactacctcgctttgctgggttgatcttaggacagggatcttggtctgcgatcacattgacaagctcagcaccggcactgacgacgatgatgatcacctgcttttgttcttcatctcattgcctgaggaatgcgtcatgaagcctagccttctatcttggaagaggttggcagaagagcaccgcaccatgatctgtagggacccggagaccatcctgttcatctccatggacaactacatccaaggcctccccattggcgatacagtgctcacgacatggactctcaagttcccactcacgaaccattggacttgggagaagcactctgctccatccttgttcgtgggagaccttctaaatgaccttccagtcttgaaattaaagaatccaaggatgataggaaggcgctgcacattgccaactgcccggtcagtagcattgacagtcaaaaccatcttatcactagcctcactattaccgagtatgagaggaagcatgagcaagggcattggggagtcacgggattctgtacgagatcagcattgacatggatggtagaacggtcttggagtggtcttctcttgaaagtcgccactcaaagatatttgcagctgagtttaactgctgcttacaacaggtacactactccctcttttgtccatttaaagtgtatataattttgatacggcaaactcttggaaagttaatttaaagggtgaactccatttcatcgtcacatctgcggtttgctcctttcccatttttccccttctttttttagattgccctaacttccttctcttttgtgaactttgtttcttcgaaacaatggaatgggaaagtttgcagcggagttggtcatcaacatttaagtcgttgagcgacgaagaagtggttgatgaggatgatgaaaattggaagtgggtgttcccggatgaagtgggtaatgagtgacttgtttaagcattttacaaaactagtaatgtgcccgtgctaacgctacggcggtattttataatgcaagtgttgtatattcacattgttggaaaatgctattgacaattcttagtacaaaatgtaatagcaatgaaccgatgttataatcgattgatgcatatccttgttgcgttgttccgacccaccatttcaatctcaaaagattattgacataatcataaaaaaacaaatttccccaattgtacactggcaagaaacctaggaagacagtgtcaagcacatatatagtcgaagacactggcaagatccctgtggttgaagcacataaacaggtatgcagcctagctaaggaagaaggaacgtttgagaagtgggagtagctactacataagtgggatcgagctgcatagatctcagctacttcttgttggcttcttccccaaccatgcaaagaattgtatatagagccaccatacgcgctgcaacatggccaactgataatataggatttagtacagctaggcaattgaagagactgagcacatacactttggctgttttaaataaaacattttcttttgtattgtctctgcaagtgctcaatcagaaaaggttaatcagaattgtcaccaggtgacaatctcacaaaccaagtaggcagtttctttttt

SEQ ID NO: 66185 - DNA, 2519 bp, Oryza sativa
aggcttgcgggggaaggaggaggaggcggtttgggcggcggcgcagttttttatggttttcccgcgcgggcgagggggagagcgcggaggcaggcgatggtggtgggttgggtttgggtcgtggatggctgcgggctgaggcgggttcgaggcccgaggcggcggacgtgggggcgggcccaaggtgaggtgagcccggtgcaccgtgcgcccgcgccgtcgtttcgctttgagattcgtgcggtgtcttggttccggtgtatagggtgggtctagagtaactgggactttgttcgtgtccgttatcggggatcggaatggttgtgcctaggctgggttcgtgcttcgtttgttggcgtgttgctacagtgcttttgctgtgacagggagagaccgggagggttgtgcatcgtgcatttgtgcattcagggggtgtttaggctgtatttagatctagcgttgaaaagtttatgcgtgtctcaggatgtacggacacacatttcaagtattaaacatatattaataataaaacaaattacagatttcacatgtaaattgcgagacgaatttattaagcctgattaattcatcattagcaaatgtttactgtagcactacattgttaaatcatgaagcaattaggcttaaaagatccgtctcgcaatttacacacaatatgtgtaattattttttattttgtctatatctaatactccatgtatatgtccaaacattcgatgtgacaggatgaaaagtttttgcgtaggaactaaacaggtagattcaggggtgtaaagttttggcttgtcgcatcggatattatatagggtgtcgtatggggtgtttggacactgataaaaaactaattacaaaatccgtcagtaaaccacgagacgaatttattaagcctaattaatctgtcattagcaaatgtttaatgtagcaccacattgtcaaattatggagcaattaggcttaaaatattcatggagcaaatgtttactttaccattcccatattttccctatgaaatgtccaagggatctcattcggaataacattctcagttaattctctttcaatcaatggcaagttctgtaccgatacaacaggcactccatttcccattttgatttatttttatctttaccttttttttaacaaacttataaatgtgtgtcttatgataaaaaccggagatgtaattcatttctattataaaaaaaaagatacaacagggcacttgctgcagaaagcgcatccgatgggaatagacgagtgatcaaaaggatcttacaatcacaattattttccaaagagtacatttgaatagataaatactataaatacaacagatgaacagcctgcacaggtaattcatcatctataagtgcagaaaacaatgctctttaatcctgacagagttcagctgctaagaaaggaaaagaacagtgcggcagcaacaagagtgttctactggttttcagaagcaaaattccaaaccaggtccaagacgagcaaaagaatggtgcaacaacacatttctactcaaactcacaaagcgaaaacacaagccgcggagaaaagtagtgcagccaccagtctccatgtacctgcaccgatcgaaactgcagcattggcacccatgcaatcgtcgttgttgccactgaagcatcctggacggacagacttgggcactccaccatctaccttgaagctggtggttggcttcccgctgctgaacaagacacaccagaagtacggcccgccgccagaagtgccactgacagctgctcccacctccgtgtggttcttgctgtgcagtacctgaatgctcttcgcatcattaaccaggaagttgaacgcctggtctggggtcgcatagttagactggcaagccagaagcctcccggtgatcttggtgagtgttgcagcttggacgccacaatttggggcaaatgtttcagcgaagctggtctccggaggcttcttgctttcaccgacttggttgcactgaccctcgtatgctttaatgtactgcagagcaatgcatcctaggccttggttatcatcaagagtagatgccttgctggcagtgcggttgctgttgatcaatgccacaagctggtcggcagggttatctggaaaggagatcagttaagaggtggaattggtacacaaatgcattaggctgtgattgggtggccatttgattacaagcaaaaaatcacaacactggaaccaacaaatgcatgctaacttaaaattttaaactcttattaataagcctacagtaaatgtggagggaagtacagcaaatttccatcagcaatgatcagtagtccagacatttttcaatggagaaagcagcaaccaatgtgaaagttgagcatgctagtatcaaacttaatgtggttacttttgggaattttgtttattaaagatgttattataccagcattcattattagcaaccggggtgtgaattgagtaatagtgttttacaattaactggtgtt

SEQ ID NO: 66186 - DNA, 671 bp, Oryza sativa
ggccaattgccccaaatggcgcagagtccacccttgaccctcacccccaattcccccaaagatcccaattcggggttaagttaaggtaccagcaggccccagacccagatccaaccgccacagcgcgctaaaacggcaaagccccattcccgaatcggagcatgcgcgggcagagcgctcggaaatgcagcgacaagagcagcagaattcagtaaatttacagagattactctagagagagaaagtcagagagacggtacttttgctgtcggcggccgaggcggcggagaggaggagcgccgccagcacggcggccagcagcggccgcgcggggatcgtcgtcgtcgccgccattgtcgccgcgtgccggatccgatgaagctgggtgggcgtgcgtgtcggcgagaggagaggaaggatttggagcttgggtgaggtgagctcagagctctcagcttgtgatctctcccggtcgatctgctgcgagctcgctttctttaaagcctttttctctctctctctcgtgctcgctagtgagtgtgtgcggcttccgttccgtgtgacggtgtgaggcgtcgttgccgttggcgtggatgagtgtatttccaataatacccccgccgactattttcagttagaaggcagccttcaatttcctcaagcagaaagaa

SEQ ID NO: 66187 - DNA, 7012 bp, Oryza sativa
gacgacgcggatgcatatgcatatgatgcatatgcattgcacacagatgatctattgtactagcaactatacttcatgttttccacatgaacctacataaaataatttgagaactttattactctctctgtctaaaaaaatataaaaagttttagttagatgtgacacattgtatatactgtctgtacatattcattgtattaagatgtgttctatacaactaaaacttcttatatttgatctaaaaaaacttcttatatttgggatggatggaacttcttatattttaggacgaatagagtagtaaggtgcgcatatacataaattaatacacattgcatgtgtgatcgatatagatggagctagcttgttaagtcaatttttcaaaaaaaggaaaacgaaaaaacttgttaagtcaatcatcatatcaatatgcgtagacgaccgcaaattaaaaggctggtcgtctttctaggtcgtcaagatcgatcgatcgatcgatcgccgacttaattgtcaaacgaagacaagtggccatcgaattaataatcagttgacaaaacgaaaagagctagcgctagctaagcattatggggcgtgaaatttacaaagctataagcatgcttcaaattcattattcgccgtcaagtacaaatgaaaaacaagaaaagtcaactttcttatatcaaatatcgatcatatgatcaatatagctttatggaaaaaaaacagcttgcaccgattgacatatatatatatatatatatatatatatatatatatatatatatatatatatatatggtgacattagcttataccacgaatctggacagacgtatatccagattttttgtatttgatagtgtaacattctatccgatgttattttattttaagacatactccctccgtcccataatataacaatctagtaccggatatgacacttcatagtacaatgaatctggacatgttttctatccagatttgttgtaccatgaagtgtcccatccggtcttaggtttctatattatgggatggagggagtagatatcttgtcaacacaaaaacgtcttcgcttcttagattccggcgtatcagatggtttcaagcttcttactatctttgatgatagcctatctcgattgtttctttcggcacacttattacttctttgtcttaaacggccactattttaatttctataacaactagatcattttgaaaattagaaattctgttaagttattttcaaaaacatagtattttcttggtgattatgtttcttggctcgtgaaatattcacgtatacttggtgccaaggtgaccacatatgtttcatcgatccgatgaacataactaggggtgggcgttcaggcagactgaaaaatccagtctcggtcttcggtttttcggttagttcggtttttgtaaactcaggaccgaatttcatctaaaaaatctcagaaccgataaattcggtctcggtctcggtctgaccaattttttccacatccgctggagagtggagatggggcgacgccgaggtggaggtggcgccagcgctggaggtggaggtggcacggaggcggcggcctgcaagaggcagaggagcagctgcgggaggcggaggagcggctacatgagctccaccgtcaccgtcggcgtaaccagcacgagggaggaggggatggggatgggaagggcccggtggtcagtggatggagaggaggatgctggtggtggtgggttggataaggttttgcttttgctgaggaggtattgggcctaatgggctaatgctgtatttcggttttcggtcaattcggttaaccgagccctaaaactgaattgaccgaacgaaatttggtgagtagaaagtgctgaccgaatttttcggtctcggtcatttcgtttcggtttttttgttcggtctttttctgcccacccctaaacataaccacacgcacacatatgtgttgataatactatatgtggaatggaaggtacaaagtgttctggggttttttattttttggatttcaggctgttattgtaggaaggggctaattacaaaattaccaccacgctgagatgcggaggggactaagtgcaaaagtgatgtctatatggagtgccacattggcggtcatccccggtgaaacaaggtttggattagcttggtttattataacaaaatgatggatttagatgtgcaattttcaaatttatagatctaaaagtgacacttctctcgaatttagaacgaccatgtgttttactcattaatttaactaggtgattccccgcgttttgctgcagaaattagtaagtaactttttttttaataattgagctaaaagtaaaacaacaaataaaactggtttatcaaaatatgttaagagagaaataaattaagtagacaatgtatgaacttgtagatgaaatatgatatcccgtactttgattatatggatgaatatatgttaagtattataaaaatgatatatatatatatatatatgtgtgtgtgtgtgtgtgtgttataaaaatattgtgaaaaataatgtgaaggaatataattggatgttgatttgtagaatttaatgaattatagatgatgttacatgcttgcataagttttatatgtaattattgctagtggatgatgagttggcatgtttatatggtaagctttagaactagtggattataactgtatagtaagataggattttcacctctataacgggctcgcccaattaaggagaggagttattggacatcgatcctacgatcgagttgacaacagcgttgactttgtccaacaatcagaagcaaattaaagtctcggtcgccgttgacctaaacatatccatcctgcacgcatggctccagtggtccaggaccgttttccgttctgagcttagctgtaacccctgactaatcatccgagattgatttagacaaccattctccatccgtttcgattcaagcgtggataatgtcaactgatccgtacgtccgatcggtcgatcagctagctatagctgttaccgcacgtgccaacgaagataaaagtaactaatcttcttgttcttgtgtcttggtcgtcgtcgtcgtcgtcttcgttttactactctgctaattaaccagaggtttgactggataattaggttgctactactactagtagtacctgcttgctgctgatccgttactgctccaccaactttgacttcatctcgattgtcaactttgattcccgggtcaaactcggccgtcttgttcgatctgccggtcaagttcatcgatcgttcagtttttcttcatttgcttccggataacattggtgattttcttcttcttttttttcactttaacttggatcgatctacatcgtcgtgatttaatttgcaaacttatatgatgccgatcatatacaatctgttattttagggcgaagccaagtggccaatacacccagtatatatacgtagtactaatcaatgtttttgtatgccgtagtgttgtgtatgtgatttggattttgaacttttatttacgcgtttcttaatttacattctatttatattatttatttacatttcaaattatcagtcaatctatcaatttcaagtatctggaatatatcagatcataggcgctgtcactgttctacttgcaaaaagaaaggaggagaatggaggaagtgatgtctccatttcgtgacacgtgcgttcacactagctgtcaagctggagtatatggtaacatgttgccaatgccccaccgtcgtcgtctcgttgatccttaattcctcctcgcatgagacttttcgcacgtcggccatgacaaaatgatttgctttggtttgttaaattgatgcatatttttaaatttgcatatatagatcgaagaccaggtggacgaaatagtcccgaacatgagatcattggaagatcatatttatactattccaactaacaactccgttgattaatcttccgtactatcttggtgctcaagcaatatggacacatttagtggccggcacaattagttatgtttaaccaacaaccagtaccttgcaggggacccaataatgtcactcttaagttaattattactatactaatagattattagtgtactacattgccttagcaaacatgaaacaactactactgtacttttccgaattattaagaagtagtaacaatacttgtccgaattaataaacaaattaagtagtggagtagtacttgttaatcaaggggaagggcatgcacgtgctggtggctactggctagctcgtgtaaaacgtggagtatgtaggtgcctttggaagcttaagatgccacttaagattaaaatttttatgtggtacttgcttaaaggggttgtgttaactaaagataacttggcaaggcgtaattggaatggtagcttgaggtgttcgttttgtttgaagaatgagtctattcaacatctctttttcgattgtcatttggcgaagtttctgtggagagcagttcagttttcttttggatttaatcttccagttagtgtatctcatatttttgatgggtggcttttgggagttgataagaaaatgagtaaactgatacttgttggagcttctgccatttgttgggcaatatggctgggtaggaacaatatagtttttaacaaatcaccatcattttcctatatgcaggtcattttcagagtaacccattggcttcggttttgggcacaactacaaatgtgtgaagatgatgaagagtttctgaaagttgcatgtcggaagctggagactacggttatgtaactttttgccaattatgggtggagatttacaaatagatttcaataattgtaatctcctttgttagactggattctttattgttgcttgctgtgtgttttattcaattagatctacactatgttcgtcaatcgcttctatgtaataattggctgtagctcttttgagtaaagtccgaaatatttatttattccattatctacaaaaaatgtaggtgccttcttttggagcacgtggatcagatgcagcttcttgtactagtgatacgatacatcacatcagcatttgatccgattcagtgactcacagaggctccacgtggttgttggattgctttgattttgaaacagtttcgactgtttttgtggctagggagtagtctggtcgagatgcagcttattgtcttcacattcgtgcttctttgccgtgggaaaatacaaacagtgtagttcgacatcatacgtaaaggtatgttgaaacatagggatggtttggttagagcttcaaatcaaacatggattgagttgtagagcaactccaccctttcatcgttttttttcagcaaattaacatgctccgttttcaaatactccatatgtttcaaaatataagtgattttagatgtatgtgacatatcatattactgtctagattcgtagtaacagaatgtgtgacattccttcaaaatttcttatactatgggacataagaagtaattgataatctagtttagatttggttcgatcaggcaatttcatagaaaaaaactaacaatgtaaaaatgtatggaccattatgaacaacggagcaaacacaatggtttcgtctcgatgatcacaaacacaattaacaaaacaattgctcttaggcccaattgtttttctcaactccaaacttcaactttctcattttccattagcatatttttaaaattgttaaatggtactctttagcaaaaagtttctatgtggaagttgttttttttaaaataaataatctatttttcagtttttataatatagttaatacttaattaatctaataagttttctcgtttcgcgtgcactgaaaatatccctccaaccggagagaacgaacagggccttagcaaaaatatctatcctcaaaaaaaataaaatctaattcctccatcttaaaatatagcaacttaaaacttaatgagacacaacaaattagtaggatatatagtcctaatttctttgttatcctaatttgttaactgactgctccgttacgagtggacttgaggcccatatctcttttatggaccagaaccttggggcccggctcatcacctggcgcgacatgggcctgatcagactcgcgatgcccatcacgcagccacaccgtcatgccgacatgggcttcatcgaggcccattagaaagcgaagccgaagaagcccacgccccgtcgcctcgcctccacacctcccccttcctttcttccccgacacacctcgtcccgtctcttctgccgccaacgcgcgccccgcaccaccgccaccacggcgagcggccgcgcgccgccgatccgaaggccgcgaaccgaaaccctagcgcctccggcgtggcgcgccgcggcaatggaggtggagcacctctcaccgtcgcgatggcgcggatcagccgcctccgccgctgtccccgatgtcgcgcgcgcgcgcgctctgctcccgcatggagggaggttcgaggcatccccttccgcttccgttgtttttattatcagattcccagttccctacctcgctctctcctcgatttcgtttcggttgcccactgcgcagcggcgagtttggtgttttcgatggggggatttgtgcgggtttggggctgcgaattcggtcattcggtgcggcctctgctaatatagcgcctgctgctttaggccccgaataggggttgatctgggctcacgaaacgtggccaccttcgctgtgatcatttgtttcgacaatttctcttgcaaggcgcgcagattgttttacgcgagttgggaaatttgtggagggaaccgatttgtgggatcaatttcctggctataatcctcagcattacgttctattggctactagattctacgattttcgaattgtgttttcgagcaaaatcaagtctgatggttaactggacagaaattcgcatttaacggattg

SEQ ID NO: 66188 - DNA, 2016 bp, Oryza sativa
cacattaatcggagaaaaagaaaagaagagtccaaatagaaatacaatcaaaaatagctgaaattcggaattaaaaatatgcaatattgaaagaggagtccatataggaacccaatacgtgattaattaaagttcggaataaaaataaaataaatttcgaaattagaaaaaggaaaacgaggagttcgagtaggaatacaatttaaaaataactgaaattcggaattaaaaataagaaatattaaaataagagtccatataagaatccaatacaagattaattaaaattcgaatgaaaaatttaaaaaatcaaaaattagaaaaaaaacgaaaaaaagagttcaagaaggaatacaatttaaaattaacttaaattcgaaattaaatataagcagtgttgaaaataatagtgcatataacaacctaatagtagattaattaaaattcgaaagaaaaaacaaaataaaatccgaaattaggcaaattaaaaagagagttaaagtagaaatacaattttgaaacaactgaaattgaaaataaaaaataaaaatatcaaaagaacacaatacgaaaaataaaataaattctaaaattaaaaaaagaaaaatacttggaataccatttataaataactaaaattggtgataaaaaatcaaaactattgaaagaaaataccatctaaaacacatggcgagattaattaagtaacatgcctataaagaagtagagtggtggcggttgatacgacatataaaaactgttaataaaacaccaaatagaatcctaataacgattgaaatgaaggacgacaggtaggccgtgaatcaatcgatcaaggcggtgccgggacttttaaaaagtaaaaaaaaaccaatgctaatcatattcgatttttaaaatctcaatgataataaaaaggagaagcagcgggcgggatgtataggaaagccgccgacggttggcgagacttttaaaaaataaaaaatgaattccaacgatagttatgttcgatttttagaatcccaatgacaataaagagtaggcggcggatgagccatagaggagtatagtgacatcgtttaatggaacttctaaaaattataaaaaatgaaaacaacaagactataaactctaaaaactatgaggtccaatttttaaaggtttggaacttctaaaaagtaaaaaaaacacaatgatagtcatgttcaattttaaaatctcaatgacgataaagaagggaggcagcgggcgtaccataaaggaaaacaatggcaaagccgctgacagttttggcgggacttctagaaaataaaaaatgaattccaacgatagttatgttcgatttttagaatcccaatgacaataaagagtaggcggcggatgagccgtagaggagtatagtgacatcgtttaacaggaattctaaaaattataaaaatgaaaccaacaagactataaactctaaaaactacgaggtccagtttttaaaggtttggaacttctaaaaagtaaaaaaaaaacacaatgataatcatgttcaattttaaaatctcaatgacgataaagaagggaggcagtgggtgtgccataaaggaaaacaatggcaaagccgctgacggtttagtgggactttagaaagtaaaaaatgaacccaaacgataattatgttcgatttttaaagtcccaatgacaatatagagaaaagacagttgacggcctgtagaggagtataataacagcgtttgacgggacttctagaaattataaaaactataagatctgatttttaaaggtttaaaggagaatgaatagaaataatggtagatcaagcaagcaaataaagaaggatatgacagaagtaaggggtaatagctggtttgacttttaaaaactatataattagaaatacggggatgataagatgtggtctttcaaagtcttaagacgacgagatagctatttaataaaatttaagtaaaatcatcctaaaaaatatatgattttatttaggtgcta

SEQ ID NO: 66189 - DNA, 1159 bp, Oryza sativa
caattctgactttagccaaaacgaggagaaacaatactgataaaggcaacattgaaaaggtagaaaataggagtaacaaagctcacatttctatccacctttagtcgttttgctgattcattaacagaataatactccatatttccatctgaatttggtttggttgatgatataattgaagggaacatcactttatccctctccgcagcattttcaatcgcaactatgcagcatgtctcagagggtccatggggggggaaaaccaccttcacagggcaatgacttctgctcagacggccttggtttcatccatccccaagggtttaaacatgaggcttccatattcaggctgttgcatttagaaacattggagtttgacaggaacaacctgctccctttcttctcagttacttcaagtgatgagaaggggctgtctgaattcaattcagcacatttgttactttttaaactatcatgttggagcgtttggtctgtagcctttgcaataatctgcatggttatggattaacaacaacagcagcattgcccacctggtacaagcaaggaacccatgttgaattaaacataattatttgatctacactgaagtaaacagcagagcatgacagacatcatatgcatgtccagcagtttcgtgttaaaggaagcacatatatggacatcgtgcttaataacaaggatttaaatcttctccaatagaggataaatacttgctctcaagcatatgtacctcgcaatttattaaacttgttaggttcgcacagataggttgccacgcaatactacaagaatgtcttattactagctccttaaattatcacaggtaataactatattgaggaaggaatgacatcaggcctgaattggagggctttaggagagaaaccctagggtggggtgatatttaaaacagagaaactacttcactgatttgcttgattcacaatgataactggctcatgtagtggaaatggcatctaaaggacacaagatttgaaagaaattccaaaagataagaactagatacaggtagcaagttggatacaacttatattgcttatcatattttcttcccacatcatagccggccatgatcctgtctgcctgagtctttccctagtccctactccctacacaa

SEQ ID NO: 66190 - DNA, 2327 bp, Oryza sativa
ttttgatgggttatcataaatatacggtgtcttttaatgggttgtctgtgatatattgttttgtatcgtgtttatccagaattttccaagaagttaaaaaaatagcatttccattccattttcaaataattcagaatctaaataaagcagtcgatacaaaactgcaatgtagcagataccattagaaaacttcaagccatttcaccgctaccagaaagtcaataaaactaagtgtatcattagtcttttaagatatttcattgaattgaataacttaaattaccttgccctggttccctcaatcgtcggtgcgatctcacttgtaatgatctgcggtttgtatttaatttgattaattaagtgcactttatgatgtgacgtaccgacgtgtcttcaccgaacgttcaatgacgctactagctttatatatgtacgttcttattaaaaaaaaaagagagatgatggtatcacacagctagtcgcataatatggtaagtgagattttcatgaggcatttttactcttcgtttacacattcaagaggggttatgaatttacagactttattacccatgttatctgcatggagccgtaacccgtaagtacttgtgcagattaaaattaaataagcgaaaggaagtattcttttctggggtaagtttgcatcaactagtcaaatctgttattctccacctgtagtagcaatttgatgccttttgtaatctatttgccgttacctatgaggctgtgaaattaagcacactgaaatttaaaaaaggaccaaatggtaggtgcatgccatgtgcaggttcttaaattaagaacgcaaacactgcaaaatcaaacgacgcctatatctgccgtgattttgcaataacaagcttagcacatctgcacatcacatggcagcaataatgtgttctttttgtcatgtctacggttttacggactgctatatccgaacatacgcgggcctccgacgaggatttaatttgtccgtgatgattgacaaattgataacctaaccaatgtcaccgacgacagtggtaataaactaggagtactacctgacccgtgcatgctaatggagtattatcagtttgtcagtacagtatgagggggcagcgctagtgagacaattaaatgaccaacgaacggacgctgtcatgtcacctctcttaatcttcttcaaaatggaagaatttatagagattttgtcagaatttaattaaattatgtgaaatttctgtaaagttcttacattaaaaaagaaccatggaaaaacaatctattttgccacttattaggcgtttaactatttacgacccatatttaccacccaaggatgacacacacaaaaaatatattgtcataacacatgtgtgcttatttacctacgacatatgagtccaatatcaaatagttaatagccacatttaaaaatggtaaatagttaaatatctccacaccagcactaaaaattaaatcgttaaatgtcacatctaaaagtgataaatagttaaatatctcccggatctgaactgttgatgattaatctgaaccgcctgcccaaaaggcacagaggttcggtagaggtccaaggtgtattcggaatagcatgttcccaacatgcactgtaaacacgaaaaacgaagcggtccattagtgtgtgattaataaagtattagctaatttttttaaaaaaaatggatcaatatgatttttttaaacaactttcgtataaaattttttttgcaaaataacgtaccgtttaacagtctaaaaagtgtgcgtatggaatacgatggagaggtgttccaatcacagccaatatattttgaagagtgacaattataaagggcacatcaggaaatttacctaccgcactgttcgtgccagatgtgatcttagccgcttatacctaatcgaacggtgagcctatcctcctctcccacctccccaaaacctcgacaaatcgtggctccggccgccggcggccgtacccgcctcctcgagaggaaacacccccgacccacatccttcgctgcacagagcatgcagcatctgacgcgccatcccaaccatggccgcaggcgaccagggccatgtccatctccggcggttcaattcttcgagtactaaccatctccttcgggcacggcgactaagggcctgtttggttgctaccctgagcaaataagcctggcctaaggtcatgcctgtaactcgcctggcctctggttgggtgcttaccctgaggattctagcctgataaatcttgcctgagtgtactcgcctgaatcaggcgtacaaaatgggtggcctga

SEQ ID NO: 66191 - DNA, 3576 bp, Oryza sativa
ctgaattgttatgttgtatgctgttttcatctgatcatgcatgtgctgctctgaagattgatcttgaagttagcatttggtacagcaaactgaatttgaatatgcatgcaactgttaaacacagcctaaaacgtgtttacatggatctctactgcattcccataatcaatcactacggttttggttatcattggtactggaactgccagtcaatttcttctatgtaacagtcgtcttagacgaagaatgtgcacagcaataataatatgtttgtgtctatgatgtcctttctattggacttgttcatccatatggattgttagttttgaactgcattcacgacttagcttgcatgccaacttcaggtaacactatgcaacaaatatacgaagtttaaattggaggtttcgtgctttcaaattcaacttatagtttatataattcatttgtatttttccattaaaagtgccaaatcttgaagctctttgtatttatacatccctttaggtatgtagtatatagcagtttgccattttatgcacacattagaacattgcacaggataatgaccttgaaattttttttgtcacttctatatgattttagtgtatgtcaggtagaaacaccttttttgtattatagaccctgtgtatttttgtttatatgctgctaaagcatccccttaacaagtgaaatatcctttcaagtatttttgttcttattgctgatgcatgacttcgcaatgtgtaagctttgtatacaaacacaaccagattgtcagtgtgcattttgttaatttccagcctagtacagatagctgcatacaataaacctaaaactggattggacttctcttgtattcatgtctgccatggtatgtttgtctcagagtaacatgtggcggtatatctgttttgaatataaattaattagcaagatcttgttagattgtaaaattaaattgttttgtttttttggacagaacctggactgttcttcgcgcatgaatttggctagtttgcacatcgacctactgtgtattgtgtgcatccaacttttttatgagtatgtgacgccatgtttcatgtccgcactatctgatttcggactatcttttgtttttccttgtctctttgtatcatcacaagatttgtgcgtgcatgtatccgtctagctagcttttaatttcatcacgagtattgtggccacagctgtagattctatacatgcaaagaaatggatggctcacatgcaaataaagattagcaggcgaacttccatttctttacctgaattgatcaatccatctgtatccgacatgcccacttatctatcaggttatattctcatttgatacatgaatgttcttcttcagtacaatccaggatcttgagagctgcggccaatctattagcccaaacttattttgttctactcaccaacttgtctcggatttctaaaacaagcttgactggagcctcggaaggagacaaagaggcttttattccggcttgtattgctgcagttgggccagaaaatcaagggacatttctggttgactgaagaaagatgccaaggtgagccatcttgttttagctccctctcactaacattatgtatgtgacactgatcaatatactgtctagaattatttgtgcctgtactgttcttttttatgagcctaaagcacacgttaggttgcatgtccgatgctgtggcagcataggaaaatagttgcacatgtgaatgtgagtatcagaaaatttcttctaagcttatccaaggcttcagcagatggtcaatagtattagctgcctattttataagaccaggcttggtgaaatatggtcaccttgtggtgaatttagtcctagcccactgtaaagaagcaaggagcatgcgggatagtggcgtggtgccatggtagggttaggtgaagtgggtgaaacctatcccacaagttcccagatccatgggtcgagaaataggattgaggaacacgggatgctacttattttaggtttaacatgggagggacaatattgttcccgtgttcccgtcagttccatatttcttgtgacgtttgactggatatcggaaggagttttcggacacgaatgaaaaaactaatttcatagttcacttggaaaccgcgagacgaatttattaagcttaattaatctgtcattagcacatgtgggttactgtagcacttatggctaatcatagactaattaggctcaaaagattcgtctcgctatttccgtgcgaactgtgcaattagttttttcatctatatttaatgctttatttgggtgtcgaaagattcgatgtgatgtttttggtaaaaaaattttgcgaactaaaccaggccttagggtgaaacccgcgaacaatccacctaagattaatggtaagctgtgacagtgattttcagaagaaaaaaatcgtctggaaaagccacatgtctgtaagattgtgaaattttctcttcttttgtagtaataccttagtgcggcttgtatctatgatctatctacaccaaatgggagtacatgatgtagctgaaaatttgaaacagtagcttccacatgtgactcgtgacctctcctagctagtagtcctagctactagatgatcgtgcaactcttgtacacaccatatcagggaatgcattttttgctgcaatacatttctttttcaaccaatggcatgcattccttgggtgtatactagactttttttctggcaacctgatttgatgagctgatgcgcagtttgtgcacaatgggcagctgctttctgaaaatgatttgcttgaaagctgacaccgcgaataatgtcgccctgtgcaagtcaacatgactgtagattgctctgcaggtttttgcactgtggaagggagattgaccctcgcttttcagcagcagcatgtgaagttagtgccatttgatggagtcacggtcagatttacatgcccatcacagtacattgagaggtatcactcaaattagtttctttgcttctctggttctgggctctagcacagtggatgcatgttccgttcagtttggtcactttccagttaacccagcagtagactgctgctagatagctgttgtataactgctatcgatcctgtctgctgcttcagagggcagaagctgggccacaggtcatagaatcatggaggaggtcgatggatggactctcagtaagtaagcaggcccttttagaggaattattgcttgacacactaacttgactttgaccacttgtctgtgcagctgtagcaactggtccaattggctaggtcccgtggggcgagctagagcccagcgatcgagatgcaatcgtactgccacattttgctcggcatcttgctatcatgctatgaattgcttagctggtgagtgtccctcccatgcttatatattgcttgtggtccttacctctcggttctagttcagaacgtggtaaaatctccagaattttatatgctaattttttttcctgaattatattttccgatccgattcgagccagtgctattgccatgtgcacattataccatat

SEQ ID NO: 66192 - DNA, 39557 bp, Oryza sativa
  unsure (1)..(39557): unsure at all n locations
ctgatttgcgtcgggcgttctgcagttgcatatgtaactgatcttttcaagcgttggaagtatttttttttagataatggaataaataaatattccggcctttactcaaaagagctacagccaattattacatagaagcgtttgacaaacatagtgtagatctaattgaatagaacacaccgcaaggaacaataaagaatccagtctaacaaaggagattacaattattgaaatctatttgtaaatttccacccataattggcaaaaggttgcataaccatagtctccaacttccgacatgcaacttttagaaactcttcatcatctttacacctttgtagttgtgctcaaaactgaagccaatgggttgctctgaaaatgacctgcatataggaaaatgatggtgatttgtcaaaaactatattgttcctactcagccatattgcccaacaaatggcagaagctccaacaagtatcagtttactcattttcttatcaacttccaaaaaccacccatcaaaaatatgagatacgctaactggaagattaaatccaaaagaaaactgaactgctctccacaaaaacttcgcaacatgacaatcgaaaaagagatgttgaatagacttattcttcaaacaaaacgaacacctcaagctgctattccaattacgtcttgccaagttatccttagttagcacaacccctttaagtaagtaccacataaaaattttaatcttaagtggcatcttaagcttccaaatgcacttattcctgtctatataaccattattaattaaagctaggtacatagacctcaccgagaacaacccattctgatgaaaattccatctaaaagtatcaaacgaatcattcaattgaatatgtactatagaggaacataattcatgccaacaatcaagattctgaccaactaaaactcttctaaaaaaacattaagcgaaacagaacccattacagtagcaatagaagatgttttcctacgagcaattgcgtacaaagatggatacttgtccttaaaagcccagttacgtagccacttatcctcccaaaatctaatttgtttcctattattgacaatccaagaacccatatttaagaaagtacttttaacattcataagaccagaccaaaaataggaatcatcttgtttcttgtcaacttgggttatagacttattataaagatatttcctcttcaataagtcatgccaaaccccttcctcattaattaacttaaacaaccatttacttaaaagacatttattttgtaccttcagattatgaatcccaagacccccctggtccttgggttgacaaacaacatcccacctagtgagcctgtatttttattatgatcatctccttgccaaaagaatcgcgatctataaaaatcaattttatgaagaacccttttcggcacctcaaaaaaagatatcataaacatggctaaacttgaaagaactgaattaatcaacaccaatctacccccaaccgataaatgcttgcctttccaactaagcgttggaagtatatagtactaaaaggcgtgtttcaaccatgagatttattcacaaataatccatcaactgtcataaacggaagtatataatgctttaagtacattgtagtactcatcgttgctgctgctggtgttgcaaaataacgtccacgtcacggtgatggtctttatttgccggtgttcccagctgaatgtccgcggtgaaggtgatgatccttgctggtgtcgtcatcgtcatcatcgtgtcgtcgcaggatccacgacgaggattgtgtgttgcgtgccatcggtgccaccactatcttggcaactcccattcttgcggctgcgggagccggacgtacgacgtccccgcccttcagcgtgacggaaccgaaaatccaacgccagcggcggcggctcccaccgagccgcgttcacgaatcacgccgacgcgggcgaccagccgcccagtttcgcgtacgtgtgagctaacgagcnccgtacgtcccaccacgttattcgatcggggcctcggcctaatgcgtaccagggcggcccaatttgttatggctcataggctcgaagccaccgtttcgccttcctcgtgaaatgtaagcgcaacagggaaagcatgtaagagcatcagggaaatcacgtaagagcatctccgagagattctccgttccaactcttcaagttaaattttggccatccaagagaaaaattgctcaataaaaaactagccatccagtttgctaagccatcctactagctaaaagtgccctcggcctggccaaacttggccatcctatctcgcttgccattcatgagtcccactacttttttttctctatcttctctcattcccaccgaagtgcaatagggaggcggggggcacaggcgttgttggcagcggcatggtagagggggagactccggtggccggcgacagaagcttagggatagtgtcatctctggtgagcagacgaaagcacgtgacacggtgctgtcggcactgctccaggaggatttgggtcccgcaggcgtagtctccgtggcatcggctacggcaacggtggcggccgagcggtgggacttcagctccggccagatcgatggtgcgctcgtcacccctgtcggtgtgagcaagaggtcccacgccacctggccaaggtccaccattctgttcgcctcctgccgatgtcgatgccgttcgcctcccgcatcgctgtcgtccacccaaatttatgccgccatcgtcttcctggatctgtgtcaccgctgtcatctccccgaatccgcgctgctgtcgttgcccccacatcatctatgctatctacgggttgtttctaggggtagacaaaaaactcgaaactcatgagtagctgcctagctcaactcgtgtaaaactcggcttgactcgagtcgagtcgttaatgagtcgagttgagtttgaactttcactcgcttgcttaacgagacaactcgagctagctcgtgagttactcggttagctcattgagctcatgatgcattaagatggaagttaattgttcatgtaggtataaaagtcgtaaactcataattatacattgtagcacaatcttgtgagtcatgatatacatagcatgtcaattataatctttggtcatagaatcacaaattataccgcatgtgaattttaaaccatgtatttcggtgtaacgagtttaatgagtcaactcggactttttaacgagtcaaattgagttccatttttaactcgttatgttaatgagtcgagccaagctagctcgtctacttaacgagtttttacaagtcgagttggcttgttagccacccctagttgtctccacctccaaacccacacttccagctctgctaccctcgcctttgctagctgctgctgctgctcccggccaaggaagtggtggtggtggcggcacggagaaaggggggagcggtggctgtgtggaggggtgaagaagggtaaggaggctgacatatgggacccactatcatagactcatatttgagagtgtagatggagagactgttgaagtgaataatgagtttgacttgccaaatcagatggagagttggctatataaatgtttggagagtcataatttaagtagagcgttgaagatgctctaacggcaagtcgacaaatacaacagccaacgtttcctctattttgattatgttctcctcaataattaacagaagaatttttgttcttaaaaaacaaacacgtacaattaatcctagcccctgcggtatacgaattaaccctatacgggtggcataaatcatggcaaattggcaacccctcacctggtagccaactctaggggattgacccattttcttctcccagtttcactgacatatggacccaccttgacttgtccggtgctgtacctcaacacgtgggcaggtgtcggagatggcctcacatggcgctcgtgggaaggatcgcttcgcatccaaccgttgcttccaaacgagcgacggggataaatccaacacacacgcttcccgttcccttcgtcttcaacattcgttctcctcgctgtcttctcccccctctctccaaaacccaaatcccccaaaccacccgcctcgcctcccccctcgcccaagcaaatcaaacccgaagacgccgagtcgccgacggccatggcgccggcggtgctcgtccccatcgacgaaggcagcgacggggagggcggtagcgccacggacgtcgcagccccctcccccgctcccatggacatcgacggcgacgacgacgggcgcgaccgcggaggagaaggcgatggcgctgcggcgagcgtcccggccgccgacggaagtagcgccgcgctctccctgacgctgggtctccacgtccacggcgacggaggcggcgcggaccgcctcagcgatctccacgaagacatcctcgccaaaattctgggccatctcagggacatccgcaacgtcgccaccaccgccgtcctctccaggcgctggctcgacctctggaccctggtcgacatcatcgtcttgcagtatgacgagccccccgactccagaatcgtgcaggaagttctcgccgcccgcgcgaggaatggttccacggccacggacatccgcctgctcgaggtcacctccctcaacagcgccacgccggacgccacggcctcctggctccgcgtcgccgcgccccgcctcaccggcgagctcttcttccgcaacaggtcctcggttccgtccgaaattctcaacgaggagatggacgtcgtggagcagctggtcgaggagcttggggacttggtggtggacgaatcgggcgccttcgagctgccctgcttcatgagggtcaccaagataacgctgagcctggggtttctcggcctatcgctaccaccatcgggtgtcttcgccaagctcagggagctgcacctggtgcacgtccagttcaatggcgaactcaccatggaagatgccatgctcccgtccttggaatggctagagattcgccattccagtggcttggcctccctgacgctcaggctggcgcctctgacccagatgactctgtacaatgtgcggcggttgcgtcggctcaacgccgtgcttccagggctcgaggtgttgtctgtaacggaatgcttcctcgaggatctggagggtgtgagcattgtggcagaggagctggaggacctgcggtggctagatatgtaacagcctggattggtctacttcaagaggatgccgcgcctgcagatgttgttgccccccgctgtttatccttatggattgcagaacgttttcttcaatcggagctgtcagatgcttctcaatctctgtccaagcattgacggtctcctgctgttcgttgaaatttgtggagattatgggtaccccatacccacacggcatggttatccgactagttataggggataacttatatttttgtaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggtaggaggccctctagggggcatatgagacaacctgatcgtcagatcaatacacactcggcggattcaaatccccaaacaggagtagggtattacctctcattgagagggcctgaacctgtctaaatcctttgtctccgcatccatccacttttaggtctcgtacgctacccccttttattattgccgaaatcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaattttttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgagtggtgcctccgcctacacggctggcctattatgccgccgctgttgggcgtctacgacttcaccaccggcctgcctccgtcgccgccgactggtgtccccgcctatacggtcggttggtcacaccaccgttgatgggcgtcgtcatcttcaccgccggcctgcctccgtcgccgccgactggtgcctccgcctacacggctggcctattatgccgccgctgttgggcgtcttcgctttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttcctttcctctgcctcactacaccaattggtcttccattgagtagtgagtcgggggctacagatgttatatcatatttttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggtcgactcccagtgcttgggggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaggcttatctcttacgctccaggaatggatcagtcagaacatcaccgactggcttgccttcgccgctgccgactggtgtttccgcctgcacggctggcctttatgccgccattgttgggcgtctacgtcttcaccgactggcttgccatcgccgctaccgattggtgcttccgcctgcacggcagacttattatgctgccgttgttgggcgtctacgtcttcaccgaccggccgccgcatccgccgctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgttgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcgacttcatctttattatcttcggcactggcaaactctattgctgctacttcacaagttttactacttcaccaaccacgacgtctttgtgaacctcgacatctcggcatgcaatgccatgatattttactacaacaaatgactctccaatattcaggatttctacttggacaccttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagccaactctgctgccgttgatgggaaacttcgtcatcatagtcggctatctttgttgccgttaatcatcattaccgttggatgcgtttgtcgccgccgattattttcttcatcttcatgattggtggatttcgccatcactgttgatgcgcgtctacgtcttcatcgtcggtttgcttttgtcatcaccgactgttctttcgttgttgttgggcgcctacatcttcactgctagctgacctgactgttgccgactggtttctttgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccacatatgccatatatttccaggtgtggtgaaaccatgtgtcttttagggacttaagcacatctgttaaagcagtgtgcgcatggcgtatgcccaatactttggaaatttctttattcacagcattcaagcttctttatagctattttgctatatcactcatcatattttacaaagcagttggtatatcacccggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactatatttttcagccctccacagtcttcagatttggtaaaagtactcgggagaccatggcgaagatgattgaagcactcggctttggagtaatctagttcgagagaaggttatcttttcgactgtgaaggtctcaggggctactgtggagattatgggtaccccatacccacacggcatggttatccgactagttataggggataacttatatttttgtaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggtaggaggccctctagggggcatatgagacaacctgatcgtcagatcaatacacactcggcggattcaaatccccaaacaggagtagggtattgcctctcattgagagggcctgaacctgtctaaatcctttgtctccgcatccatccacttttaggtctcgtacgctacccccttttattattgccgaaatcatgtttcgacaaaattgaactagtgagtgcctcttcttcctctgtttcagtcaagtaatcaattgtgtattgctcgaactgcaatgtggattatcagatgattatccttcagaatatgcaattttctattgcaaacttgcaattgttaagtttagatcatctaagctcatgagtgtttaggctcaacactcaatgctcgattcagctgcagttttttgttggcctatcttttgcattgttgagagttgaatatcttgaatactagttagaaagttgcagaataggagaacaatcttgaactgaacttcaaatgtatacttgaccttaggaaaataattttatcagcacattttcaagtgatacttgtttctgtacaaaggatcaattgctgcattcatgtttactgagctagcataattgcgagtcatccatgcttgcatttctcgatatgctgcagtttctgagttgtcgttaccaaagagatcgtcattgattatcagttgtttcaccattatgtggttgttgaacatgattacataagcctgcagatacatctaattcacttgcactacaattgaattcagattatattaatttctattacatctggccgaaaagcagcatccaaagttccaaactgaaaatgttgactctgcagcaaattactagatcgttacttgtctgcaagcaaattactgattcttcaactgtatggccttctgtcaaacatttctttgctctttcccagttagttttgcattttgtctgagattacctctgttaacttcctacaaattcataggagcaaggcgacaagcatggcgttaggcctttaatggaaggcattacccaactccctcacattaagatcttgtgcttgaatttactaacacgagggcatgcttatggagctagtgtgttgcatattctgacaatgtgtactggtatagcagtgctgggcctgagaatagaagaagatttccaggtaatcatgtttcctatgaattccgaacaactgcgttttttaattctaatttctatacctgcagtaaattcttaagtgtaattacaaacgctctgttggtttaggcaggaagttactccctcagtcccatatttgactcatcccatttgtgtcccaaaataagttcatttttaagcaaacattgcatcagagtttgcgaaagtgaaaaataattgtataggaagtagataaagcgagaaataattgcattgggattgaataaagtagggatatactagttcttagtgtttgtattggtatgtgtgggatgatagaaaaatgagcttattttgggacataggtagtactactccgtcctataatagatgtcgctttgactttctgcttgcaacttttgaccattcgtcttatttgaaaaattagtgtaaatataaaaaaagataagtcatacttaaatacttttgataataaacaagttaaaaaaataaataataattccataattttttgaataagacgaatgatcaaacgttacaaataaaaactcaaagcgacaagtattttgggacggatgtagtatcaattatgcctatttatgacatagcaaaagctaactcttgatatgaattaatttaatctgggccttttgtttccctattcacatattacttgtcttatcatcatagccctcttggacaatataatttcctactgtccttttaaatgatccagtctgtcagagatgtaatagatccatgaaagttttggtagcactgaaagtcatgcttcattgtgtgaacatattatccagcctatgtgacatgcattaaacctgattagaaaaacaaaatcatgacaggaaaaactgctgtttcaattttcatcattccttttagggtgtgtttagttcctgaaaaaagttgaaagtttgaagaaagttgggagtttagaaaaaaagttggaagtttacgtgtgtaagaaagtttttgatgtgatatgatgtgatggaaagttgggaataggggggaaactaaacacggccttactaggctgtgtttagtttctgaaattggggagaagtttggggaaagttggtagtttggaaaaaaagttgggagtttatgtgtgtaggaaagttttggatgtgatgtgatgtgatggaaagttgggagttggggggaagtttggtgtgaactaaacacaccctaggtgccgaacaatatgaaccttccgcagttactcaacgtgtcagacgatgaatctcattaacaccttgtactttgttctgatcttgtaatttcaggttgaaaatgcttgtccagtgaactgcctctgtgaccggccacgaaactggagagataaggacatttcgatgagatctctcacagaaatagtgatcctcaacttcagagggaagcaacatgagcttgaccttgtgagggtcttagtccaggtagcaccagcccttgaccttgtaagaatgacatgtcaccgttcgttagctgcttttggggtagagttgctacgtgcctatgtacgaagttttgcaagctttaggacttctgtggaagtgagtcaaagtaactgaagcaagaatagctatgcgaccgtagcgaactgaagtataggctactgatctttgaaatacctgacaaattttgatcctgctatgctgtagagaaacagagaaactggctggctgcaacgaacttagttgccacgcgttgttcatttgtcttcataagcaaatttatcatttgttagcaatttggaatgcctttttcgtatgtttgtcagagctgaagtaatgtgtttggcgcacccgctcactgtagcttttacggctttaccggtaatccaccacggatgcactgggtgtacatggcatttctgatttgcgacgggcgttctgcagttgcatatgtaattgatcttctcaagtgttggaagtatatagcgctgaaaggcgtgtttcaaccacgagatttattcacggataatccatcaactgtcatatcggaagtatataatgcttgaagtacattgttgtactcatcgttgctgctgctggtgttgcaataacatccacgccacggtgatggtctttgccggtgttcccagctgaacgtccgcggcggtgatgatccttgctggtgtcgtcgtcgtcatcgtcgcaggatccacgacgaggattattgtgtgttgcgtgccatcggtgccaccactatcttggcaactcccgttcttgcggctgcgggagcgggacgtacgacgtccccgccctccagcgtgacgcagccgaaaatccaacgccagcggcggcggcgtctcccaccgagccgcgttcacgccgacgccgcgccgccgcgggcgaccagccgaccggttttcgcgtccgtaggtgtgggcgtgcgtgatcgatcaagaggcctcgactctatggaaaatgctatatgtactactaccttctcttattgtacgccgttgactttttatccaacgtttgatcattcgtcttattcaaaaaatttatgtaattatcatttattttattgtgacttgattcatcatcaaatgttctttaagcctaacataaatatttttatatttgcataaaaattttgaataaaacgaatggtcaaacgttgataaaaaaatcaacggtgtcatacattaaaatacggagggaataactttttcttactaggtggttatcttttctcttgaagatgaagattaatttttttacgcagaacgaggtggtattaacgtttgatggattgagtttaattattaaaaatttaaaaaataaattaatatgatattttagagcaactttcgtctagaaatttttttgcatgagacacaccctttagtagtttgaaaaacgtgtcaccaaaatcttaatcttcatccaactcttgttgaagaaaagaacgggacctaaatttatacgatagatgaagcatgaaaattctgtgataattctacaattctgcagtaaaaattatcctgtgacatgttgttgatgcaagtttatttgttgcatggttagttactgttttttaaagtacaaattaacatggcttaattctagcccttgaggtatacgaaatggcatagatcatgccaactcctcacctggtagccaactgggatctggaccctttttcttctcccagtttcactgacatatggacctaccttgacttgtccggtgctgtacctgaacacgctggcaaaaggtgtcggagatggcctcacacgatgatcgtgggaaggatcgcttcgcatcccaccgttgctttccaaacgagcgacggggataaagccaacacacacgcttccccttcacttcgtcttcaacattagttctcctcgccgtcttctctccctctctccaaaacccaaatcccccaaaccccgcctcgcctcccccctcgcccaagcaaatcaaacccaaggacgccgagtcgccgacggccatggcgccggcggtgctcgtccccatcgacgaaggcagcgacggggagggcggtagcgccacggacgtcgcagccccctcccccgctcccatggacatcgacggcgacgacgacgggcgcgaccgcagaggagaaggcgacggaggcggcgtggaccgcctcagcgacctctccaacgacaccctcgccaaaattctgggccatctcagggacatccgcaacgtcgccaccaccgccgtcctctccaggcgctggctcgatctctggacccatgtcgacatcatcgtcttgcagtatgacgagccccccgactccagaatcgtgcaggaagtcctcgccgcccacgcgaggaagggttccacggccactcacatccgcctgctcgaggtcacctccctcaacagcgccacggcgggcgccacggcctcctggctccgcgtcgccgagccccgcctcaccggcgagctcttattccgcaacgcgtcctcggttccgttcgaacttctcaacgacgagatggtcgtcgtggagcagctggtcgaggagcttggggtggtggtggacgaaatgggcgccggcttcgagctgccctgctttatgagggtcaccaagataacgctgagcctggggtttctcggcctatcgctgccaccatcgggtgtcttcgccaagctcaaggagctgcacctggtgtacgtccggttcaatggcgagctcaccctggacgatgccatgctcccttcttggaatggctagacattggcaagtcccgtggcttggcctccctgacgctcaggctggcgcctctgacactgatggctctgcacgatatgcggtggttgcgtcggctcaacgccgtgttgccggggctcaaggagttgtctgtgtccgaatgcttccttgagcatcttgatggcgtgagcattgtggcagatgagatggagcagctcaggtggccaggtttctactggcctggattggtctacttcagcaggatgccgcgcctgcggacgttatgcgtctctgtctctgattttgctcatggatcgcgcgaggctttcaatcagggctctcagatgcttctcaatcgctatccaagcattcaccatctcgagctgcgcgttgtgatcaaaacagtgagtgcttctccttcctctgtatattgttcaaattgcaagatgggatatcaatttagctgttgccatggttatgttcaaatcgtctttaatatgtgcacatgtcatttgggttgtaagctcagtactgaatgcgtgatttggctgcagttttttattggaaaatctttttctattgcttagtgttcgccaactgttttgttagttgcagactagcagagcgatcttgaacttgatgtgataatttgttgatgtgctaaagattcagtttagtgttttctgtcttccactccgcatatgctgatgcggtttctgcgttgcctttaccaaagagataagcaattattaccaattagttatcgttaccattatctggttgctgaacatgagcctgcagatatatctaaatttacttgggactgtcattgaattcagacaatattgatttctcttcctgctggctgaaatggaacagacatatggaggatatacaaactaaaattgttgacccaagctagctcttgtacaagcaaattactaaatcattactagtcggaaggcaaactactaattcttcaactgtatggccatttgacaaacattttttgttctttcctattagttttgcattttgtctgagattgcttctgttaacttcctccaaattcgcagggtgttacgcctttgatggtaggcataaccggactcccttacactaagatcttgaccctacatttagttacagagggccattcttatggagctagtgtattgcatattctgacaatgtgtactcgtatagccaagctgaccctgatgatcccaaaatatttcgaggtaattatgttccctatgaattttgaacaactgcatttttcattctaatttctatgcctgtagtgaattcttgagtaagtggaagtgcacatgatttatgaagttatcaattatgccctatttatgacacaacaaaattaaatttaactcttggtataagttaaatgataaataggcccatttgttgtaaaattcacatacttgtcttatcagcatgtccctctttgaccatttctttcctgttgtccttttaaatgatccagtttgtcagcgatgtaaaagacccaagaaagctttggtagaagtggagtaatttctagcactgaatcatgcttaacggtgtgaacatattttccatcctatatggcatggattaaacttgaatagaaaaaatataatcatcattagattaagaacagctgttttcagttttcaccattccttttacttactgaagtgtcgtattcacagttagtcgacgtattagacgattaatacattgtactctgttcttatccttgtaatttcaggtcgaagatgcttgtgcagagatttgcatctgtgattggctaccaaactggagaaacgagaacattttgttggagtgtctcgaagaagtaacgatcctctactacagaggggaggacgatgagcttgaccttctgaagctcttagtcaggggagcaacaggccttaggaggataagaatagcccgctactgttcggttgctgattgggagatagagatgctacgtgctgatctacgtgcgtatgcagaagaggttggaagaagtcagatttccttggaagtgaggcaatgtaacgagtaactgaagagtgaagaccgtagtgagctgatgtgtgcggcgccttcttgctcagacctgaagtaaaagaagagctctgttggctattactgatccttgatgtacctgacaagttttgatcctgctatgctgtactgtaacagataaactggctggctgcgacgaacctagctgccttgcgtggacatttgtcttcataagcaaaagggttatcatctactactaggattttggaatggctttttcagcatgtttgtcagagctgaagtggtgtgttttgcgtaacagctcactttagttttcactggcaatccagcagggatgctctgtgtgtacatagcatttctgatttgctacggcgttctgcagttgcatagtaagtaatccatcttgtccaagtgttggaagtagtatatatataatgctaaaaaggcttattttaaccatgagatttattttccaaataatccatcaactgtcataatggaaatatataatgctttaagtattgtagtcttggtcattataagtaacctagtaattgtcatagcgtccaatgtccatactactcatctttgctgctggtgttgtcatatgatccatggtgatggtctttgccggtgttcccagctgaagatccgtggtgatggtcctttgcttgcgtcgtcatcatcatcgtcatcgtcgtcgcaggatccatgacgaggattgtgtttgcgtgccatcccatcagtgccgccactatcttggcagcgcgcccgtcttgcggcgccgcgggtgaccagggacgacggcttccgcctccgatacgccgcgggaaaatccgtcgccttgaccagcttcttctgcctcggattcggcacgtttcgtggcaatggctttggttttgggggctattgccgcgccggcgcccgggcggccgtgcgcgtgatcgatcgagagatgtcgatccactccacgcgcgtgccgcggtgcacggcgtgaggttggtttccggagcgagacatcgatccgaccgcgttattccatcgggggcctcggcccgatgcgaaccaggccggcccagtttgtcacggctcatctcatcggctcggcgccaccatgtcgccttctcttgtgaagttgtgaggaggagcagcagagcacgcaacggcaactcggcattcggcatttcggaaagcagcgatgttctgttcgaacgtttgctgagagaggcttctacgtagcggggaacgtgtgaggctgctctaaattgcaacatgatcccattcgaaaaattgctccgttttgaaaaagtcgcgtcattacaattgtttagtgatggttatcaataggtatccaatacctactctctcaccagtctaaaaaaaaccctactctctacatcttaaaaaaccaacctaaaaataatgtgatacaatctagtacaacaaatatagatagatacctatccagatctatctagatttattgtatctagattgattttcataggacagggagtatactcaaaccattagtttaaacttatttaagacttatgtgccacattatctcgcctggacggaatgatgtcgaatatatcatatatggtacactataggtacaacctcatacctgtcaggtaataggcttggtacccgtcggtattatctgattattggatctgatgtcgggacggagtgaggagggatgggagaataaggaatagatatggtttaccggtgcaagttctcccatgtggaaacaatgatgcaaagttcaggtggcgccaaatccatcgctagggatcttggggtttcaaatccgccacgaccgagcaacaaggacgactacggtgctactctccatctttcctcggtgcaacaatggtgctgctccgatcctcactcaacacaacagtggcgctctccatcctccctcgtcgtgaccccaagcaagaggaggtgcagcaggacgctccctaatctcctaggtgagaggaagagcaataggcgataggaacagcatgagacgacaaagaaattaaagggaaggaacataaggccgtggagaaaaaagaagagccacaacaggatgcgatgatgtcgaatgatacaaggcatcgtgtgaagcggaggtagacagagtaggcgccatgagaagcggacgacgggttcccgcctagatggtaagaacgggatcccggtagatatcattttatttatttaggttgcgttcgttgtaatgagttctgggggattgggtgagaaaaggatatcgtattccgcgcgcacgcttcccaaactactaaacggcgtattttttacaaaaattttctataggaaagttgctttaaaaatcatattaatctattttttaaatttaaaatagttaatactaaattaatcatgcgctaatagctcacctcattttacgcatcttcccaatcttgtcaatcccctctcctcaaactcacccttaatatctgagctacaatcagtaacattattttttgtcaacatgatcatttgctctcccgagctatatctctcttcccttctcgtagtacgcttcctgtaatctctcgctggcatgtggacccaccctgacttgtccatgctggacctgaacacgtggcagtatcggcgattggccgcccgattgcctcagacacatcgcgatcccgccgttgcttccacacgagccggtggaataaaaagcgaaggccacggctctctcccccctcccttctccttagctcgtcttcaaatttatcctcctctgcagctctgctctcgccgtcttcttcttcgtcttcgtcttcctcctctctccaaaccccccaacccaaacccacctccccaagcaaagaaaaaaaccgcctcgaaggccatggtggtgatcgtccccatcaatggcgacggcgacggggagggcggtagcggcacgttcgtcgccgacaaccccccggaccctgcccccgctcccatggacatcgacgacgacggcgacgggcgcgaccgcggcggacaaggcgatagccccgcgacgcaggatctcctcagcaagttgaacggcagcggcggagaaggcgacagccccgcgacgcaggatctcctcagcaagttgaacggcagcggcggagaaggcgatagcgctgcggctgcgcgcgtccccggcggcgaaggcgatagcgccccgctctccctggcgctgggtctccacctccacgtccacggcgacggaggcggccgagacggagtggaccgcatcagcaatctccccaacgacaccctcgccttcatcctgggccaactcggggacacccgcaacgccgccgtgaccagcgtcctctccaggcgctggatcaacctctggacccaggtcgacatcctcatcttgcgctacgacaagccccccgactccagattcgtgcaggaagctctcgccgcccacgcccacgcgacggagggttccgagaccacggccatccgcctgctcgaggtcatctccctcaacagagccacgccggaggccacggccgcctggctccgcgtcgccgcgccccgcctcaccggcgagctctacttccgcaacaggtcctcggctccgttcgaagctctcgaccttgaggtgttctcgatactgtatgaggctgtcgtggagcaggagatgatctggtcgagtagctggttccagctgccctgcctcacggaggtcaccaagatcacgctgagcctggggttcctcggcctctcgctgccacagtcgggctccttcggcaagctcagggagctgcacctggagcacgtccggttcaatggcgactacaccctcgacgatgccatgctccccctcttggaatatttaggcattcgcaggtccaatggcttggcctccctgacgctcaggctggaatctctgggctggatgggactgtacgatgtggtggggattcgtcggctcgacgccgtggtgcctggactcaaggccttgtgttcggtcggatgcttctgctatcatgatgtggacagcgtcagcattgtcgcggaggagctggaggagatcgagtgggaggatttttactctccacaatcgttcaacttcaacgacttgccgctgctgacgatgatacacacccactgtgttttttgttctgaatcgaacgaggctttcatcgaaggatactatcagcttcttctcaatcgctatccaagaattagccatcttgacctgcgttttgtgattgaactagtgagtgcttcttcttcttcttcttcctctgtttcaatcaagtaatcaactgtgtgttgctcgaactgcaaggtggaacatcatctcattatcaatttagtgttgcaatagttatgtttagatcgtcttttaatccgttgtaagctcaacactgaatgcttgattcggctgccgtttttattgggaaaactagctagaaagttgcagaccagtagaataatcttgatctgaatttttttttttgtttgtttctttgacctttggaaaatattgttatcagcacattctcaactgatactttgtttctctacaaaagatcaattgttgcattcaatttagtttactgagctagcataattgcaaatcatgcttgcattctggatatagtaatgcagtttctgagttgtcgttatcaaagagatcagcattgattaccattcgtttcgccaacatctggttgttggacatggttacatgatcctgcacataaattgagttcagactatattaatttctatttcttctgggcgaaaatgttgactcaagctagctattccgcaagcaaattactaaaacattactagcctgcaagcaaattactgattcttcaactgtatggccttttgtcaaacaatcgttgttctttccttgttagtttttcattttgtccgagattgcctctcttaacttcctacaatttcacagattcgagatgaaaaaagcgttacggattcgatgatagacaatatccaactcccttacattaggatgttgaacctagctttgaaaacagaaggccatgtttatggagctagtgtgttgcatattctcacaaagcgtactactatagcagagctgaggctggtgaaccaagaaaaattcaaggtaattatatttcctatgaattttgaacaacggcattttgattctaatttctttacctgcagtaaattcagttaactcttgaaaatttcttgtcttatcgtcaaatccctctttgaccatttctttcctgttgtcctttaaatgatccactctgtcagcaatgtaatagatccatgaaagttttcgtacaagtgtaatatctaccactgacaatcatgcttcacgatgtgaacatgttttccatcctccaagtctatgaaatgcattaagcttgaatatataggaaaaatataatcataagatagagaactgttcttttcagttttcatcattccttttacttagtagtgtggcacaaagtgaagctttgacagttactgaatgtgttagacgatgaatctcattaatgctttgtactttgttttgatcttgtgatgacagtctgatgatgcatgtaagctggagtgcatctgtgatgggccaccagattggagagaaacggacatttcgatgaggtatctgaggaaagtagagatcctcaacttcagaggggaggaacatgagcttgacctcctgagggtcttagtcagggtagcaccagcactgaggatgatcagaataatctgccaccgttcgtgcgctgcttgggagacactatctgcacatatacgaggttttgcaagagaagcgacttctgtggaagtgagtctgtcagagtaagggaagcaagaatagctctgcaaaccgtagggaactgaagtaagaagagagctctgttggctactgatctagtctgatgtacctgacaaagttttgatcctgctccgctatgctgtaaagaaacaggagaagttttagctgccattgttctttgtcttcgtgaagcaattttagcattctgcattctggaatgcccttttctgtttgtttgtcagagctgaagtgatgtgtttggagcaccgaaaatggagcacacggatgagttgagccgctgaacgtttgtgattttctacggcgttcggtagcagcatgaaattgcttgtgttagtcgctgagaagaaaatcgttgttgtatagagcgtgaaattgcatcagaacatgagcagtcctgctgtatgttgatcatgcataatcctgtgggttttttttgccgtgccaactgccgagttggcctagagcaccacagcccacagcgtggcgggccgcgcggcacaacctcatgttccgtcacggtcgcgacagtatgtggtcgatggcctcgcacggcgcgcgcgtgggattcctcagtttaacatcctgccgttgattccaaaccagcggcttggacaaaagccaacacacaagcttcccgttctcctcgtcttcaacaatcaacactagtcctcctccaccgtcttctccggttctcccctctccccaaaccccgcctcctcacaagaagagaaccaagaaatccaaagaccccccctcacccacggccatggcggttctcgtcccgatcgacggcggcggcgacggagagggagagggaggtagagccacggccgtcgccgaccccgcccccgcccctgctcccatggatatcgacggcgatcgcggcgcgctcgacgtcctcgcccccgcccccatggacctcgacctcgaccgcgaccgcgacgggggcggcgacagagccgcgctcgtcgcctccaccagcaacgggggcgggcggggcggcctcctcagggatctccccgaggacatcctcgccggcactttgggctgcctcagggacaccagcgccgccgccaggaccagcttgctgtcccgccgctggcgccacgtctggaaatgggtgtccggcctcttcttgcatcattacccagccccacgactccagccccgtgcgcgccgccctcgccgccctcgccgtgcacgcggccaccagcatcaaccagctctacgtcacctccctccatccacagcgccacgccggacgccaccgcctcctggctccgcgtcgccgcgcccctcatctccggagagcttctcttctgcaacaggagctcgattccgttccacatgcttttcgacgaggtattcagcgataccatcgaagaaagaggcgcgctcgagctcccctgcttcacgagagccaccaagattcggctgcgcctggggtttctttgcctatcgctcgctgccgccgtcgggcgtcttcgccgcgctcagggagctgcacctggtgttcgtccggttcaatggcggcgaactaaccctggacgataccatgatgccgttcttggaaggggtagagatctggtgttcccgtggcttggcctccctgacgatcaggctgaagcatctcatctcgatgaatctgtacgccgtgcggggggttgtttgggctcaatgccgtggtgccgagactcactcaagtttgatcaatccatcttggagcatatttgatcttctgtacacgcaattaatttaactctgccaaatttcattgctatttagctctgcccaatttcattgtgacataatcatcggtgccacaaattctgtttcaccaatctagcaaatatattatgaaaatcataacgagttgcctagctaatctaaaagatcgaggatacatagtccacattcaagatttattgctgtcatataaattacaatcaaaatatatatgaagctattcgagattcccagaaattataattaagtcactcgaattatgtttggattgtttggttcagctctcttattaaatgttcccatatataagctttgccagcagaatgatcttgggaaaacaactaactgtaaagaacaagtatatttgccctctccgattagttacaagaagaatgtttacatttcagcaaatgactagtcaaatccatgtctatttgtatgcttgatgcaattttttcattacatcattattcttccttacagagctaaatttgtactgagaagcatcctaaaggtgacaagctcatgatcttgtcataggtctcttcatccttggcttaatagatttagcaacaatatattatgattttctcaaggcacattatggttgcatactgaagaaacattagagaaaatccagctcattattatagtgctccttgagatttatctgtatctctgatcttccagcaaaaccaagttaaatttctgatctattctatccaacttgtagctcaaagaaaacgattggaattaatttcatgtaatagagaaaggaattagcaatgcatttaacttgacctcgggggcatatataaaaagaagggatcattttaatttcaatagtatgtgataaaaaatattttgaattgcatatgtattacattccagtgtcttaagaaaaatgcagttttcgagcatcttttctcctaaagataaagataaagttgaaaaattaagtgtgttacgttagtcgagatagtattaacgtatgattaattgagttttaattattacaaacttgaaaaaatagattaatctgatattttagagcaaccttcatatagaaagttttcgcatgaaacacaccgtttagcagtttgaaaaagcgtgccacgaatatgcaaaattttatccattttttgtagtgaaaacgaacggaacctaagtgatgaagtattctgtggtagttacctttcttagggcacatgcgcatatcttaagagataggagtacatagcgcatacttaatacttccttcagcaccatgtgtgggtgtcatgccctactgtagtaattgttgttgtccctaattaaccagatccaatcaactgattatcatacgaaagtatccgaggaatttagttaaaacaaaggtatatatactaattaacctttgctcacaatttatttcagtatcatctgtttttattagctattcaattcttaattagtacggacctaattaatggggggagggaattgaacaaatatttcatataaagcatccaatctgaagaaaatgatggaatttttttttaaaaaaggtctgttcatggactgctatttatgcatttaaaccggttactaggaacttggtgtgccatccaagtgtatatgagcaaaacagcagcagagcttatatactgacttgtaactgttgtaagctaaatcatcaagaaatgataactatatatatatataatatccttcccagaattcttcaagacaatgttagatatcttttacaaaagggtaaattggaaccatgccattgtaattttacaaagagcattggaatttggacagacccatgggttagcaaattaaatatgagaatatatccctttttgtcttcctttcaggacatatgatcaattgcacacataaggtattatatctaacaacggtcaacgagctctagctttgaaaaatacatcagtttcacatttttgacaaatctactatatatgctctcctgattcctaccaaagtgtcaccaaatgaataatcagtgttaacacaagttgcactaccaaattttatttaaaaactctgatcgatctgcttgtggggtatgttgtaatgtagtacgtaaagatatttatactatgtaaattgtgttagtcacatattttaagactagctagcaaagttgtgctattgacacaattaaatgaaaaatatatttaagtcacccatctgattgattaattgaacataattgacacactagtggatggacttatgtgtgacttacacaaatgtggaaagcaaatatgtaatcaactcctagctgagatcaacacaacacaataactgtatgtcatacacacacaactagtatcatcaatttattaatatcacacacacaacaactaatacaaattaatacacagtcaattaactactcaatcgattatatccatatattaattcgcatctcgcttttaattagccggcagctacaagctagtaataatctaactaagttgatataattaaaatcatcggcatataatataaaaagatgagagacacatactggtttaataggaaatttgatctgtggaacatcagtgcaggtactcgagaaaagctccaagatcctactaaaatgcttcgaagaagtgtcgattgatgacgaatatgcacttctggaggcatccggtttccccgatcagcttgacctcctcagggcagcagccttcctagcagaactcctccatcgccggcatcgagagtgacatggccgagtccttcaattcaatgacgaagcaatccttcacttgcatctttgtgagattggctgcatccacttccagccattgcagatcagatcattgacagacacgaggaataaggtcaggagtgagctggtgtggatggtgagctctctcacgcaggagtagatgctgacaagctcgaggatctgcaggcgaggacagccctacgacatgacctcgctgagatacgtacccgccctcgtcatcggtgatgacagtctccgataagtgaagcttcgtcagcagtgcaaacgttggcttgtcgtcgtcggccagcaccagctggatcaccatgttgacggagatggtacgtgatctccgttgccctcttgaagcatgggagctcaaggagatcagtgtcctcatcatagttgtcgaacatgtcaatcccatgcgacacgaagaggtgaaatcggctagtgactagccggacgacagtgtcgatcgacgcacgagatgatgtcattattctcgaagccgaattcatccccgaggaccgatatagcgaggtagcgtaagaaacaaagggatatcctctcgagagatgaaaacactttcccgacaggagagcacacgggtgcggatggcctcgaccaagggcaagaagacaaggatgtggcggagaagctcgtcggcaagggagctgatttggtcgggaccctcgtaagcactaccctttctgccagatccgccggtgctagaagcctaagctcttgcacttcgcccatgggctgctgctggcgccccgagctatgggagagaattcaggatggggagggagatcgaagcaacgaaaggaatataggtcgggttatgtggctgtggcactgcctcgagagagcaagagtagagtagggaattggaggtggctagggttccgtgaaatgtgccaagctctgctgctaattaattttctgaatttattacacacaagcatttgtcgagtgtctgcttgtgaggaatggtgacgttagctacacctaatattagattcatctaggccgtccatgtcgagatcgacggtatagtcatgtttgtactggccggcggtagtgggagctgtttgtgcactagttagcaaaaccactgaaatatgtagggaacagctaccagtatgcccctactttggaaaataatgtactatgcacaacttaacatgactacttacattcttctcaataaaatgtgtgcacagttgcacatataacttgagaaaaaaatgtttcttacacattctagagtagatatgtgagttttttatatggtacattaacccaaaaaaatgaagtgtggcttgtaaatgaattcgagcctagggagggtccatgttgttgaaagtgccttaggggtgtggctggtgacatggggcggccaaatatgccccccatgaacccaccttggcgaggagcgtgtggaagcggtggcctatgttttgaggtggaagaggaagtcggctagagttgttgtggttggtttgcgtgcaagaaggaagaccatcatagcactctgtgtttgctggctgcagtgggcagtggctacaaggatgcatggagcacacgcgccggcaactgtgtggctatcgccgcgagccatggggagaactcttgctagggagggagatctaatcaaagagaggcatctagctagggtttgtgtcggcggcgctacctcgagagaacgagagtgaactggggaattggtggtggctagggttccgtgaaatgggtcggactctgctaataattgtcttaatttattagtttattacataaaagcgtccaccaactgtctggttgtcaggaatggtgacgtcgactacaactaatgtggccgttaataagattcatctgggccatccatggaaagatcgatggtgtagtcatgttcgtactagccagcagcagtgtgagcttttgtttgtgtggttggtctgttagtgtcctgggcactagttagcagaaccaaggaaatatgttggggggggggggtacatgtattctttggaaaaggatatgctctatacacaacttaacttttttttaatgaccttgatttttctcaaaaatatgtgttgtgcacaattgcatgtatagtttgaaaattaataaaatgtttcttccacattctcaggtagatatttgagggtttttttatatagtacattgagcgtaaaaattaaggaggagtttcaaatgttgacctagcactaggacatcattaaggtgaacataacctcaattggaggcgacctaggttggtcccaagacccaggccagctataaaaatatctccaaagtgcctctagagtaaaagtattttctacgattttgaaagtgctaactcctgaatttacagccaatctgaaaaatcactctagaaaagtgtctctacttaagctttttgttgtagtgggagcattgtagtatcatcaaaaaaacataaatcccccttccttctgcaccaagccaaattcccagacagtaccccgctgatgaagtgcgatactatagatccccgatgcaaggaaaatcaatagctttctaatgatatgctcttccatgtcctcttggttatgcccttgtgtcgaggtcaggggtggacctaggcctcagcctgaccatgcatttttttcaccatgtaacagacttggttagcaaaagttcaatgggcgcagtcccacttgtcatattccttctcccctttgcaagatcgtggtgttcgtggtgtgtggcaagctcatgccctagtgttctttggaaagagtgagggctttcacgtagagcacgttgtgaagaagaggcagcagggaggaggaatctaatgagtgggaccaagagcatttttgacctgccacactatttatccctgccatgagtaaaaccacgatgtttttgttgtagtggccctatgtgaccatttgtttcatctgagccgtccattatattattgtaagatatatattgtgaagtcacattataattatttctatttgctagctgtgggagcttgcctatttaattatgactacggattagcagtttgccgcacagccaatgtaaggatcataatattcactagctagctagctagttaggtttgaaatttccatttaattagttgatcaaggagaatgatctttaatggatactcaacagttttgtggaaatttgaatatgtgcatacattttgatattgtgtaatatgcagtctactactttaccattttgtggaaagggcatacactactcttttttatgtgtgtgtgtgtgttggggggcagggggggctcaagtaatctaaaaatgtgttgtatacacttgtatatatagtttcagagggattgaacaattaaatcattagtaattatgtgtagtttagacaattactccctccgtttcataatgtaagactttctagcattgtccatattcatatatatgctaataaatctaggcacacatatatgcctagattcattagcatctatataaatatgggcaatgctagaaagtcttccattacgaaacgaaggaagtaattattatgtatattgttcaccgctcaacatttactattatttaacttacctccgagtccaaacaaagttgtgattttcccttacgtgacacatgaatagacccaacaacaaataaaaaattaaaaattggtagactccaccaatcttgttggcctctctccatgtgtgtgtctctctccctctggcgtctctctagttaccaatccatgccctatgcgcaaactgttgtccaagaagaaatgttgcggattgcttccctgtgtagattccttgctccgttcttatactctatatgtcggtgagccaaaaaaacaaagtctcctcttttcctctaccggatcccctttcccctccatctctggtggccgttggtcgcctgccaggggaggggggtttggggagccatcggttttatcccttagtcgggttcattctattgtaaatcgagtttatctagtactaggttctctgctccttccctttcctgtatagctcgatggagatgccataatacccatcttcttcgtcctggctacctcctttcatggccggtttgagttccaaatccaaagcttgatctgccttgcgccatttgaaaagttgttacgggattttataccaatgttttagtcaacaagtgcagcatatttgccccatggtgggaggtctccttcctccacaacgatgagttgtggtcggccgtttaaatcatctccgacgagtttgctgctagcaatttggtgcccttgtctttgatggagctttttcaatgttagattgaatctttttgtgttcatcgggttcacttcaacctccaattatgagatgccatcgtcggtttcattgtcttggtgattagattggaagacaaagtgaagcagggactcgattgcctttttgttttctgttggagtcatttgcttattttcaggacccctgcgtaacttgtttatctttgaggagtctttttgcaaatcatgttgtatgtttatctacatgtccttctataggcaacctaatctctctttctttgagagatgtgacgtccactcatgcaagttgtgtataaacatcctatattaaataaatgcgtgagttctaaaaaaaagagaagtgttacagaagttggacagcaggttataccatcgtggttcacgtttaatccttagggaggaccaaagggggcagcaggtacaccatgtcgtactcacagatccggatggggcagaccttcagggaggcggatactccctccgttccataatataagggattttaactttttgcttacactgtttgaccattcgtcttattcaaaaaaaattgaaattattatttattttatttgtgacttactttattatccaaagtactttaagcacaaccttttgttttttatatttacacaatttttttgaataagaccagtggtcaaacagtgcaagtaaaaagttaaaatcccttatattatggaacggagggagcagattgtttgcagggctgtcaacgagccaatgtcgactagttcagaaaccaacgaaaattttcagtggagcatatagaggtatatacagtgaaaatgcaagttctgagttctgacgctatttcatatcaccctccacagtattgtcagcgcctcaaacaactaattacaatgcagcaaatcagaaatgctatacatactcagtgcagcactgcatgatcatcaggaaaagcaaatcaggactgctctttgcaccaatgctcacacttaacttcagttctgagttctgaccaagcaacaagggcacactgctccgtactaacaaaaatggcattccagaatgtcaaatgctaagaatcgttcatgaggacaaactaaaatggcagctaaattctccgcagctagatcagttgctctgttcctttctttacagcacagccggatcaaaacatgccaggtacatcaagggtaagtagccaacaaatattttcttacttcagctcactgtggctgcatagagggagtgtcctgactcacttccactgaaatctctggtcttgcaaaactttgtatgactgcagatagtctctcccaagcagacaacgaacggtggcaggttattctgatcctcctaaggactgttgctaccctgactaagaccctcagaaggtcaagctcatgttcctttcctccgaagttgaggatctctacttctccgagagacctcatcgaaatgtccttattatctctccagtttggtggccaatcacaactgcagttcggtgaacatgcatgttgaacctgaaattacaagatcagaacaaaatatgagctagtaatgagattcattacctaacacattgagctagaccagtctaaaaaaaacacattgagcaactgagaaaactttattttgtattacaaagcatgatttcagtgctataaataactcttatacttaaagtttcatggatctatttcatggccaactgattgtacgatttgaaggacaatgagaaagaataaaaagtgggacataatgataagacaattatgtgaatttggtcacaaaaggccctgtttatcagttaactcgatcatatcaagagttacttttgctatgtcatcaataaggcattattggtaccttcctgcctaaatgtaactgacggagcatatacaagagagtaaggattctttagacataattgtgtgtgtgcacctacacgtgctatcgtggctgtcatggctagctcactccaaaattctcgctacgtttgggtacagggtttcaaagaaaataatacgaagcatttaattataaatcaagacagcttgcaggccatgttagaggtgaagcgcaaaccaagcagaaatttcagcaaaatagacatgaaggggaatatccctattggaaacaatatactcgtttttgtgaagcatgatattcctatgttggacatggaaaaaaaatgtgttgataggcacaagccaataaaacaaacaagtgcactaactatcagcactaaaaacatccatgtttttttaataataaaaacggtttacatcttcggcctttgctgttagacacacaaccaatgatttctatctctaaaataaacgatattagattatgggaaaaatcctgtttctctccaaatgataaccaattgaactaatgaaataaaactcacatagactataacatggttgctagaatcacgttaccagcttgcaacttatatatggagttcaatatatgattgtgtttcaattaatgaagcaaattcatttcagttgaaggatatattatctcggtcaggtgcttcttatttatattgacaacaaatgaaagatttgataaatcgaacaccgtcgctaaacttgccaagctgatatgggacatcttgtttcctttgctctatatatgaacgtacggccgtacgcctcaagatatatagtacttatcctgtacctattgccacacatcagtggagaggtgctttattttcagcatgcaatgcaaatagtaaagatattggcacatatatcatattggcgatcaatttatgaatgattgtgtattacaattgtatgctttgcagagcaagagctttctatagctaactacaattctagctaattgatgaacttatcatcgttccttattttccaaaaaaataaaatatcataaagggaaactatatatatatatatgagaggtaacaactgctataaagagaattaatttattttgttgcacgtactgtgttttcgacagatatattcatattatattatatatatgttactagtttattacaagccacctatgagtattaagaataatgagttcataataaaccccgtgtcacaaaaggcgaaaggacctgtagcctagtggttacaagagcctcagtagcacctgaggtcctgggttcgactccccgtgggagcgaattttccaggatttaacggcgttgtgctttcagtggtaggcgacgtacccgtcgacagcgaggcgcctgtggtgacttcatcaatctctccaggatttgcccgtacccgtcgacagcgaggcgcctgtggtgacttcatcaatctctccaggatttgccggcccagtcttcgaagatgctcataggggtaggccggtttgcgtgcatgcgttcataggggtgactgcgtgtgcgttgtgagtgtctgcgttgtactgtgtaattctcaaaaaaaaaaaaaaaaccccgtgtcttttttgcctatctccacccctagacggactcggcggtggcaaatgagcatatcggcacactgcaggttttgaaattttgtaacccgcctcccccgggcaagcacatatctcacccgaaatgttcagatttttccaaatatttatgaatttggtcaaagtttgttcaaattcaatcaaatatattaacatttcaaatagtttcattaaaaaaacaccataattctcgaaattttggtggtaaacataactatactaaccctggcatcctagcgcctattgttcaggtagatttttctttttttaaatccattctagcacaaatagttcggaattcaagtcatgtgttgtaccacacattagaataattaatgttggcaaacttctcgaaattttggtggtaaacataactatacaaaccctggcatcctagcgcctattgttcaggtagatttttctttttttaaatccattctagaacaattagttcggaattcaagtcatgtgttgtaccacacattagaataattaatgttggcaaactttgataacaacagtgaaaaatggaccagaatcaaacacatgcattcagcattgttggaatccatccaaacagatcgaccaatcatcatgttttgctcagaagattaatagtgtgaaagacacaatcaagccacacaacatttaatatcccaaagttgtacgaatcttacaatttaaatatctaggatatgttccacatggcaatatataagacaaaacatagccaacaccaaaatagtacaccaaagtcgctattccggtcaatctattacagccattatagcaccatgtatttatgtgtatctttttgtctacactaaattattattgttcaactcgatggtgcaatctgatgtgcatagctggcgtagattgtctaaaaacgatttgtatgagtggagattgacagaggaaaccaatgacaccttcctaagtaattttgagttttctacaataaatagtaccaactgcttctcatcatacgtgcccccaaagccattgatacttagttcttcaagtgaacccaatgagatctcttgatccctccaatttggcggttggcgacaagtgcagttgggctcgcattggatatgatttttctgagatacacaaagaattgaaatgatataaaaaatataagcccattttgatatatgaagtaaatcgataaaatgtattcaagcaatatatatatttaattgctagaaacactcaacacagtaatacaataacagacatacctttggacatatttcgagagaaaaccttttgatccacctgcttttcttgaggaggtgtacaatggttggggcgagagtatgttctttcttttccacaatgagttctagctccaagcaatagggtagatccactgtgtgtagaaatttcttttgctcctccgattcctggcaaagtgtcacgaaataaataattagagtataacacaagttgtattaccaaaaacactggtctatcgatctatttatggtggttaatgtaactgtgtgatgatatttatatataatagctaattaaattgtgttaatcacatatttagttagctaggaacaagtaaggttgtgctagggacataaaagcatgaaaatatatttagatctcatccgatactgctaggggatggactttcatgtgacagaaatatagaaatctagaattaactcctctagcctagataattaagctacagtgacaatgtacttgtttagttataataatcattctctgtgcacgatctttataataatctaatgcattaatgctcccatactgaacgtaatcaattttttaatatcatatagtaatgcacaacctaattaactagaccctccccgcaaaaaaaaactaattgactagaccagaaaaaaaaaacatagtaacaagtcaatttcaatttagtactcacacatactaattaacatgtgcctatatatatataaccggccgagctgactaatttgtatgtatatatactctcttgagcagctgcacttaatactactcccctgctcgttgcggttaggataagatttgatcaatttttaagattcgtaccatcaattattaattaggataagtttctaaaatctaatgagttcatgataataattttcaggataaagtatactatttgttttcaagataagcattaatttgagaaatatatattcgtaatggttgagttttagaagcatacttggctactaaatcctgttctaaaaacatcaaatatttttttactgtaaatccgtaatataattaagtccatatactaaggctctaataatgcaaaatcatgacggcataataatatataagagatgagatctagatcatatgtaccggtttaataggaaattcgatctgaagaacttcagtgcaagtgctcgagaacagctgcaagatcctagtataaaacgattggcttccgctgatgaacgacaaatttgtcgaagcagagtcgacgcatgcgatcttgtggatgaatcctgcaggttccctgacgagcttaacctcctcggggcagcagtccttccagtagaactcctccatcgccggcgtcaacagcgacatcgccgacccctccgtctccgccgcatcgatgtcgaagcaatccttcaccttcatccatcggagattggctgcgtctacatcaagcagttgcaagtcgttgattgagacgacgcacagggtcaggagcgaggtggtgtggatggtgagctccctggcgccggcgtggatgtcgatgagctcgagggttttcaggcacgggcagccatgggagacgacctcgctgaggagctcgccctcgtcggcgacgaaggtgttcgacaggtgcagcttcgtcaggtgggcgaacgtgcggccgcggtggtcgtcgggcgccagctgcaccgccatgtcggcgatggagatggcgatctccgtcgccctctcgaagcacgggagcgcgaggaggttggcctcctcgtcgtagtcctcggagatgttgatcccgcgcgacacgtcgaggcggaagcggccggtg

SEQ ID NO: 66193 - DNA, 8948 bp, Oryza sativa
tgtctcacctaattgcttagaaatcatacagacacaattctcttctttaaatttgatcttgatgctggaaaattggtcccgctcctatatcgccttccatggacttgtagctagtctactctaggagtgcccatctcacaccagtcacatcttcaccacctttacttggagtatatttgtgcatccggatgtgcatgtgaggaagctacagatctatgcaccaatctatttcagggcatttgacaatcgatgcacaaactctcaagcgctgaggttatctggaatattttgcaaagcttttccaagagatcagatgcatgtacactagaaattatctagattacactataaatataaatacaacctagtacagatgtgacttattatagaactatgaatctggacagctgtctatctagattacacttatattggaacagaggtagtagtcattatattaaaaaagtacacaagaaattagtggggataaaatcataaatctgttagtagatgctgaacatgcttttccatttgaccttagcagctggctagctttcacatgtgattaaagatgtttctggagctgaacatgatccatcgagatgcatgtatcactgttccagaacagtgctagctccagataaactaattaaaatgaaaacgatgttagttttttttcctgctacgatgtcagcttcaagacgtaggtcatctaatttagttgtaccgtagctcactggtgcattcatgtatctctgtttggaattgtagctgggtaccttcaattgatctggtttccaaatatgggcactattttatcttttgaaagtgagttaattgatacggagttacggatgaaacgatacttttccatttgggatggaagatgcattgacgaaatcccctatattttacgaatgaagtagtatatatttaaatgtccatatggtgaaaaaaaaattaactggtcgatcagacaggttttttgctaaaagtagcagattttatattggcttgctatatagtttgggtgcccactattattaatttgttgagttttatgctcagattgatctctctgcaattgtaatctgtgaggacgattgacatactatatataattttagaatatgttttctgaatggttattattggagtatgtctctctactcaagaaagtattgtttcgaaaaacaagaatacatgttattctaacttctggctggtttgctgatgtatttccatgagaaattagttttcatatgagaatttcgaagtctctaggtgttctaggatttttttagaatattgcacaatgcctacatcgcaatatttgttttgcatcttaatggaacgatgttgagcttttaaaagggcaggattaatgtagagtgaagaatcatgtaatgatcaatccaaactcaattcatccaaagtttaggaactcccaaattagtaattatattatttttaactaccattttttcttttgatttttccttgttgaatttatcatcaattgtttgttagttccctcctgatttggctcaagttaaatctaatatttcaatggctggcaggttaagataccgggttatttcctcagtctcttcggtatgaactcaaatttacttcattttgtccttcagttcatataatagccatgcttagttactttaccttcatttggaaaaatctttggaagttattactggcaattcaaactaacaatagattttctaaaatgttgtttacataatattacgtatctctagatgtttagctgcaaaacagggttactgaaattaagtactagttgaagaatgtgatggacatagtacatagcaacaccttctcttaatctggaaatgaaaagctgcagtgtaaattcaactgcaagcaaattaagcatataagagaaaactttcttaaaaaaaactgaaaagtaaaactttgtgggaaggaagctagtgacaacccaagaccagatagttctgctggatatgacaatctgtaagttttcctgtacttacgtaggttataaccatccagctcaggttcgacgaccaggatgctatgctggatgatactctaactgtaagttttcctgtactttctagtgctgcttctttcgaggactggctatccatctattcaattgatacttcagtttatttgagatataggaataggagtactctatattgtgataatgtgatccatttttcttttgaggcttggtttagttcccaaattttttttctaaaaacatcatatcgaatctttgaactcatgcatgtagcattaaatatagattagaaaaactaattgcacggttagggggaaatcgcgagacgaattaaacaggccctgaaacctgtgatcattatagtggtatagcacctgggatcaatggtggcgtctgggctttgccagcgtctgatcgaacgtttgaacacctgtatgaaatattaaatataggcttaaaaaaaactaattacgcagattgcgactaatttgcgagacgaatattttaagcctacttgctccatgatttgacaatgtggtgctacagtaaacattcgctaatgatgtattaattaggcttaataaatttgtctcgcagtttacaggcagaatatgtaatttgttttttattagactatgtttaatacattaaatgtttgtccatatatccgatgcgacacggcaaaaatttttaccccttaatctaaacactgtctaaacgatggtccagctagctctataaataaacaacattttatccggtctacatcacgatgttctctgtgacatcaaatcttaaacactgctgaatctaatctggtcttcaaaagtttggtccaatatatatactgcgatatgcaccgactccttaaaattaacgattaaaaatatatgagaatatctatagtttggatatgatggaatatttatagtactcctaggatatagcttatcttgtacctgattccggccagctaaaagatgtatactgaaaaacaagttatttaaatttaaatgggtcaacttatacaccctgtagtgctgtcgttaacaatctagctcctcgcaaatggcaccatgcgcacatatatatatgcagctaattggagtttgtaaggcaagctcacaagctgctaaatactcccactggaccgaaataaatccaactttcatatctagagttggacttattttcggacaggaagtatggcgtagaggattttagccttccaataaacatctatactcatttaaaagacaatagtgatggtggtggcagcctccccatcatttcttttatagtttttacaattagcccctaatatttactgattttatagaatagtccaatatcttgttttaaacaagtgaatatcatatatatttaagtaagcaaacaagtaacactaacatattttatatataagtagaatagggtaagactattctacacccggggtatagaataactttcatcttcctcccgatccccccacccccaccttctcgcgcgcctcgcgatcccccctcccccacccgagcgcgcgaccctccccctctccttttttttttcctcccgatcgctcccctcctcctgatcggacatacatttgaagtattaaacgtagactaataacaaaacaaattacatatttcgcctgtaaactgcgagacgaatttattaagcctaattaatccatcattagcaaatgtttactgtagcatcacattgtcaaatcatggcgtaattaggctcaaaagattcatctcgcaatttacagtcggactgtgcaattggtttttctttcgtccacatttgatgctctatacatgtatccaaacatttgatgtgatgaaaaagttgaaagtttgaagaaaaaaaagttgaaatctaaacacggcctaagcaaatttgccatcagctatgcttttcaagttggattagtgggacgttatgggctgtgtttagttacacgctaaaattggaagtttaaagaaattgtaacgatgtgacagaaaagttggaagtttgtgcatgtaggaaagtttgatgtgatgaaaaagttggaatataaaaaaggccatagtatgatttgtcaaggggtacggacgtaattttggcaccagcaagtactaactaggtctagagtcgacattgctgtactgcgcccactctacccgccatggctttctccaagcctcaggggcagcggtcgggatgggcccacaacggccattcccaggcgtcgacggttggcccaccaccgcggtgaaccaatcacgggtcgacagcgccggtgccgaatgtccgacaaggacccgccgctccgggccccgagagcgaaccgcaaccaaaatgaataaaatagaatagagaaaaagaacaggcaaacaattcctttttgttaaattactactcgtactaggcatgcaatgcacgcaccttcgacggtagccaccgcgtgtgacggtgtggtgctgcaaccaaacgctgctgctgctgccagccactggagggttgggggatggaatcatggaagggataggcggatagctcagcagtggtcagctctgctagtagtaacaacctgtaggatggatgagagttattgtagtagtactttggtagtaccagtatattacgagtaggaatggtaatgtgttgagttatatatacccctgtaaaagaaaaaaaaatcctagctatgagcctaaaaaaatatgcccactccctccattcaaaaaaaaaatccatttttagggatgaatctggacatacaaaggttcaaattcattcttagaattagacttttttatggagggagtaggttagtagctaggattaagttttttataggacaaagtagtatgtcatttcacaatcctattagctcttatatatttttaggttaaaaatgtataaaaatttagcccatctcattttaatcccaaccctcaaagaaaaatgttagacccttcaccacccttaagtactctttttttccccttttactacctctgtcttaaagagattttgactatgtatttggataaccacttttaaattatagtaatgtttatagtaaacacaaatagtaaagttatactactatttagcattcaaaatactttaattaattataaaacttttgggaggaaaaaaaagaatagaagtgatcaatgtcgttgcatgcatgaatagtatctagtgccaactactccctccatcgtaatataagtgcaacctagtatagatgtgatatatcttaaactataaatctagacagtatgtttatttagatttgtagttttaggatactgtccaaattcatactaaattgcatttatattaggagagagggagtaggagtaaaaagcacggagggagtacaaaataaggtgcgcgtcaatcacattgattggggcatgcatgtctggggtccctgcagtactggtcctgctggtagtagtttcctctgtcactcaggccatgggattacaagggtcctactagtatttgcatcccgctgattctgtttgaagcacttcaatttcttaggaatggaaagccctcctatgtgacttcttctgggctttctatatgtgtgttataaagctggattgtactaatcatcgatgattaaaagaacaccccaatgttacattgcaaacatcgaatgtgaacaattaatatataatagagcggggctgcattgggaaattcggttgtaaggaaattcgggccttgtggtgtaaggggagaaattttggattatcttgccattgggagccagcctgcgttagaaaacatatgattgctactctgagtcagattggtagggactcttcatcatcaaatttgcctgttaagattgctatcacagatatgaccttgaggaggcacctttttattgacctagaaatcatacgttattaatatatatgaatgcaagaatagcttgtgtcagttgaccactactaattttagaacattttgaccacgtttggaatttgaatttttctaattcctttgggatttagattgtttttatgcaaaattaatgcattgcaaataagagtttatattattgtctgatagcggaattattaattaatactatcataatttatgtattactatatattaattaaatggacaaatactagctatagttatgagataagggttgcagtagatcgagttgtcaaatgatgtgagagtgcatgtcgggtgctcactgatcgtcatgcatgcatttcttcaatatttcgatctgtctgagtctgtccaactcagctatcgtcccaaagaaggcggtgcctatctagtcaatgcgagtatatcaaggccgagtgagtttagctccaaaatttttctacaaactttcaacttttccatcacatcaaaacttttctacacacacaaacttccaacttttccgtcacaacgttccaatttcaaccaaactttcaatttttgcgtgaactaaacacaccccaagtttgggggacaagtggagtagtcgacgtgaacgcaaaaaggagattcggagaaagatatccctccaacattttcttaagaagaaattatgagcgcgttgggaattgaacatgagacatcagggttgaaaccacacatcccttgtcactacattatcaagtgcatctcgctaatttaatttagttgctatgttcatctccatggccctgtttggaagattagcccagagctaattttaagagctaatgtttagtcttgaattagtaggctaaacattagcttaggatgatatgtttggatctatgggctaatatagggctaaaaggtggagagagagtagagagagagaggagagaggaagggagatagggctacttttttatgatccccacagaaaattagccccattatcaccccttggaggagctaatgttttgagggtggctaattcacttaagccttaaattagcccatatgtttggattttttggggctaattcagggctaaaagatgggggctaataattagtccatgtaaccaaacagggcccatgtcattgttgataaccgaggaacgtaatgcctcccgtcatcatattgtttttgtgtcggtaattcacttctatttcttgcgattgcaatcaggtcaacgttttcatacccttggtagcactgcaagtacgtcaaaccatgcaaaagagagaatccacgggtagtttgtttaatccttggggatgtcactgaactttaacatctcctgctcagctgcagcattccagctagcggcctagctatttggccaacatgttgtgttattacatgtttgatttattttggtgacatcccaaacagaagagaattggttgatagtattagtagttgattatggcatgtccaatagtccttagaatttgacattttatcagaagttctatatatttgtcaggggaaaggaggccagggaatgtgtcatctgttttgcaaagggtcatagagagcctggagacgaaaatcaaacacacaggacagattctgcgcatataaagacggccaaaagccatatatacaagtcagaggccatcattaatgcttgctgcctgtaggacaactcgatcaggtacgcattctttgcttctacggtattgctgcagcgtaaacggtcaaactaatttactacagtagtaatttattggcagaagaaatgttgatcaaaagtacctttccaaagttcaaaaatgaaacgtgcatgaggtgtacacagcatatctgattttaaggagaatagatgcttgaattgaatcaacataaccaccaccttcttatgctagctctactaatcaactactacaaaaacatgttctggacatctcagcgctgtcctaaaaatgactttggtagctaatatttattgtgaaacatttgaaaactcaataagttataatactataaaagtacttttcaaggaaaatctataattatatatatatgtaatactatgtgatttttcatacattcaatctaaataattaaaattgtattgatgtccaatgtttttaaagtttgagataaacatgtctaaaccgatatgtttgcgtgactggagggagaagaaatgctccagtgaaatcaaactagtatttgactttctgttcttaattggtctatatatattcatatgtcgcaatacaaatagatcatgcacatggataaaatattttcaccaaccgagctttccatgaccagacaaatatgtgcggcttggagcaaagctttcaacggccaattcaagcaatcagcttgaccactctaccacttactgctaaactagaggccctgtttcgtcgaatttaacgcaagggctaaactaccttacaaagcttcagatatggaaatcagcatggctattttaaaatcctaatacctctcttcaaagtttgccatgtacctcctctcagatctgtccaaggaagagactagagagtaaacaatggtcatgataaactaagatcaactaacttcatcgaattaatggaagttcatcggagataccattgtcgtactatgaacagtggcaaagtaaactttctttaatttttgggtgggatattggtaccttgtcctcctccaaaatctgacatgtaattaatcaaaatgcaagtaggagttctcactgtacacacagtgttagctcttgctaattggaacttcactactgcaaggcaggagcagggtctataactagtactactatgcataaaccttcagccctgggaggtacgaccatcacccgtcccatccatctcctctgctccaagaagcaaacaccaagaaacaaagagggagggagagagagagatagagggagagagtccttttctctcaccagctctcctttcaagctcagtacggtggccgctca

SEQ ID NO: 66194 - DNA, 1526 bp, Oryza sativa
attatatttctatcatatgcttatggttctaaagcatctgggggtctggggttggaaattaataaatctaaggctggtatttcctttactattttgataacttatataattttcaggctgactcaaagttttgctttcaattaaatcactaatttccattcttctcctgccctttcttcagaacttatttttaaagggctcatgacagttattcccttagagtgcatattttcaatcacgtcatttacatttattttgtatttggaggcacttctattagttaatcttcctataaattctatgcttactagcaaatttgttcctttaaattcctcgtatccctttgtttgaaaaccaaaactcattttatctataaattcttttataggcatcattagatctggggctatatatgttatcaacatattctcattcatgtcaccttctaaaaatcctaatgctgctttatctattgtgtcccaccttttatctaacagagttattagaactttagctcctaatttctttcttgtcatacctttgattcctattatatacataccttggtgaatatatttataccctgaatactttaatccattttcaaattccttggctacaatttttagctcaactgcgctttgttaaaacgcttaactctacttctctagatattctgtataacccatttttattctcaaaaaatcccatgcaatatatttgttgaggtcttattgccctcagagtatctctttgatatctttcgagctgtttgtctacttctgcaatatcttcaagctcatctatgtcttcatttttacctttttgtttatcaatacaacttaaagatttatcgtctctgcttgctattcttctaaacaaactcctagataggtccatttttctgaattaatagcttgagatgaggtaattatgcctgttgaagccaaaactatctcttttcctttactagaatttattatttctaataattctttgatatagtcactgttttgtaatatcttattctgccttgtcttatattcctctagctcttttagcactgaatttaatttattactgacaagcaaatattgttcttcagattgctttcgttctttaaacaaatcttcaatccttcgctctaaatcttcctgctttttatcccaatttatataaaaattatatatcagatcaacaattaaatttaattgactattgttagagtgccaactatggtcttcaatgtgatttaacctacaccttatattcagattatctttggtagtaattacctttccaatattagcttctgaatttgatttctctatgatgactggctctgataccacacttatgcttcggacaaaaaacactgttcaaaaacactatttattcggctgaatactattcagtttactgtttattcggctgattactattcaaaaacactattcagtttactgtttaaattactgttcaatactgttcacttcgagagatattttaactttaggatctttgca

SEQ ID NO: 66195 - DNA, 5000 bp, Oryza sativa
atgggaaacttttcgtgggtctatctctcctataaatcctatacgacttttcccatgaagcattgaataaacaagaagtcccatataatttctgcattttgaaaatcctaaggatcaattaaatatgccaccttaagtttggattcatgtgttccgaaagagccctaaagagagagagtatacgagggcataatttaatttgcatgtatgcgttgaaatgtaatggattgagagacggctgtgttcggcagtaggagattgtgagagagtttgtttcgttttccgtatgtactcttcccgaactactaaacgatgtgttttttgcaaaaattttctatacaaaagttgtttttaaaaaatcatattaatctatttttaagtttaaaatagtttatactcaattaatctcaggtagccgagtggaggggcatctcatttcccaatgcgtagatagagaaatggcacgctcgtacgacaacattacctagaaatctgaataagattgtgctatactcatctcctggactggaatgacccgggtacaccattcaatttttcatcaattgctaatcgctatattcactagtactccctccgtccctaggatatgatataatgtttccattatcgagatatatatattatactgaaaaatatcatatattatcctagattagtttattagctctagtgtattggtaaaatttctatgcctagttcactgtacaagtcgatgtaaaattatataatttcttccgtcccaaaatataataacataatactacaaatctaaacaatgtccaaatttgtactattagcatgtgtctcatttagttctagactattatattattagacggagggagtagtcaagataattaattttgtactagaccataattaatcaaaaccttcagactattattatttgtaaaccagaggaaaaaataaacccatataggagtatatgaaaaagggatgtatatatacgtagaagtagttaattgaccatatatgcagctcgggtgtcattaacccttttctctgcatgcactgcatgcacacataaacaagttgatctcccatgtttcccttgacagctacgcggttcttcttagatccttgggtatatgaacgagaaatattattgacactaccaatgatcatgttgaaatgtgcgtttgcatctacacatgcataccaaattgccaaccaagtgaccaacattacactacatgcccctttcttatactctcttctagtaggggcagagcagggcatgcgtgcgtgttgtagactcgagcattgaaaaatggagtgatcacacagctggtagtggttgtagttgtagtagtagtgctactactagtactatagcgacacatgcaggtagatggggagaccaggagaagcacaagagggaatatacaagtgacgtgctgtctcgtgcacgccctaacagggtaggaacagcactgtctccccaaatcgggtttacgaggcactttttactctggtgatttgctctccctctcgtccgtatcaggcacctagggagagaatccctcccagatagtaacacggcccaacagtactagtagacgttgttttcttaatttaacatacattttttttctttgaaattaattagtaatccatgtgtttgtatacctctacggccagtttggttggaggaagtttttaggagggattgagagtttaaagggatgagactattaagtgttttgtttggtagggtgacataggaattttggtgggctggggatggggaattgaggaagaacttccctcattttcaatacttgggaagcgccaggtaattgtaagggaattcttcttttatttggtttaagcaaatttaacccacccattttaataaatgccttattttccaattaaattcccaaccaatttcaatcccttttaccaaccaaaaaattggaattaaaaatcaaattcccttttaaatcccatcaccaattccctggggtaaattcccaatccctttccatcgagataccaaacaagccactagcttattccatcgacatagatataagagcattaattcatgatatattaactccgttacagctatctagattcattgtactaatatctaatatgattatagatggctatattattatgtgatgaagggaatttacattacaaactagagttgtccataccatctaaaacaccactcaagaaaactgttcacttagtgcatatacatatatatatatatatggggtttatctcagactcaactaatcaatatcgttaccttaatccccatttcaatcgattcatgtctagacacaatatgtatgcatcaaatgctttttttatatattcttaaggttggattttatgtaggacataggttgtctctccccgtattaattgcagtgacaccttggattttatccaatcagacatgctatttataatatcatgaactctagtgatggtggagtacatagtacggtaggatcttacaatgttattcaaacatactgtataagttgatcgatctatatgaatactttctttattccaaaatataacaacttttaacttttagaatttattctaaaatataacaacttctccaccaatatgttttctcaaccaatcacaattctctaccattcaacatatcttcacttcttatccaatcataatcttgcccatttaattctacctattttcttaaaagttatgtctagtcctaaaagtccttatattttggaacgaagatagtacaatttacccagttgtgatatattttttctttgacgattaacattggaaagtgtaggaccttatgacaaacatgacgactctctttcagcgctctgtttgtgctctcatcaaaggcagagacaggggggcggcagggtccgcaagccccctccaggcctccaacaaattttctacatagaatcatctgacgaattatgtaattaagctacgtaatggagtattagaccccttcgtgactcttatacctctctcccaagtttaaattctggctccgccgagggctctctaaaacacatctgaatgggataaaagaaatttgggcaaaatgtatgcatgggatggatatatgcatgcatgtaatttggacaaaatgtcagcagaatggaagagctatagctaggcagatgagatgagagtaaatgcgcctttgggcaagagggtggtacagttactgccatactggtgacacgtacgtacgtactccacggaacacagcaaaatggatggatgggtgcatggcataaatgcaccccacattacttcctgtccccccctccaaaaccgagtagaggctggaggccggcagctcttgcattctaccctacccttgcattgccattgccattgccattgccattgcattgcattggcagtagtagtggttgcacagggtctcaactgtagtgacaagccaactgtaaactggagtaaaagcagcagctatacaatgcacacaatgcatggatggatgcatgcagatgcaggcaggaaggaagggggtgaaagctagtatgtagctatcctacactaggcctggctaggaaagctgacatgactactggagtaactgtgccagctcggaatgacccaaacagagaccatgcacaagctgcagctaccgcacgttaccgctagctccccggccggctacatgcagatcgatcagcatgctgaatgatgaatgaatgcacatgcatgaatttgttgagcactgttcgagctcgaaatcgcagtataggggaatggaaggagacagcactacagcagaggcattctaccatcagctgagaaaaattatgagagctcccattttgctacggactactctctcaatcccttgttccaaaatatatgcatttctagctagcggccttctttggaacaaagaaattttgctagtttttttctctaataaattgaactaattcgtacgaaaattaatcctgtaggtcattagcatccaccatccggttaccagagcacatatgttaattttggggtattgttcgattgatattgcttggagttagatgttggagaaagttttaaattgtactaccttcaacagcccggctaccacccggtagtttgacttaaccgtaccccggtcttgactactactaggatctgattgaactgaactagtatagtgcagcaagcaccacgtactccaaatgaacgtaacattgtgagcaagttctagtgttgaacccaataaaattaaagatgaaaaacaataacactgctagaaattagaaaatcatcagagcctaataatgtcataccagatggcccaaatgtattgtggcccatagaagttcttacctggacagaagcaggccagcctaatgggccacttgcagaaatgacctggatatcaggcattcgtgccaacccaagctgggagcggatggcgtcgtcagtcctcgcattattcatttatgatcaacgcaatagagcaaacactggccctgttgacaagtcacaaattccacattagtttgacaacagttcatgcactccaaataggaggactgaatgcccagttcaaattaatttcaagttttcaaggtgaaagcagaagatcagattaacaaaaaagtgaagaacacgcccgaaaaagtgaagaacacgttatgctggagtggaatgtactaatttaagtctacagtagcaaatctcgctacaaatcatgcactcgcacctcaggtttcatttatatagtgccagaaaaggatgaagctacaagtttccaactagttgtacaagcatacattgtgaggatgaataggatgccccatgtttcagacctcgcttgcctttgtacatgcactctataaggcagacctccgaaatcctgttacagcaagttcaaaattgttaggtctcaattgaacatgtaggcagaggagatgctagtgtgatat

SEQ ID NO: 66196 - DNA, 691 bp, Oryza sativa
ttctttatccccgacgacggcatgcgtaccatacgctgccactgcatgcgtgcatgtgccggaatcatagcatgcgcggctcggctgcaaagagggacgccttcttatcatcaccagtcatgggctcgtggcaggccataccagggtttctcataccgccggagccagggttatcgcgctccgatggtaagcactgtggcaaaccatacaaaaccgtgtaaaatttatcaatattttaaattattttttaaatttaagaagattaccatggtttttcttttaccgtaccccgcggtaagcacggtaaccgtgcagttaccggcggtattgcaaaccctgggccacacacgatggactccactagatgctgcagtccttttttttttttttgttagtgattgaattagagcaagtttaatagtatggctaactatcggtttctaaattacctatcgtcaattcctctgatgaaactgcaaatatgcaatagctataccatccgcactggcacgatggttgcttgactgcacagactttcaaaaggaatcgactatgcaactgatggctacaattatttatgagccatggaagacaagaaatagtgcaaggtttgaaaacatttttgactgatcggattccgtggcgcaaagagttctttttcttctggatgaattgccgaagttgaaagatc

SEQ ID NO: 66197 - DNA, 2217 bp, Oryza sativa
agtatagatgcagtatcaccaggaagtttaccagctctccgcttgcgaaggatctcttccctaatatccacaagcttttctttgtacccctacaggcaggacattttggttcacaaataatgcactacgatgatggatgaagcatttcaaaggacaaaaggctacctgcttaagctcgttcttcagctcatgccgtacacgctcaaccaaggatctttcaccctcggtcagcattaagggaccaaagcccatgccgtctgacccatcatttccatcaaacatgttggcttcactgtccacttggttatcttcatcatcagacatagtcgctccagtcccttcaccaggagatgcccctgcagaaccaatcatacaagcataactcagttgtccgaacatcatctaggccccttcagtaagaagtatcagactttaagatacaaatccgagcacaaaaaagggcatgttctccatataaagtggtgaacagctagcttatcaaactcaactccaattgtagttacccagcgttatctacaagcctggatcaactcagaattgttaccaaggcctcacacatgcctttgagattctgatcaatatcagcatgtgtagtagagctcagaaaatgaacaaaatcatatttaagattttacgtaatagttggtagcttatggctgctgacaagttggcacggattgtctctgagatctaagtttgcttaatcctaagcttattgtagggcacaacaaaaactcctttttctgatagagtaataattaccaaagtgatggttgaaatttaaaaaggtattgaacatacattcttggtctcaaatgaatagtgttgaaaatgttatgtatacttcttttcctttctagtttcaattgatctactatgtagtttcccattgcaattggactgaaactaactcatagcaaattagcaatctgcttgcctgaatattatcaatgaaataacaaaaaaaaagtgtatgtttgaaattttctaccatttgctgaactgattcaagcagatagaagctttggtctacctgttagactttgtaaagactgttcaagttcccagcaccccatcactgcttccattgcatgaacacgcacatgctgctgaagttgttccttgaatgagcaaagaagcaacacataatgtgtctgcaattaagagaagtatgttagagtccacaagaagggctgccatgtgaaaaacacaatgacatgttcatttccaagataaggagtaacacaggggtcataacgtcacagcaaatttcgtagaaagagaggtaatggcatcaatacatgagcttatttttccagttaacagcatgatgagaacaaggtattgtcattagatgagattagcatagcacagatattaatagcaaatcaataatcttggcagggaactttcattcatgcaaggttttacatcatctcagaaactagagaaatgggcctcagctatttttccactttgatagcttttggtctagatttatgagcctttgaatttgtggatttatttcttatttatatgactgtgtcccgtttagaaggtatcaatggatgcgggagtagcaataattatcaacgggtgatagaatcctttcaagcaaacaattcttgtaacaacttcataatcactaggacaaatccacaatatgccactaagtttcaactatctccactacgtgccactcactataaggatgtcactaagacatcagtggcatatcaaagtcatctacaacaacaaaacgggctttgcaacaaaataaccatagtacaagttcacccttgtggtgattttcaaggtatagtgagactgtttgaactttatcctgagattttttgtccaatttggatgacaaccaatcataagcataggggaaacgtgcaaacttactactactactaccatataaagtccatacaatagcaaagcaattgaaaaatcttattgcagataatccaaacaaacttaattgtccatttcttttcctcccatcgccgtttccccgacctgcagcagaaaattctgcacgcggaaaggggcataaggaggggcctgggagcggagaggcgtaccatgaagaggtcgagctcctcgccaccggaggggccaccggcggcggcggcggcggaggcggctgcaaagggaggcgggcgcgcggcgatctgcgcgtcgatgcgg

SEQ ID NO: 66198 - DNA, 6911 bp, Oryza sativa
cgacgggagccctctcgtcgcgctcgagcttggccggtgagctgcttccgtcgcgagccatggggagagagatcgatctagggtttgcgcaagacggctgagcggcggaagcgcgcgctgctgcttcgaattcgagacgagaacgatggagttggggaatttttggcggcggctagggttttgggaaatgggccggactctggtctctatttatattacacacaggcgtccgctcgagtggttgagtgggaggaatggccgttagattcatctgggccgtccattgagacatccaacggtgtaatcacgttgcacgcacggtcgagccttggtcgtgggaatttctgtactgaggcctcggtgtgtcgttgtctgatgctggttcgcttcttcgttacggagtacataacaaaaaagcgactcctgtctgctcctctgtccctaaaagaattaaactctacggataaatatgaacacatcacacacacacatatatccatattcatctatagagtttaattttttttgggacgaagaaagtatatattatttgaaataaaattctcacaaatcgtaaattctacttccttcgtttcacaatgtgagactttcttgcattacctacatttatatagatgttaataaatctagacatacattcgtatagatgcctagatttattaacgtatatatgaatatgaacaatgctagaaagtcttacaatataaaatggaggaagtactatagactattggaccactttaaaatttgtacattatacctctaaacctaacccctcatctctcctcttgtcactcccagcgttatcaccaccgcgagttgcgaacttgcgctcgatgccccaattgtagcctagcctcgcaagctgaacgaaagggatcaacggcgtcggcaagccctcttccctgtatacggtggctctcagccactagatccatcaccaccagttgccacatccaaaccacaagattcagtttgcccctgccgccaatgccgcccaccaccctcctccacccccgtggctctagtgcatttctgttcgcccgtgtccaccacccaccactgggtggccacctcctacgaccatccctctaagctcaatgatctctcctcccctaactcaccctaaacccgagactgtaaacccaaactcgtcggaccactgccagtcgctgaaattggaggagacagagttggatagccagaacacgaattgcgaatattagaaatttgcaagattttaaccccaattttctgtcaataaccatgtagtgatttcgaaaaaaacggttagtagatagccgtacttagaaaaaaaacatacaagtcacttttatacattatataaattaaaattacttacaatgtaatcacttttggggaacttttatgtgaactacatgaacagatcagacagttccgtgtgaaaatttggggattttcttgaatgtgaatgttaattagggaaaaaaattgggttgaaaatgtactctctccgtcccaaaaatacccaaccttgtactaggatgtgacacatcctacgttggagtatgccacaaacctaataagcccatatatatatatatatatgtgtgtgtgtgtgtgtgtaaatgcatctcgtggtaggcgtcttaatatacatgtggaattttgtttttacagtcggctacttatcccctcctataaaaatgggcatttgaatactcgttgtacattactggagagatgcacatctctcctagttcgcaaccctctttattccgggtatgcaaccgggagcgcgaatccgggactaaagattcatctttagtcccggctagtaacaccaaccgggagtaaagttttttttttcattgtttcttctgtatccatattgatttctaaccaaactctcaaccataaaatcatcaacattcacaaaagcatcacaaaatcatcaacatccgcattaagaattcacatcacaaatatacaaatccaaaggcatcacaaattaaaaaattcacgttcacagataataaatcaacaaaatcctcacgttcacagataagaaatcaacaaaatccaccgccgcgctgtcacagttgcctcgcgccgaccaagccgcttccgctgcccgctccagccggcgatgctcgctccccgtaggccgcgcggggacgtcgccgcctcccgcgccagccgtcggcgtttgctcccgcgcgggccactgcacgtaggccgccgccgccgttcgctgcgagaaaaaaaaagagaggataagagagcagcgagaaaaaaagaggagaggataagagagaggaggaaaggggatgaggaggagttttcgttccagagggtaagtgttagggaccggacgcttttttcaactgggagtaaaaatgatctgtagtcccggttgataacactaaccgggactaaagattataaaagtgcgttgagctttttaaccgggacaaaaaatggtttttaatcctagttccaataggaaccacgactaatatggttttatgctgaaccaacaaagatcagttctccagtactccagtctccagtagtgctagtagaaacgactaccaacccgcatttgaaaatgcattatacttgcttgtatcgtattagtggaatttcagagattaatctagaatttcaaacaaaagtttcaaataaaatttaaattttgaataacctttttttgttgttgcatttgagcttacctttatacgttgcctcgtcctcgcctcttgcatcccggccaccaggcctggcacatcaggtgttttccctctggacctccgcaaacctatagtactcgcgccggcaccaactatattcctgtcaaccgaccgaggcctcacaccgctaggtagcgatcccaattttttcttcaaactttcaactttttccatcatatcaaacttttctactcacataaacttccaactttttcgtcacatcgtttcaatttcaaccaaacttttaattttagcgtgaactaaacacagcctaggtcaggagcaacggcaaggaagtcaccatgcctctagagaggaccagaggctgttgcatcgccttgcagagtccccgatattctagtgaggagagcaagctgctgggcaaaatgcagggctgtcggtgagggtgtgcaaggtgcaggcgactgaacatgcctccaaaattagaggccctaaaattttcatatgttaatccacttcagatttggaccgctgtgaggatgggggtggtgattcctctggtttgaaaagttgaaggatgtacaatattttgtattgaagttgagtggtgtaaatcgaacttctgcgatttatagttgagggggtcaaatttgattgaacccctatagctagtatgccaagagtttatacaaaccaacaatttacaagtgacttttcgatcaccaatgcagtttgcaataggctgtaatgaatcaaattataagcgcaaaccaacaaagcggggcatgcacttcgatcatttagttagttgtctcgcaatgatttcaaatgcatgaccactagactagttataacacaaaaaaataactctctctttcattacaatattattctagcaaacatacataagctagtaataccagaatagtgcacaaggacagtagttctccacaaccaaatttggtacacatactcaacaaaagttcaataaatcactgcatgcttcttgaatattgccccatcaaacctttgtcactataattttttccagtccactatagcagtatttctctctacacggaaagttcaactcgatggtacatccagtcattgatagttttcgtacatggcacagaaaccgtctatatgaacaatgaccattcgagaaaacgagagttatctttttaagtacttttgaatttcgtataataaaatataccaacttctttgcttcacgatggcccgagatgtgtttgatggctagttgttcaagggagtctagtgggatatcttgatcccaccatttaagtggttcgtggcaagtgcaattagacatgcagcatggagcaaatttgttttcctgaaacagagagatatagtgatataactaaactgattgataaagcaaatgatccataactaacagtgccaaaaaaagtagatattttttgggcaagagagatgaaattaaggtaaaacataccttaggatgatatggatttagtgtaagagttaagtttctgatggagctatttctcttgaggaagtgtacaacagttgagccaaacgagctatgcccatttgttatcacgccgaggtctagcgctgaatagtatggaagttgcacgctgtgtataaggctctcttgctcttccgaatcctgcaaaattaacaacatcaccaatggaataattaaacaaggtatatatatatatatatatatatactttcacacgaaatattaaaaaaaatgctgtatcctggaagaagtgacacaaacgaaaagttcactacggaatattgtaaatacacactgtcattagtactcatgtaaggtcagtgcacaggccaaattattcggtcccaacttactaattaacttcatatttccctaacgtatgtatatgtatgtacgtagcttacattgtgattgcctacttcttgatctgcagagggcacgcataagaagatatatagcatcataaaggcatgcaagaatttcagcgagatccattagttgctaaactagttgacaaacctaactaagtatgagtatgtgacttacacaaaaagatgtgtacactgataaaaaaaaaaaccaacctagctgtgatattgacaaacttattaaactctatgcttttctttaaaaaatctaaattctatgtacctaaacaatctcaaggacgcaatttacgcacgccaaaatactaattaaacatcaacaagataaataaatataattaaataagtaaacaaataaagaaagaaagaaataccagtgtagctgtagcagtcataggagaagtgagccttaaaacatgagcacgagagaaaagcttcaagatcttggtgaaatccgattgcccaatctcgtgaataatatgagaaggaagctcgacgacggcgagctccatgaggcagctaggtaaactaatcagctcgaccttgtcggggtacgcgtcctcccagccgagctcctccagcgccggcgcggcgagccgcatcgccgcgccgccggtccacggacagcggctcgtcccgtcgaagcagtacttgacccgcatcttgcgcatgttgccggccgccacgtcgagccgccgcagcgggacatacgcgaggcgcaggctcagcagcgagtcgctgcggagggtgagcgcctccatgccgtcgatgtgctcgagctcgaggcactccaggcttgggcaccggcgcgagacgacgccgctgatgccctcgccggcgtcgctgaagcggagctcggacatccgcagcctcgtcaggcgggtgaagcctccggcggcggcggcgtcgtcgagcgccgggaggcggacggccatcccggaggagtagagggagatctccgtcgcccgctcgaagcacgggagatcgaggacggcgtcgtcgtcgtggcctacctgggtggtcacggcgaggtagaagcggccggtgacgctgcgggcggcgaaggccgcccacgcggaggcccggtcgccgtcgacctcgggccagtcccagtggtacgagatggcgaggtcggcgatgtccacgtcggcggcgtagcggcggaggatgccgtcgaagtggtccgggatgtgcccggcgctcgtcgcctcctcctccaggaggtgcagccgcgggacgcgcttccagacgccgacccaccggcgggacagcgcgctggtgcggacggcctccggcgtggtcacgaagctcaggacatggtggagcagctcgtcggggaggctgctgatacggtccggaccaccgtagtagccacggccaccgccggcgccggcgccgacggatccgccggacagagaagccttcttgtgcgcggcgcacctgtaagccattggggaaatggggatttgagctagctctgaaggagaagaaatggaggagaaatctagggtttcgtgtttcgtctcgtggcggcgttgctgcgtcgatcgagcgagaggaggagtacgggaggctgcctctgctccgaggctttacatagcggctgtgtgggagagagacaactgatgcatgtgaccgttggtttcatccgagccgtccatcgcacgagtaccgtatgtgtgagtgtgaaaccgtccgaaacctagcttatttcctataatactggtcgatccttttattttctttttttgaaaatggattcaaaccagacatctacatccaaaaaataataatgtgtgaaaccgtccgaaacctaagtgcctgttctaaaaaataataattacctattctgctgatcatatatccctgtctggagctgaagtctaatggaaatatggaatgatacattcccatgtaaaaaaaatatatgcctgcgtttgtatgatgaaagtacagtaattaaattaattacttgaacatgaaaaattagcatcacaaagtgctgcttatatttcattggtttcgatcagattctctgatgagagaagaatatgaaacaaaatcgtctctaaccaaaaactatctaaagtcaacaaggggctgctcacttccatcaaatgttcttcaattcttctactgcgcatgcacttccaatcaagcagatgttgcagacgtaggagtacgtcggtcaagaaaccgcgcagtatatactatactcccgtcccaaaaaaaaaaaaaaagacaaacattgggtttccgtgtccaacgtttgactgtccgtcttatatg

SEQ ID NO: 66199 - DNA, 2201 bp, Oryza sativa
ctaaatatgttatttataggttttgttgccttaaaaattaatgccaatgggcccgtgaagaataccactatatatcattgtgagactttatacattaattaagggaaattcaaatggtaaattgcttattggacaatgcaaatattaaaatagcatctcataatttgattggaatttatctaaataaagtaaaaaaaggtatgttgcataactaataagggactttgtgttaaataattaagaaaaaaaaagtgtgagcagtcgatattatggggctaaaaccacacacctcaaccaccttactagtaggcgcattgaaaaaagaaatgcagttactgaatgccatatctctacgtccgtaaataatcaaaacatcaaataaaagtagtgccttaaccatggttaattgtgtacaattctcttattcgtaaaattacgacggattgatacaggattagctatacatttattgtcaaattttaactaaaaattttaacagatgtaaatcgtgatgtaattgttgtgtaacttacatgtaactataatgtaacttgtatataactttcaaaaatccctaggtgacatgctaattccgtgaaaacggatgtaatggtaccaaatccccttgcatgttcgtggattgtgattttttttcctacctctcttgcacgaatttaacaaatcgaacggttcaaaattacattatagctatatgcaagttgtaatgtaaatacactacgattatactatatttagatctgtcaaatttttagaaaaaaatttgtcaaatatatagtaaaattgtttctgtatatatgtagcctttgatggtctactggtgttatggccaccttgggtttttgggtaccggtgttattaacacatagttagatgttttgacgatgtagctggatatattacgattgtagtatatttatatctatcaaacttttagaaagaaaatgtcgacaaatatgtatgtatatgtatgtatgcagtatttgatgttctgctggtgttgtggccaccttgggtttccggtaccgatgttattaacgtatagttagatgttttgacgatgtaacactagatatattatataaggaatagcgaccgttacgtgtgttttacgataataactataaaaccttcacgatacgcactttttttttgcgaggacacgatacgtacttttaatatgggatttcaaatgatcttagtcataataatacggtctatctaatcaacagctagatctttcttatttacgtagaagctctctggaagcgcctaatgcagaacatagtaaaatgaaagcagactaactagtgtgcataaatggaagaaaacagttgtaccggttctttcatgatggaattccaatgccgtacaagatggaacaagaacgggcagagaaggcgcggatgcacaatcgtcggttgatgatcagcctaacccatgacggatcgatcgatccgccaactggtgaaatgccgatcgcctctttgccaactcctgcatgggtacagaattaacactctaactgtcagctctaattaatataatccctctgcgcttcacaaatcacaactgttggtgagagtagttctggagctctggatcagcattgttgcagaagcagaaggggaacaatcacctacctgcagggaagctcgtcgctcggaattagacgagaattcgtcgatccgtcgtccaaagaagagccctagttagctgctaattcgtctccaaatcaaagacacgacatgacacgcgattccttgcttgttgcattgcctggtggtattagaagagttggctggtgggtcatcggatcctttgcttctcaccgagctcgcgtctcttttacaaattaaagcatggaatcgaattctgttgcgtttttattctttctctaaagatgtatcatcgtttcccatgcagttgctgtgatcatgcatgtctgcacggcccattgatttatttaggctgtgtttagttaacgtaaaaattaaaagtttggttgaaattagaacgatgtgatggaaaaattagaagtttgtgtgtgtagaaaagttttgatgtgatgaaaaagttgaaagtttgaagaaaaactttgaaactaaacacggcctaaggctagagaactagtctttgctcctttgtctaaaaagtaaagagattgaattgggtccaattaa

SEQ ID NO: 66200 - DNA, 1303 bp, Oryza sativa
tcacaactgcattacaaaagggaagcggaagccaagacttgaaccaaacatcacaggcgcgacttgggaactaggccgaaaccctaaaactcatcgaagccggcttgctcctggaagaactcctcatcagcgggatccgcttcatcttcttcagcaacttgggggggttatttatatagagcaagggtgagtacgggagtactcagcaagccatgggaaataagtgtttaatgcatgcttcaaggaaaggctgttatttttgcaattgatttaattttgaactcctttattgaaacaactaagtgagtgcttctcaaacgacacggatgagacagtgcgtctcgtccggtcggagtatgtgcaatgtatcagtcttttgaattgttcaagattggcacccggccaacaacttttaaacggccacctgggcctagctgatcccatcagctacagattttccaaacatcgatccccttcccacaacagcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcaccctgcccacggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctaattactcagccaggggtgtcccattccacccatgtggtcgtacttgtcttatgttcggatgaaattccaaggaaacggtccttaagtgcaagaacgggaaactgtacacccggtacgttccccggtccgcggttttggaaattcatttagttcgcgagcaccgacccaggtgtcgagttttccaagtcttttgtaaaacccaagttttacccaagaagttactcagattttaagtttgaaggcgaccgtcgatactcgcacagagtgcacgaatatcgaggcgcaactagatggttacaagggaacatggtataacaattaacaaaggaaggatcaaatgcgacaaattaggtaggtccgccaatctgccttcagacgggacaagcagactaagtgcgatcctatcaatgcataatatttttcaagcaacataattaagttcaaatataggc

SEQ ID NO: 66201 - DNA, 57943 bp, Oryza sativa
ttatatgaaatttttttataattagtattttcattattgttagatattgataaaacatgattaatattttctgcgtgacttgtctttttaatttttttttataatttttttaaataagacggacagtcaaacgttggacacggaaatccatggtttgtctgtttttaggatggagggagtagagtatagatatgcagacgagatttcttggtatgcaagtatataccgtgttcttggcttgcaagatcacccacgcaagttcagagcgaacgacggcagttaatgcaatctactccatctttctaagttttctggtgctgccttgattaattagttccgcacaatcaacctcatgctaatttcagctgaagttttttcccggcgaaaaatttcagctgaagttttttcccggcgaaaaatttcagctgaagttttgcaaagattattacttcttcaagaaatggcatgcgcgctaatgcaatataattcagtggtcacatgatattctttcccctgaaatgagaaaataatgtaactatgatattatattattacacgggcatatattaagagataccctcccggtaaaaaatatttatcatttaattaggacaagattgtgtggcatatattaagagatacccaccccggtaaaaaatatttatcatttaggacaagattgtgtggaacctttcacaaagtacatatatttagttcgatcactagataatattaatgactagaaaccaacatagtgccggatgtgacacattgtagtactacatatgaatctggacatatacgtagtatatataacacatttcagtatatatatgccggtggtgtgtatatatatatatatatatatatatatgtatatatatatatatgtatatgtatatatatatagtgcacacaggccctcacgtgtacacacgtgcacaccaactaaaaaatatcaccaaaaaatctagaaaaaatcatacacatactttcaattgtattacacctagggttcaaatcttaacgtcaaattcattatattttagccgtaacaaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcctagaacttttttgtgataatttttagttggtgtacacggtgtgtacacgcgaggtcctgtgtgcataggatacgctcccatatatgtatatatatgtatatatatatatacggtggcgctacacagcgccacccacaggtgctacgcgccacgaaacaaaatggcgccagacacaaacgaggagaggtcagcccaccaccgacaaaatcccaccaacgaggcatccaacccacccgcggagttaaaatttaacttagatacagttggtggtggtggtgcggtgatatcgttgaggagttaatattatgcgatgattcagttggtctgagttaaagtttaacttagatacagttgggtggtggggtaaaaccagcggagttaaattttaacttagatacagttaggtggtgggtgcgatgacgtcgttgaggagttaatattatacatggtttcagttgatatgagttaaagtttaacttacgtacaattgggtggtgggatgcgatgacatggttttggagttaaaaaattacttgttgttgttcaattctggatgatatgtgattgagtctggttgctgctgagttaaaaattaactcgcgatacaaaactgcaggacatcgttgtagagttaactcagtttgtatgagttaaattttaacttgtgtacaacaagattttaactcaacatatacgtcttcacaatctataagcataagttaattttttgtcggcacttgctccggacatcaacggcggagcgtcatggaggtgttcgtcgctgctcctccatgtccttcggtgttcgaacacgccgccgcggaggtcgccgccgtgtgcgtggggcgcggaacggcggcccgatccgccgccgcctcggctgtcgcccgcagtcccgcagtcgccccgtcacgggatccgccgtcgagccacctgcatccacgcctgacacgcaccaccgcaaccggatccgtgtacgtggggcgtggagcggcggccgaatgcgccgccccctcgcctcgccatgccatgttggatccgccgacgcctcgccttcccgggcaggattatccccggatccatcatcacgccggatacgccctaccatggccggatccgcgcgcgtggggcgtagatcggcggctgggtgcgccgcctcgtcgcctcctacacgccgtcaaccgtcgcctccacgcctgccgccgtgtcgtaccggatccgtcgacgtcgcgcccgccgccgctcggcagtggaggtggcgctcgacgtcgcgccgccagccgtgtcgtgccggatccgcccaatgccgccaccactcgccgccacgcccgctcgccgctctcatctccgaaaaaataggatctacatatgtggttggttacggggtggatgtacaacactggtatatatatacactaaaagttgagtaacatcaagttaaattttaactcaaatacgtggtggtgggtggggggaaggtgggacagggtggtggtgcggctgtgtcaggcgccatctaatacgtggcgcctgtagcgccatatagtagttctatatgtatgtatatgtatatatatgtatgtatatgtatgtatatatatgtgtatatatgtatatatatatgtatatatatatgtatatatatatatgtatgtatgtatgtatgtatgtacgtgattgaaaatgtgtcatttcatatatatcaacaatatactgaaataatggagaattattttatttgatgataagctgctttagcagattatgtatgcctcactgacatgtagtagatgctaccataacatattaaatcaacgtaaagagtggatttgaatctttttagacctacatgacacccaagacaaattcgagaatttagaaatacattttgagagtgatatctagatgacacactcgcataagtttaggatagtccttatacttatcagcctcatcttttcgcttatgcttattcttatcagccaaaattcgaattttcaactttaaatttggagttgattttgaggtttttgttactgggattttgaggttttttcatcggagtttatttttcagcttttgcttttagatcactaagaacacgtatatatatataaaagttttattcacagattaattttcgtttgcatatatgccgtttcccttattcccggaataagcgaaatgatggagcacttcactcttgttttttattttggccggtttcaattctggaacgggcagaacatctttcagagaaatcatcatcgatcagcctaaaatcaaccagggactgttcaccgactttacaatatatttcttctgaggaataggtacaatcggggactgttcatcgcctttacaatcggtacatactatgctgcaggcaacagctcaggctgcatttagttcgacgtaaagtttagattttggttgaaattggagatgatgtgactgaaaagttgtgtgtgcatgacagggtgatgtgatggaaaaggactgaagtttggatctaaactttggatctaaacacagcctcagagcagctagctagccacagataccgaggaacgaaatttccttggcttggaaggcactgtattttctttgctagcaagagatcaccctgttttaatttgtaaaatattacaggctgcacgttcagaacaacggatggcgacgcaatctctcataaatttatgattctatttcttctatgagacgtgctcgtccaaaaatcaccttctaaatactctatgtctcaaaataaacaaacttaatacgagatgtggcatatattactaatagtatatatgaatctgaacatgagatgaggaatgtgtccagattctgaaaccaaagaattaataaaaacagcactatgtgatatatggatgctaacttcctccgtttcataatgtaaaactttataggattgtccacattcatatagatgttaatgaatctagccacaacatctatatgaatgtgggcaatgctataaagtcttatattatgaaacagagggagtacatgttatgttatcatattacttgttaagtatatatgagatggaacaaaaatgaatcaagcgacggtaattgcagtggtatttgtgatatttatgttttgagaaatctaggaatgcttatttcctgataaacatattacactaagattaacataattttgataatgattttaatgtttatctataatcattaaggcaataaaacttagttgtacagatcaagcgtacatcaggctagcaattggagctgcatcttatatagctgatctattattatattctgattgataacacaattaaagttaaaagataaacaatagaataaaaaacaaaagaaatagaaaatatgcgcgcagttggcatgccatccatatggcttgcataaaccatatttatacagtaaatgcatgtaatatttattatttatttgtaaaggagttatattttgaatagatctttaagcagttttaaaattgtatatctatcaagcctaacaaaaacattatgctggtaaatgtttaaattacatataaaagaaataaaaataaatgtttgaaacgtggtacgtggaacacaagtcttgaaaaatatggtacgaaggggtatacctcttcaaaacatttgttcgaagggtgaaacacgttccatggattttttaggatgatagtccggaatgatatggaaaatcaggatgcctttgttatgcaaagaataatttgaactaaatatatgtaaactttagggcttatatggatgaaaccatttgaataaaagacttttcataatattaataaactcaaagggctaaattgaaaaaaaagatgaatctcttttcctttcaccacatcaggccatcaccccacgatggtatccacaatgggcatgcacggcaagatcaacgtcaacaatggcaaaggcatggaggaccaagaacttgtcctgtgtcgttgcagtgcatcacccacatatctgacattggatttctcacattctgatcttcatttttttatcagttttgatcgattgaagaatgaagaatacaacattcttttatcagttttgatcgattgaagaagacaaatggagacctcttctttcttactttgatgtctatttttatttcgatttgaagagattgcaagtgatagtttggaatactctagagtttagatgaatgttcgcgcgggagactgcacagggttctccaccttctctccatatggacacatggcagattttaggagaggttcaaatcgaaatattaggacgccatatggcccaatgagaggctagggattggaccttgaaatcggtattaaagattactgtacttccatcatacaacgcgggcatttcttttttttttcatatatatgggaatgcatcgatcattccatgcattagacttcagctccagtatgcagggattggtccgtaggtaattaggtttcgaacggtttcacacatacaagcgctagacagggattaatcagttttgaaaaaggaaaaaagattgatcagtatagaataagaaattagctagatttcggacggtttcatacatactcgcgtgatggacggctcagatgaacccaacggtcacatgcatcacttctcgctctcccagacagccgctgcgtccgctatgtaaagcctcctcctctcgctcgatcgacgcagcaacgccgccacgagacaaaaccctagatttctcctccatttcttctccttcagagctcgctcaaatctccatttcccccatggcttacaggtgcatcgcgcacaagagggccaggttgtccggcggatccgtcggctccagcgccggcggtggccgtggttacggtggtccggaccgtatcagccgcctccccgacgagctgctccaccatgtcctgagcttcgtgaccacgccggaggccgtccgcaccagcgcgctgtcccgccggtgggtcggcgtctggaagcgcgtcccgcggctgcaccttctggaggaggaggcgacgaaggccgagcacatcccggaccactatgacggcatcctccgccgctacgccgccgacgtggacatcgccgacctcgccatcacctaccactgggactggcccgaggtcgacggggaccgggcctccgcgtgggcgggcttcgccgcgcggcgcgtcaccggccgcttcgacctcgccgtgacgagccaggtgggccgcggcggcgacgacgacgagcgcgccgtcctcgacctcccgtgcttcgagcgggcgacggagatctccctctactcctccgggctggcggtccgtctcccggcggagctcgacgccgccggcgacggagacttcacccgcctgacgaagctgcagatgtccgagctccggttcagcgatgccggcgagggcatcagcggcgtcgtctcgcggcggtgcccgagcctggattgcctcgatcgagctcgagcacatcgccggcgtggaggcgctcaccctccgcaccgactcgctcctgagcctccgcctcgtctcggtctctcgtctccaacggctcgacgtggaggccggaaacctccgcaggatgcgggtggagtactgcttcgacgaaacgagatcgtgtcgtccttggaacggcggcggcgcggcggcggtgatgcggctctccgcgccggcgttggaggagctcggttgggaggacgcgtgccccgacgaggttgagcggattaggttaccgacgtgcctcagggagctcgtcgtcagcgagcttccttctcatattatccgcagcatggggcaatctgatttcaccaagatcttggagcttttctctggggctgatgttctaaagcttacttctcctatgactgctacactggtattatttattcattaatttacttatttatttttatttatttctcttattgacttttaattacgttctaaacttttttctaatttagctttttttaagaaaagcatagaatttagtttgtcaatatatatcacagctaatttggtttataactttcatgtaagtcacacttttaggtctatccactacaatattcggtagtggactttttcggttgtgtttattaattgttgaagagctactcctctcaggctacaataaatcaatatttcgtcaagtattgactatgtttaaattaaattacttgacgtagtatggttcaataaatagatcttcaaatcattttgtgtgactaagataggtcaaatagcaagctagtaaaatgtgagtaacacacaacttttcaaatgtatacaagtttaaaaaaaaaacaaattacagtaccctgctgtaaacatagtgttgtttttatgaagattaatttattacagttagttttaatcacatgaaagtgtataactcccttgtttaattattcaattggtgacgatgttaattttgtaggattcagaagagcaagagagccttatatacagtgtccaacttccttactattcaaagctagacctcggcgtgataacaaaagggcataagtcgtacggctcaagtgttgtacacttcctcaagagaaatagctccatcagaaacctaactcttacactacatccatatcatcctgaggtatgtttcttaatatctacgtttcatctctctttgcccaaaacatatctactttttttttggcaccgttagttatcgagatcatttactttctcagtcattttatatatatagttatatcactatatctctccttttgtgttttaggataaaagatgtgctccatgttgcatgtctaattgcaattgccacgaaccattaaaatggtgggatgaagatatctcgctagactcccttgaacaactatgtgtcaaacacatctggggtgaatgtgaagggaagaagctgatatactttattatgcggaattcaaaagtgcttaaaaagatcactgttgttttctcaagttggctttgttcatagagacgctttctacgcaatctccgcaaactatccacgtctggatgcatcatcgagttgaactttccgtgtagggagaattcctgctatagcggaatggaaacaattacagtgacaaagggttgaggggtaccggtatattaaactttttgagtatgtacctgtaccaaaatttggttgtggaaaactacaatccttgtgcactattctggtattactagcttatatatatatttgctggaataccttatatgtggattcattcctttggaatgtgctctcttaatattgtaatgaaagaaccctagctagttttttgtgctaactagctagttgggtggccattcatttgcaatctttttttttttatcaaacattcatttgcaatctttatgagacagctaactaaaggataaaagtgcatgccccctcattgttggttgcacttataatttgatggatgaacctattgcaaactatacgtgtgaaattaaagtcacttgtacagttgtatgtctttgggttgtatgaactctatgatatatatactataggggtttagtctgatttactatatattgcaaaagtttgatttaccatactaaatccaataccggatattttacacacttcaacttttcaaaacaaacaaatcaccatcccgcccttgtcaacgcagtttaaatccaaagtagttttagtcctgtgacatacatgagtccacctcaaatcctctgactttctatggcaaaatcacaagcgtgcggttccatctatcccaccatcgattctcatccaacgatgcacgctcattcccccaatatgtttcttcttcatctttctccctttgctcagcatcacggccaaccgccagctttgatatcctccttgagtacaaacgtgattacaccattggatgtttcaatggatggtccagatgaatctgatggccacattgggtttagctaccattacaccattcctcccactcagccactcgagaggacgcctgtgtgtaatataactagagaccgttagtagcagagtctggcccatttctctgaaccctagctagctgccaccacaattccccaactccacttgctctagtgtcgaggcagtagcgctcctgtcggtcagccgccacaaaccctagatccatctccccatgtcttccgacggcacagcagctcacctaccaagctggagtgcgagagagcttccgtctccggcggatccgactgcgacggtgacgccgcctacgagtgtcccgattgcatcagctcgctcgccgccgtgctactccaccacatcctcgtcttcctccccgtggtcgaggctatccgcaactgcgtgctctcccactgttgggtctgtgtctggaccggcatcccacagctgcagctcgacgatgatgcgtggagggtcgatctagttaattaggttgtgcattatatgatgttaaaaaattgattatgttcagtatgggagcattaatgtgttagattattatgacaattgtgcacaaataatgagtattataactaaacaagtacattgttactgtagcttaattatctaggctagaggagttaattctagaattctgtatttctgtatttctgtcacatgaaagtatcgaatgagaggtctaagtatattttcatgcctttatgtctctagcacaacctttacttgtccctacctaactaaatatgtgactaacacaatttattagttattatatttaaatatcctcacatggttatattacccaccataaatagatcgatagaccagtgttttggtagtacaacttgtgttatactctgattatttttatttggtgacacttcaccaggaatagtaagagcaaaataaatttctacacagtgtggatctaccatattgtttagagctagaactcattgtggaaaagaaacatcacacgctcgacccaaccattgtacaccttctcaagaaaagcaagtggaccaaaaggttttctctcaaaatatgtccaaaggtatgtctattattgtattattgaatgtatgtttctagcaattaaatcgatctatagcttgaatacattttatcgatttacttcgtatatcaaaattggcttttttttttgttatatcactttaattctttatgtatctcagaaaattcatattcatgcgagcccaactgcgattgtcgccaactgccaaactgtagggatcaagagatctcgttgggctcgcttgaagaactagctatcgatggctttgggggcacctatgatgagaagcggttgatatattttatcgtaataaactcaaaagtactgaggaatgtgtcattggttttctccgtcaatcttcactcatacaaatcatttttgcacaatcaacaccagctatgcacatcagagtgcaccatcgagttgaacaataataatttagtgtagacaaaaaggtacacataaatacatggtgccataatggatgtaatagattaccggaatagtgactctggtgaacactcgtgtgtgtactattttggtgttggttatgtctgaattagtcttatatattgccttgtggaacatactctagctatttaaaatgtaagatatgcgcaactttgggatattaaatgttgtgtggcttgattgtgtcttccacactattaatcttatgagcaaaacatgatgattggttgatctgtttggatggattccaacaatgctgaatgcatgtgtttgatcctgatccatttttttcattgttgagctcaaactttactaacattaattattctaataaaaaattgatggtagcaatcttagaaattaaattgaccaaatcttgtcaccgtaaagagcagaggggagtacgtagtacatattgtagctgatcaagagactatatatagatataataaatagagacaggttattagtatgtatctgagtactaaattgacttgttactgtgttttttttatatagttaggcttattttttggcaaggaaggtctggttaatttggttgcgattatatgatattaaaatattcatgtatgggaacattaatgtattacattactataaataccgtgcataaaaattgattattataactaaacaattagtgcattgttattatctgtagcttaattatctaagctagaggaatcaattctagatttccatatttctgtcacatgaaagtcccctagaagtatcggatgagaggtctaaatatatttttatacatgtatatatgtctgtagcacaactttactagtcttaaaatatgtgactaacacaatttagttagctattatatgtaaatatcctcacactgttaaattacccaccaaaaacatatcgataaaccggtgtattggtaggacaactatattaattatactctgattattcatttggtaacactttgccaggaatcgaaagaacagaaaaaatttatacacggtgtgaatctaccatgcatattttttagagctagacctcattgtggaaaacaatcaacacacggtcgccccaaccattgtacacattctcaagaaaagcaggtggatcaaaaggttttctctcaaaatgtgtccaaaggtatgtctattattgtattattgatcgatggctctatgtttctagcagtaaaatctataacttgaaccttttattgatttacttaatttcgtatatcgaaatcagcttatatttttttgttatatcacttcaaatctttttctatctcagaaaattcatattcaaggcgagccctcctacacttgttgccaaccgccaaactagaaggatcaagagatctcattgggcacgctcgaagaactagctatcgatggctttgggggcatctatgatgagaagcagttgatatattttattataaaaaactcaaaagtacttaggaaggtgtcattggttttctctgccgatctccactcatgcaaattgtttttgcacaatgtacagcagctatgcgcatcagattacaccatcgagttgaataataataattattattgtacattaatgcatggtgctataatggttgtaacaaattgactgtaatagcaatggtgaacactcgtatgtgtactattttggtgttggttatgtttgatttaatcttacattttaccttgtggaacatactctagctatttaaattgtaagattctttggatattaaaatgttgtgtgtcttgattgtgtcttccacactttaatcttctgagcaaaacatgatgagtggtcgatctgtttggatggattccaacaatgttgaatattgtgtggccctgaatagattaagttcgttatggaacctgctggatgccctccataagatcgcctgcgtcgacttcgcttcgacatatttgtcattgatcaaggaagccaatcatattatactaggatcttggagttattctcaagcacttgcactgatattctacggatcaaattttgtattaaaccggtacatatctagatctcatcttctaatatattattatgccttcatgattttacattgttagagccaatatatggacttaattatattatggatttacagtcataaatattcgatgtttgtagaacaggattttgtggtcaataaagcttataaaactccaaccattactagcatatatatttctcaaatgcttaacagtatactttttattgaaaagtattatcataatatcgtataaacttattagattttataaacatcctaatatagaattgattgtacgagacttaaaaaaatgataaaatcttgtcctaaccacaaagagcagagggtagtattgtagctgtcgagagagtatatatacataaaaataagtcagcttggctgcttatatatagagagacacgttaattagtatgtgtgtgagtactaaattgacttgttattgtgtttttttgtgtctagttaggtttagctttttgcaggagggtctaattaattaggttgcgtattatatgacattaaaaatgattatatatgtttagtatgtgagcattaatgtattacacattactataaagactgtgcatacaaattgattattataactaaacaagtacattgttattatatgtagcttaattatctagctagctaggctagaggagtcaattcaagattttcatatttctgtcacatgaaagtccatcccctagcagtattagatgggagatatattttcatgcctgtatgtccctagcacaactttacttgttttaaaatatgttactaacacaagttagttactattatatataaatataatcacactgttacattacccaccataaacagatcaatagaccagtgttttggtagtacaatttgtattaattatactctgattattcatttggtgacactttgtcaggaatcgaaagagcagaaaaaatttatacgcaatgtgaatttaccatatatttcagagctagggcatattgtagaaaagaatcagcgcatgcttgccctaatcattgtacaccttcacaagaaaagcaggtggatcaaaagttctctctcaaaatatgtccaaaagtatgtctattattgtattatagattgctgtgagtttctagcaataaaatctatagcttgagtatctttgatcgatttacttcgtatatcaaaatcagctcttttttatatcacttcaattctttttctatctcagaaattcatattcactgtgagcccaactacacttgtcgccaaccaccaaacttgagggatcaagagatctcattggaccgcttgaagaattagctatcaatagctttgggacatctatgatgagaagcagctgatatattttattataaagaactcaaaagttcttaggaagttgtcatttattttttcttccggtctccactcatgcaaaaaaaatttcaaaatctatgccagctacacattagattgcgacattgagtagaacaatattaatttagtgtagaggaaaatgtacacataaatacatggtggtgtagtagattgaacgaatagcaactttggtgaacactcctgtgtgtgcttttggtgttgcttatgtttgattgtccttaaaattgtaagattaattcgtgcaacttttggatgttaaaagttgtgtggcttgattgtgtcttccacacttttcttcttctgagcaaattaaacaatgataaattaatgcatgtgctttattttggtctattttttattgttgggctgaaactttgccgatattagttgttctataatgtcatacatctcacgacttagaattttgatccattcgttctagcatagattaaaacaaaagaagagtgtaatatgcctaaacgacaggcgccagtgtgctgagacgctcgctaacacgccgtacgtctaggtgcggagacatgcaaaaaggacaccggagtcaccatgaacttgttagtcttaacgctcacaggtaacttgtaaatgaactgtgtatgtgccgtcaagtttctcccatatataaaaaaacaaatcaacagaactgcttgttatgtgtggacacattttctgaactgctaaacggtgttttgggagacgaaggagaactatatttcaggggacgaagggagtaacgttgaagagaaccagaattggaaaaagttaacttgagtttcctcatcttatcgttgagtttcaaaaaaattcttaaaccaaaataccaggtatatataacgcatcatattcttacagaactaggtcacattgagttccaaggcatcattgctcccggttttggccgacgtggcagctaagttagcgtgggactcacatgggccccatatgtcagcaacctgttaggtttaattgggtaattgatccatttaaatcaattaaatcaaataaattccaaggctcattatgctaggaattcatgtgaattcattcttttatgggatatcaatgggatgaagagttttgagaattaatccatttgattaaggaattggtaacttatatcaattagtcctaattgatggatggttgatggttgtgtagtggaggatggttcatggctagttgatgagaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagataaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctggaaaggacatgtgggatgcacttgaggccaagttcggagtttctgacgccggcagtgagctgtatgttatggagcagttctatgactacaagatggtcgatgaccgttctgtagttgaacaagctcatgagattcagatgttggcaaaggaacttgagaacaacaactgtgagttgcctgacaagtttgtggcaggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaagtaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggacactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtaaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaaggggtaaagaaatatttcatgacactgatagatgattgcactagattttgctatgtgtatctattgaaaacaaaggatgaggcattgcattgctttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggacaaaaactgttgattgtgtgtttcttggttatgctatccacagtgtgggttatagattcttaatagtaaactctggagtacccgacatacatgttggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgaaaaatcctttggagatgactacattgtatacctcgtggatgacaccccaagaaccatagaagaggcatattcatctcctgacgctgactactggaaggaagcagtatgcagtgaaatggactcgattatgtctaatggtacttgggaagtcgttgagcgtccatatgggtgcaagcccgtaggatgcaaatgggttttcaagaaaaagcttaggcctgatagtacaatcgaaaagtacaaggcaaggcttgtggccaagggttatacccaaaaggaaggcgaggacttcttcgacacatactcaccagttgctcgcttgaccacgattcgagtactacttgctctggcagtctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagaattttgaaatgaaggatttgggagaggctgatgttattcttaacatcaaactacaaagaggagatgagggtgggattacacttgtgcaatcccactatgtggacaaggttttgagtcgctttggatataatgactgcaagccagctcctactccttatgatcccagcgtgctattaaggaaaaaccgaagaatagtaagggatcagctgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatatggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaagcatagtccattgttcagttgtggtcaggtgtagctccttttctaggtgaaagttcaacttaacagtcttcaccgaaacactagtatataaaagctgctatggaatagagagcattctcatgagccttaaaatttggtggggattgttaggtttaattgggtaattgatccatttaaatcaattaaatcaaataaattccaaggctcattatgctaggaattcatgtgaattcattcttttatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagataaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacacaaccaatcctttcccctctcttcccatctcaatccacctccagctcggccaccaacgagatttccgatacatagtggcgttgaggcaactgggactctgggagctgcctcaccgtcaccccctcgtcaacgccaccgagtccgacgagattaccgacaacatagcggtgcggcgtccgtcgtgcaagcgtgtctagcccttgtgcccattgccggctgagctgtaggtggattgagatgggaagagagaggacagaagattgggctactgatatatgggtcccacatcaactcagctgtcacgccagcaaaagccagtagcaatactgccttgggatctaatgtgatctgattttgtaagattagtgatgcgttatatcagctattccggtgcagtgacgattttaaaactcgacgacgagatgagagaccccaactgaacttttcccaccagaattacgggctcatttggtttgataccaatttactaccctaccaaaattttggcaacttcaatagtagcaagtgaatatttggtttgctaccaaatttaacccaccatagttcaaattgaatactactaaatttggtagtgcaaaaatttgccaatgttttgcagccccatcgtttggcctaaacagctaaagaataagtcaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagccattttaggcaaaatggcaaccgatgggagccttggtactaccaagttttggtaggacaaaaattggctctaaaccaaacaaggcctacatgtgaaactcaccaaggatcccggtccgggctagcccaaaacatgcggcccagtagctttagttacctggtgggctaaggcgacttcgcgaaaaaaaatactgggctttactcattagaggctcggcccatgcttagagtaaggcctactcccactggcccacgacaaacactcatctctcccctcgcgactcatcgcgttggcggccgccggacctagctcgccgccggccgatttcgcagcggccaccgtcgccgccgccgcccatttcctcctcctccttccttccgccctgtgtacggttcctctggtattagcgttgcgccgccgtcgccgcctcctgcaccgacaacaacgccaaaccctatgtccctatctcctccgtcagtcgtcgagcgcgcgtcctccgccgattgccctcctcgccgtgaacagacgccgagacctcctgtgtgactgtgccctcaaacctacggtttccccccacagtggccttcaccgatcaattgatccctctccctcccgcacggtcgcacggaggaggtaattttttttttcctttaataggagtatctcgtgagactaatctcttggtggaactattaaattaggttgttttaattggcaagtgagcgtccaattatttttttgtcagcataaattgggggactgctagttgttcatacttcataccaagcaaatcctagagattagaatgtagactcatgattaacaatgccattcatttagatttcattaactacaatcaaatataatggatcccaaagtggctaccattagtatgtaagtaagagtctagtttagaacagacattgagctcctcctgtttcaccctacatatttagctatcaagtttattttataagtgaggtatatgaaattttttgtctaagctcaattctgttgtttaattttatttggacttgaggtcactagaatattttacttgttcgtgtaccatttgatatgagtcacccttcttacgtccgaaaaaatgagacgcctttctctttttcaggtatgtcccagcaatcagacacaccttcatgttcagatgattctgaagataacatcatcgacccagccagcatatacactatagaagaattcatttctgagcaaagcatcatggacaatttgcttgaacggatcactgtgaaaattcagtccaagattgaagctcagaaggctggtacatctcaccatccaaggggtgaacggaaatctttaaacaggaatcatgaagggggccatcaacgacttgtgaaagattacttctctcaagatccaatctatagtgataaacagtttcgtgcaaggtaccggatgagaaaacccatttttctgcgtatcgtccatgccttaggtgaatggtctccctatttcaccaacaggagagatgcctccagtcgtcaaggactctcacctttgcaaaaatgcacagcagccattcgtatattagcatgtggttcccttggtgatgccaatgaaaaatacgtagaaattggtaagagcacagagctagagtgtttggagcggtttgtggaaggggtgatcgacaattttggtgaagaatatttgcgaagccccactagtgaggatatgcaacatatactacaagtgaatgaggcacgggggttccctggcatgttaggaagtactggttgtatgcgttgggagtggaaaaattgcccagttaaatggaaacgtcaccttactcataccgatcatggtgctgctacgatgattcttgaagcggttgcttcacatgaccactggatatggcatgctttctttgctgtcattgggtccaacaatgagatgaaaattatcagtcaacaacagttgtttaccgaggtgttgaaaggccaagttactcaggtgcaattctctgtcaatgggaagcaatacaatacgggttactatcttgctgatggaacatacccagaaggcaatgtcttcattaaaacagtatccctccctcagagcgaaaaggatcgaatatttgcacggcatcaagaaggagcaaggaaggacgtccaagaagcatttcgacttctacagtctcgttttgccattgtgcgtggtccaactcgtttctttcaacaagagattcttgcaaaaatcatgcaagcctgcattatacttcacaacatgacaattgaggatgagaaagatatggccagcgcttgttttgacccagatgaaatttcagggacattggctgttattttatcagacatcaacactgtgcctgctgattcttttactgaagtgctacatagaaatgcttctgtttgtgctccaccgaaacatacacgacttagaagggacttaatggagcatatttggcagcgatttggtccatttggcaaccagtaaaacaattaatcctagtgtggtaatattagacttataactttgtttaattttttgttataactttgtttaattttttgttataacttataatcctgcaatattagacttataactttgtttaattttttggtacatttggctttgtttctaattatctgtaataaatatttgagtattgccgtccagtgacatttaaattatactccattattaaatgtattatgaaatctttcgagattgttcatcctcaaccatggatgttcaggtttgattagtttgtttacacaaaatgtatttcaggtttggatttttttttttttttgaagaaaactaaaatgaattatttacctcatttatttctgtttacacaattttgacctagatgtaagccaaataattagagaaaaattccaggaaaagtcagtgaaggtcaaggctatctggctttaactaccaccaaacagctgtcagcataaattgctacattttcagaaagacattttaaagttgctcccaacaaatcctaggttttcaacagaaggtgagctaacactgtgcatagtatgctctactatttcatatgaagttatggtgttctgcggaagttgtagtttcttataagttctaacggctatttcttttgttgatttattcagtcctcaatctagactggaagttgctaatttgttaaagttagctcttcgatacagctccctgcagtgagttgatcatggtcatcttttttctgtaagtggaaaaaataacgacattacaatttcagcatttatgagtgttgagtttttctaaaggtcctcacatgttctttcagaatttcaacatttagacatatctcatagctagagcaattgaacaatctcatagtctgttatactgactactgaggttgtgttttattcattttcagatatattaccagggagtgcttaggcaggcttttcgtatgcaccttttgaagtactgtaggccaacaagttggaatttttcagcagaattttattgtgcataacagcaatctcaagcaggagttccattggattacctggggactggggtagtagatttccaacataataactagtgatgtgcttctactgtttcttttgtctaagataccaactatggatacgttggttattttgtaaaaatagcatttggacttcaggagcatattactcggtactatgaattatgatgacacttgcagagtttcagtccatatcgcgaccatgattgacgccttcaagggtgcgaaaccgtcctgttttgtgtgaacttctccaagtttaatatggctttgtgcccacatacctgatttgattggtcctaaaagaggatgctagatcagatttaacatttttaatcgcattcctatactcataattctgtagtctggaagcgggaggaccgcacatgccagcctcagagtctactaaatgaattgatcttttttttttcaatagcaatgtaaaccaactaagactatccatgggtctgccaagtcccatggttgaaactacggtatatctcgcgataaccgcacggttagcagtaaccgccaaaccgtcgggtggcggtaaccccagccccgccacctcaaacagtttggtaaaccctagccatggtaggggtaacttccagtatggtttgaggaaatttgtttgaattgaaatttataaaaaaataatgaaaaaattaaaacggggacactattttccctcatgggccggcggcctaggtcatactgggccgtctggattaatgggcccgagggtagtatgtttgcttgctcccccacccctcccatataaagcaagtagggttcccgtctcgctcgcctcctcgatcgtcttctccacctgcgccgccgcagcctcctcaactcaactctcttcggcagcgagcagcagcgccttccaccatggtgagttcttctcctctcctctcttccccgcggcgatggctacgcctgggctagcggcggatgcgcggtgcggtgcgattgaccccgttgttgttttggtttgtgttgttgctaccttggcaacgcagccgaagcagatccacgagatcaaggacttcctcctgacggcgaggaggaaggacgcgaggtcggtgcggatcaagaggaccaaggacgccgtcaagttcaaggtgcgctgctccaagtacctctacaccctctgcgtcttcgacgccgacaaggccaacaagctcaagcagtcgcttcccccgggtccgtattccgttatccactgcctgtgtattctcttcctttcatttttattgatgctgttcttaagtaaggaaacgtccgctgctgtgtgcgaaatcacgtgttttgttggaacgaatcgttaaatcctttcatgctttaggatttaaaaagaatgtggtatggaatggttatgcatgttctttgtgaatttagtttggtctagcatgctaatcaggtggagctgttgataaattggccttccatttagtctggaaattgcattgtgtgcaatgatacccaattagtgcctcccaagatagtcatggaaatcttactgtaggatatgtgcaagtctggaacttctcctgggatgagattgcgcagttgcaatcatcttcctctttgtatagcttttaattgtcatttccatgtattgatgtcagtataaatgtcaaggcgcataagtaacttgcctatctcagagccatagatatgacaattttttggcagagcagaaaatatcatttacctcgtctttggaaaaccagcaaaagtaattacagcactgggcatacctgttctatttcagatcaaatatgctacaaaacaacctactaatcaagtacatcatacttgtctatctggtccagcagacaaagccagcaccaactaaggttttgtatatttttcaaaaaaatgatgcagcctacaagaccagctaatttcatgccttccagatatccttggaccataagctgttcatccagaaattatacacgttttgcactatgtatctatgcattactgttctgctgttcattcagtacaaaatttctttttgttcaattgatcatcattgctaactcaatgattgtgaatttctttcttcaggtttgactgtccaggaggtttaagcatcaaagccagaccatgctgtttgtagcagcaggattgcttgctcccgttcgcattagtagctattagatgctgaaattttatctgtcttgagttttgaatgtaacacccaaagtttatgtgctgaaccttcttcgagtcagattgcgctgttactcctttctggagatagctaccagtcgtactgtccctaaacacactgaattttgctccatttctctctaattgctggagtgtttcatatttgttctggagtgtttcgtatttgttttgaaccctggattgttgcctctgagattgtgttgacacatccacacgtgagagcatgaacacagtgacacgtgagagaggaagaacgatttttgtggtattgctggaatcttttcggcttgcaggttcttaatatctcgattcttcagttggaatatctgctgcttggtaggtcagttacagaaatcgtggtgtgacgatgaggaaagccatctgtgggctatcctatgtgtgcagtacttaacaaccgtgcagaacttgcgttcagattgtatttgcggcaagattgtcacttcgacaaaattttgtagaaccaatttgtccttcagttttggttcatgtgctattcatttcaacttctatgaaatatgagcaaccaagaccttgaccagcatacccataattcatctatttcaaccattggttacattgctttataattttagtcggtagcgctttattgacgaagttgagtcttgaagaacctatcaaactaccaaactgagtttaaaatggtctttaagattaaaatttatcatggactgttgattttttaaaagtaaatttaaggttgtactgtccctaaatatttttctcttacattttttttggcaattatattgttattactgattaatctccaccgtccgatccttatcatccccttcccggctacctccatcatccccttcgccagtcgctcgcttctactcccgcctcgccttctctccgccccgctccgctcgccggcgagccgccgccgccgccccagccccacaccctcgtcggcgcgtcgcctaccggtggccatcttcgcccactcccgctccatgtcctgtagccgaagtgcggcaatgattgactgcccgcggctgctcctggcggccgcgcgcgcctctccgtaccccagctccgccgctcaccggagggtctgcaccgccggagtccctcccgtacccgtatattgccgtgtcagccaccgccgcaggtcctccgttcctggtgagcttcggttcttactttccttgtactcgtgcaagtattgcaggttttttttcctttttttttttttgcgattaaactactcgtaccatacttgatgttagctatggagtactatgcataatgcaagaatttcttgttttgcattgtgtgcgaactcgacaattggaagagatgctagcttgaatagggaaaaaatggtttcattttatgctttagttatcttatcctctggatgaaacattgacagacttgggtcaacacagtgcaatctgcatcctctgggtcaggaagccaatcaagcgttgcagaaagttcggaggctaccgaatgggccatgcagggtaaccaatttccccaccacattctcaaatcaggatagcagattgtgtttctttcagcccatgagaccatgaatgccagggttttgatccttatgcttagaagttggtgacagatttctacgctttgcggaaggatgtcgagctggctgtagcgcgcgtcagtgaagtcaggcagtctgctggtttggatcagcttgaggaggaaatcgcttcgctcgagaagaaatctgcagatagttccttgtgggatgatccttccaaggcacaggagatacttgttgctctgacagaggtcaaagacagagtcaagcttctcaacgatttgaagttgcaggtttaaccaacttgatattcttcttcatcccatactagagatgatacagaatgatgtagaattctaattgttattatactatagctatatatattgaaatgattgtttaacacctcctgtagtaaattagtaattctcattattataatgtggatttgccgcgttcataaatacaagtaatgataactaataaaaatatgtaccccctccgtcccaaaaagaaaccaatctaggtggggatttaataccactgtccatatttgttgtcctaggtggtgtgtaatcctcacctaggttttttttttttttttggggacggagggagtacagatttgctgcatatatccatactacagctgagaattgacagaggctatccattttggttgaagaacatgacttctggaattaattggttaccaacactagttcttaattgtgtcctttccattgttatttacaggttgaagaagctgagaccattgtaaagcttactgaggagttagattccatagatactggccttcttgaagaagcctcaaagatcataaaggcattaaacaaagcactagataactttgagatgacacagcttctttctggaccttatgacaaggaaggtgctgtgattaatattactgcaggtgctggtggcaccgatgcccaggtatgctttcactaattctcatgcttccttcttagctcacaatgtaggaaagatgatttttgtcttagttttctaggatcttatgacttgttcatttagtcttgttgtgcttgtagaaaatttagcttttattattgtcgatattatacttctagtaccaaatatgtaccactgtcataactttttcatacatgtcctatttctatctgttactgtaaaagacgacctaacatcagctagaaaactagtgcaaatgtgaatgtatgatatgataatgaccttcttgatgattattaatccatagtgtacataactggatttccaggtgtcaggatttaacgcaaactttatatatgtagtagtatatgtaattctaaagatgtgcagttcaacttacatgagtttatctcatataagaatggcgatagatgatgtttcgtgtttttctggagaaaaaacatattgtagaagagcaagttgtgattataatttttttaatggcttatatttgtaggattgggctgacatgttactgaggatgtatgttaggtggggagagaagcagcggtacaagacaagagtggttgagaaatcccctggtgaagaagctggaataaaatcagctaccattgaattagaaggaagatatgcctatgggtatctctctggggagaaagggacacacagaattgttcgtcagtccccattcaatgctaaagggcttaggcaggtatgtgtagtttttcagttcctcttttgcgattcatatacatattctcgcaactttgaaaggaaaagacatctactcatgctcagttttctgttcaatgtgctaatttctttagacaagctttgctggtgttgaagtaatgcctctactgccagaagagtccatggatgtagaaatacccgaagaggatctggagataagcttcactagagcaggcggcaaaggaggccagaatgtgaacaaggtggagacggctgttcgcatggtccatatacccacgggcatcgctgttcgttgcacaggtttgtactcaaagacagtcagtgcagcttgcatgatgtgtcatatcttcgttagggctgtggatctgaatatctgctaattcttggctctatgccttcacatatgttgcataaataggtagttttgtcatgtttgggtaagacccccaatcttagtttgatatgatgtggtcatcaaaagacccaaaaaagaaaaagtgaaattggtaatcgttgaagtaaagtaaagaactgagcaagacatcctccaaatgattgaagcctcataatccctcgttgtgaccatagttaaatgtgcagctaaattcagttttatcacataaacaccatgacttaactgtgtacctgagaatttgccattgaaatgtatttgcaattttgcatcaagaactgtagctacatgagtaattttccacatcttttccttgcgaaacctcgcagaggagaggagccagttggccaacaagataaaggccctgagccggctgaaggcgaagctgctggtgatcgccgaggagcagcgggcgtcggagatcaagcagatccgcggcgacgcggtgaaggcggagtgggggcagcagatccgcaactacgtcttccacccctacaagctcgtcaaggacgtccgcaccgcctgcgagacgtcggacatcaccggcgtcatggacggcgagctggacaccttcatcagagcctacctcaagtacaagctctctgccgctgctgaggagcaaagcgtcaagtgacagatttgcatccagtgtccgatgcaacaaccgtgcttgtgctataggcgcagaattttgatgcagagcaagaaccccatcacgtagtaagcttgtaagaatagcctgaaattaaccgtgcagaattcggtttgcttggctctactaagcacccaaattttattttggggcttcatgtattagtggatatattaatttcatttctacccaatatatataagcctctcacctgcctgacgctctcatgccatttctcattgcaaacctagagtcaggctagcggtccatgctcaaaaaggttactctacagattgaatgctttggaaccatttgaacttctctctctctctctctttctctctctctctctctctcatgcataaatctctctctctctctcttatgcataaaggccgagcttagttccaaactttttcttcaaacttctaacttttccatcacatcaaaacttttctacatacacaattacacaaacttccaacttttctatcacatcgtttcaatttcaaccaaacttctaattttggcgtgaactaaacacacccaagctacaatcagttcaatttgctcaaaacatgtgcgaacagatcatacgttgttcaaaaacgctctctcaattccctaagagcaagtttaatagcatagcctactacttgctccaattcatctatagccaattttatagccaattcatacaatagttgcttactatattattaatacatggtcccacttgtcatacacacattgcgtcttggagtccgtgctgtagctggctacatatttgtagcccactgctcttctctctcatcttttatctcattaaaatatgtttatagctggctaatagtctgctattgtacttgctctaacacgcatccaatccgcattcccaatccgtttggtggacggaggacggcggtggcggcctccgcagatgggactacctatacatttgtcaacaaattttttcccaaaaatttaacagatgtaattatagtacaatcatggtgtaattacactgtaacttatatgtaattacactgtaaattgcatgtaactacagtgtaacttatatgtaagtttcacataattttgaatcattagatctattacaagatttgttttggtgaggaagaaaacacatcatagcacacacatatgtgaaagaattttttcccacgacctccattttaccgaaataacatgttacggagagatttttgaaagttacatacaagttacactatagttacagtgtaattacactacgattgtagtgtaattacatctgtcaaatttctggggaaaaatttgtcgacaaatatatagcaaaatcgccgcagattaatgttaatgggccgggaccttttgggctcatcaggcttcattggacaaatctggcccatttaggtaatcgtgttatagcccacgttttcatgactgggctggaatctcgaggcatgggccacggcccgctttgttgaacagacaaattcaggacagggcttcgttttgacttttgagtgtgtgtaaaatagggatggaaatggtggaaagaaaattctcgactgatcgagtatcgatttttaaatacttttctctaaattatgtcaacatcatattagagtcgtcactaaatagttaaattcatagatatgaaaacttctcgaatcctgaccaaccaataaccgtttccgtaggaatatatcatttccactctttggaaaaattgtagacactagttgtttaagtgaaaaaaaaagatccttccgagataccgtacatcccaaggtgttttttcttccttttttaaaaaaaattcccaaggtgtattgttatagtagcagtgcatccagctaaagaaaaacaaaacattgaatcaaccttattatttacatagtgcatctctgattgtgcagtgaagattctgcagacatgctgcccatgtagcaagacaaacaggagtagtagtgtttttgcccataacgcacacagcaacggctggttaataattttaaaaaaaactgcgagattccattccaaaacctgaccagtttactcccctcttaaacaaatcatggtggtggtgcatgctttgagctgctgcaaccgtttgacttgatgagcagccaggacaagtgtggtgtttgctccagatcagacacatccatcagacagcaaggacagcaagtaccactattacttcttaactcgtctgctcctgcaagattagtactcctattagatctaaccctctggattagtttaggctttaacccgaccaatgtacttaactacacggtgcagccacactgtagcttagctaccatccagtgatggagagatcaggaatcccactgacagtccatgcctccccgagcacgaattccgaggcgtctctagacacggatgggccagcgtttacgtcacctgcaatttgtgagaatctcaaagccaccactactccttctgtggaccaatgcttcagcaattcagcactgtattggtttactgctactactacctgtctggtgtgtgtgcccatgcctattgccctcttgcctttctgctgctcctgcttcagaagagttcagaacccaaggcaagcaatgcaaggcaaaggtaccaatgttttgttactaattactgtagtattactccttgttattaaccagggtagctgcagtagttagttaattgtagttgatgacttcccaagcaatattggtctctctttgggtctctcaaaaacatgtagtaaaccctagctagcccctaggatgctctccttgactagtgtggatgcttcctataagcatggccttggtttaggagtagaacagcactactgtcagtggagtagtagtcacttgcaagttaggttatgtgaccaaaccgttgttttcttgctgtgttttccttgggagtaatgcagctgaaagcctgaaagcctgtgaaacctattggcatttcaaaatgggaaccttccatactctcacactggttctacttgtagcttagcactaatcaaatactgacatgatgcttaattatctagtgtgtaattgcctgttcaatatatatacacaagttggcacatcagaaaattcagaagttgcttcttcgcatgttgcctactgctaccagcagcagcaggcgtatgggttaactgtcaacatgatgcatgcatcttcaatagactattaatacttgagttgcctgaaaaaacagattagttaattaagtaacagcgatatacagcgagaacaatcagcaggcaccaacatctgaactctgaagaaattaattggagaacatgcttgtaaccaaaagaaaaaatacagcatgtagacatgtagtagtgacctcttcatcttgatctgtacagtactgacgacttctgattaacttaatcgaagaacccaatacgccactgaagtcgtgcaagctttagctttgggccgacttatgaaaaactaattaactaacaaacaagaaacctttgcgtggtgcttatccccacacatgacaaacatgagtgtgttcgaaggaatcataatcttaattgcatcactcgagctacttgcttaacatctctgatccttatctccatctggacaaatattaattatttccagctaattaattgatctgctattttttttctaattaagcacagagatgaagcctccacgatatctgcgttttgctcttggattttgcagcgtggttaagccgacgagaggagtacaatctaagcgattactccctccatcctataatataaaggattttgagtttttacttgtattgtttgaccattcgtcttattaaaaaaatttaaaaatattatttattttttttacttactttattatccaaaatactctaaatacaacttttcgttttttatatttgcacaaatcttttgaataaaacgagtagtcaaatagtgtaagaaaaaaactcaaaatcccttatattataagatggagggagtatttccttagaatcttagcctcctgcatgccttttgcacgtgcttccgtagtcccgtgtgcttgcattgccaaggcttaaactaatgcggtcaaagctcacaaatgactcaaccgagcttagtttgcttaggtgacaacacaacaaatgaacaaaatgtctttgaaacttaagtgcattgacttaaaaaaaaacacggtaattatgtccttgctccatggatttaaaaaaagaggaagagctgagaacgaacaaaactaaaggacatgttgctttgaactgcgtgctgatgaattagatttcaggcagggtacggtgcatggctagcaatatggaaatgatcatgagtgtgttttcttttttgcttagtaagatctggcccatgcaattaaaggaccattcacaaaccaaagatatataggtaggagtacatatagtagaatatatgggtccttagtggaaaaagcatgatgttgtcatcctcataatcccctttagcaatcatagagttttgatggtctcccatgtatggccagatggaagagaagctagctagctaaacctggtagccaaaggcaacatgcatttcgcccccaccaaaacgcaccttttattaaaaaaagggttttgatttggatgtgtgtatatgagtatatcatgttcctttttttttcccattgagctagctttatcctcctctgtaaagatccaaaatgagaaactaccgttaatatgttaccaaatgcaattgcatatatagttttggatgcgtctaccaatgcaatcacgtacaagagcaatgagcaataaagggcatcggcatcttttcaccatgatgctaattaatatgtgagaatttctacaaattacactatttagttgaatgcaccaactagttcatgtttaaaaaattaagctgatgaaaaaaaaaacaattgcattgacactacatcaggcctgtttagttcccaaacaaaaatttttcaccctgtcacatcgaatgtttggacacatgcataaagtattaaatatgaaaaaaaaaactaattacacagattgcgtataaattacgagacgaatcttttaagcctaattacaccatcatttgataatgttgtgctacagtaaacatttgctaatgacggattaattatgcttaataaattcgcagtttttaggtagaatctgtaatttgttttgttattaaacaacatttaatactttaaatgtgtgtccgtatatttaatgtggcaagttaaaaaatttcgttcacgaactaaaccgggcctaaatgtcaccttttttttttgtcgacgtcgcatgttgatttttgaagcatgggtgatcttgagatcagatattctgctcagtcgctccatcaatcaatctatcaatcaatgtaaaacactaaccatgaataggcataatcagtcttgcacccccccccccccccctattgtcgttgatatccttggctcagatagacttcatgatcagagcagctagctagtaagagcagctacgatagcaggctataagccagctataaatatattttaaagagataaaagaagagagaagagtagcgggttacagatctatagtcagctatagcaagggctccaagacataatatgtgtatgacaggtgggaccaggtattgatagtatagaaagtatctattgtatgaattagctattacattggctatagatgatttggagctagtagtggctatattattaaacttgctctaaaccaccgtatccttacttaatttaacactcgtagacctcccggttatattagcttcgttgtcactcacaacccccctatacctctacaactccgtatcatctatctgtctgattaatatgagcgcgctataattaaagctgtgtttaaatctaaagtttggattcaaacttcaattcttttccatcacatgaatatatcatacacacacaattttttagtcacatcatctctaattttaactaaaatttaaactttacgctgaactaaacacagccttgtactgtcaatcagcgtttgtcttcagcagatggacacttcttcagaatgcttgactcctctggcgccagccttgctcccgggtcacacgaatgcttgacattattggcgagaaaaaaagggaaaaaaaccggatgccgaccgctctacagagtattttaacagggcgtaggctgacatctcatctcatcgtaactgacgaggatcgtgagcatgaacaggtcgacacacagtacatccgtcggctgaagtacctgcatggcctttgccgtgcattaatggcagaaattctcatgcgtctgcaccgctacatgctgcacgtacatgcacggcaacttccttctgctgctgcggtgctgctaaacgatgcacgaacagtgccgcttagctaagctggattttcaaaatatattttagctctttttcaaaaacttattccatacataaatctttagaaaaacttatcgaaggaatccactctttttctcggtgccaaggttcaatatctcggtgccaatgacacggacaccaacaccctcgtatcccgtgatagttaagtcgctgacatcaagaaaatcggcgtaaaaaaactaaacgctaaagatttgtaaaatatcttttttagaaaaagaattaaaattataactattgtactttttttttcttataaatcggtgccatcctgatttgaaccactatgcgacgagaatgtgtggtggagttaatgcgcgcctcatcgtcatcgtccggcgcagcatccgctgggcgcccggcggccgccgacttcttgcattcagtcggtcaccggctgaggccacgcacgtcgcactactgtttccacgcctgcctgaatacctgatgatgatgcgcacgccgatggggaggcagaatcggaggagaagtacaaccagatcacctgggcatcgcggtaccgtacgtatatgtacgttccccggccaccggccagaacaccggcgactgcagggtgcactcatcagtcatcaaaaatcaaaatggatcgacgcaccaattaaacacgtaccgatcgagcagagatcccacatgaagttgtcctgtacgtataattgtgtctgtttatttactagtgtcgaaaaaatagagtcaatataaaaatagctgaaatttaaaattttaaaaaaaatattgaaagaagaggcaatagtccatataaaaatttagtaaaagttagaatatttttttaaaaaagctaaaagtagagcttagagtacaaatagaaatacaattaagaaagaactaaaatttaaaaaaaaagattgacacgagagtctagagtacctattggaatataatttagaaataattggaattcaaaattaaacgataagaaatattgaaagaagagggtagagttcatatagaaatacaatttgcaaataacagaaattcgaaattaaaaaacaaaaaatattagaagagtagtctagagtccgtacagatacgatttagaaataactaaaattcagagtttaaaaataaacaatattaaaataaaggtttagagtctatataggaataaaatctattatattattaaaagaatagaaaaaggagcctccacgttttcgctctcatggcctagaaattctcacattactcggagaaaaagaaaaagcagagtccatatagaaatacaatttagaaatagctgaaattcggaattaaaaaataaggaatattagaagaggagactagagtccatatagaaatacaattaggaaataactgaaattcggaattaaaaaataaggagtattagaagaggagactagagtccatatagaaatacaattaggaaataactgaaattcggaattaaaaataagaatattagaagtagagtatggagtccaggttagaaatacaattaggaagtaatagaaatttggaattaaaaataagtaatattagaagtagaatatagagtccatatagaaatacaattaagaaaaaaaattagaaattcagaattaaaaaacaaggaatattagaagtagagtataaagtccatataggaatttaaaactaattaaaatttggaataaacataataaaattaaaagtagagtttagagtccatataaaaatacaatttacaaataaataaaattcgaaattaagaaaaacatgggaggaagagtttaaagtcaatataggaatacaatttagaagtaactgaaattcgaaattaaaaattaaagaatattgaaagatgagtttagagtccacatagaaatacaattagaaataataaaaattcagaaataaaaataaataatattggaagaagagtatagagtctatatagaaatataatttacaaaaaaactcggaattaaaaaaaaagaaatattaaaagacgagtctagagtccatataggaatatttataatttacaaagaactaaaatttggtattaaaaataattaataactaacacgtatataaaatacaatatgaatattacacattagtagttttataaagttattgcaaaatttaaaattatgttgtcattttaatatatttgaataatataatgagaaaacaaatatgctattatatgagagaaaatataatgatgctagccgcacaatttgcgtgggacaccatgctagtttataaataaaggaactttgaaatttaaaaataaggaatattagagaactttaaaatttaaaaaaaatattggaagagaagtctagagtccatatagaaatacaatttagaaataactaaaattcagaattaaaaataattataaccatcacgtatatacaatacaatatgaatattacttattggttagtttggtcaagttcatgtagaatttaaattatgtttccattttaatatatttttataataaaatgtgaaaaatatatatgttattatataagaaaaaaagatactagccgcgtaatctacgccggccaccataaagttaaagtaatatatatggggctgaggggagggagaaatcttaaaaatcagtattaattccatactgtttcgttataaaaacggacgaatcatatatacatgtctagggtggatggagaggccgatagtcatttggttccactgaagaaaatgaagctattgtgttaggagcggattatacatcacgccttgattaagcatagtagtagtaataattaagtagcggcaagtacggccaactgctgtcggcgccggcgcgtgatgagggatcgatggatgacccgtccgtgtacaagccgttcgacgtacacatccggcgtaattaccttagctaaacatcttgaccaaccacgtaatcactagcttttccctaccacagaaaaaaaaactcataatcctgattgtacgatctaccgatttaattacatctgcaatcaaacagaacatggataaatgaccaaataatgagtacatttatatatgatctctattggtgttagtaggagtattttactactcgtattattatcaatcaaagatatctaggcggtttatttatgagttatattgatatgatccactagactagctagaaaagatgaacaatttgaatcgatttctactatccataaactccattgaatatctagaaaaataaatcatttggggagataaagattcgccatgtctgttgctgaagagcaagaaaaaggtccactcatgaacatgaagaaaccattggccgtagaccacaccgagctggccatggacccatggtggtaatgtgccggtgtacgtggccgtagtccacagtgaacttggtccatggcaccatgcagttttttttttttggcagggacggtgtgtgctgtaaagatcacccagccttttttgaccatttgagtatggtgatgacctgtgtaagatttgtatgggaaaaggtggtttgtcatggctaggtgatgagcatctttggcccctctcctctcctctgccaccctgccaaatcctactgcatctttgattcatccatctgtgactgtgtgtgactctctctctctctgtgtacagcaccaggagatgtttcttcttagataatgataaaaactggggacaatccactcataaattaaccaacagggacagtactgctatacagttcgggcaaggacatgctttgtgttttatttccatggaaggacacgtaaaaccatgtgcaattaactcgtgttaattactaacccatatgggttaaggacgcttctttggtgtgaagatcataaatggccaggtcatgtcatgtgccgttgtgtttcttttttttttttcagaagttggatttggattttaaacctgtggtgagcaaaaaggaaatggaaagtttttgtcaggcgcaccgaagcacaaaggttggcatagaatctctctgagctttggactggctatctctctggtgtagtaagatcaacagcatcatgtagtaattggaagcatggcacgatcaggacaagcatgtgggaggaagtaataaattactaatgctagtaatatattccctaatttatttggggttagacactgtatactcctcctttaacccttgttttattgtctcaaagagcatccaaaaagctcatcaagggggaaaaagttcctaagcctagaaagtgactcaaatgcccatgttcttttaccactaagctagtagccatatcagcgctgtcagagctgtccttgctttctaaacactgtaacagcatatttaccgagttgattaatctgcagattacaagtcaactgttcccctgaaccttggctgccatgatgtcattgtgcctttactgatcatgctttacactgcacgtctggtggctaaacaagcatcttaagcaaggacacaaacagaggactttgtttattgctatggcttaatctttctaggtcttgtgtgacctctgagaatctatcttgcacgataaggtcatagcataataataataattagtccaccataaacaattttaagcatctggaatagtacttgccaaattgtgttatgaagaagaagttgtggtattatagacttttagttaatctatattcacaatctatatgcattgccatgttcttcagagttcagacactcccaattttcacagctactagctcttctctccagtgaccaagaactgatgcatcatcataatacacatatggaaaaaaattgagaaaaaaaatgaagagaaaaaaaaggggcaagaatgcagggatgaaagaaccacatctctgcatttgctgctactcctatgtacaatcagtatgaaacgagcttcaagaacacatccggggaagtgatcttgaagcagcgcggcggccggcggcggcgccgccgccgcctccggtggctctcctcgccgccttcatcttgctcatctgcgtcttcatccggctgcacaccttctcgagctccatcacccgccagtgcatcccgtcgaggagcgacctgagattctggctctccagcgacaggtcgagcctcccggcgtacaggacgacctggccgccggcggcgacgaggtcgtcgtggtcctcgccgccggcgcggtgcttcgccgcggacaccggcctcaggtgttcgtccgggccgccgccgcggaggaggctcttgagcaccgtgtgctgcgacgccagcgcctgcaccgccgccctcgtcgggaatccggcgttccgggcgaggtgcttgcagcactccggcgagagcttctcgtagtttatccccttgcagatcctcatcttctcctcctccgtcagccgcgtgtgaacctgccatgatcgaccaaaacaaaacccattagctttcagctagtagagcaattaattaggaaaaaaactcaagctaatttagcatcttaatcagcaggattaacagcactgacagtgacaaaagtgccaaaatcttaagcgtccaggacaatgaccaactttttttttttcttgagacaactcgatcgtttcaggcttcagagaacattcagaagccgatgatgcataggattcagaggaggtaggagtagcaataaaacgcactagtagcaattaatgcgagggtgagtctgtgaaatgctgacaaaatcaagaacagtgctcgctgtcgaggctaggcggcaccaaagatctgagtaatttacctggaagtagacgtcgatggcgcggtaaagcgcgtcgtggcagtccctcgccgcggcgggcagcgccgtggcgagctcgacgaacatggccgggcgcagcgacgggtccggggcgacctcggcgaggtacaggtcgacgagcttgcccaccttcttcagcctcggcgtctcgccgcgcgcgccggtggcggcggcgtggtggaggaaggcgtccaggaagcggaggacgagggtgacgtcgtacaggctgctcgtcgtcccgggcggcgccgggacgagcaggttgtcgagcgtcgcgtggtcgagcttggcgccgatcatggcgacgaggctgtcgtggcaggaggtggggagcttgagcggtgaggagatgcggaggatgccgaagaggcccctgcaggagaccgagctccggtcgaggccggacatggcggcgatcgccgcctcgagcatcgccctcttgtcgtcggcggtggcggcgccggcgacgcggcacttgaggtagtagaagaggaaccgggagacgacgccgtggtcggtgcccctggcgaggagcgccccggggacgcgctccaccatgccggggccgaggacgacggcgaggtcctcgaaccaccaggtgcggctggtgcaccgcgcgctgaggcagctgctcttggtgtcgcacgagaaccggaacgccgagctctccggcgaggagctcgtcggggtggcgtccccgggggagacggccacgtgggacaccagcgcgccgacgacccggtcgaacacccccgtggcgtccgccgtcggcagcagccgctggcactgcctcacggcgtccaccacgctctgccacgaccactgcggcatctcgtcgagagccttctccgtcatcttcaccaggctcggcggtgtcgacacctccgccgccgccgccgccatgtccatgaactcagccgcgcaccgcagcgcgcacgcgttcgacgcggtcaccgcgacgccgccgccgccgccgccggtgtaacagaacctcgcgacgagctcgaatgcctcagcaccgccagggaacccacgcaacacgaccctcgccgccgccgcagctccgaccaccccctcgccgccggcgccgccgccacccaaattcttgatcctaccacagaacggtgcaagaacctcctgccaaaattcaccaaaaccacgaaaacaaaacacaattcaggacaaagaaaccaaacaatttactcgtacaagaatcaaagaacacaccagcctaatctaacccatccaattgactcccaaaatcaatgcgaaacgtcagaaggaacatgcggtttatgctcttaaatgaggaggtaagctggtggccattgccatgcagcccaccaaacgccattaaaggcctcgcactcactgacagaggcgaagcagatgagctgtagctattaggccattaactccggggaagaagaggaagaggaagaagaagaggaaattggaatggaacattattttactcgcctaattgctgcgagctctcgccattggaggaaggagatgaaccaaaacgaacaagaaaccgtagcagcagcagcagcaacactcacactagtactcctgcgccattaaggaggaagaagaagaagagatcaagaatggctaggcttggcgagctggctgctcattgatggcgatggcgaaatggaacccacaccgcacttaaatggaagatcgcgacgtcttcctcctcatctaatctctgaactcgcagtaaaaaatgtagaaaaaaaatattcagaagcagctgggggtattaacagcagaattacagggagaaattcagattaaccgatgcaattaaggcgatgatgatgaggattcaattccaacagcgtgtgtacaacctgacaggcttgcattcgcacgaacctgtcccactcccacaggagagacaggctacagctcaagaacaaaattacagcaagaacaagcgatgaggcgacagacaatgcgagcattttatagaccaagaagaagcaaatcgtaactacgaattcgaggttggtacatgaaacaagcaggatgtgacaagccgcacgaaatccaaaatccgacgactagggatcaaggagagaacagcacaaggggataaaagcaaagaatggaagagaccaaaattgggaaggagatcgcgaggtaatgccaaaaaaatttggggactacctgaaacagttttggacagaggaaacaacaaatgctaggaattgaaacaggctcaattccagcaggatgtgacacacttcctcactcatccccaagaacttggtggtgaaacactagagaccagaagctagagtacagaacaataatccccagacgacagaggcaagctgtcaacctaagaaaggaaaaaccaacaacaagaacatcaccatcgtcaccaattcatcatcttaggatgagaagcagcagaacagagcaagaaaagaagagaccttaggaagaactgcaagaagaagatttgttgctaccaagaaggaagaagaactgcaagaagggaaaggaaaggaggaagaaccttatcaacgaggaagacctcttcaccatccacatcaacctcaagaacacagcccatcgtcctctttttgttgccacacaccacagcagcacaccacaaaacaaccagctttaaagcaacatggcaaagaagaaggaaaaggctgcaatgatggggatggaagcagtaacacacacaaagggatagatggatggcaccacccccaaccccaaacctcctcactcacagagagaaaagcccaagcttccaaatggctaaatgctcaacaatggcagctgctctggctctgatgagtggtcaatggcttgcaatgtgagagagagagagatggaggagaggggccagccaaagaagttggtggatcctgagctctactgacagcctctgccaccctgcaagtggagagtttgcagggagagagctttggggaatatgtaaggctgggttcttgatttctccctgccctttacccaccttgcacattgcatatttgtgcaatgtgcctgggtactattcacagtcaagaaatgggcaacagaagaggggaattttcttttcttataggggaggtgtaggttttgtgtagagacagaaaaaaaaaatgcttcgcttgtgctgagcatctgagttggtcatttccatgtgacactcggatacctgattctctgatgtgagataatctttgcatcaactggggcaaatctatatgtttcgcgtgaagaaacagtgcactcattctgttgccctggatgaatttgcaccgagtattcataaaattattatttttagactggtcaccggaggagctttccaacctgaatttcggccctgtttagatccgccagttttgccattttgaagcactttttaccattttgaatctaaacactaataacaaaacttgacaatttgacatttgctagtccatagtggtaaattgtgccaaaaagtgctttgggaccactccctctctctttctctctctcactttagtgctagaatggcaaaagtttaggaaacatctaaacaccaactagtaattttgtaataccaaaacttttaccatttaccatttgtcattccaaatggatctaaataggcccttcattaaaaggagaaacagtacaatggtttagttcgttacattggaatgcaaaaggaggaaagaatttctttccaggattctactactatcatgatgtttttccagtatttataaaattataaacacaatatatggtctcctgatgttttttttagaaaaaaaaacacaaaaagactagatcaacatatcttaaaatttataaaatcatcacagatgtctcgttattgataagtatgatacgtaccaaaaaaaaaataattaatatcatcataagaatcctatatccgtttaaccgttaagttacgcttatttcacggtctcttgatgttttgacatttctttaggagcaaataattgtttacaaacggataataaatgtttgttttcagctttacaagactgacggaatgacacgccttaagacggcattttgatatgtaaatgaaaagaactactactccagtatcatatagtcggccggtttggtgtgcaaactactactactactcgtcaagatgccctttgtaggatcaaatcattatgtcatgtggttgttaagctaggcttcatgcaccgatttgcatgaatggataagagagatttttgttggatcaaatcctcgtataaattaagctagctttcttgccaagattcgcatgaaaggagcaggggagatcttttataggatcaaatcctcgtataaattaagcaaggtttcttgccaagattcgtaaagtatgaaatgaggaagaatggaactttatgcccggaattttgggaccatttatttagcgcttcatttgaatattcaattatttattagtcacttttttttaactcatccattcaccgcactttaatttcggtaggggggaacaaataatgttttaacttcgagtacacaatgtacactttgcttaatccgcaccacatggaatacaatttctaatttgggaaaacactacagtataatacaccattttttcaacaggatgtctataatatatattgcatacactttatcctcggttccaatttttctccactctctgactttccttgactctctgaggctactattcctcatgaaagatagtgcaatgttcaagtgcacacagagagcaaaaattagggcctgtttagttggcaaattttgccctggcatatcacatcgtatatacgggcacacatttgaaatattaaacgtagtctaataacaaaacaaattacagattttgtcagaaaattgcgagaagaatttattaagcctagttaatctatcattagcaaatatttactgtagcacaacattgtcaaatcatggcgcaattagacttaaaagattcatctcgcaatttcctggtgaactctgtaattgtttttttttctaaatttaatactccatgtatttatccaaacattcgatgtgacagtgtgaaaaattttgtttggaactaaacaagtcctaagtaagtacacaagatgatatgttgacgaaataactagtgcgtgaacgtttacgcgtctgggccgtgcgcgaatacccgtgtttttcttttttatcatccatgtgacttctttttttttttggaaattttaaaaatgatatgaactgtaaatttatttcatgtttatgttagagtaatttattagaaagaatgggttttgtttgcagtaagtaacaatgataatgacgagaaattgagaactattgaattgccatccaaggtacgaaaaaagtggctttttttttttgaaaatttcagccgcctttgatttctagacatcccaatttcttatcccagacacttaaaaatcgatacacgatgatcctgaaacgcctgtaaacactgacaaaagcccacgaaagcttcacaaaacaccgaggacacacacgtgctacattattaacaatttgaaacaacaaccgttattatccatggtgttagctccaaaaagatcattgaccataccctggcctcaacaaaggaagcccatactctgccttgaaatagtgtcgaggcagatggtctgccggtctgctctctctgctttacattttgacagcgtctcgtctacctccagaggatccgaacccccgaagaaaaaaaaaaggaaaaagaagagtatctagctactatttgccctgtcaaccatcctgccagatggccacagagaagaaaagaactggcgatccttgctggatcgctcctgccactgtaccacagtcggtaggaataagtttactttaggtccttcaatttgttctcgagtctaaaatttatcgtagaatcataatactgtacactctctccgtttcagattacaagatgttttgactttggtcaaagtcaatctgcttaaagtttgactaagtttatagacaaatatagtaatatttacattaccaaattagttttattaaattaataattaaatatatttttataataagtttatcttgggtaaaaaaatattattatttttttctataaacttggtcaaacattaaacagtttgactttgaccaaaatcaaaatatcttataacctgaaacggagggagtatgatgcattccttaactctcaaaaccaatgcaaataaagtcctaagacagtttggacagttggttcggcttacgtgatgcctacgtggcacttaagtcgaaaaaaccgtgagaccaacatatcaacagccaacccatcttcctcctcctctctctcctccctatctctctccaggccaggaacaggttgcgggcgacaagcgacggcggacggaaggcggacggtgggcaacaggaagaggtgtggtggctatggtgggttggaagggtcgtagccatcacagggttggaaattctggaacgaaatttcagaaatttcggaccacttcgatacgatattatttcagtcgaaattttttaattttttaattttccgtgtgttttggtaatatttgttcaaattcaactaaaatttgttcaaaatttcggaaatttcgttgaggtccgatcaaatcggctaaacggaaatgtttaaccctgggccatcatcctctttccttctcttgttcatctctttataggccgggaggcgcgtggcagaggcttggagagagatagggaagatagaagagagaggggggagagagagagagaggaggaagatgtgttgactgctgacatatgggtcccatggttttttttttgtgacttaggttccacatcaacgttacataggcgccatgtcagtcaaaactgatgtctaaatcaccttaggaccttatttgcactgatttggaaagttgatggatgcatcatatatggtattgcggttcaccaatgaatttcaggctcagtgagggacctaaagtgaacttattcccgaccaggccatagcaatgcggcgtgaccgacgcagttctattactactactcgttgtcacctcccctcccctcttctcgcaccatggcggtggtcgaggaggccactggtgacgagctccatgaccgatgaatgaatcctggtggtgtagccgacgagcttctggtagacttgtagctggtggagtctctcctcgcggctcgctcgactggtgggggtggcggcaagtagaaggggttggtgggggcaatgacgagggaatagcagccctcttcctcctcggtctttgttgttgcttccgaagctcatcgaacaatgccattgcctccctttctccagcctccgtgtgccgcttccgtccatcttacttgataccgttgagtccagcaccatcgtcattgaggtgaatggctacgggggaagatagaagagagaagagggggaggggggagtcaccaacatgtgagccccacatgttgactcaatcaattgaactaagtcaacgagtcacatcagcgaaaacatactcagaacctgagtaagtcatttcgcaccggtttctactgctgatggttcaggatatatgttattgcggttgagcgatatgtataagattggacttatattagagggagccaaagtgaacttgttccaaaaaagggcccatgaacaatattggcctctcctagtgacaggccacaggcgagtcgctcgctgcgtgggccgccggtgaaatccacccgcaatccggtcgcctccgatgggccggactacgcccgcgtgctttcacctcacgccggaagttttgtcccgtgcgatttcgattgccgctacacgatcgctagtacgctcccataccatccaccatagccaaaagagtacgagttcttcagagaagataaccactttttctcatcaaccccaagctaggtcgctctcgctcgatcaacgtcctccgaattcgcgtatcatcccgtgctcaattcggccgcaaaaccgtatcgatcacggctggtgcatccatccatccgcccaattaatcactcacgcacgaatatcagcatatatatgccaccaatggccgggccggccacggctcgaaggagctaggccgttagcacggtccatagctacgattcttcatacataatcctctcttcttcatcgtcttcttcttgcagttgcagcatgtccggttcatcctgttgctctcgtgtgtgcgccaggggcgtgctatccatggcaacagagatgagagatcgatctcgctcagtgctatatactagaacctacagccacctatcgctgtagcacaacatccaaaatttagaaatttcccgtatactccctccgtcccaaaaagaccaagatgtgacacattttgtttatattccttgtatgaatgtgtcatattttctattagattggtttttttttgacaaaagaagtaggcagcactgagacctcattctttttaattaagacagttttttttcttgattttcgttagtatgtttttcatattgctaaatggtgcgttttgtgtgaaaactttatatatgaaaattgttttaaattatcagataaattcatttttcaagttcataataattataggaacaattaatcatgtgctaatggctttattgttttgcatactccaagttcatcttcatctttgttagaaaagaatcaccacctgaatgtctgaatccccaagacactgacatgttccaatgactctagggcctagactgtcactatgtagggatgcacaagccgagtagagtagccttgagcagagctactatacaaagacgacaacatcgcgatcctcttctactgtgcatatatcgtcttctttggagaggagaaacgatttttttttcttatctgaaaagggtgcttgacaaggattgggccgcggaaagagggcgcattgcatatacctgcatcgcgtgccttcactttcacatggattttcgtttcttgaatctgctgtggagtgcctggcactgcagctggatcagtcaaccaaccaaaatgggattagtttgaacctgaatctgaactagtggttatactctagctaatcacctgttcatgagtcagggcatgatgattgatgaggcagaataagaaaaaggaggaccttgatagagttggaaggcacttgctcattttctgtccttagcttcttcagtttctctttcagaaaaagaaaaggagggcttctttgttcagtcccttagctttggaaaattaggcgcacttgggcaaatttcagtggtgttctgttctcatcttgtttgcgcgttggatggctatggattggaacgtgtttttatttattttgcttttctattgtgtccttgagaaaaaaaaagctgagatattggtcgcctgaaagagatttatctgttttttagcacagccctgccttttctaggagcctctttttatggttagtgtaatggagcatgaaataggccacaagaaatggctgttctgtggctcagcttacacagtgatccagctaatcaacttactcctgcaattatgtgcatgatggtaagctaaaatcgcaagaacagtaaattggctgaaaaatgagaagtacatatatatatatgagaatttgaactctagaaaataaaacacaagtgttcatttggtgcggccaccaagatcaaacaagcaaacaactaggtcaaaatgataacatcgagtcatcatggcaaattttcttccaatgggtggttttgcttaatcttccttgtctacacatgggaacaatccggagatggatccaatgtatattgctgtcttttcatcctcgacttgggttgattgaattccatttgtccactggacaactaaagcactctttattcctgatgaaacaagaatttctccatcattctagtcatatgacggcccaaaaggtcctttaatctcaccaattcagatatagccacatggaatggttttagagttgtactgcaaggatgaaaagggttctcatcactttcacgattacaattgatgcatgccaagacaaccttgaggtctattttcttgttgatatcctctagctgcctctaaaatttagttagtgcacaaacaatttaagagctctacatcttgagtgattttccgcttcttcagacgctgcaattttgaaactacttccgtcccataatataagcatctttagagtttgacacggatattaagaaaatatgtataaattaaataggggaaggttgtgattggttggaaatagaatgttggagaaaaagttattatattttagaacaaatcttaaatgctggaaattgttatattttggaatggagagagtagtttatactagacggtataatttatactgccagtataaattaatgatttaagggtttagattaaattatccttcccacttaaatagattggagtatagaatcaaatgggcgtaaaatcatctttctatacttagttcatggaggcaattatgaaaaattgcattgtatatatagtgaaacaatgctgggcatttcccctgctcgttctcattccctattatccaccgtcctcattactatggtgaggtgccaccagccacatccagtccacatgcgtcgtccgtcagctaacataggatggcgatgagatgactgatgggatgttagggactaaaacatgaaattactggaatgctcttttcaaattttgccgtaaatttctaaagtgtccttgtatgacaatatatactactcccttcgttctattttaagtgagtcataagtttccgtatacaacatttgaccattcgtcttatttgaaaaatttatgaacaaattttaaaaattaagccacacataaagtaatatttatattttatcatctaataacaataaaaatagtaatcataagaaaatttcaaataagacgggcagtcaaacattagcactgaaactcataactgcgcttattatggaacagagggagtaacaaaaaattgtaccgtaaaagttctttaatttttacagttaatttgtggtgcctcctaacatgtaaatactatgtaaacattagggatgtactaaaagtttacgctaataagaaatatagtacctgtttttcctcaaagatacatctttacttcacgtacattatctttttctgtagctggtggaatctggtttcataccttgcaacattttattacctatgcatctttagttggaacttttctgcacattactatacacatctagcagtcccttggagattaatcatataatattgtgtccttcccaattatgttaacaatcatttgtctctttttgttctcttttgttgctttgtaagccttgactacttctctttagcctctttttctccttctgtttggtgctgtcggctagctaacatacacatcaacgctttgcagtgtagcagccctagctaagatgcaatggttcgttattaattaagtagtgatgcagacccaaaaaggtgtatatatatgttattactaatatagatctcactcaggttacccaagaaaccaagagatatgtcttgtttaattgaataatagaaaatctgaatcgcgtgtcaatttagttacaggggaaagtcttgcttctcttcaagttgacatgacaacacaccaaagaaatctacacagttttgtttacctaaataaagaggttttggccaaaagagtaaacaaaacaagtataactttacaagcattatttgccaacttgaagtccaaaaatactatattataattccattccagtgccactctgtccttaagtattaattcgtcgcaaagaaataaaatagatctttgagacaaagcaatggacagtggacacttcctatagtcttgtcttgtatgcatacggtttccaaattatagtccaaaagataaaggcaggggagatatccttgactattttatggcctatcccagatttactgattttatagtccaaaagtagtatttaactattaaggttgagtgctatgtcactttatatatccttcatttttagatcaagttaaagctagctaaccagcactgactctggtcttccattgtttaactagatcgtatcctgcctgaaggttactctgtgacccaaaagagacaaataatacgataaataatcatttactccctccatttttaaatatcaatttaaaatatatgatgttgttggcttggatataatgtttaatcattcatcttatcttttaaataaaaaattatatcaatattatttattttattgtgacttgtttttcattaaaggcagtatggcttatattttgatgtttgcactattttttttcaataggatcgaccaatgattcaatgtcatgtttaggtatgacgtatagtctcttgttctccaccccttctcctttgtgcacccattctcccattctcctattgtcggctcacatcctttccccgccatgtttgtaacgattttctagcaaatatatataggcacatttctttgagtctaccgtgcccatattgcaccatgccttgaaagcttcaagcacatataagaatctctcttgtggtattggtatcctatatatttaaatgaaaaatattataaaattaaacatagccaagagcactccgacccattgtttttcgtcccaacaaaccggcaacaggccataaaagtcattagcagagcacgaaacagctcaacttagatgataattaagaaatatcccggaaaaaacctctcgcgtcatcctcccctggggcggcacgggaggcggtgaccctgccgcccctctcctccccccctctgcctcgccgccgcctgagcggccgtcggcaaagccggccggccgcaaggacggcggcggtggggcctctcgccgaccatgcttcgggcgggcaggggagtcgtcctcgaccggcgacggtggccgccagatccgggccgctccggccggatttggcggggtggcgactggcggcgggaagggcgacgacgaaggaaggggcgcacggtgttgggcggcggtggtggaaggcggcagggatggcgtttgctgagggtgcgaaggcggcggcggcggcttgtgtgcggcgacggcgcggtgctaggcggcgacggcggcggtgtcccccagatccgcgcctctcggccggatttggcggggtggcgactggcggcggggagggcgacgacgaaggaaggggcgcacggtgttggccggcggtggtggaaggcggcagggatggcgtttgctgagggtgcgaaggcggcggcggcggcttgtgtgcggcgacggcgcg

SEQ ID NO: 66202 - DNA, 4290 bp, Oryza sativa
aattaaaaaataatctgatcagtatatgctcaagctatttcgtactggtcagttaaataattagtatgtagctgcaggtctctattaaccccaattagttaagaataattactagtacttcacttgtggacttgtcgctgtgcgtgttcaacaacttttggtcgattgatgcttccttgatcctctagtaaattgcacatgtcttcttcaatcatatatagcttaaattgtactagtgttaagatataattaattaccgggaacttgctaatgacttgctgagtgttttcttgtccaatcctaggaaagtttctgccctatataatactacatgcttgggttacagagtaattaagcttatcgatgacgaaaggttaatttattctatacacgcagtcaagtgaattctgaattaaacaggggacaatgtacctttcgtaaaatcttgtttaggtgatatcatacaaactaatatatacaatcattacacattcgtgcacatttagcgtaaatttatgtgccttcccacaatctataggatatgatcggaatatttgatgtatttggaattttcgagcttgtgtagagaagaccatatatggcgttcacgaaaaaagatgtgttcgggaaagaccatatatggttgtagatgtagtaaatatgcgcgttatacttatttgtcgaaagatgtggtctgcctattaatttttctagaattaacgacaaattaccatttaacaaaaagatttaacaacttgacgttaaaatgctttctctatcgacagacatctgacgcgaaatctggatcatggtgtaatcaacgtaagcataaatttgagatcaaattaagttaaatcgatcagagagtgtatttcaagatatgtatttacagtcgcgttgaaatatttacagttgatggagcatatttatactactttgagctagggacgtatttacagtacagtagatcagagatccagtgggcagggtgcaattatcgcctctgttttagtaatatggtagcgtaagttagaaaaattaatggtcgattagccaatgaaatcttgatcaagatatagtgaaaagacgatgaaaaagaaaatattggagaggagtatatttgtacaacttgtgtagcttattagctaatgaactaccaataatgctaattagatattgagcatatatgaaagcacatattgactaagctagtggcgtgttaataattaaggttgacatcgtcttgaccaggcgagcataccgggttcatttccaattaattagtgtgacatgtctacaagtgtagtaccattaacatatatacaatctcccctcgaggaaaaaaaactttataatctatacattagaggaggtcaaaaatagttgtgttcacattgagtgaagtctatatacaaaattagttagcctgtgtacaatgcattctgaattttattgcctccaggagtgctatttaatttagctcactgtctgtttgtatgctaccaaacttggccacataatttagaggttgcagttttctttccagtaatgactttgtgcagtgtcatgtgtctcattatcttgggtccaacttgtgctagatagcttattatttagaatcattcgagtggctaaacttggtacacatatataactagcaatgcaactagtttaattttaatatttggtgaagcatgatgtattaatgaataaatgatcgagatgtatatatgtgagagaatattccagtcaaatatgcaagtcaacttaagaacattcatgcggatgtcactgtttttttcttgagcatataagaatccattcaaactaattaggttatctaatcatccatatataatatattatatatatgcactgaaaataagatttgttcgtttctgttgcattccaagtcgatcagggactctagctattgacttcgatcgtcaagtactccatatacacttgatgaagtcaatgaccaagtaaaagaccattttttaaaaaggtaaagaccttgcaagacgtgtctacatcgatactggtattatttgataggtgccttgcttagaactaatcataagctttgttaaccaaaacaataaaatgagattaattaattgttaattaacacaaagattaactgtaagaataaattgcacacaaataacggagcatgttgtttcattaaccttatgtatgaaaaaaaataaaggtcaaacttagtgattactcccttcggttccattttaattgacgttttagataatgacacggtctacaaaatatatttttaaccttatttttctattataatatatataataaataaatatatgtttacttttattatagcgttttgaaagacaaatctatatatgttgttctagttcctttacgctaaatattttttaaagttattgatggtcaaaattataaaagtttgatctccatcttatccaaaacgttaattaatatggaaccggagggagtaattatgagttgcttagctagctatatgttgtacatacagacatgtgctcatggttcacattgaggattatttgtagcaactaatatagattctcctatctctccacttggagtgtacatggaatcaacaaaaccaattagtacctactaaagatcatgtcacgaaaaggtagggcacatttcgacatagcatcatgatcagaaaatatacattttggttcatagatagattgagctactgcatgcaacgatgcgtatctaaccaaactattttttttctgagataaagcctggaccatgcattagcggttagccagctgcctgcacataggctctctcctactcaggttcttgtcggtccacaggtccatctaaaaaaacactatggttcatgttccatagctagctaattaaagattcacattgtccatgatccaagtaattccgtttaaaagaatgcacgccaatatattagaagaaaatagagttttagttatacgacataaccgactaggtggccattgctacaggacaagaaaacagagttttagttatatgacacaaccggccaggtggccattatattgctacaggaagctaaacttgaaaaaactgctcctacaaaggaggggaggggggggggcttagtcctactagactcccaaaagccgtgatgcctgcagaagaccacattcagtcttctgcagctaattattttcttgtaactagctagggaccatgcatatattttttttaaaaaaaagagggcaaaactttgcctcgtatatattgatagagaagaggaccatgcatatatgcgcgcatacgcatggttatattaattactccctccgtaccaaaataaatcttcgagtatgataaatctggacatacatagatatgtcacatcctgtacgatgttggtttattttgagacaggtggagtatgtgtgttcatcaatatcattcatacatttagattgtttgtttggaatctgatcccagatatgctgtgatcaaccgcgatttaattctgaaaacgtgtacatgcatgtcgccttcaaattttcaggcaaatcatgaaaattaattcatttcatacagtttgatccggttgttgcattttgacttgaatatatggcttgcccaccagttagagaagtatctatgtatatacttctttaatatatagttttaaaaattttgtcttaacgtagctaatcatggtaggcacgtacacaccgactttaagtaaattgctcccacttactcaaggtttggttgtgtgtaattaatcatgcatgcaaagcgtgtattatatttgcattccttaattatcatcgaatatacttaacttatatacatatttgtgtcaattaggacacttaattacgatcatggcatgcacttatgcataattagtctgctagtgatcagctcatcgatcttagttggtttctgaaacgtagtatatacaccacctctatctcaagaaaaaaaaacgtacagagtactagctatatatacatatcaaggtatatctcgttctggtactattgagaaacaatttttgaggtattctctgcttaattaaggggccatatatatgtgtacagaaaacatatatagtgtaattatttgcacgatatgtttctttaaagagaaaaaaaatcctccatgcaaatcattacatcatattgacaatgcatggatatatcgatatgatatatcatgcagctacaatcaattcctaaatatctgtcgaaagactagtgttaacaaccaaatatttcatga

SEQ ID NO: 66203 - DNA, 1640 bp, Oryza sativa
attcaataaaattaacatcgacttatgctggttcataaaaaaaatggcattgatacgtgaattatgtcatcaatgacctgaacataaccgtccaaaaactactgaaaagtagtattaagggaggtcacctatgcatcatttctgacgtaagatttgacagcattttttattcttcttgttcaagtaattttgcaacaaaaatgcatgtcagccttttgtaatgctacgtaaactggcaacgcaacacgttcgagatactctctccgtctctatgatataaagatatataaaagattttgtaatgctcgattgtttgacaattcgtcttattaaaaaaaattaaaattattatttattttatttgtgacttactttattatctaaaagtattttaagcacaacgttttgttttttatatttgcactatttttttaatatgatgagtagtcaaacattacaataatactagtgaatattctttatattaagagaaataatactagtgaatattctttatattaagggacggagggagtagatgaactactggatgggagtggtcaatggagtccatgattttacttatctttttatctctcattctgacggtcatacttacctcatgctttcttttttgaaactatacctcatgctttcgccagggccatgcgatagagaactgtactggacgaccatacgaatctgaaaccagtttgaaattaagaatggcaatgcattatgtatgtgaaacttatggctaaagttcttccatcctcaagttattctgtgtgggacacgcatgtacggcttctcccctttcagattaagcagaattttatatgaatcagtatggctcattcttattctcggctggttttagcgttgttccatagcatggataacccattaagaattgtttgcttttgtttcagagttttgtgcaacttggtcaccaacaactacagaccctaaaaaatgatgtatacgaagcagtacactgaagtacacatctctttgttttttcagaactgaagaagtaacatatctccaagttatactgccaactgccaaaaagaaatattcagaccaaattgccaaatttaaatacgaacacattttacacatatcagctgatcagcatatgcatcgtagtgtcttgtacacgctgctcgttttgcatgtgtgctgcggtttgtttggagcataagtggccgtggttttcatgtcaaatcgtacgcagctgagagctcggcgagttagttggctgccaccacttacacgctagaattatcatactctcacgtacagcttcataccgatattcgaagttcacaattggcttggttaattacaggttataatgagcacgtacgcatctgttgcttacttgtatatactattctgtatgttaatctggtttggaaatgagtagcacgcaagcaaagcagcgagtaattaatctatatctagctagctgtgcctttgacatttcagcaggaggcaggttagttaatcttctgaatggaaaatacaagtacttaaaaaaaaagtcatggtcacacgctcgaagagttaattgcagacacgtacatgcttatttatcttcagacttcagaattccgagctctgaccatgatggc

SEQ ID NO: 66204 - DNA, 2511 bp, Oryza sativa
aagccagctgaggtaggggaagtagtccctccaatcaggctccacgacacacgacaatatctcatgcacaaggacatggaagatctcttccttggatatctccctcccaaactcttccacataaactgaacacacatcctcacctaaattctgaaattgcaacaatcatgatcagtacaagtaacctgaaatcgcaacaattctataagtccataacaatgttcgttcaaaaaaaaaaaaagagaagttcataacaatcatgaccagtacgttcgactaactatgaaatcgcagcaatcatgaccagtactagaagtaacaaacggaccattggggtaatacaattatacaaacctggatcaaggacaatccgaatagctcagtagtgtaaacttctctgaagttcagaggggaatgtgggtcaacagcaaccaatttatgcaaactgcttaacacgttactgaccatcctttctcttgtatcgcagaagtgtttctgaaatttacgcaagcattgcattgtgagagcttaattaactgagtgtgacttgtatccagaaaccacaagtaccaaatttaaaacagttgagatttgtacctgcgcattaaaacctaaaattgcgagcataatattacgcttcgccatcttatagaagtcaccatagtcgctgatggaaaccatgtttttacggcttatcacagacaatgcttttggtagctttttagttgatattgatgagaatttttcaatcatcgcctgcaaaaagtagtacagaatatatatatgtgtttttattatttacagttcaatatgagattatcagttataggtaactattccagaacacgaaaaagaagtaaaacatttttttttgaagacttagatatattgaggaagcagagagttcaaagtctgagggatgatatcccttaggttgccttcatttttccaaacaaagtattgaagccaagaacaagaaggaagagaaacatcaaacatcatagcacccacatcatgaactagaagccagcatcatagcacaattgcatggaccaaaacgtttacagttttacccccatgttagaagagacagagaaataatataatatcagctctatagttcatgttgtagtaggattttccttttttctgtatcaagataaattggaaatattatattgccattttattaagaaaaagaaaatccagtttagaatcctaaacttctgcaagaatccaaaaatcaaccctgaactataagaaactggatatgatcgcacctcaaattgtcaaaaaccatggaatctacacacacacccctcaaactaaaagcacctccgttctgcatatatgtaggcttgatagtactattgaaaagtacaaggcttgtcgctaagggctatactcagaaagaagacaaatatttctttgacacactactacaaaacatcaaataggtgtcgccactataggtgccggaagtactaaaaccggcacctatatgccttttcccacttcccccagcttgaaatcgctaaaaaccaacacctttaagcaattataggtgcctgttctaaataagaaccgacacctattctataggtgccggtttttatagaaaaaccggcacctttaatatattataggtatattaaaggtgccggttaattaaaaaccgacacctataatatattatagttgccttttttaaaaaaaaatccgacacccacagaatcgagccgagccaggcgggtagatattcttccaacggtggggcccacacccacgggagataatgacgagacgtcgagccctcgagctacatccgtccagttcttctcagcttcttctctccctctttccacttcccttctctccatccttcttctcctctctctctctccgtgtggcggcgggaggggcgtggacaggaggtgcggcggtggcggcggtggacggcgtggaggcggcgggctaggcctcgcctccgccagatccggtggcgtggaggcggctgtggcccggcgggggcgggaggggcggccggccgggcgcggcgccctcccgttcgctagatccggtggcggaggggaggcggcacggcccgacggcgggatgagaggcggcggcgccctccctccgtcggatctggaggggggcatgcggcggcggtccggcggcaggaggtggtggtggcccgacggcggcggtgttgaccggcagtggtggcgccctccctccgtcgaatctggagggggtgcatgcggcggtggtccggcagcaggaggtggtggtggcccggcggcggcagtggtgaccagcagtggtggcgccctcctttgattttttctgatttttgttgttagtgaaagattgaagctgccgcattgagccatcttgtatgttgtttgggaatgatttttgtgaaagattcaatgttagtgaaagatttttagttatgtttttcatgtttgtttttctgtgatgttgtttgattggggattgggattg

SEQ ID NO: 66205 - DNA, 1953 bp, Oryza sativa
tattttgtgaagagaataatataccaattattatttttgaagtaagataatatatcaattttatagtctcttactctcttttgcctcatttatcatctaaatgtataagaacgcaaaatttctgttaaacatgcatgtaccaaccgtagactaaatatgatatacatagcagatgaagcaattcgattcggcagcatgcaaccttgtaaaattataatatgaaatataatcatgtttagtggatatatattaagatttgagatgaaagactgtagtatcccttgtgagtgggagggtggttgatgcgataagtagtactattttagtaatgcttataatgtgtataaattctgaatcctaaaaatgcttatatttgagctagctgtgcgattgtgcagcatgcaaacatgtactgttgtttaatttttgttccgtgcgcatgcactacatcggtcctagctacctcaaagtatgaaaactgaataggacataaattcaagcgtctgatctcagacataccaaatgaagcatccaaccgtatgttgcttacatactcctcgtttcaaaataactgacatagattaaagggtggttgggaagaaatttaaatgaggtgattgaagggaaaaatagtattctaggattgcttttttgagacaagatttaaatgttacaataattgttttgggacagagaggtagtccatgaatagatggccaagattttttttttctttttcctgatttaatctgagtatttctttctttttcgatcaatatgggaatttctagatttttttttccttcactagattaatgtgaggatttttaggagagccttagtatatataatgctattgaagagtccaatagttcctacattttcaaattagagttagtttggtcccataaaaacaaacgttgcatctattttcttattactaagcactgaaaagtgcaaattcttccttcaattcatatcaatgagttcattgaaaaccattcaagactcaagcatcaattgagatattaagttagtctagtataaatcaatgtgatcatctgcactgtaagtttgttaaccccaaaaatcaatgtaccttatccaaattactcatgttgtgtagattctacaggctgcactgaacttactggtttcgtagcggcccagagggtccatgttcctaaccaaaagagcaacaccataaagatacagtcagcgggtccagaagaatgtataatataaggtactagaggatttagttaatttacaaatgttaatttgcatgatacagacatacaccttagggcttaggccatcgatatcagtatgtagtatgctaatttacatacaacacagtagccccaatcatcttgcaggcacagacaacaccatcaaactccccccttatttattcacaatacagaaagacactagcagccccagtaaaacatcaagaatactacgctactctgtcgttttctgatctttgagacgacatgaggatcttggcctatgcagacggcgcaaatccatcattgaaaatgacctcacaggcacagatgatgttttaggatcacaggatcctaattgtagtgctggagcattataaaccgcagaattttcatcattagcaagcgacggaggagaatgaagctgctcagtgagctcggtttcttcgatgctgatactactgctgctcctggaactgctactagccaaggtcaccaaagagtttctgctcagactggcaagcctcttagggggtccagtttcataaacttctgctgctgtctcctgtgaagtttcatacatgatgctgtatgcaaggagattcttccgttttctcgaatatgcgctctctgccttcgcgatgtcctttgcagagccacaagatgaaacagcttccttgagacacgcgaaagattttgattttccattgtagaatttgga

SEQ ID NO: 66206 - DNA, 1201 bp, Oryza sativa
caaatagaaacaaaatgattcattcaaatattataaataaatcatagatccaaatccataaatttataaagctaaaaatacaaagctctaataaaccttaaatataaaactatcctaaacaccccctctaactactcacgagctgcttgtcggaatcttgaaaatccttgaaacaaaaaaaagccactcctccgtttcatattataagttgttgtaaactttttcataaccaaatttatggaaaaaaatagcaacatctttaacaccaaactagtttttattaaaactgaaatttaatatattttgacagtttatttgttttgtgttgaaatgttgctatattttctataaatttaatcaaacttgaagaagtttaactaaggaaaaaaatcaaaataaattataatataaaacagagggagtaacttataactatatatctagacatagactttgttcagataatagttactccctccgttttaaaatataagagattttgaagggatgtgacacatctagagctagaatatgtcacaaacctttaaaatttcttataggacggagggagttcgagttagcttaggtattgtttagttgggaaaaaaatttggggttggttgtcacatcagatatacggatacacatttgaagtaataaagtaataataaaacaaatttcactagaaaaccgcgaaatgaatttattaaacctaattaatcatcattagcaaatgtttactgtagcatcacattgtcaaatcatggtgcaattagtcttataagattcgtctcgcaatttatatgcaaactgtgtaattggtttttttatctatatttaatactttatatatgtgtgtaaacattcgatgtgatgagtgaaaaaaatttatttcgagaagtaaacagcccctttattttgagacggagcgaatagagcacaagtcctcgcggagggtagtagcggagttcaccgttacatcgtgccaagctgaccctgcgaccacaaaagcaggccaaaagcagtggactcgccaccccaccatcaccacccaacccaacccaacctcctctcctatcgtcatccgctcttcttcccctcttccccactcgcaccaaccccaacccccccaaccgccgccgccgccgccgacgacccaccggtcgccgcgtcgccggagtcgcgtactggagaggggggc

SEQ ID NO: 66207 - DNA, 11261 bp, Oryza sativa
gggcgttcagcaatagtggttcggtgccagtgactgcggtcaccgaaggcatgccggacttggacagcttgccgagggtgtggcagacggctgcatctggccagcgcggcatcgtttggtggaggggtcggagtccggcttggcgcagagaggcgcagccgatggagggaggccggctcggcgcgagaggcacaggcggcgaagatggaggccggattggcgcgagaggcgcatccggtggaggaggctggcttggcacgagaggcgcggctagcggtggagggggcgacctaggtgtgaggaggagctgtcggtgggtgtggcgtggtcttcggcgctcgaaggctagccaacgggggatgccggtgcaggggtcctacatgtcggcagagcttgtatggtggtggagcttcggtgcgttagccgtggattcgcaggtggtgagcggtaggtgaaaacccagtctggcctctgccggaccgacaacgatggttcattccccctcctgagggcgttgttgtgttgtctcacccctcaaagggtggttgccgggtgaaagcctagtcttggctcctttgagtcccgacggacggcggcggcggtttctccgtcgcttctcttcttgaagacgtcgttttggcatcccttggggggcgatcccgtctgtgtccccttgttggtctaatgacggtcagtcacgcttagcggtggccggtccggtactagtcttctcctgggctggtgtgttggcgatgtcggtgtgtgggtggtggtccttttttcctggttacgaccctccagggttgtagtcttgtaatgtttttcctgctctatcaatagaacttcgcaccgtttcgtgcgagtcgttcaaaaaaaataattaagaaataagaaatgcagtgtattgtttgatgatggcacacacacgtacaacatcacacaaacaggagaaggaaaacacaatttgtatcaatttcactcctattagtggcactcatcaccaacatatgctagcttgatagctaataagttgaggaaactattagtaccactgtatatcatcagcatttgcatataactggatagtgttgtctgacgaagagtcagtgcaggctgtcaagccaatgagaaatcggctaaacactctctgaaatgacctgacaaatcggtcaaaaaagtacggccccgatacttccaatgtacaaatagaacatgtcacattttttttccactagcaatagatatgatactgtatgttcgatcaaaagaagaggcagtagaccagtagttgccacaattttatctgataagatctgaccggatattctgaatgtgaccctgctacacggtacatattgatatgctgcgcaagtgaaagccagtcactcaatcatatactcctctaagatgtaatccaagaaataccattaacaactatctaaatccaaaagaaaatgacatcgacaaatattagttccaagaaatgccatcatacaaacgattttgtcccaaaaataccatccgccattaggattccacccattccgcattgttaagtgctataggatgaacaatatatttaacgcttgtcaatggcattacttggattatctcataatttaattgattacatttcttagataatggtatagtgtttatgttttgtagataatgatataaagagattacatgagagaaagctatagacacatataacgcctttaatttacacccccacgcttttgttgcttcagatcgttgaaatgaatagtcaactaaaaaatactcctcgtttttttaaatatacggtgtcgttaacttttcaaagtatgttttatgtttaaccatttatattattttaataaatatatgattaattttattttgttatattttatcactaaaatattttaagtatgacttatatttttacatatttgctcaaaagattttaatgatacaaatggtaaaaatatgcttaaaggtaaatagggtcataaaataaaaactgagggtgtatagttttataaacttggaaagtataaaacttctcgtttctacaccaaataagaacgcatacacgactatatttgttgatactagaattcgaactaactggagcaaagtgaaacttttaatgagaaaatatcatgtgaaaacaagttaaatgttaaaaactcatgaaaattatatctaaaagttttataaattcataaaacaattactagagaaaggtatagatgtgaaatacattctcaccaaatctcaagtccaaactcaactttatttgagagaaataaaaatgacaaatttcaggtgaatagtagcatattactattcacccaaaatttgtcttatttgttacccaaaataaagttgagtttaaacttgatatttggcaataatgtatttcataaccacacctatctttaatgtttttttcataaatttataaaaacttttaagtataattttcatgagttctcgttttcactgaatatgccctcatttttaatttgttcaaaagcaaatgcacactatgtaaaagcaccatagtcatttctctcaaaaatttcctgtgtacctctcttgacattctatccacgaataagagcaggggcgacgctacagcctaccatcggggtcagtagaccccgacgatttcatgcatacatctagtacccctcgcttttttaccagctagaccccagtcaagcaaactactagaccccggtgacaccgtttcgttaaagcccaatagcaattaggaacgagactagtaagtagaaaatagaaaattaatcagctcttaaacgcctgagacttgagcccacatggccggcagcccagaaagtccattcccctgttgcatcatattcttctggtagtttgaccgagcacttcgcattgcatcgccgcacatctcgatttctcgactttccgtgtcttctcgtcctcgagtagtacacgcgtgcatcgccggcttggcgtcacaaggacgagaagaatggcaagggtgaagggttatggttgagcgctcgagcgctcgagctgttgagggcggtaacctactaacattatcacaatttcttgattattaccatcacaatttagccctagggtggtttctcaagtccgaaagtttattaggaagttagggttctataattcagaagttctgaaatatgaacatttgatttgtctttgttttcaaacttcagttatatgatcatgagtaaggaggaggattaatgtataattttgttccatcttacgcatagttttagtcacactacaaaaaaatggtttttttttctgacagccacccctttcattttttgcaaatggctagcttaaacttaaaggctatatctgtgaagattcatttcaccatgtgattatcgtagcaccggtcacaagcgaaaagatctttagtcataagcgacacgattggccacctgtaaaaatgtgttttggccatttacgataaacctgttcatagtagtgcaagttcattagttagtagtgaccccggcgatgatttattctggcttcgcccctgaataagaggacaattacaacataaacagttctctttcttaaaaaaacactaaacatgatatagtcaatgtctagtgtggatataataaaaaaaaatcgtgcagcataagaattggagctacccttagccgcccatgttgtgatagttcaatatttttaacatattatccattatacatctcaatcgtactacgtacgcacacttaatatgtccttcatcacaaaatataaaaatatttagaaagtgctaagtcaaacatttttaattttgattattaataacgaaaaaaatagaataactcgtttatcattagaaaaactatcataatttataacttttttaatttcaaataacttattgttataaatattattggttgaaataacatctcgaacacctctctagagttaaaaaatacttatattttggaactgatgagggagtaatacatagacagtaaataaaaccaaagaaaaattaaattgcctactcaagtcaagatgtggtgacatgcagggtgtgacctccacgccataatccacacaagctggactaatcgaagactagcataataaaactactagtacgtaatagatatcgctgagctagcacatctcgaaccacttgccccattaacttgcattagcaaaacctgtcataaattaatcaaatctgcagataggacgatgatatatttgatactatatccttgggtgtactggagaaatggtctacggattttcggctgtcggatcgagatctaacggtcacacactgatcaaaagtcaagaggcagggtggcatggtggttagtgtctcgccatccagtgatcagccatgttacctggaaactttttaaaattttaattttaagtaagacttggcaaaaaacagagggcacccattggatctaattagggctcatttggattgagggaatttcaaaggaaacttattggattttaatccttggaatttatttcctatgaggttctttaaaacaaaggaacggagtttgcatgcaaattatatgaattgtttcctatgccttcattccataagaaactaaacgtgtgctcatgttttcatttcctttgaaaagtccaatgctcttattctatttctatctctacactcatttcgattcctccaaaattccttgtcatatttcctgtaaactatctaaaagcattgcttctaatgttcttatgttctgaaatactgtaggaggttctattgtgtatgccattttattcatatatgatttccgtgttgctatatttatagaatcctagttccagaatccagaggatattacttaaatagtttgatcctcttgtctatttcttgcgttttgtgcaaatcaccagcagattatatgaacgtaatatcatgagaggcggagatagagtacggcagctagggttgcaaccctactccttagcctaaatatacattgaaattacactttaaaattttaaaaattagaagataaaggtaaaattatgtaaagtatactatttgagccctatgcttagaaagattctggttccgccacccattatccatgctaattaatttgcatttagagatcatgcactttatagacaagcatgcatggaaccatcaccatatccttagcgagattggagaaacgtgtaatattgtagataaaggcggagaagattgaggctagagatgtaatgcatcttccattatctttataaaaatccagatgagattattttatttactcttttcagaaataaaaagaaggccaatgttttaggtagataagctctctctttaaactctttttacgtggattcatgccacagctcacaaacaacgtacgtatagcccaattgtccaaaacaatgcaatttgcagtgactgcatgcgtgttccacaccaaaactaataaactctacttactaatttgtgaaaagaaaatcccaattttacccatgcaacgattaattaatcaccaaatactaatgtcaactctgcaaggacaaaaggggcagtttagtcatttgggtcgcggccacagcaagtggccgcctagtacaaacagcgggcgcgatataatacgcatcacccgtggccatttgatgcggatttgctagggctttgaattttttttttccgctcgatcgagttcgcttcgaattcgtataattaagctaatataagctaattaagctcggggatgaagctgttcgccttcgtgaggcgctgccggcggctgtcgtcggcgccggtggatcaggcggcggaggaggagccggcggcggtggcgccgcccgcggagaagcggcggaggaggccgtcggggccggcgtggaagccgacgctcggggcgatctccgaggacgccgcggtggcgtcgtccgccgccgcgaaggcgaagccggcggcgaggacgaaggcgaaggcgaaggggaaggcggcggcgccgccgccgccgcggcgcgtggtccggtcggagtacgacgacttccggtgagttttttttttctctttctccccgcgcgcgcgaacgttagcttgggcagttttttttggccgttggatttcggtggttcgagggatcgggacggataggatctcgacacgtgtccttcggcgcgcttctcccgcgtcgccggacgccgtggcgcgtacgtgtcgcttccaggtgggccacgggtgacgtggctccgagtcaaggtcgtccgtgcgtgcatatgctacgcagttttgacttttttgacatttttacctcatcaacttaatcctctcctgcagcttctttcttttggatttttttcctttttttgggggtaatactccgtagatgatactacgtataaagacaaaattgctgaaacttggttggtttgatcaacttgcgagttgcgttgagtacctaattagcaattggatctcgcagagagtttgactccagataagagtgagtagaaaatttaaagaatcctaaattaaatgggttcacagggatcaagcttgccaggtcaatgcactttttttttttggcaactagcagcttatacagttgaactgttcatcgcagctcatgattatccgtataacctagccatgttgcaaagcgtaacgctccatcatactttgacgacgtctagggttagttgaaaccgtacatattattccaaagacacataagcaatacctattgtggaaaaaaaaataagtgagtgaaaattcataagtcttgttttgtatgcatgaattttaagatgctcatgtcacgtcgagatactgcagaaaaaagactgcagactcatccggtttttcaatttccattatcacaacaaaagaaaattgacatactcatacggcttaaattaaggaattcatctctatagttgaatatcttagcactttcaatttgtgtacagatgttaatgatgttacagattcttagcattattaggtgatgtctaatcgagtactaatttattatatgttatgtaagatggaaggagtagatggacacttcgaaactcatcgcggttgccccttttttttctaataagttattttggcttattagaaaataaaaactaatttatagataaaacttttatatatatttctaacgatttaaaagtcgatgttgaaaaataaactacgttaaaaatatcttaaattaactttaaaattaagtttaaaaatttaaattttagcttttgtttgatttattagggcaactctctttaattccctgcaactagttggaccaccgtgtcctaacaatggaatctactatgtatatagacaatctcaattctcaccgtccttgtcagaatcaagaacgagggggtcctccacacgtactaatttcctcccttttatcgctagtgcatgttagtcaaactcaagctatagtacactggcccagatgacaagtgaaggccgtgaaactcttcccctgatcacttcgtgcctgctaccgctactacttcttgtccctcacatgccattatggcaaaaatttcaacagacacccatatgttcaaagttcaaacatagctgaaacttgcgaaatatatccagattcatatgcatttcgtcccaaaatacataaactttaaaagttacgaatctggatatgcatttatccatatttatagctaaaggttgttatattctgagattgatggtagttacttttgtggcctagttatttttagcttgttcactaaattattgctgcagattatttgctttgcgtttctttttctattttattgttcaccgttatttgcttcacatggacaaaataatccgcggcaataatgccttagtcactctctctttttttttttccttagggggagggggtttggggtttctattaactggtactccctccgtttcacaaggtaagtcattctaacatttttcatattcatattaatgttatgaatgaatctagatatatctatctatctatctagattcattaactttaatatgaatttaagaaatgctagaatgacttacatatgaaacggaggaagtaactcacaatttagccttcattactggtaccgtggtactaaccaaggtgcatctctgtgtctctacctgcaggcactacggggcacccacggtgttgccggcgttcgcgccgacggcgttcttgttctgagctcaactccggtggacacaagtcctgtagctgatggggcgctgtgtgctcgtagtgtgtgtgtgtgtggtttcactggcttgaccatgacgcctctctagtgtgtgtggtgctcgctggcttgaccatgacggctcagcttttgtgcgcaaagatctgaacgaactcgcaaagctgattctgtaaattttccggatgcttctgatgatgtgcatataaatctgctgctgctgctgctgctgctgcccgatcccccccactcgcgtttgtggctttcggtttccatcgcctttttacgattcctgatgttctcctgcatgatgcgtggatatgtgatggaacgagcagcaaattcctcttggttcaacgatgccgagacaagttcatctttttgatagttcgattgctacaacgacaaataatcaaccagaaatctcgacggttttatgcattacagtgatctcgatggaccaacagatacgacaagcaagcaagcaagaatgaacaactattatgtcctttactatagtgaaaagaagaaagtataacgtgctaatgaagtaccgggaaaccaatatgctgcatacataggcatagcactgatctggcaacatcttaaaacaagcacaccagaaacatatgtggcacatccaagtagcagcacagaggttgcaaattattccccagcttaaatcacgggtagcaggctgaagaatagaagcacaaatagttcataaattctcatctctttgttatcaagagtggaaatgagccaccagttacgagatcagcacccctcgtgtgtcgccatccagagagcaacaattgatttttttttcccatgatggaagaatcaaacatgaagataaaaccagtgcgcttcggcgaggccatggtatttgagtcgtgccatcatgggagcacagcgtgcatgtgcaatgaggttagtaaccgttaatctttcgctgcgaggggctagagtgtaatgcccggttgtcagtgagccttgagaagccaacctgatccctggtccctggactctggggcactttagggctaggaacacttgtcaagcgactctgaggcacagtatcagacatggacttcgagaaggcttgtgcaagctccaatgcagatgctcctttcccaaaacgaggtgcaacaacctcaggctttggtggctcaactggcttacgccaggtttcaggctctggacgctgttgctcgggcttctccacatctctagcaactctcctgttgtcctcccgtcgtgtaggcctatacacatcactccggtctgtatcccgcctgtagtctttcttatcagcattccttgggcctctagaaccagctggaaaactctcagccttttcacctgaagggttaatggacatagcttcgaccttctgctcaccctttgcaaattcacttttagacctggaagatgccacaaaggttattagcgaatgcggtacacatccaacgtatgcatgctatagtaatatctgcagaaaaggaacaaagcttcaagaaaatgaatctcgtaaaataaggtaaaaactacatgttttctgtcaccatcctttcttggcactccaaaagccaacttcgaactttcaaacatcagaattagataaaaaaaactctatgcaaaggaaaataatacacattcagcttaggaatgttgcacaaacaagcatgttgtttcacaccatcatgttagttgctttccgaaaacacaacagtgcaacttttactatcttaagaacgaaagcccaactggaagaccaatcactggtcctgcaattgtaggtggccagtaaaatcatgtcacaatgaatggaacattaactatggtccagacctggagataccaggatttcaatattaataacaagcatgaatcaggaagcattagatataaaaatgtaattcaagccaagtaaaacgttgattttatctgaagggctgtatgctaactacctgccaactggagatgtcttatcaaggtcacttgctaaagcatctattccacgctctctgagaacctgagtttatgaacaacattaagtttttggtaaagctaggaaaaaaaaaagaaaattacatatatgcaagtgcaacatgaggagagagagagagagagagagagagagagagagagagaggatcgcatacttgttccctgggccgagctccaccaaagagggattgcctaccacaatatttacaaaaaatgagagagaagatattgagaattactacaggaatgaaatagagaccagaaggacaattcttactgaacagattgaatgcaagattgatagctattaacttgtgaacaaatttagcaacggtataaatcttgaaaacaaaaaatccaagattcagagattgggaaaaaaagaatggggattcaggagccaaattaatgacagtagaatctagacgcccttgtacattttcactcactcattattcacatggatttaaaacatttttcacatccactattcgtgcagacaaaaagaagcacagtttatttctattggagcaactaaatgtctataaacatgttacataattcgttccacatgtagtgtgcactatggaactaaagggaagtggtttgccacaagtaaataataaatcaaacctaaagggatccctattgatataaactcaccatgataggttaaacatgtgttatgcccttttgttaaatatgagctgcatgcaattgtcaacaaagaaaaaagaaagatgacctccaataatacaatactgcaaattgctttagtcctccaacaaggtagaatccaaaacaaaataacaagccattcttaatagcgcacagcacaaacatgcatgtggaaatgtacatactgaatgcaaacaacgaagattaatattccaatctaaatgcacctatttcatattaacaaagatcaatcaaccagatggatacttgtaacctcaacatttaacaaaacataaaaaggtgcttgaacaggccaagtg

SEQ ID NO: 66208 - DNA, 621 bp, Oryza sativa
tgaagtgcatcaattctgtcttcaaaggaccgtgtggtattggcgacaagcaatgtttcatcaaggtcaaacacaataccaaggcaacgaagattcaacatgctcaagcaagaattatacaagcccgatggcaccttatagccccaaaaacaagcaagattcggcaagtttctcttggaagtcattgccactaaatggatctcttctgctcctagaggaaaaacagcagtctgcaagcaggagagaatgaaggaaatgaaaaggattaagaaaaaggagaaatgttcgtcactaatacaaaatgcaatcatgtaaaaggcatggcatctagtacatttgttcacatacctgcatatcagagtaacatccacaaagtagtacagaaaataaaaggtacaacagaaatgcaaaaaaggggatacttgttaaaaaaaaggcatgtgtggattaaaaactctatatccatccaaatcttaaaatagcgaaatcaataccaggaatatttatagcactgtcctgaccacagttaaatgctatttaatccaactatgtaaaggaaatattaggccgaaaatagtgtgtttcttaatatagatgtaattatcaaataattcaagtgga

SEQ ID NO: 66209 - DNA, 15026 bp, Oryza sativa
cctgcaattcctctatgtacacttgctattctgtcagcaaagctgcactaatctggagagctcaatggactgatccatcagcagcgtcctgcacaggaatgttgagatctggaagagcgaagccgcctccgatggactgcgtggctgactgctgatcaatctgttgctttccttttagatcctctgtaatcatcggtttgttccgtgagctcgagatctgtaatcttatctgcaattccgaaaagaacttacattagatgtctatactgttcagattttgacaccaacttggttgtaagtacacaaggccacaagggtaatatcacaaagcatcttcacaagcaatggttgttgttggaaacaatagtagtaactcgtcagcaatgagagaacataagattcttcacccacatgggcaaaattgagaaaaagaatactccttcagtggacccccaaaatcagcattcgttgtgtagaaattattttgcatgaaataggtgtatcaaacaaaacatgtttgccattataatgggtggaaccatctcgatgcttatatctcatattctcattaataaatgagatccatcaaattgaaattacccggttggtgcaactacagttcaactgaatgagatgggattaggtgggcaggctattttaaatgtggtagacaaaatattgtttaccatttttggaagttgtggcttgttaagtgtaggatttattaattgggaatgtgtgtaggtcatcaggagctaaactagcgataaaattccacttcaaatatcggtaaaaccagttattatatttgccaaaactcaaacaagatcccttgaaaaaaaggattattcaagggtacacatcactaatatgtattttaaacattgtcatatgacacaatgcattgccaactgactatgcattcacctttcagacacaatgactttagggcgtgtttagttccacatcaaaattggaggtttgaagaaaaaacttggaagtttatgtatgtagaaaagttttgatgtgataagctatgcctaatgagagtttttaaatttggaagttggataagctaaactctcatttaggaaagttggaagtttgaagaaaaagttgggaactaaactcggccttaatatggctttcagtaaaggtagcaacaaatcgtggcacatgtcaacatcgttaccacctagtatcatttataagtgggcagtggcagctctctgtaccttcaagatctttactcattaattgggatacatgctgtcctgaatacagaacagggtagcatctccatgactgggaaatatggagtataaagcaaaaacaggcgagtagctttcaattcaatattggagaccatgtgtagctgcccaggccccagaagtcaatcaattcctttattggtcagatatatcagtcacaaccaccatactcaatagtagtaggctctatccaagaaagttgagttctgccagttctcagatgttggtgaaggtcgatttcatcccaacaagacaaatacttctaatcctcggctacagaggtacgtactcagatgttggtgaggttcaattccatccaacaagacaaatattaggttttctaaaggtgcagcttgcatcgtaaaagtttgcaacacaactgcgttcatatgtactactattgatggccaatgatatctatccagagcatactattagtgcggtagtgaacaaggaaattatagtgttatttgaatgaaaatttgcctctgggcttgctaagtatcttcgaacttatttctgaagacctagagtaaaggatctgaattcatctactgtttctcacgcaatgattttttttttcgttttgtaaatagtgcgtctaatcagttgttgttgctaagattatagtcaatcatacaccaaattaataactgacaagcccatttcccaacagagacctctgcagagactttgcaaaagactagaaaaatctacatccattattgtcaaaggcccatcagccttgataatgatatccatgtctattgcatagcttatcagagtgagatagcctcaagttaatttgcttaaaagatatgaactggatcatatggaccactacctttggaggtataaacccttagcaatttaaaaactctcattaggctttaagctaaaataagtgacacagcttttgtcattcaacccaaaacacaccattactggcccagatgccaaatttgggaagaactaaaagagaaacagattaaaattgttattacctcaagcttgtcgttttcttttgaaagcgcagcgcaagctctctgcaaagtacgcatctcctgctcacagcaaaaccaagtaccaaacggcagttagtgaatttgaagtagaatacataataaactgcacatagtaaagaatgtgagcatcacctcacggaggctgtcgttctccactgcaagagatcgcaccagctgctgtacgtccggtagcctctgcatatcaccaaaacaaccaagcattaagacgaattaagcaacaccagcaagagaacaggctttggccccccaacagttcacaagatttgatctttttgttggctagtacacctttgtggctttgccctaagattccactttttgttcaacctcccagcctttcaaagggcaggccgagatgtagcagcttctgctttatgctaaactagtacaaatatggctcaaccaccacaagaagaacaaccccgcccttttctcttgtgatgatagtggtttactcctccgaccgggtcaagactcaaagactcctcttttgccctagaactagtaaagcgcgtacacaaatcctaatacttttcccaacacgtgacacacacacatacattgctttgcaactgttttttgagtgccctgcgcgcgtacgcaccactcacgctggccgtagtactactattcaaacaaccaagaatgacctacagggttgcgaggacaaaggtgtggtggctcaccattttcttccgtggacgctgaccggccggccgtagaggcgacggcgctgagaatggcagttgttgctgccgacccatggcgctaacctacagggagacgaaccaaaccatctgtgagtcatttacacaaatccaaccaatcaatcattttccctgaaaatcatatacaacatccaagaaagccacactcgatggtggcaagaacaaaggaaggacaggacagacactggtaggtgggccccacccccaaccacagctgtcccaacgcatgatagtcacaggatcccacattattagtaaaaaaacaaaacatcagttataataagcacgctaataggaaaggaaccctcagctaaacctacacctaaaccataccctcctccatctctttaaaaagaaaaatcaaattctaattatgaacttgaacaaatctttaaattgatttatttcgagaactgcatacgaccatccatcccattcgccgcgcaaccgcatgacgaacgaagctcagccaaccgctacgaccactgactattacatgtgggcccggctcacctttcctcaaaggggaaaaaaaaggaaagataagaaaagaaaaaacccgacacaggtcatcgacaggtggggcccctctcgccggcgctcacgtcacccacgtcgaccaccgcctccgccgcgcgccgccgccgacacgcgcgcgggaggtgggcgcccacgtgtcgcgggcccacctagctttgactctgtccaaccgcgggggggagtgtggcccccaccaccaccaccacgctcccaccacacgagcaattgcaccggaggataaaaggagcacggaaattaccaccctacccccggaacaagcgtaagtgcgtaaccaatccccattggccatggtgaagagagcgaggggcagcatgggaaatccgcgtgcgccgcacacccacttcgccgagtccctgagtcaaccacaaactctactacttccagccatacaaccactggacgaaaacaatccgtgctcgatttcttcctgcggctgtttggtctcgtcgtctcgagcaattccaatgtggaatccagaatctcatttgttcgtggggaagcaatgcggatctgcgaggcggaaacggggatggatgggtgggttgcgtccgttgcaagcaaagaagggggaactgtattatggtagtggatggtgagatggagaattggcgaggaggaggaggagaagaaggaaggtggaaagggaagggaaagggaaaggcggtgtccaattcaccaagggaagggaagggattttcgccactagtaggggtaattccgtcacacggtacagaacagaagcggaaaagggcaaaaaaaaaaactcggaaagcaacatggggataggagagagagtagtggtggggggaggagaagaacccaatgcagcggcggcggcggcggcggaggcggcaagacggaggtggaaggagatgcgggtgcagtgtgaacgcactaaccttggtcgtcgccggcgcggggcggtgtccgggaggcgagcagaaggcgccgtcctcgccgccgctggtggacgcggccgacccggagccagagccagacccggagccggagccgccgctgtagtccagcggcgaggccgggctagcccgggcccacctccccttcttccccgccgccgccgccaccgccgacggagaccggcggcgcgaccgcttcccccgcgtcaccggcggccagatcagctcctcccgcgccgcccccttgctgctgctgctgcaccaccacggcggcgtccaccccgccaggtccgccccccgcagcgagcagatgatgcccgccgccaccgcgtcgtcgtcccccgcacaatccatcgcgcgctcgccgacgaatcccccgaccccggcgaccgtagaggaaggtggaggtggaggtgggtgggggagaagagaatggaatgggagaagaagaaaccaaagccgcggcgtggtgtggtgtctcgttccttttaaatggttgggggtggaagcggaataataaaaaaatagcccaatcccgcacccacacgacacacaccccgcacacctacgatagctaccctcccccactagcggggcccacctgagtcaccgcccactgacacccctagcccccacgtttccacaggccccacctcccagtggcaaagcggaagggaggtggggccgggttgtcagtgggtgcagggtaaagcggcgaggcgtacgccgcaaggtaaaggaggtgggaggagcggcgggtggagactggagggttgaactggaaggggagggagtactagagtagagtactggagtggggtggaggtggggcccacttgtcggtcactgggagagctgctactaacttaagcgggcgaatgcaacagtggtcgggattcgtggctcggcgcgggcaggaggaccgccgtttgtgttcgcccgtgtggggccctggtcccacctggcagtgacggtggacaggaggacctccaaagtctggggcttttaactatttgccacttttagatttggcaaataactatttgtcacccctatttcaatgacatatgtccacatgtgtctataacatgtgggtctagtgacaaaaggttaattgccacatttatatgtggcaaatggttaaatatctcccaaagtctggacgggcaagacggctgtgcagcggaatgtgtactgcttggaatactgtttagagcaaaggaaagtcattagaattttgctagtcctagtactgctgtaacaagtttgaaatgatcttgaactaaggccccgtttacttccccaattttttttttccaaaaacatcacattaaatctttggacgtatgcatgtagcattaaatatatattaaaagaaaaactaattacacagttaagggggaaatcaccagacgaatcttttgagcctaattagtccatgattagccataagtgctatagtaacctataagtgctaatgacgaattaattaagctcaaaagattcgtctcgcggtttctatgcgagttatgaaattagttttttcattcgtgtccgaaaaccccttccgacatctggtcaaacatccgatgtgacacccaaatattttcatttcgcgaactaaacagcccgtaacaatttcagctgaaacatgattttagagttgaaaaaatactaacttctttcaaaatctggtatctcaggctagctgtggacatttaggctgtgcatccacactttcccaactttactctcgcgattttctccctaactgtgtaattagttttttcatttatctacatctaatgcttcatgcatatatccaaagattcgatgtgatgtttttgggaaaaatttctggggaactaaatggggcgtaaacacaccctaaggtgtgaaaaagtttatataaaagggtaagatgattgattggtaaggtgattgttttaggattgtattttttttaaagaaaagaacggattataatctttatagggcatagaatgtactctctccgttttacgttataagacgttttaaatttagtcaaaatcaaactactatattactacttttttctatagagttagttaaacttagagtagtttgactttgatcaacgtcaaaacgtcttataacatgtaacatatgatttttttccccttaacgtgctcataggtcagcccaacatcggatttgtttgtcaattgtcataggtcagccttgttcataattgcttgttggcagattattggtccagattgtttactccactcttgtaaaaaaaagtttcttcgaacattattctgccgcatttagaccactctgttcctagttgctactcctactgtttatatttttaaagtttgttttcaaaatattaatttaccgtgttaattaatcgagtgaatcatccatttcatttctccctaacccatgctgctagaattgaatagatatatataccgggtcaaacagcgccgatgcatgcagatatctcgaggaaagttgaaaactccatgtgggtcgcttggtcaaacaaagtccaggcacacgcgtatctcttctttctcattttgagcccagattgctactagaagatcagaagggggtggcaatagccaattcgtcctagagttgaacttgtcatggtaaactggtaatggccaaagtttagttccaaagtttttctttaaactttaaactttttcatcacatcaaaacttctctacacacataaacttctaacttttctaccatatcgtttcaatttcaatcaaactttcaattttagcgtgaactaaacacacacaatgtcaagcgctagctggcgtctggagaatgtgtagtactgtagtggtctcgccgggggttgactgctgatcagatcatttgagcttttaggctctgtgtttcccattggctgtagctatttttttttagaatcttcgtattactaccttcgtcccaagacgttacaactgaataactgattacacatccttttttaaattgtaatattttgagatggatgaatatatgtccttacctatttcttaaagaaattataatattaaagatgaacctggatcaaattcatccataggatttaatttatttatagagtgagtagactctaagaatcttctcagaagctacatagtacaaacaagctgttttgcaaaaatttaagtccccaaacaaggtattaggttgagttctaaacattttgggggtgtttagatccaggggtataaagttttaacgtgtcacatcgagtattatataggatgttcgggcactaataaaaaaactaattacataatctatcagtaaacggcgagacgaatttattaagcctaattaatccatcattagtaaatatttactgtagcaccacattgtcaaatcatggagcaattagtcttaaaagattcgtctcgtaaattagtcgcaatctgtacaattaattattatttagcctatatttaataatttatataagtgttcaaatgttcgatgtgacatggtgtaaaattttttgtgtggtaacttaccctataccagtacaaccgtataatgcagagcggctttcacatgcacataggagtagcggcagtaggtgttctgaaccaaaatcgcagaagtatgcgactgacaaaagatcaggctgacacacatgaatattactacctccgtcccaaaatagtttccgtgctcaactttgatcgtccgttttatttgaaatttttttataattagcatttttgttgttatgagatgataaaatatgaatagtactttactcgtgacttatgtttttattttttttcaaaaaaatttcaaataagacgaatggtcaaagttgggcgcggaaaaccatagctgcacttattttgggacggagggttcctgtgatacattataaagtgtctagattcattgtattaggatagggttggttaattttgagacacaataagtagtgtagtaagtgtactcgtgtccagatttactgtattagaatggggttagttaactttgagacaaataataagtactgtaataagtgtactcgtagctgcgtaggcgtagaccgtgtcgagccctcactcatccggcccctgaccacgattagaccgctgagcggctcaccgtaccgtaccatttctcgcgagacccccgtacgtgtaccggtctgtactaagtacactgtacactgtttgctgctacagcgtctcctaaccgcatcattaagccattcccctttcttcaaacacgtcattaagggaggcattaaccaactgcttccattccattccatgcaatgcaaccagtacaagtttacaactacttttcggttcattgaaattaatcaaaaaatcatatgaaataattcgtactggtgcgttttgaagctgtatccatacataatttcatcgtaagggtcttggtaggattttgcatacgaatttgtggtgctattgaagtttgtgattttgtggccatgcatggatcgttcgcgtgcagaggagatcagagagtctctgtaacctgtgatctcaagttttaagacgagatcgactgagaccaagcaaatgttgcaccaagctgaggccgtgtttagttttccccatattcccaactttccattatatcatatcacatcaaaaacttttttacacacataaacttctagttttttttctaaactctcaactttcttcaaacatctaatttttttcaggatctaaacacaccctgagtcgacgagcagcgcgaattgaaaccgcggttgttatcgccgccagccacacgtacacagccagtgaccctatcaattcttttaaaaaagattaaagttgtgataagttttgttcgatttttttcagtgtttatcatggtttttatgcggttatcgtgattaccaagcttcctaccaagatacgataccgatacgatacctctactcggacctatacgatacctctactcggacctcggggatgaagccaggtcagtgtggggcagctttggctcgagctttacacctggtagaaaaatttgcgttagcatatattattaattgtaagttaaattttaaatacaaaatttatgcttcatagttaagctctatgcttaagataccccctataaaccctggagaaatatgtacgtgccctggtggtgatgggctgtccagcccatgggccggagccggacaaagatttcggtccggcccagtacaccggccttgcagatccgtaattcggtccagtaccggtatcgcgacgaaaacgatcgttattgctcaaattgttgtgaccattagttaagtacaactaatccagctgttaataagcatggcatcatttgctagtactgtgtaaacaatcaaggaaaacacaaagatgaatggtccaagttcaaaaatgaatagtgcttattgtcaattactccctctgttcagattcgttgtatgtcccatcgaagtactagattaagtctttttgggacggagggagtatttataaacagagagtattttcttccacgctaatttaagaataaaacatttatattttgttttattagcggtttaaaactcttgactagaaaacagaccacgacaaagaaaaccctccaaaattaactttaaaagttccaaattctaaaatttagctgcagctaataaactagtaataaacatacctcgaaaacattctgtaacgtacgtaccagtactacgtaagagtacacatgggtgactaatcacccgatttgacgcagtaattacacggtgacacaatctgtaatgtactttctttgtagaaacacagtacagacacggtaatctataatgtactactgctgcgtgactgcaacatcatttggtagtgacctgacaagataaagtcatcaccgagataatgtagtttcaaagcttgtactggtacccgtgattcttgatcaatgactgatagtatctcctccgtttcataaatgtaagtcattatatcattttctatatacatattgatgttaatgaatctagatagatatatatgtttagatttattaccattaatgaaatgctagaatgacttactccctccgtttcacaatgtaagtcattctagcatttcccacattcatattaatattaatgataatgaatctagacatatctatctatctagatttattaacaataatatatatatataaatgatagaatgacttatattatgaaacggagtaagttctacaatacactgcgtgtaagcatttgcaacaatcacccgtgccggccggtctgcttaagccactgcaattaatcccagcaagcaacagcctaactaataacgtgacgcttcactcgcgtcatccacaacgtaattagtagtacatatatatccaccattttgttgagtgtcagacttgttcatgtttatgtaaatttataggaaaaagaaatgtattccctcggtttcagtttgttagttgttctggcaaatctcatagtactaaattaaaaggtgtgacctattatattgctaccctcagcatctctaattatcttcccagaggtagcaattcatttttttttctgttagtactactactactgctatattagtgaagggtatgaaaggaaatacatatctaaaaagatatggaatatcagaacggcaagtattttaacaaaaaaaaaactaaatgttactccctccgttccaaaatataagcatttttttaacatagtattcgagatattactttgatcaacactatctataaaaatagaatgttttaaataaaaagagtttgtttaatgataaatatagtaaaatcaattttacataattgatatttttaattttttttatattaatagtcaaagtaaaaaatatttgacgtgacactatgtttaaaatgcttatattttaggacgaagagggtatggtaaactagaacaacatctctaaaagttttgaacgacaaataaattagaacgaagggaccttcaatattttcaacataaaagcaaatattggatttaatagaattaatttgatgttgcacgtattgttagtattatgtaccaacactaatatagtacttgactagagtagctatccacagtagtaggtcgttcaattaaatcaacaactaggcccttcattaactaattggaccatatacttatcctcccaaccgtcagacggttggagcgtatggatcaacggctcagatcgatcagcagcttagccactagcttagccagttgccgtgtgactgcttctgacagatcacaaatgcaacaaaattgcctggtcccctgtacatatgcattccattctggctttgcaatgttttgacattgctgattgtcactgccagaagacctggcaatcactcactagagtctggagaccatctgcagatgcatatgcatgatctggcctacacaaagatcacaacatcatctcaacatgttcttgttttatagtaccaaaaggtgtcacctaatcattcaggtagtattatttttactgtgctaatcacctggattgttatctcaatctagatggattggtcgaggaagcatcatagtacatgtatatataaaaattactatcaaggtgtacttcatgtgtactctgctgttgattatgattataggcgtttgagatgaaaagttgcatgtttttttctgcagtttgaagcgaaaacttgtccgaatacggcagtgttcagcgtgtacgtgtgggtcatacacccttacgaccatctgataatccaatttacaaatcgtataggagtatgtttcatattgccaatttaaattttagtctgattttacagaagaaaaaaaaacccagctacacttcccattgcacaagccacaactagagttttctgaacattttaattaacagaattgctttgttctgcatccatctgaaagaaataaaaataaaataaaatgctgattaaaccctgacactgtaaaatctaaacatgattagcgaaagagaaacaccgacagagagttgtactagtagtactacctgtggagtctcatcctcttaacaaagcctgtccgtgcgttcgaaatcgaaatgaatcgctgccgaatttaatttgggcgatcattcactaggtgacagtggagatagatggaacatttctttcatgggtgagatcgattcaatgctcagttgatgatgatacttaagctcggttttaaactccatcgagaggaacaatctcaactgccgtttgctctcccgttgaaacgccgcggtttttgtgtcgtcaggagttggtagcagctgcaaaaaagtcttaactactctagttaattactccacttatttatatgttcaaccgttatttcaaaacagcatctataacgtttaggctgtgttattcccccttcttttccgactcaccttattttctttaccgcgtgcacgtttcttaaaatattaaatattacgtttttttaaaaaaaattctacaggaatttttttttaaaaaaattatattaatatatttttttaaaaaaatatcaatacttaattaattatacgctaataagtagtaccggagggattagttcccaactcactccaacgaacttagccttagtatatcaaactagtgttcaaatccatatgagtcttacagaacctaaactaacagctcctccatcatttactcttcagcttatcaaccgtaattatcaaaatttaaatttgaaaacttaattttataggagtagttgaatttgatttttttcatcgtcatttattttctagcattgggttatataaaagtttacccacaaattgtttaagagttttagcttatgatcagacctgataagatatcgtctacattttaaggaagaccttacaacaaagtcgcgcggaacaattctaaatcgaactaaatactgtgaaaatcatgcgaatttaatggaggcttgaactcaaaatacacacgaccaaaatatgtcaaaaaatttaaactttgtacgcatgaaattcgccagttggccagagagcattgtgcactgaagatgaggaggtgggccggaatggaaggagggaatcacggagagggcacgaaaactgaagttggtgtggctctgccctgccctgcactgcacatgtactatcacccccattcaacaccaactctctctctctctctctctctctctcaatctctctcaaatgagctgatttcagtgctcaccatcccaacaagaaacaatgcactgccttttggcaactgccacatgactgtttttctcccttttttttcttcttattttcttcagagatcaaccctggtagtactagcagtagtaggagtagtagtacaaaaactacaccaatccatacagtccgtgcaccaaaagccttttgcctttttcttcctccctctcctcctcctccatttcccaagatcaagaaagaaacaggctgcttgtgcagacaaatcgttggtttgggttgagtgcacacgaggatcaagaggggaggagaggaagaggacaacctgctggtcacaatatctgcattagtttttttatctttggattccctgggttttcatggtatcttgtcagagaggcacagaggcctttgtgttcttgctgttccctttgtcttctccacttctcctcctcttcagccagcgaggtgagtgagtgagagagagggtcaatgcgatgccaccgccgccattgacgcctctctcctcctcctcctcccgcttcttcttcttgctggtgctggtgctggtgctgagctgctcgttttcggccaatgggaggactcaccggtcgccggcggcggcggcctcgccttctcctggaccggggccttcaccggcgccggcgacaccgcgggttgttccccctgctccggctccggctaccggaggtggaggtggaggtggaggcatcttctcctcgaatggcagcctcgccgtgactcccgccgccgccgccgccgcggtggcgccttctcctcccttgggtaggttggcggctgttacagttggatcaaagattgcgttttcttttttcttttttgtctatgtgttttggtgtcctgtcgcattgctgaattttgtgttctctggctaatttttttaaaaaaatttagggagaaattttatcgatgtttccttcacccatttctgagaaattcccgtgctgatttggtgggaaacccgtgttgtttcttttggagatatggggtaaaaagtgcgcccttgggatcctttggtttcttccaagtttgaacaaagcgcataactttaagtgccgtctcgtgaacttgggtacgaattggaattgaatatatgtgctcgttctttttagtatggtgaactttgcccaatcttgggaaagaaacaaaaaagtgcattctttccaaaggaaaaaagagaaacaaaagatgctccaatatatttgcctca

SEQ ID NO: 66210 - DNA, 695 bp, Oryza sativa
acagatataaggttgttcctagttgcatctgaagtttaagtttcatgttaaatgaagagagatataactcaagttttttagaccatgtgaagttgacttcaaagttgaagatataagcacaatagcacctaatggctgatttgcactagacatgttccatcactcaacatctcaaaaaccaccatgatattgcatggcatttacgtatataagataaaaaaaacagcaaaaaaaatcttctcagcaaaattagcatatgaaagagtaccctgttggctgccctgttgctgcattagtaacaataactactttgagcaccgcaccaaacttgttgaaatggcgagatagcgcgtccttggtggcaccaaaatgaaccttcaaataaaattgacaaaggtataagaatataggacaagaaaccatgtgtgatgagaagacatagataccaacattgctaacatagagggttctagagtctgcgtcctcagttgggtgtgcagtgctatatgaactcgtaactgcaaggaaggacagatatattatattgtgcaataaacaatagtgagataaggtgaaacattccgtcctgatgattgtttctgatgggaatttacatcagagtgctagttcagcattatgctttgacttttgaattaaacaattttaaatggtaaaatgattttgagttatgtcac

SEQ ID NO: 66211 - DNA, 834 bp, Oryza sativa
attcctgcagccctgcaaaatttgtgatatgccaccctgacccacatgttattgactcatgtgggtcctaaatgtcattgagatacgggtggcatgtctcaaattttgtaaatatagggtggcatggttacaacaaaccgaaaaaagagaccgggcgaaagataaaaaaagcgaaaaaaataaaaaaaaatccgacccctatccgattccctctcagaaacgaaaaaaaagtccgactatagatccggttcccccttaaaaacgaaaaataaaaggcgccactccttttgagtccgagatacgagcgactactcctctcagtttcaatctatatcgtgatatctcacacatcttggtgaaacaaaatgatgttccggattgaaaatctgtttaaaaaacggaacctacaggtcgagagcattccatttttatatgattttaatttttgggtttgtacttttacatttgagtccctataatcttgcaataagctacttgaggtcgtttttgttaaaaataataataaaagagagagaacaaaagcagaaaggtgcataaaaagagaaaagagtaaattgcatcttagaccatatttttttaccatggtttcactttgggatactcttaacataatgttttcactttaggcctgattttattaccaaaacctttcactttgggccattggcccataatcagtctctcaaagcctatctctcatcactatctacctggtcatcttcgactcttttcgtccatggctctatagatcacaaagggcctatttagattgttaccctaccaattttttggtagtgccaaaatataggcaag

SEQ ID NO: 66212 - DNA, 8974 bp, Oryza sativa
cgtgaagaccttgagcaaggcaagtcaccctttgatcaattgcccctataattgaaaagtcattattattttgtttgcaactttcattattagaatcacacttaacttgcttggcctcggtttgcgtgccaaaccgacggacctacccagtagtcgcactaatttccgtaggtcgtaataccctgattccttgtcgctccacccttgtggtacctcggtattcgtgctctttgagcgcgtataccaaatatctcacatacaccgttgtttgttgaaaacttggaaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagtttgatttgtgaacgcctaaaatggcctatgtttatgtgaggatttgatccttctatgtggcatgaggtaaccctgggtcagcttgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgtctgtgctttgtgaaaagttgttgtggtgtgggaatcgtaaccagaatcagcctatgtggcagatggatgacctgagtggtcaagaaacgaatctgtgtgattcgggatgtctgcgggcatcatagactaggcttcctgagtggaagcggattgttgtgctgctaggcagctggactctgggagtccgagaaaatgaaaaaggctctgggagccgattaatcaagtggaatggctctgggagccgagaagtaatgatctgacccgggaggtcggtacattactaaatgagctgttgaaaaacatctcttaaagtcgaatcgagacgcaagtctctcttcggcccaaacttagaaagaaataaatcacttagtgatttcaaaatgtcttcaaataaaagatttgtaaaataaccttgcctctcttccaagcttgcattaaacacctaagttcccgtgacttgctgagtacgaaagtactcacccttgctctatataaatatatatatatagttcctccgccctgaagagaagataaagtaaagtgaagattagggtttcgtcctggtttccagccgtcgcctgtggtgttgggtgttagtccgttggttccgctgctgctgctgctgttggtgtttcctcgtccgcgtcgtcggttgtaatctcgggctgtctgagctgcaacctaagttaaggtaaataagtcctctatttagtttaaggattgctatgattcatatttgtcaccgtgggtaccagcactatgtcctgggactggtaccgtgatcgcggtttcgtaggaagcggttcgcgccgttttccctacgacacgctcctgtcaggtgccgttgtacggcggtatcagattggggtgtgacagtagcccgctactcttctttttcaatttttcatctcattaaaatatatttatatcttgctaatagtctgctatactgtacctgctctaagtagatgatgggtcatataatttaccctccttcacaaatgtgttatttgtgacaggtggtaagttaccacttgctattgatgactcattttgactggtcatatataacttatcatccgagtcactaatgacaagtcatgatttttaaatttggaatgaacaaaaaactataaagaatattttgaatttttctagttattgaaacatcactactcataaaaccacaatttttcattttttaaaattttataaaatgcacaaaaaactagaaagaatattttgagtctatataattatcctatacatgatcacacatcactacttgtaaatccataatttttttcaattttaaatgcatagaaaatgtaaaaatatattttaaattttactaaccatcctatatacatgatacataattttcagataatattcacatatattcggctatggagttcaagacataatatctccctctcttcacaaggcacgcccttaccaactcacctataaaactcacgttatcaactccttcatcattattcgttttactgttcttatatatccaaatcatgtttcacactccagatgacttcaaatgaaaaggtccttaactacaaagttaccgatcttatgtgttccgcgacttttgtataaggattttctctatcaaagatcgttcgaagaatttaaatttttattttttaaaatatatttttttaaagagtatgtaaacaatctgaaataaaaattaatattatcgcttttaacattatagacctagacattcttaacgagttggatcaacataatacgtttgagatactcatctcgtacagttaattataacattttggttgcttattacgacgagattgatggatgaagggatggatctaccatgaaggcaacgaggtctcgagtcttcggtattgacgcgagaatcacggaagcctccacgaagctctcactaaattttttttgatatatgtaaataggaagtggagggggggtgagggtagttttgtctaatttgtttggatgaacattggtacgaacggcacgtttcggcttccttgtctatatgtaaccgtatatatatatatatatatatatatatatatatatatatatatatatatatatatatatatatatatatatatatatgcatgcaccgtctttctggttgaatttataattttgtgctgtcttattaattacatggttaattacgtctacgtgcatgcatgtacgtgcaaacacggatgatggatatcgtacgccgacataacgtacgcaggttgaactcttgaccgaactcggtgattcggtgtgttattcacgaaaaagttcgctgcctctatatctatttatgtacctatgctaattataattggttatttaatttctcgaacgaactcgatcgatcggtgattcggtgttattcacgaaaaagttcgcggcctctatatctactatttatgtacctagatatactaattataattagttatttcaacttttcaagggagctgactaggggtgttgattagacgcatcataccgggtgttgattagacacatcataccagcgcggaggcgcggaaccatgtagggttttatcaccacttttccaagtcatctgtctcatttttcacgcgcccacttattaaattattaaatggtatatttttttaaaaaaattatacgaaatttgctttaaaaatcattataatccatttttaaataaaattaactaataattaattaattatgtattaatgcaccggatttgtcacaaaatttatgacgttttttttaaaaaaattaagacgtatgatgctgtgtcaagatttgtcctactacattttagttaaaaaatatattttaatatattaaaaagtactatgtaacgtcgtacattttagttaaatttcttgtaactatattataacctctatataataaaaagttgcatatatttgcgtatatataagttgtattatgttgtggtatagttatggtaaaaggtattataaatagtttttcgttaaaaagaaacttgtggcagttttttaatagccccctatatgaagagcctgtattagactgaaaaaaaactacgatgaactctttaattgtagtttttttttccaaatttgtaattaataaacatggatttattcccatattagatttctactactacaaaatcgattttcacggtcgaggcaccctataggttacaacctggatataaatgcttccacatgcaaaaatcgatcactcccccagggtcgattgaagagccacatgtaaaaataaattatcgcatgcatctttaaaattttccaagtcatcatacttatctcctcacctcctttccccctctaatttctactctccactctctcccttgcctccccctatcaatcggtgggcgagagcaaccagtgacagcgggctcgctcggcagcaacaccgacgcatgtgacgactgcagcgacggcgggtagcaaatgagggtggccgattcggcggcgtggtccttggggaggggcggatatccaccgcccttggcattatgaggggcgacggcagagctcgagggcggtggtttaggtggcaccgtccttgggaggggtggatccgccgtcctcggtctcaggaggggcgatgccgacggtgaactcgagggaggaagctagggtttcgaccaaatttgttttatttttatttttatttttttcttgaaattatttttgcatatggttggcataggggactgcaccagccacatgaaaaaatgtggactttcgcacacacctgagtgtaggcgggccacctaatcgcttgcgaaaatcgatttcgatcgcatgcaaaaatcgattttgtagtagtgttttagtttaccaattttgaatatattccaaaattcgaaattgatactgattagcaaattgcaagtgacgtggactgtgctttaaatctaaatatctaatcccctataatttagaaataaatttagaattaataaatatggaaatgtagctatcttggatttattttatcaacttaattctaaattcgaacttaacaggtagtaagttataattgacgtggagtcttctgtttagtcgctataatttcaaatatataccctacaattttttttagacagagaagtcgaagcctccatcatttcacaacgaaaaacaacagaaagccgtcatgttatttagagtaaaaaaaagatagtacttcctccgtcccaaattataggacgtctcctttgtaagaaaaattaaattcgatagcttttgactaataatcataataactatatttatactaagtattacttatgtatgttattatattactagatttatattttaaaatactttcatgtgatgctaatttcatatttattgggattatagaataaaataaaatactggtctaaatatattattgaaaattatgtgagaaaatatatatcttttaatttgggatagacgtagtatatctgtaataacagcacgcgtaacgttcgggttggcaactggagtatagctaatatgtgatcgtcgagccgtgtcatgtcaactgtctcaggttagtgataaaatatttttctccgcgaattccttctgccgctggcttggctagccctgtagctacgcgtccacctgagactggcacctcaggttagtgattaaccaactgtacacgtagctatctgcgcgaatgttagtctgcataatcatgtggttaaaactggaaccactagtactactgtagtaaaccctgtgcccatcggggtgcaaatgtcatatacgtgggtacttatggaccaaatgatagtggcacatcgtgtcatcattcatatcacgctctcaaagatctctaagggtgtatgtgagggagagaggattgggaagatacgtaaaatgaggtaagtcattagctcatgattaattgagtattaactattttaaactttaaaaatggattaacatgatttttttaaagcaacttttgtatagaaaatttttacaaaaaaacgtaccgtttaatagtttgaaaaatgttcgtgcggaaaacgagtgacaatctcccctatctccaatatctccaatgaacgaacgcagcctaaaataagttgcggtcgccgcccttttcaatgcccttctgatcgatcttccagcgaaatgcggtgaggttgatttcactggttgcatactagtacgacaaattaaattaaagctcgcgccccccactactgctatgcagtatacagcgacgacgaatttaatcaaatctgtcaaagcgagcagacctaaccggtttcatgatatttgttcacacctaacttcgcgtggagtgcatgcgcacgcgccggcgaagtggcgaatccatttcaggtccagtcctgcgctcaggaggggcttctgagttctgatgaagtctagggctttttggcaggatgcaaatcctccagtgttctgtacctgtagtagtgtcactgatgtgggtcccacctgctccgggcccatatgacagtgacacatactgcaatatacagtactcatttggatcccctgctcatttggcatcggttttcagctcaaataaagcgctgggtgtttattcagcttagccaaagtactgatcagctctaatgctaatgggtaagcgtttaattggactcggatggggacgacatcgacaacggaacggtacgaagacgatgttattgtccttaagcgaagccgcgatgataccatcaccataggcacagtacgaacactacggagtacttcctccgttttacaatgtaaaacattctaatatttttcatattcataatgatgttaatgaatctagatagatatatatatgtttagatttattaacatcaatatgaatgtgaaaaatactagaataatataataacttacattctaaaacggagggagtattaattttgaagcagatctcagtcgtccaaaagcttctccacacaacgcgcgaagccaccgtttcccccgaaaaacattgaagaaatcaaacggttggtaaaaaaaacatgtgaatatattgcattatactcgattcacatactaaaagccaggattatttgaccgctccttccggcctcatcgcacgagagcgcaactaatcccttgaggaaaccaggaaaaccctaaatgattggttaatactccctccgttctgtaatataagagattttaacattttgtttgcattgtttgatcgttcatcttattaaaataatttagaattattatttatttttttacttactttattatccaaagtactttaagcacaattttttgtttttttatatttgcacaaattttgtgaataagacaggtggtcaaacaatgcaagtaaaatattaaaatctcttatattacaggatagagggagtagaaaattactggtaggattcattgctttatgttcgatccacactctcagctagctcgtctacaatatgagcccattgcaatgcaccagcatattcctagtaattgagaaaatttaagtactattaaccatcaagatttgttcacatacatcgtaccgccatgttgaattatagacatcttttttttttttgaagtcgactttatagacatcttacgggagggttaggttacccatcgagagaaggatggtgaagtgaaattggcagatctggacctgaacaaacagtaaaatgagtttgttattatttgatatacgaaacaatactagacaatttagctgtaatatctacttcatatgtcttaagatataaacatgtgaagttgggtgagtaaggactaaatgaatttcattattaaaaaatacgggatatatagttgcgattggttgagatgagtagcatatggttaattatattttggataaaatttagacgttgaaaaaaataactatattttggaaaagaggagagaactagtagtttgctacgtgcctcaagaacattgagtaatttattgtagcgctttcgtccggacggccggtccatgtcaaattaaatggtaaactctctgcgcgtacaattccgtacgttcagccctgccgtaactagtactagcaacggaagagggtccaatccttagaaagggagtcactagaggagccggcatgttatattgtagaagtttccacgaagtggattatacgtgcggattatattgctgagggttttccatcatcaaaaaaattattacggaggtttcgaaaaggggattttgatggaaatcatagcagattatattgcagaggttaattttcacgaggatccaatattctctatattcattttggacaataagaggaaaaataatgatggctgatatatctgtagaaagaaaacaataggagggcgaatattccatataagtgtggggcaatgtgtatttttaccctttttgtattttagactacccactctctttgcaagtagatcaatagtcccagttacatccgtgccctcatgttgacgatctcccttatttacgtccagcccacattgttaatgaaaaaaaatgttggatgtggttagaaaaaccactaggatggtctaaattaagtaggtaaaaataattggtccaaagttttttttaaaaagttagataaatagtgatcgaaagtaaaacttatatagataataaaaggtggtccaatctagatactacagtccatttatgttttaaaacggaagaaatactattggacgacaagtccaccaccacagtcaacgtgcccactccggaggcaaggaagcacggtatatctatacacagtacgctatcctagttcaataatcaagtctgttatagctcctgctagctatatagtatgtgacaaccactctactgtaatgatgaactaatgatctagctctagtaatttttatatgtaaaagaactagaaccataaggcatgagaacttgtggttatctgtggatacatgagctagagcagatacaatagtaagttataagacaactataaacatatttaaaaagataaagaaagagagaagagcagtgagctacagatctgtagccagctacagcacggactccaagacgtaatgtgtat

SEQ ID NO: 66213 - DNA, 1624 bp, Oryza sativa
aaaccatggttaaaaaacatggaccaatatgcaatttactcgaaaagagtaaggaaagctgcacaaagaaaagaaaaacaacaacaaaagttctgttttccctaagtggtgaaaaaaacaccatagatccaaacggaaaaaaaatccgattcctataaaaggacaaaaaaaaagtggtgaaaaaaaatactagattcgattccttgaaaaacaggaaaaaaaagtctgattcctataaaggcaaaaaaaccgaaaaaacaccttaaaaaagttcatccgattccctaagaaagtggcgaaaaaatggttcgtaaaaaaataaaaagctggttcgtataaaataaataatgcacacgagaaaaaaaatagaaagggcgaaacaaagtctgatttctaatcaatatatatctcttctttatctctaatataatctaactatttaaaaagagaaaatacacgagaaaataaaaaaacatgctaaaaaggctttccatcttccataaaaaaatttaaaaaacatgcgacgaaaaaaatgtcagaaaaaacgcgcctttttaaaaaatggttttaaaaaaccatgcatgaaaaaaacatcgtctattaaaaaaatcgctctgagtcggataggatccatcgattttttgccacctattacacggcttttatttcgtcatatattctcctgtattgacaaaaagcaaaaaaaaaggaacatttgaaaaaaaaacaagcaaaaaaacgcgcgagataataattgtcaaaaaaggcaaaaaaacacacgagaaaagaaaagaaaagaaaaaaagggagaaaaatatggttttcattgtaaataaaaagcaaaaaaaaacatgctagaaaaaaacttttagaaagaaatgagccattgctgaatggtttgagaaaatcgcgcaagaaaaaaactgtttataaaaaaaaggttctcattaaagtacaaacattgtcattgacatgattattcatgaaaaacgcatattatcattagaatgttttcacccgttgcaacgcacggacatttttgctattcttaactaattaaaatattcgtaattttcctttcgtcacagtaatttttcgtccgtcaatctgagaagcggcatcctccatacacacgcgcaattacatccatacgacggccaaagcccaaaaaaaagaaaaaaaagagttcgatacaaaatcaaatatggattaacaaaccaatcgaacatcatagttagtattagaactacaccgagagataatcctaccaataatctaatctcatggaagcactttccaaaaccagactttcatagttcgacacaaccaaatcggatgcacaaacaccataagacaaacacaataaccaaagattcacccaaataaaatcaacaaagggatccatgggagaactccaatccaccccaacaaaattagcattgcagcctaaagcaatcgacaaatcccttcttacatatccatcttgacctccttcttcagcttcttcagtagtcgcgccgccggtggggaggcacacggaggggcaccgacgtggggaggggcagctcgtggtgggaggagggccgtcgctggtgggaggagccaatcctgagccactgcgccg

SEQ ID NO: 66214 - DNA, 583 bp, Oryza sativa
ttcccggcgaataagcttttaagcttatcgtcacagttaatctcccttttgtttgctgggttctgcaaaacatcaagcacataatctcatttcaggaacaaactgcttgcagtgaaatctacggcacatgaagagttcagtttagtacagcaaatgattgtgacacaagtgtaatcaaattaatttatataccatggtaaactagaaaggcagctaaagtagcatatctaaaacacggctaacactgctgcaggtgcagagcagacattcaagaacatgagttcaatcatgcctataacaatgtacagtaagttaataacagatgatcaaagaataactataatgcacgtcacactatatataaccacacaacagtgatcagcatacattctggacgccgtgctccacatcgctctaacagtcaagttacaacttcagtacaataaaactaatccaaatctgccaaataaaatgcaccgctgtcaaagtagattactgctcagcaaccttagcacatgtaaaatgctagaaaagaactttattgggtgcaattttgtttttattcccttattgacaccccccc

SEQ ID NO: 66215 - DNA, 4044 bp, Oryza sativa
ggaggggcaactcgcggtgggaggagggccgtcgccagtgggggagagatgagcggcacggcatggattattggtgagaacgtgcgcccatcgcacctttccgcaccaccaccgacgacgatctcctcggcgctgcccctacacccatctcaccaatctgcgctgccagggcagttagccgctgctagagtcgccgtctccgaccccgatctacacctggacgcccccccttccgcgcccccattggccggcttggagagtaatgggggagagagagaacgagggacggcttggagagtaatgagggagaaagagagagagtgggagagagagaacgagagagtgagagtgagaggataaggatctccaaatttctctcctcggtaatgtacagcaacaatctttcttttcttttcttgaaaaaacaagagctttagattggactaaattgcagtcaaatgtcaatgtgtgtttttacattgtgctaatccaaggggattcaattccgccaaaaatattttattttattgagatcgttaacattatataaatatttcactttaatatttatttgagataaaaaataacaattgcaaaaaaaatccacgagacttaactccaccccaagctttgttgtcgataccgccacccacgcctcgagccgacaccgaatccgccacccacgacccgagtcgccaccagattcaccacccatggcccacaaccgagctccacctcttgtggcttgacctcaccgccttgaacttcgtcaccagtaccatcgcccattactcgagctccgttgccgccggtttccactcctcccgttgaatcgagaggggaagaagatgccgagggagaggacaattggatctacgggtggcggatctgacgggagctcgggcggtagggtcaagccatcttccttcctctaaaaaattttgaaatatcgttcggcgaaagttatttttaattttatggtgttatttctatgattatatttccttcagtcgaattgcgatatatggtttacgattttaatttaatcatatttctttcggtccaattgtgatatgtggtttataattttaatttatatcgatcaattttatttagaatccgttgcaacacacgggcattatgctagtctactattataaaatgtaaaaatgtttcatccaaaattttggtacgtcatccgtgttcgaatcggttttaattttatgtttcagtcaaatccttttcttttattttatgccaaagtgtccgtcttatccgagacgcgcgtaaattaattgggcacgcacttttcatacgtcccttgccgcacgcaacacccttgtgtgtgtgattttctgcatgccagattgggcccgcgacaccctcgcgtgcgcgatttgcctttgtcgcatgtttgattgggactgtatcgtcctcacccgtgatttaaaaattgaagatgttttttgtcgaaactatggaatgtcgaccgtatctgacggagcgcggggctcctcaccgggagaccgcacaggcccccctttgccggttcggccgggggctcagggtgagatcccaagctctctctgtatgtggaaagatcgcgacctatcgaaagagcatgaaacataagcgatgtatacaggttcgggccgctgagaagcgtaataccctactcctgtgtttttgtggatctgagtatcaaggagctacaaagtgtgagccaacctcccccttcttctcctttgttctcggtccccaatctggaaaagatccttcttttatacttcaaggggataccacatgcacccctctctttccaaactggacttttcttctcttcataaatggacggagatttgcacggttgtcctccgaacatcttcctgacgggacggcacacacctacctccacttctgccggaggcaggcgcgtcgtgggaatgtggctgtgtgctgacgacatgagcagtgtcagaccggtcacaaatcagtcattcttgtctaccacgcgtcagcttagcaacgtgcatgtttgcccttcttcacacaacatcttgcctgtaatggttaggatgaagcctggcatatatcgactggggctaacgtgccatctctgggatgtaacacgctagctccagctggggacgagtgcctagaagctctcgtcttgacgggatggggcgaagcgtgcgtcagaccgcctgtcgccacctaacccgcgatctgaccggtctgtgaccggtcacagaccggataaacgagtgcactgcactgcacttcgtgcggtgtgacacgtttagccgaggcgcaataaatgcggttaggtgagccccgctgggctcacccaacccatacacgcggaggagaaaccgcgaggggtcggggcgcctcggcccgtctggggcgaggcaggagtggtccgagcccccccctcggggagaccaagaggtgggcgcacacatcaccctcgggcccgacgtctcccgagggtgccaggccacgtgggtgattgtgtctgcctcaagcctctagtcatgatactcccggtcccatgtcaccgacagtatccgattcccgtcacgcgtaacattcattgcaaagtcattactcgcaaacgaactgcgaaagagagtccgtgtgatgtagataccaagtgaatgaaattcgcagactccgtatggatatcatgtacatcgttgcttagatcatccgattctattcgcattacacaacacgattcctaggacatgttagcataatttcaagtcagtctccacacatgctcgtatgtactattagggataccattacaataatacataagaatcaattttactttcgaaaagagcatgccaactaaaataaaaagatgatcgaagttgttgattccgtccgtcatcaattcttgcctgacttgagataaagctggatgacaaattgggctcgtgtttgaatgcctcattgtttggcttatgcttattcctataagccgaatttaaattttagaacttattgacacacaaatagccttttatttggtaataagtgattcaggtatgcacatgaatagacgaaataatgaactttgattatttatctactgacatatgttcaaattaaattggctctacccgttgcaacgcacgggcatcttttctggtaaagaataagtaaagggacctgagttagacttttgggatggatggactccacagggaggagggggagtactgggccggttgtagtgctgggcctgccatgtgctggaagaggaaaagatggcccaagtgtaataggatccttttggataattgctaggaatttttgtattttgccaatgagtttggattagaattttgaaaggaatttgtattagaatttgctctggagattgtaaatggattgtatagttggacatttatcttgcctttgtaattggactgttaaataggatgagatttgattcggctgcttagtcgatcaaggactaaacttaggatttctttgcaattgcctgaacgaacggatgacgatatcgaagaggggtttagaatcggcgcatggcatacaaattcattggatatttcaaaggtagggacaatttcaacgatatttggatcaacacacgacggtcgacttcgccgaacgattttagggttttaaatgaaaggcgaactcaaggattttgagtaaaaggaaacagggaaaaagaatctgaggaaggctgagtggagtgtttttcgattcaactctagtgttccaaagtttcgggaaaagatacgatatagcaacaattgaaaagggtttcgggacttctattagctttgcaccaaagtgcttaacgaaacagacggagaggggagaggacaaggaaggacatcgaacggaggacatcctttagaaggaacgatttaatcatagtagtcaaagattcaagggaatgacgcaatattgtgataatagggttctcgggatatgattatggaattgcaattacggaataatggtgggttgagaggtcaatgaagggagattaccttg

SEQ ID NO: 66216 - DNA, 1306 bp, Oryza sativa
tgcaagaatcaaattatcgttacatggatccgctagttgttggtgtttgtcaccctgctcccagaagtagcatttgtcaccagccttcctcctctaataagtggttgttgaactgtcgataatgcaggtggaccttcattctggtgacgatttacttcggggtaggtcccttaatccctcctttttcacaacaaaatagtttgtctctgcactgaattcatgaatctaatgattcatgtcgatttatctttacatcgaacacatctgaagaaaagtttgttttgtggaattgttcagctcggcacggcgttgtccatctatggatgcagcaagcttgctgatgagaatgttgtcactgaaagaacagacatggagctcggctcgtacgtcgcccatggagctggtactaaacccaatttgaatggggaagatgacacaggagagattgctggattctggggttacctgctccagatcatctaccaggtaaagagggattccatgcagccaaagaacttagaataaccatccacttgagcgcctttttttttcttatttgttattgaagagagttatcttatctgcactgacatttgcgtccatggagagggggtctgatctcattaggcttttcatacgcaattattgcactaacaactaaagtacgtttgtggtgtgctctgatgaattggattccgtttctaaagatcagatgtgcccacatactagcatctttgtccggtcacatttcaagggctctcacgtagccgccctacatgagccatcttgacatcttgttggtcctatctaaatattcagataatctctgcaaatctcacatttccttgtacctcaagggctgaatcagctttaaaccgctttgcgaaatgtagggctgactctttttagtagtggcatcaagaataaagacaacatgtttcctttgtgttgatttgcaaggcctaactgtacccaaacggtgactgaatacctttctaggctgaaataggacagaatggaactattgttctgctttgtgaataagaattactagatagttctatggatggtagtttactagcgccatgtttagttccaaagttattcttcaaactttcaactttttcatcgcatcaaaactttcctacacacacaaacttccaacttttccgtcacatcatttcaatttcaaccaaacttccaattttggtgtgaactaaacacaacctagatctgtgttgggttactgtgtacactttgccaacaaaattttgtaatatatctcaccttttttagagaaaagaat

SEQ ID NO: 66217 - DNA, 9588 bp, Oryza sativa
cccactattagctccaattcatccatagccaattctaatagctaattcatataatagttgccttactatactattaatatatggtcccacctgtcatacacatagtgtgtcttggagtccgtgctgcagctggctgtagatctatagtccgctgctcttctctcttatcgtttatcatattttcattaaaatatgtttatagctggctaatagtctgctattgtacctgctccaaaccagtacgagtagtttaattatagtgctccgcgccgtggcccagttaatcagagggtcgtagcatatatagcagcgcagtaaatgaacgatcgagccgtcgtccaccgccgacaacgtggtcgctcgcaaggccgtgaaggggacggcggcgaggcctcgcgccacggcgcccagccacacatacccccgtgcgcccacgtgcccccgtctccaaccgcaagtccacactcccctccctagctagctcgctcgctcgctagctacacgtacaccacgccgcccgtgctacttagctagccagccagccagcccgtcctcctcctcctcctcctcctatattacggcgccgtgcaggccgtcgtgggcgtggcgcagcctctccatactggagtactactagccaacgactgcgcgcttggacgcacgtacataggcacgcgtgcgcgaggagctagccagtgcatgcgtagccggacactacagggcgcacttcgaacgcgccggctgggagctgatcgatcgagtgagctgagtggccaacgcagctagctagctaggcacgtatacgccgtcgtccactcgggcccggcgccgcgcgcgcgcgagagcgagaacgagggtatagatatcgagagggatggggagggcgccgtgctgcgagaaggttgggctgaagcgcgggaggtggacgacggaggaggacgagaagctcgccggctacattgccaagcacggcgagggatcctggcgctcgctgcccaagaatgcaggtgcgtgatctacgcccgcccgccaccgccggaagtccggaactagctaatttcatcacacacatgatctgcactgcgtatcgatctttattacagtatatcgtcctttattcattccctgctgctggtcatcacaaagtctgcggttgattaaacagcttgctaattaaagccctaaatctagcaaaaataataaaaaaaagcgcactcttgcttcccagctataggagaactagtactatagccatagctactaacaagctccgactgtcacttgacgcgttggtttgattcatcgtgtcgtgccgtccggacatatgcagggctgttgcggtgcggaaagagctgcaggctgcggtggatcaactacctgagagccggcgtgaagcgggggaacatctccaatcaggaagaggacgtcatcatcaagctccacgctaccctcgggaacaggtacactgatcgatccatccctctccttcctttccttctctgcttttcttttccctttgtttctctcgatcctctccgacctgttctgcagcggcatgccaatatcagtgtggagtgcctgagaagcgtccgaccgagatcaagtaaaggcgatgtactattcctacactgatcatagtacacacgcactatactcctacagaaatcactcccacgtactttcaacgtaattaaaagaaatgggttccactgacagcataggctagctgtacgttacactaatagtgcaaactcaagcgtacgacgggctactattttagttgtcacgtacgtgtgccctctagagacatgagaccgcgcggtagctagttttaacaataacttccaacgaagacatcgcatttgacaagcctataaaagctttgtcgttaattaactatccttattttactcctatatgagcactttaagagttctgtctccgtcagtccttcggttgagagttgagacattactgtcaccacatataggcacatacagtaacagtattcagtagtgtgcatgtgttggctactctactgagcccctgtgtgcagagcagttgtatacagtagacaccagtagtagtagtaaaagatactggaaaaatatacatactccagctgcatatgcacgcgtgcatggtcccgaatcccttttagggcctgtttggcacaactccagctccagctccacccctcctggagctggagctcagccaaacagtttcagcttcaccagaaatgggagtagagctgggtggagctctctcacaaaatgaactagagttgtggagctgggtttatgcagcttcataactacactccagacccaactcctgtagttaaatttagaagttgaagctgtaccaaacagttcttaacttcgaggtagtctcagctatttttatactggtacctgcaatgcatgccttggcttacgtgtttatacgccatgaaagtgcacacagtttttgccggtcaattaattaatcaatttggtcactgtcacatgtgtcacccaagcgtgtggcggaagagcccggcgcgtctacagtttatgcatgcagttaatttctacgagcagtagctaggcaggatagcaacacgtcgagtgttacacacattccacgcttaaccctaagtagtgtggtcgtcttgtagagtttactagtaattaattacgagttctttcgtaaaacgatatacagttggtccaaaaatattttcatggcttatttatatttgcaccagtttgatataccctaagtattatttgtgttgtagtagcctctttaaatattagtagtgaaagcaagataattaagttttcactatatgattttcaaattaacttcactaatttttgagaaaatattataccatgacacttacaagaagcttaaggacctgtcctttctacagtactacttcgtacgtctataggttgtgtttagttcacactgaagtttgaaagtttggttgaaattggtacgatgtgatagaaaaattctgtgtatgaaagatttgatgtgatggaaagttagaagtttgaaaaaaaactttgaaactaaatagggccatagttatgtgacatgagttgttcaaataatggtgttttcgccagcaagtagtaataactaagtatatgttagaaaatgacctattttatacatgtatcaatttgcaacttgctataagagttcactattattcgggaccaacccaatcgcaagtgcatgtaggacaagttaaatccaaatcgacctaccttctaaagattcttagctaaatggctgtgcatcagatcatacaactataggattgcattatatatatgcccccacacagacgccagtagtagtctcctctattctctactcccataatataattcccatgaccagattgtccgctttatttttcttctatcaaaaggagatgaagcacgaggaaaatccttggtttggatgctttcccgtgataaaagatcgaagtactgctatccgtagaagtcgcgcgtacatctaatagtgaactagtgataagttgtcctttcttaataacatatatactacttcctctgtttcacaatataaaactttctaacattgtctatattcatttagatattaatgaatctaaacatgtatatatgtatgtctaaatttattaacatctatatgtatgtggataatattagaaagtcttatattgtgaatagtaaactagctaccgccttgattttgtcacgtcattcggagcgagctagtagctagttcctgcaggtaagctagcttattgctgtacagtactgaataaagaaaacaatacaggagtttctcatgacttgacaaacgaactatccaatttaattgcaacagtgaaatatggtacgtgtagtactaacatacttcctctatcccataaaaattaaatcctagactatgtctagattagatttgtttttttcaagtggggaagtactttatgtgtaacggattaactgctcattaacagtagacgattccacacatgtccgcaagttgatctgaacaagtctgccgcgagcgtcggtgcggggggtggagggatccaacgtacgacaaatgcaatcgataatccaaactcacatgtactgtagtactacgtatcgtgacaagtgtacgtttccccctcatgacgagacacgccctagctagctagcgagctaaccggccctttaatttactccctccgtcaaaaaaaaaattaaatcgtggatttccgtgtcaatgtttgaccgtctgtcttatttgaaaaaattataaaaaaaattaaaaagataagtcacgcataaagtattaatcatgttttatcatctaacaacaataaaaatactaattatgaaaaattttcatataagacggacagtcaaacgttagcacggaaacccacggtttgccttttttttgggacggaggttgtatgtagtaactagtacttcctccgttttatagtgtaagactttatagtattgctcacattcatttatatgttaatgaatatagacatatgtatgtgtttagatttattaatatttatatgtatgtggataatactagaaagtcttacgttgtgaaacggatggactacgtgtgtttgggcgcacgtgactactgcttccaacaaaacacacacgtacggtaaagccatgcataagagttttggtcttttggactatatatgtatatggcctgggccttccacgtctcgttgcgcacacacggccggccgtttgtgggacaaatattgttgtgcatgcgcgtgcttcgcgtggcttacgacgagcatgcggccgttgcctgccgctcgcgtacaggagctgtactatactactgtaaacatatgtaaagtttctaatagaatatataccaacacgtacatgagtagttgatccgagcatttatttgctgcacatactgtgcatgcggttgctagtataatcaattttccgtttgttttttgagggccggactcgcggcatgggtggggagtgtgcatgttgttggcgtctacctcggccatgtcacgttgtggctaaaacgaacgcagagatgcaatgcgtatgtgccgtgcatgcgtacttccgcggacagggcgtacgtacgtgtagcatcaaaaagctagctatcggagccatggctaagattaattagccccggttgatctgtcaagggtacacataaatggcaggaaaacgatcgctgggccgtcaggcttaactgctgacacatgacccgtctcggcagccatgtcacgctaccctcgcgaggtttttgcactttggacgcgcttttttttttccaagtgtatatttctccttcctctttaaagggggcatgtccctctcacgcagatcatcatcgcgctaatggcgccccctttttaattggctaatcatgtacatctggctcacctgccgctgtccgtgggcccctccaggattaattgcgggtcccacgtagacctcatgacttttaacttgacaaatcagaaatgcagattttgttgggagagccgagagcgaacgaaaccggccagcccgtgaggtcccccgggccggcctttgcacctgcctgcctgcgggcctcgcttaatttctctactgaactttccgttgctttccgcgctccgcaatcatacgaaccaggtcgccccacggcgtatcgcccgtcctggtgtccatgtacgggtcgctgcgcagttaagcggcgcgccactaccaacagtatccccacacaaactttattacgaagagcctagtagcaatggcatcgccgtcacgtgtagacgtgcagtaaatgcgaatactagtgtttctactcctatttgctgtgatgaatgatcatggatcgcgtgatacttagatcgaaacagctaaccgtgaaaaatctggtttgtctgcctgcttgcacaggtggtccctgatcgcgagccacctcccggggaggacggacaacgagatcaagaactactggaactcgcacctgagcaggcagatccacacgtaccggaggacgtacaccgcccccagcgaggccgccgtgaccatcgacgtgaccaagctccaggccgccgggaagcgccgcggcggccggaccgccgggcagtcgcggaagggcgacaagaagcgcgcggaggacgacccgcccaaggagaccgccgccgccgacacgccgttgccggagtcgagcccgcggcgcgcgcagagcgacgaggcgcggagcggcagcgtggtggtcgacccggaggagccgagcagccagcccaacaacggcagcagcggcggcggcggcggcacgccggacgggccgtgcagcgaggagacagccactgggccgacgtcgctggacccgatggagatgggcctctgggaggttgagagcgagttcgccgagatggaggcccttctgtgcggcggtgtggcgcccgacggccccgggataccggggctcgagccgctggacgtcgcggcccaggcggacgacctgctcgacatggactgggacggcttcgcggccgacctgtggggcgatccggcccagaggggcggccttgtccaagacgcgggcgagccaaacggctcgatgggctgcagctcggacgagctcgagtcgttcgcgagctggctcctctcggactcctgctgaattgaacctaaccgtgaccagcacagcagggttggcgtcgtggacttgtacaaattttgctagctttttagttctagtttgtttcgtagttgtgggctttcctctctcggtctctcgtgcaatggagagtcatttgcctcacacggcatgtaggctgtagtgaaaatcggcacttcggcaggtttcacgcgctgctgctgtggagtgtagagtggaggacacctttgaacttgtttgcaccgttttgtgaactgaactgaactttcgtgttgggctgttctagtttgtcgcacttggttctgtgatatctttgtgttttgtgtttgcttggttaagaggtagatgaagtcatagaaccgtggaaataacttgtaataaaccaatcatacaatccaattcacctatctacactatcctcacgctgcaagagaaatagagaacagaacacctgttgtgatactatatagtggtgtggtatttacccaatatatcagaatctacgactccatgtgatgtgacacaagtgtaggatcgaatcacaaaaactaagccaatcagaggggggtgaatggttggtatatccaaaaaccgaaaacttttagcggaaataaaagttaccctcgaattcgacggatcgcggtctgaccgaagtgtatgcgccggtctgaccgcctgatgaacgtcggtctgaccgatgtagatcgatcggtttgaccgtcgagatcagctgccgctcgctgtcgtcaccgccggtttgaccgccgtcagaccgcttgccgccggtcggactgccggtatatcgccggttggaccgccgaaactcggtgaaacacaaatcgaagaactcttaaagtggatgacaactttattgattctctctgtgtttacaaagtgcaccaacagcacttcttacaaaatttcgactaaactcgaaaccctaactcaaaactcaactcaattgctctgaaaagcgatatcgggaagcctcatgctcctcctctatttatacttgaggtaggcagcctaaagccacgaaccaaactcatatttatacttgaggtaggcacactacaaaaattcaccttgcttctacaaaaatccaaaaattttcacattacttctcctccttttgacaatgatttcatcaaacataggaattatgttcattaatatataagagcttagcatacatatagtatatcaggtcatgtgttgcaataaaaagaagataaacccatgtataatataacaagcatgcattaaagtataaccatgaaccaaagattttacaattaagcttgaatcaacaatcaaaattcatgatttcatacgatttataaagcaacatcttaacaagcatataggttgaaaataaacactaaacacatatacctattgcatttatcactctttctcaaataaactttagcacaaaataaccaagaaatttttttataacttttctttttctagagcctttttgctcatatttttctcttttattccgggtacgtccctgtcgtcaagactgtttccatgaattcggcacccattattttgctcatatcgaatacgtccttgtcgtcaagactgtttccaaggattcggtatttattttcttatattttttattctctttttcacaatgagcaattaaagctatttgaggaataacaattcaataaagcatatacatagagcatttacaaatcaaaccacatgctagcatcaacattgcatatttgcttaattcaagtatagaatttaagtgtcatgcatcatctcccttaaaagcaaaatctaaatatcatgaaaagactagaatacatacaaactatgctagagacaaataaaccttcaaagtattgctagcatgcacaagaaaataccatatgcataaacaaagctctcttttatcaatttttctcattgtcatattattgctcgataaaaccatgaggtacaaactccccctcaaaccatgccaaaaggatgaattatgcccaattcaccacgaagaaaagcaaagcgattagaatccaaaggtttagtgaaaatatcagcaattcgcaactttgtgtccaaaagctgcaattcaacatctcccttctcaacatgatcccttaaaaagtgaaaacgaatatcaatgtgctttgtgcgtgagtgttgaacatgattcttagcaatgttaatagcactagtattatcacaaaagagaggtactttctcaaaagtaagaccataatctttcaaagtagataaaagccaaagaatctgtgaacaacaactagcagcagcaacatattcagattcagaagttgattgagcaacactagattgtttcctagacgaccatgcaatcaatgatgtaccaagaaaatgacatgttccactagtacttttcatatcaattctacaacctccaaaatcagcattggaatatccacttaagcatacagaagatgaagtagaataccaaattccaaacccaagtgtatgattcaaataccttattattcgcttgaccacttgacgatgtgaagcacaaggagaagcttgaaaacgtgcacacaaacacacaacaaattgtatgtctggcctagaagcagttagatacaacaaagatccaatcatacttctatattccttttcatcaacagcttcaccatcttcatcaggatccaacacaactgtagaaccaattggtgttgaaattggcttgcaattctctatcttgaaccctctcaaaagatccttcgtatacttcgtttgatgcacaaaagtacctgaggtgtttgcttaatttgcaatcccaaaaagtacgataactcacccatcatgctcatctcaaattccttgcgcatagtctcagcaaaatctacaaccaaagcgtgagtc

SEQ ID NO: 66218 - DNA, 3686 bp, Oryza sativa
atgagtaataatatgaaacggagagaatatcgtatatttcgagacgaagagaatatatttttattttgaggaggggaaaatctgatgccaggccggcccaacagaggagaggttctgcttctccctttacttgatgccttgattcctccctttcttttcatcttctcctcctcctcctcttggctttcctttcttccgatccaagctactctctctctcctctcctcccctcccctcaccaagcgagccttctagagagagagagcttcccccggggggatcgagctcgccggaggactccacccgccgcgcctcggctgccgggagatccccccgcccgcccgccggtccgtccaacggtaagtctcgccttcttcgctcctccctgatttctcaccggcgatcgatcgatcgatcgatcccccgcgcgcgctcgagccgtcgccggagcctgggtgggtcgggaatcgcggcggcgtacggagtgagagatggtgtggtgtggtagggtagggtggatggagcacggctcgtcgttgaattaggggggaggagaaaaaaagggagggatttttatgcgtttttttggtgagggggaaatcggctgctgtctcgtgcgagatgtgctgctataagtggcaaatgtcaagtgccggattttcgttttgcgttttgccctggttggggttgggttactcatccctctactgaattggcatgtactactatttcaagctaatttgcttgttagaactatatatgttcagataccttttttgtggctgcacagtgtgtgtgagttttttttatcttaaaaactgtcattagaaggcatcatggcacaacagataagagaagtgcattgccaatgctgcaaacgggattgcggcaacgcaagcttgcagtgttgcctgtggctaatcttgatgatgctgatgatggtgatagtgtctaacataagttctgaacttttcttgtgtattgacaaaaccatcaccagcttgcatgtaattcatcttccatctgtgatagttttgtactccctagttttcttcaccatgctaatttcaatattcttgtttctgctatgctaggaattgaaaggaggtagccttcttgtcagctagtatggtaagttctctagcagaaaattgattttactacagcttcccagtttatctgccgcaccaagttaacttgtggattcggaggatctctttcttgcaatcctttgtttctacccaaagtttgatgttctaatatatctgtaataaatagtatttcgaaggctatggctaccgtggaagtaccttcgagcagacatatcgctgctaccctgcgtctttcattgacaaggtttgtctactgtcttcagataggctccatttactcatgccactggtataatgttagggtggtaaatcaggttgtttctagctttctttttctaatctaaagtatcaacataacatactgatgctatattgatatgtaaacatttcctcttttcctgtccttattgctttgtggcgttgtttttgcctctagcataatatgttgacatcctttgaactgcttaagtagaatctacttcctccgattcatattataagactttctagcattgcccatattcatatatatgttaatgaatctagacatatatgtgtgcctagattcattaacatctatatgaatgtgggtaatgctagaaagtcttataacctcaaacggagggagtagcagttaatacttctaggaaatttcttctaaaaaaagttagaggaaacaatcacatttcaagataaagcatctagtttttcattcctggatatttcttctaaaatatcttcttttttttttttaccctttgcagcctcagcttgaaactggtgacaaaagtatgctctctgttcattgattcatcatctgttaagttgattttggaaattgaactaagtattactttattttcttttcagttattatgccaccttctgctctggatcgtctaggtaagtttagttgtgttagataatctctttcttcttggaaacgcatgatgatgattcatctcgtctgctctcacaagctttccatgctctattttctggtaacttctctaatctattctatcactatgcagcatctctgcatattgaatatcctatgctatttgaagtccacaacgcggcagcagaacggacttcacactgtggtgtcctggagttcattgcagaagaaggcatgatctacatgccatattgggtatggacatgtttagaataacgttgcaattacttttatgcgattccaccaaagctaactctattactcatcagatgatgcaaaatcttcttctaacagagggggatatggtgttcataaaaaatgccaatctccctaaaggaacatatgtgaagctgcagcctcacacaacagacttcttagacatttcaaacccaaaagcaatgttagtattgcttggtaaattattttctgttcttttcttttgctatcacttcatgtcttcatatactattgtgttgtgattggatcttatggtttgactaatgagatccctgaagaacagtaacaagccatttatgccattcttgcagcttggagaaacattgcggaattactcttgtctaaccactggtgacagcattatggtagcatataataacaagaaatactacattgatatagtggaaacaaagccttccaatgctatcagtattattgagaccgactgtgaagtcgactttgctccaccacttgactataaagaacctgagcgacaaaaagctgctgttcctccaagtacagcgcctactgctggtagatttctctttatgccccgttattgatcttgatctcttccctcaaattctcttgctgttcattactttaagatttattcgttttgcacaagaggcaactgaaaaagaaccatagttcatcccctttactggacctgggaggcgtctggatgggaaggctcctaaagataaggatgtatcagcttcatcccctgcaaaacggcaagctaatgcaacaaacagcgtgcagccctcaacagcgtccacatcacagagcagttcatctcgtaaaaccacggaaaagcttgtttttggccctggtgggaaccgcacatctaaggaaacagaaaaggttggtatttttgcaatttatgcacctattggcagctgtctggaaaacgagtgctagttttggagctacttgagatgcaagaacctctagtgaccaatgttatctaaaacagctctgtcgattagagaaggcataataagttattgcttcgatgtgtttgacacacttttttttaccataatttgttttattttcaatgtaggtgcctgaaaaggaaccgaaggaggatcccaagaaagatgaaccgaaattctcagcttttacaggaaggaaatactcattgaagggctgatagccagatagtgtattatcacttatcagtatttccagagacagacatgattatggagaaggagtttgattgtttagttacctccttgaagcctcttttggttggaccagtggcatctttgaatgtttaatttctgtcttaactatgaatcatcctcgtgccagcaacggagaggcaactgatgtataaaaaaaatctattcatgcctgtttatgga

SEQ ID NO: 66219 - DNA, 32097 bp, Oryza sativa
tttacagactgatcataagcagtccaggaattacgccaaagacggacgaagatgaacataggagttacaatgtcaaatgtatgtggttatacatcttgaagtaaaatatgtcaatctggtaaagaaaatattgagttttgaagctgccgcctaaggcaacataatcatcacttttttatatagattataaagatggtgagcaattagaatcttaatatcattataattatatatgcggtggcagcttacatctagaattataacattttctttcccaactctatcgaaattaaaagatatgagccaagagcagcctgccgcaaaggataaaaccaccacctttaagagatgatcgaataccacatcacaataaaaaatcatacaaatgagacaaatagggcaattcaattagaaaaaaaaatattcatgggcgaaagagcgtgtcaacagaatgaatggccttcctaaaacctgatttccccaatggcacaatctatacattctaagctatccaaattatcttggccgttgtgtgatcttttaggtcgcctttacgactgaacaaatggcagtaacagcagatataaatgcctagtctaaaacagaaaaactttacaaaagcatgccgtttatgtcatcgatcacattgctgacagataagcagcatgatgaacagctattttcaacaagaataattgcccggagaatgacagcaattgctaggaggacatgaagggatgacaaccagcgtccccttgtctcgatttccataagcctctcatcgatgggcacattttactcccctgaatatgtttgtgggtttcttctgaaacaagcaaggacatgttagagcctatgaaacaccagaaaaataaagtaaattcctaaacagtgtgaactatactttcacttcgctacattggcatgcgtagcaaaattcaccattctttttgtatagtgaagtataaagaaatgacttaactagcaatttacctagcaagtacttgtactctgcatacatatttgcttgacaagttgctgttgctctagacaccttcagttccttggaagttgtttccatctacaaaattactgtgagcctgagtaaaagaaaaaccattgctgcggtttggaatgccatcaagcagagtttgtggactgttggctactggcggagcatgaaagttcatgtggtttggttcaactcttggtacagaactaccatgctctgaggcattatggcacaagtccggtctaatagtcgggcttggtctagatagcaacatgaaaaaacgttcataaatttgacgtctttcagaaagagctgcatgccttccaaaggaagtctctgaagtgttggcttctgacataacatggaagttctggcttggttcactttgtggtacagacccagtgttgtgtaaagtgtcagattctaatggtgcgcaaaagttcatgtggtctggttcagtgcttggtacaaaaccactctgatgcacaccattatgatgcataactggcccaagtgttgtccttggtctagaaagcaaactgcgtatccagtcatgcatttgacgtcttctaaaattcgttgcgtttgtctgccttccagatggagttgatgctcctgcagtagaagcttgagactcaacagaatgatttcccctaggaatctctcttggagatacatttagatcaatcccttgcctttcaaaagtgccaattggtgaaattgcaccaaacatcccagaattgccattcacatgattatggtatgaatgtgcttcgccatcgagtctacaacctccacagtaccaatttccttcaggtacttctcttcccaaaccaacacagtaagtatgtgctgaggagtcacaaatatcgcatagtaacatgagactgtcatcaccaccttgattgcactctatgcacacaacattctcgtatggatctagccaacgtcttatttcctcttccgtaggctgataaacctgtgcaaaaatcaagagacagcatatgatgtccaagaacataatcaaaccagggaattaatgtggtttacattgaacactccaacaacgccaactgtgcaggatgttacatgttcagatgttccaagattataatattattgcactgtacataacaaactcttatataaaacactagatctctggcattttagaaatcaacaaacaaaaataaaccaaacatgaagtttgccctttccctccatttttggaacaaaagaaggcgttgtcaagagcctccccatcatctggccacaagttggacctcagatatcctatgccatctcatccatcaaatagctttctatacttgatcgtaagagcaataaagatttgtctttatattgacagcatagtatgatgatggaaaatctccaccagattagcaagaataacttttctctgcaaagaccattaagacggggaaggctttgcaaactgtatatagctgaagtaccaggaaagctaatgcaaaaaataacattgcctatgatttgtaaatggtaaatgaaaaatagttccgaaaattagttctccaaataacatttgtcccctaaggcaactagttctaacatggaaatgaacaaacgcagtaacagtgagaagtcacataaaaataatgaaaggataagagtatttataagaataaatgaaacgtgtacagcagaatgacagtaaacatattcatgaatattattttgaatagactgcccatataaatcagaaatgaagttaacaaatttagctgtcggatttgatattatatgacaaccgcagcaaggaaaggttacctgatcacgttcttcaaccctaattacagaatttgtcagttccaaaccagtatcctcctttgacgactttgtgattgttgtgaaccgccgtttacacaacggacaccttgactcaaccttagaccattgcatgatgcatgcaaagcaaaaatagtgtgaacagcaatccagcacaccctgcacagtcactctctgttcttcagaaaggcaaatcccgcacgttgcccttccagcctcctgtggttcctttttctccttccccttgtgctccccattacctgtaacagaaatcttcctgggtgatgaaggcagcactttcagagactctggaggctcagactccttcaaattccccaattccttatctgatacaacgaattcagaatctgaggatgaatctgacacaaatacccttttcttcctccccttcttaataaccctagtaggctcagcaatggctgcttcctcatcggatgttacaaattcgaagtctgtcgtgtctgaatcaatagtaggccatatctcagcctcaaaaactggtgtcggaggatcaacctccatctgcttcctaattctagcctttttccttggttgccaatcagccataacctcgtcctccacaatgaagtcgtcatcctcataacgatcaagcattgaacgttttttctgcctccgtcttatagacgcagcgttccttgccttgactgaacccaccttccgactggccaccttagagctgctcttcatcttccctcgtcgctgattcaaagtagactttcgccgccccatattcttaaccctcaccttagtcgcttccaattcatcatcttcctcatcctcaaaatcttcttcctcctcgtcctccacttcaggatcgaaatcaacatcctcctcctcttcctcctcatccatgtcagggtcaaagtccatgtcctcctcatacctccggcgatttgatcgctccagaggaagcttcccctccacgttgcggccaccacgtttcttcatgcgcttggatcgtggcgcctcatcgtcctcctcttcctcctcctcaagatcctcttcctcctcctcaagatcctcgccgtactcgtcgacccgatcgtcttcttcttccgagtagtcatcgtcatcctcgtacttacgtcgacgagatcgcgcaacgggtgggtctgccttccccttccgcccattctcgcggctcttgacaggctgcctcggccgcggggtctcatcctcctcttcgtcctcatcaccctcttcgtattcctcgtctgtgccctctcctccctcgccggcgctcgaggcagacagatcctcgtcgcactcttcctcctcatcctcctccaccacatactcctcgtcgtcgtcgtcgcctccgtcctcgcccggcctcctccgccgccgcccgccgctctcccccacgggaaccgccccttcccctcccttccccatccctacacaccaagaggaagaaaaaaaacaacgaatcagaaccagatcgccggatccctccgcccaaatcacacgccgaaacaagcacacacccacctctccgatcgcaccagccgcgcgagaaaaccagcaccgcccagcgacggcctcgcaccaccaccaccaccaccacccactaatccaataccagctccagagcttatctggtggtttccctttccagcgcctagtggttaccccgtgggtttgaatcggtttaatatatacgaccacgcgcaggtcagagaaggcggcggcgaggagctcggctcgaaaacggaaaggggggcgagcgtgcgcgcgccgggacggggacgggggaacgcggaggctacgaggggacggaggggggaagcatcggatcggagtacggcgaggtgcgggcgctttatcctcgcttgcaacctctctctcctcgcacgggacgcgttggtaggggtggctggctggcttggccgggctggtggcttcctcctggctccggctccctagctactagtggttggttggcccgttgctggagttggactagtcgcccccgccccgctcgccgcggtatcgatggcgaacgtacacacgctgcagcccggttttctcacgtgctgctatgcctgtgcagctgtgcggatgattggtgtttcgggcggggcgtgtttttccatcggttttttggtgggtttcggccgtgtgcccgcgcgcgcgctgggtgcgccagcggtggggggcagtgtcgtgccgtgccgtgccggtggtggtggagactgacgtgtacgtgactcgtcggggagccggaaaaggagacgcgcggattgcttcgtttcggagcgcatcggccggccctcgttttttctcccttcccttgctggaatctgacggcatcgccttgtgcccgacccgagtactcgcagagttgcagtagctttacctgctccatggacagggcaggactcgagcctgcaggctgcagcactagtaggaatcagatgattggtcgccttggcaggtattgctattaaaacagaaatctgttttcatgtcgtggtctgggtgcaaaagattaatgagagtttcttccatctaggttagagacaactatggcatttcgtgatttcagtgaaggggcacaccaaggggaatcacagcagctatgatttgccaaaatcatgccgtctcaaactgtcaaacagcgcccaaaaggcaattcatcacgacccagaataatttctttcctaccagtcaaattataagcaggcattagaaatcgagttttttcagcaggcattgaacaaatcaaattcgacagaaatagaagtaacttgctgcatcgaatcataggatacatttttatgtcaactgctaataggttaataataccatcctgctgtttcaatcctaatattaatagctatattgtggcttcttctcttttctttgagcaattgaagaaatgattaaatgaatttaaattacagcacctactcagcctgtcagccgttgctgaatgccagaacagcgagtaattaaactgacattactacaatcaaagtaaccagagttgtgttgccatatatgcaattttcttagctcgacaatcaattcttcatatgcagcctcttaatccaaaacgtggctgaaataccaatctaagatgcttaacgattgctcagacatttgagtgtcaatggtgcttaacagacacaaatatgttagtgcagaccagtgatctctgccctctggagatttcaactgcttacctcagtagagtgccggagccctccatcatcaccggttcaatagaagagtgaattttaagtgatcttcagtgctcacagaaagtacagtagaactttatacaccagggggccaatactgttggaaggaacataagaagcaactacctgaccgcctgtaagctctgcagggcaactcttggtagaatttggaagtaatgaactaaacaaagaaggttttcataaaaaggaaaatccgaaatggctcattcaaattgttgtggactacatactggaaaaaaaaaacagcaagtacaagcacaacacaataccagacaatcggtgcccttattatagtatattccacataagagttgcaacactctcaccaatcctgatgtgttcactatgtaactcagggaatctatgaatacatgccaattagatagtttggtacgttttatactagtaaaagatgcaggtggttaccaactatgcatagttgcatgttgagttaaactaatttagtagtaggtagcaatcaagcataatagcaaatgtatcaaatccatgttaggcaaagtttctagatcaagttaacaattccatgtactattgatttatgattctgcaaaacaaagaatcacagactgagggactggatactagaactgtattgaactataatcaggcttggatttcatcttattgtcaagttcattcatggtttcagcttgtattcatccacttcacataattatgctacagagttcagttccatggtgtatcaggctttaatcatgctgttcatagtttttgtttatgctgttcaactcggcaagttttccttggtctctttgatatgaacagagaggagaaaaaaggataaaacggtgacgatttaaatatccaatattttgaagtatctttctactaacatgtacattgtgcatgcaggccatattatagtgagttgctgaccaatcactaaattgatatacgaaaatatagtgctgcaaagtgcaaagtaattttcattggcatggctatgtatacaagacattgagaagaagtcaccgccagagtgtctttagcttttctcttttttaattctaactacaaattgtaccttttacataaacctaaacctatagttgaaagaacacaaactctttattacataaaggagaaaggtatatggaaacatattaatcggttttcggttttgatgagaaccattaccctttttaaggagaagcacaaataaaacattgaataacaaccatggtgataaagccacgcttttgatttataccccccaacatccataatccagggacaacttttgtttattgttttaattttgctccagtttgagctttattatttcatctcatcgtgttttacaacatatatatatacctttgggcttcagcacgaattccaattcttgtgagcgctgatcaacgcggacagtaagccggcggacgccatgagcgtcgagctgccgagcaaacccttcccgtcggtcacgtcccctagcgccatcacggcgtccgcaacgtcctgcacaacggacatccgcttgagcagcagcttcacccgtagcgtcctcaccacatcgctctcctccctgcaaccttccttcagccgcatcttgacggaagactccagtttgccgatctcttccagcttaatcgtgatggaaccaacgtatcccagcagctcggcccaggcgctgagtcgctggaggcgtgggaggaggtgcgcgggcaggaggccggccttggccagccacacgaactgttcgaggaagtagtagacgccctccccgccgtaggcgaggagcgcgacggccgggggcggatggggatgggcgcggagggcgttgacgttctggacgaacttgccgaggcggaaggccttgcggctgaggccgacgctggactcgaacgacttgaggcgggcggaggcggcggggggcagcgggcccgcggcgagggcgaggcgggcggcgtagcgggagatcttgaggagcttgtcgacgccgtcgcggcgggagaggtaggcctcgacgtggacgaggaagtcgcggggcggcgggtgagcggctggcttgcgggaatcggaggagcccgcggcggcggcggcggcggccatggcggccggttgctgcgtggaagagagaggcggagcggcggcgccgtcgttgggtgcgcgcgagttgggcggtggttgcgtgtgcggtgcgggctggtcgtggtaggggagtgggcgtttcgtacgggtttggaacttggacttgacgaagggtgacgtgtcattgggccgaaccgcaatatgggtcccatgcgtcagcctagcaaatgggccttaaactcttacattggaccttcttgggccgctttatcatctttctggacctttgcttttaagcccagtgtttcctgacccactttgttgggattttcttgttatgtatacatagaattctgtcacaacaaaatcatctgtgattttttctagaaacacagtacaaatatagacgctcacaacgcacctaccatttgtgattttggatgcatagtaaatatcacatgaaattaagtagcctatcatatcgataaatcatgtttatttatactggcactgaccggaaagcctggcttcggaattcagacttcagaggatgtggaggccactcttttctttgaagaatgcatgatggcatcgcccattgattcttactgcgttaatatctccttggattagtagcatgatcgtgtttaatttcgcattagcttgggatagcatacattgtttgatcacaagccgtgccaattaatgaagtaatctaaaaaatcaggggatactagtacatctaagaacactttccgttgcattttcattttccctctgctttaatttttgagacatactcctatatacttggtaagcagctccacgattatttacttttggttgcttatctaacgaaagatgcttttgaagttagtattacagcagccttacagtgtaaacagtttatatatcttaaaaaagtttatacaggctatagttccagaaagaaataaaaaattatgaggaaacatattaatcggctttgttgatatacacttgttaataaggagaagcatgagcaaaaaattgaatgatcaccatggcggagaaagcccagtttttgtatccgctcaaatgcaccagcaccaccttttgattaatttataccccgacatccagagtccaggagtaatttgatttactaattcaaactctcaccactttaagatttaattattgttcaattacatcatgttttataacatgtacctttggtgggctttcagttcagcacgaattccagttcttgtgaacgctgatcagcgcggacagcaagccggcggacgccattagcgtcgagctgccgagcaaacccttccggccggtcacgtcccctaccgtcatcgcggaatccaccatgtcctgcacaagggacatcagcttgagcagcagcttccggctcagcgttctcaccacctcgctctcctctccgcaaccttcctcgagccgcgcctcgacgccacactccagctctgccacctcctccagcttgatcgcgatggagccgacgtgcgccagcagctgcgcccagacgccgatgcgatggaggcggcgggggaggaggcgcgcgggcaggaggccggccttggccagccacgcgaactgctcgaggaagttgtagacgccctggccgccgtacgcgaggaggacgaggagcgggtgcacgtgggggtgggggtggtaggcggcggcgcggagggcgttgatggactggacgaacttgccgaggcggaaggccttgcggctgaggccgacgctggactcgaaggacctgaggcgggcggtggcggcgtggggcagcggcggctgcccggcggcgagggcgagggcgaggcgggcggcgtagagggagaccttgaggaggttgtcgacgccgtcgcggcgggagaggtaggcctcgatgtggacgaggatgtcgcggcatggcagccgcgggcgggaggctggcttgcgggctgaggaggaggagggggagcctgcggcggtgaccatggcgctggcgcgcgcgcgaatgtgttatgtgcggttgtttccgtgtgcgacgctggctatagcgtggtagaggaatgggcgtttcgctgggaaacccggcgatcactttgagtcgtcgtctcgtcgcagcctgtgtgccgcggagttcgtgagcgttttgtgtttttgtacgacacaaagcttagacttgacaatgtactaaccctgagttgatgtatcgctatctttgttcgttttcccctctttctcatcttctgttctgctctgtcggtaatgccacctcgaccaccgacaatggtgtcagactgctgccattgctgtgggtcgcaactcgcaaccatgtggatggcccacaatcccacatgcctcctcccagtatgaaaaaaagtacaccgaagatcctcaacttgtaattgagttacgtaatcgtcctcaaccataataccagatatagaatatctcttaacttataaaaccatctgacggttgagtcagcgtgggacccatgacgcgacgattgagtcagcgtgcgaccatatgagccctacatgtcagggtttccatgtcacaccccttgctcttcctcttcttctctcccttcctcctctctctcatctctttgcgcaggctagtcagtgtggggaggaggccgacgagagaggagggtgtcggcagccggcggccggcggcggtgacagcggtgacgacgtcgttcgcggccagccacggcggcgccgccttcgcctgcgccgagacggtgagcagcaggaggtcgatgaagacgacccgaggaggcgggtgagcacgcggcagccgatggaggggagtggagcggcagcgggcgagcgcgcgaccagtggagcagagcggcggcgagcgagcgggcagtggagtggagcggagcggcggcggcatccgcagctcgacgaagtaccatggcagcgtctagaacacgagacagcacggcgcgatatagtagagcgaggtgatgggggttcagcgacttgccattggaggtgaccagtatctggatgagcacgagccacgtggcctcggcggcgacggcggtgagctgtagcatgacgccgaacgcgtcgaaccgcgcctcgccgtaggcggcgacggcgacggcgacgcccgcggagatgccgagcatgttgagcatggaggcgcggcggaaggagtcggtgtggaaggagacgatgagggagtagacggcgacgggcatgaatgccttgagcatctagatgaaggagacagagaggtatatgtatgcagagttggagaaccagagcggcagcggcaggctagtgagcggccgcgagcgcgcagcgggcgagcgctacagtgggcgggcgggcaggcggcggagcagagcggcggcggcaggcgagcactcgggcggtggagcggagcggagtagcggcggcatccgcggcggcgccggcgcagctggaggaggaagaggaggtaaggaagaccgcatcggtgagctctacagccttgtccagcccgacggctcggcccgccgtcaccgcccccgctccgctctctcgaccacggcaatggcgccgcacggcacgcggaggaggaggagggaaggcagacgaccgccgcagtcgtccctcgccagccgccggccacgacaggcctcctgacctcctccccgctgcgtcgatgaagctgtcgccatccacaacgcccaggggaaaaaggagagaggaagggagacgaggggaaagagagagtgtgcgctgatgcggcatcctgacatatggatgctgactcagctgttacataggataaaaccgggttaaaatcatcgaagtacctattttaacctattttgattagttaagagacgccggatatttgttcttggttgggggacgattttgtgactggatgacaagttgagggaccttcgttgtactttttcctcccagtattgctatctgggccaagttctctcggtcctgagaaggccgtgaattgggccactgcgtgagtagaatttatctctccggttatgcgtgagtagaattttgccacgataaaaccatttggattagcacgcgtgattctctagaaatcatattgcaaggaagcagactatcatatcgagacgacccggcgagaacgagaccccgagaaatcatggccatatacttactgattggaaaccccgagtgagctggaagccattctctcaatcctgtgcaatgatggcatcgcccactgattcttacattaagatccccttagattaggtagcctggtcatgtttaattttgcattagcttatcgtagcgctgtttgatcataacccgtgccaatcagtgaagtaatctatacatccaagaacactttccattgcattttcatttcgtttcccctgccttttgagatacatatactcagcaagctgctcccgcaatgatttcctttggttgcttatcttatctaatgaaagatgctctcgggtctcgaagttaatattacaacattgctgcatgatcaatagtttatcttgaaatgttcatacaagaattgaaaaatttagaaaaaaaatctctaaaataaattggaaaggagaaactttagcagtcaatcatttgagctttctgaatatacgaaccgagctagtagattttagtctctgaaaacatcacatgcaagcacaggccatgattcccccagcagaatacgcaagggatccaaattccaacatagctctccacgatgagcaaagcttcaaatgtacaggcaggatcgcagtgtcggcagtgcataggcattttgatagtttcatgttgtatgttcaggggaaaaaaaagaacatgacacgtaagtgcaactcctacttagccgctgcaatttccctaaattagtagtcgtaacatctttctcggtgccaacacatcgttgagtctttggaggcagctttcgccgtgaaatgagttgtcaagaggctatgtgtgcatttggataatcgcattgccaagctgcctgccaccaatcgccctcctcctctcctttacggtgctgagacaatgatgcaccccaaagctcttcaaggcctacctggccatcttgattgctgcacagagatgtttccaatggctcaagcagaccgggcagagagagttgtacagtccttgctcatcagggtagagggggaaaaggcaatggaaggatattggcatatgtttcttttgagtgttgcttgagccctatgtcatgtgcatctcagagccagccagctccacacccagcgaaaaggagccacctttggaccatcttcttttccctttccattttactccactttttatatccatttttcagaagaaaattggaactgtcggtaagttctgttaactacccacttcatagcagttaaaattccctgcaaattaatcacccaaaacgaaacaaaattggggcagaaattgagaaactgtcactgaaatgtacttcagttttgtaggcttgggctgaagagaagaacgcaccgataggcgcaggaccatatgttttgttcctatttgctctccaagttggcgtacggggaaaagacgagagcaatcacaaaatggcaggattcctaaagtggttagcgagtgcatgattcagtagaaaatttctaatctggactgttgctaagtaagcatggaccattattcaatccagtgaaagcaaggacgatgattgcgtttaacttgagtacaggcaggcaggccattttcatggccgccggggcagacgcttttccccccatgattttccctctgcccgacactgcattgcaagtagctgcttaaagtggactaggctttggacgcttccagtgaggcattgatcctctctgtttcttgtgttacccatggaagaagaaccagcattttccattttgacctggcttgccataggttgtagacagatatagctgaagattctgaacccacatttcatcagagctcagaataccgtgttgtcaggcataaagcagattgttcttatgctggttccttttctgccatatctgtaccagatgaagctagctgcagtctgcagatgtaagcagatcgttcttagtcgttcttaggttgcacatatagcttgttccttttgtgctcgtatctctctttgccagatgaagctagctgcagatgtaagtaacacataacaggtagagtagctgttgttgatggcaagcaaggattcaagatggatcatgccatgatcacagggaactaccgatcacctctacgacctaacaacaaccttaccaataattttctttctggagcgagatctcttcctcgtcaagctttgatccatcgacactgaataaaaaggctttggcgttagaacggtggatttggagctaagggaattcctcgctttagctgtaaggccggtggttgttgctgcttactttgtgctacacaacgctcagcactactgagcttttcttcagtttagtgcaagagacgtgtctcgtacccgtggaattattattaagctaagtaatgtgttagcttctggataatccagggtcaatttaatttggcaatcaaaacagtcctagagtagtagagtgcagagtatttgttgctgtcagatagaagacttactcttaatgggtagtactaaccacagtactataattaacctgtcctattgcttacccctgaatgttgcaacaacgcattatattacagtgcaagctaagtgattggacagagagtatatcaatcatccggaaacggtggcgaaataattcctgcaaaattcttcaaatagtttgttaaactgttgacgaaaaatgcttttattattttccaaaaatgaggaagcattttagattttgtcgtgaccacgggatacaaaatggatttggtaaagtacaagcttgcgaaattaattgatatattatcttctgtgtcctacgtacattagcagatttgttcatagcgtgacagcaacccaggcgggacgtggtgacgcacggtccatatgacacgctccaagtttcggacgaaatggacccccataatctgcacctaacgccggaaattgagaacaaattaaaagggacggcgaccattgccagtagtgcacttttaggcacgatgctatgccaacaaatgattcataggaaacaacattatgggtataggcttgtagcacactattaattagtttgggggttgttacatctaaagaaaaatgaacagaaaaaaaaatcaaggagttgccctaggtttttacgttttcgctgtcctcggttcttcgcatatgaacagagtatgcgggttggacgattatcaaaagcagtttataattttttggttctactaggtggggaaaaaaaattccgccttcttccaagttccaactactaccaatcaggacctcatagtttttttcaagagcaatcttcttttacggtctgccgtgtcaaattcacctggttatgttgctactcattgttaaagtcatcggtggttcagtactaggactaaccaatcccagctttggacatgattagagaaatgcccatttccaggtcggacaccttgtttaccatgtcctttacatttttctttccttttctttgtatagatgcttttcattgctttctactggacgctcgattgctctcggccccttgacccactactgttgttgtttacccacacaagtccagaccaccattcaccagttcaccacgcgtcgcaagtcgctacaggaagaagaagatccgaagctcccaccatgcgctctgacacggcgggccccacgcccgccaccaccaccgccggtagctttcatgggacggcaaccacctcgcctcccattttttctccttacctccggctcacggaggccggcctccctcccaaagacgcgcgccggctggggccgatctctgtggtggggccatcgctttcgtcgcgcgggcccgcggcggaagcggagccaagccgagcgggcggcggagtgggagtgggagcgtgccgtgccgtgcgatgcgagccccggtttaaattgtgggcgaccgttggagaggagattagcggagcgagagcgtgcgtggggccgcaggcgatcaggtccgacggggattcgactactcccccgttttggagcttttgggttacaaatttgaccgagtgcaatctaaatacttctcctggtttttctttataaaaatattttcggggctgtttgattctctaccttaccaaaacactggtagtagcaaacttttgacatgttttggtactacaattttttttggtagggtagagatttattatacatatttggattactaccaatatgatgccaaatattgatgatatagagaagaaggttctaaattagtgacaaattaatcattgacattaccaataatttggcttcaatacaaacccatactattactattcaaggtaccaataaaattggtaaggcacattttggtaccaatccaaaatggcccttcattcctgccacttgcatgccttagcgcagtttcctacagtatacaacacaacatgtaaatatattgtaccgtgaaagttggtactaatgttttatattcagtaatagtagtaagtgtaaggcaataactcgtattgttatatattcacaaacatttgtcattttttacataactgatatttaccaacaaaacgggtattgtatttaccgacagaactaagaattttactcttattacaatgttcaagtaacaaaaacatccctagtgtctcccattgatggttttctcatcacaacatattgcaaacggcaaaaaatctgtttttctttggaacaaacaatagtactgattatttttttcaaagaagccctaagaagaaaatggaaaaaagttcggtaaaaaacatgctatatgtaacaattactattgcaacctatagtactccacttaatttgatcacatatactaggcattagctagtcctttattgggacaacgtcccatgatcccatcttataaatgcagtacttcacttcagatcatgcttgaaatttaaggcaaagtacatgagaagtccgtgacacactgacacttgacctatcggcgaagaaatgttgtgaaccgatacacttcgtttttaaagctgatgggtcaagacaaatttgcaatgtgtccgaagaaatttgcactccgttggttgttacatgaattaatcgaactccttgtactgaactgttaatgttgttagttgacaggacgaacgaaaattcaccaaaacatacaacatgcaggtactactactactactactactccagtatctaggaatattcattaccaaacaaaaagaaaaaaaagaagaaaaaccggtgttacagaaagagaagtggcaatatgcactactgtgtgggggtggcctggtggatcaaggcaaggtcaaacatggtgagttggtgatcccgagacaaattgtacaacaaagttagttagtgatgaccacgtaggtacggctgaatggaacatttcacctctcttctttttttccctccaaaccagtaatatcaatatggagtcactttacttgccaaaaacatcgttctgtgcataaccttcacgaccccttgtcatttgagacagtcgttttcagagaatgcatgaatgttggagttagcggaaatgacggagtagtttcacacataatagcagataaaaaggtaaaaaaaaaagaacttattataagtttgaagaaatgctgaaattgaatgcactcgatttttttttagaaaaaaacattcccacgctagtctctttaaaatccactagcaattctactttaatactaggctattttagttttacacctgcaagtatgtgaagtgagattagctaaattggatgggttacagtgggatctgctcacctgggttcaagtttacaactaattattcttttagtggcatgtaacgtacctatcgatagcgagacatctgtggtgactttgtcaatctcaagatatcctggcacaatattttagaagtgctcgtagagacagggtgtgagtgtacgcatgtttgagtgtttgtgtttataccgtataagtatgatttgctaggaggtgctcatagcgtaaatctcaaaatataacggtgcagtcttttgaaaagtgctcatagtggtagaatgtacatgtgtgcgtttatatgggtggtatacacctgtttgagcgcctacatttgtacgtataagtatgattcactacaagatgacatatatgttttcaggaactataataccttgcaaaatcctcttaggaggctatatgaacaaatgtaattggttaaattcaataaagcttccattgtctttagaaaatatgaacaatattgtaaagtttagagagttaaatggacatttttaaagtttatggtgattagattattaacttaaagctaaagtttagaagtggtatatggacattttccaatataaaatatactagtacagcaataatcaaacacatatgcgaagtgagcatagcttgactggttaggttccttgtggtggaaccagcccacctgggttcaaatcctagacgggtgccggccttgtgagtgcctgcgttttgtattgtgtttctaaaaaaataaaataatcaaacacatatacataacacatttcaccaaatggtgcattttttaagaaaaacttttcgtattaaaagattaaaacaactcaaaattttaactttgtactagctagcagttagttaatcgtatactaattgagtgtctttcctgataagctaagcggctaatcaccaaaatgccgaaacgaacgcggtttatctctaaaatatttttgcattgtttttagctacttcaccgattattttcacgtcttagttgctccacgtagtctaaaccaaaccttaagtttcatagtgatcaatgctatatttgaataaagcacataattgtattttaaaaaagaaaataccatgtgcagcgtggaccaatctttatcatttcgttatgaaaaaaaaattaacaacagaaaaaaaaacaagcggcccgtactgtagttagggagcaccggagcagagtacactttactcaaacaaaacgctctgttttgtattgtgtttctcaaaaaaataaaataatcaaacacatatacataacacatttcaccaaatggtgcattttttaagaaaaacttttcgtattaaaagattaaaacaactcaaaattttaactttgtactagctagcagttagttaatcgtatactaattgagtgtctttcctgataagctaagcggctaatcaccaaaatgccgaaacgaacacggtttatctctaaaatatttttgcattgtttttagctacttcaccgattattttcacgtcttagttgctccacgtagtctaaaccaagccttaagtttcatagtgatcaatgttatatttgaataaagcacataattgtattttaaaaaagaaaataccatgtgcagcgtggaccaatctttatcatttcgttatgaaaaaaaattaacaacagaaaaaaaaacaagcggccgccgtactgtagttagggagcaccggagcagagtacactttactcaaacaaaacgccagagcggcgaaaacaaagaaaaaagagcagaagatgagaagacaaaaaaggggaggaaatgaaaactgaaatccacttccactaaccacaatttttaagcccgaagcagccgaaagaaaagcgcgcatacacgcagcgcaggcattggcgcatcgcaaaatcgcaatgcattgcagctaaccacaaagctcccacctctccgtctcctcccccctccattataaccacccccacaaaaccaccacgcatcgccccattaatggactcgccacctccctaattccaccgtccatttcaaaccagacagaccagcggagcggagcggagcagctgcagcggcgaggcggcaccgcgcgcgagccacggatggcggaggcggcggcgctcttctcgctctccgcggccgccgtggtggaggacgtgctgcggcagcacgggtgccgcctcagcgaccgcgacctcgcctcccgcagggcggaggaagccggtgcgtgtgtcgtgtcgtgtcgtgtcgcttcgcgtgttctgcgtggaatcgtggtggtcttttgccaatttgccacccgctatcggctggcttcgctcgctcacgcgacattgtttggttccgtgcagcggcgaggcggaacgaggcggcggggtggctgcgccgcacggtgggggcggtggccgcgcgcgacctgccggaggagccgtcggaggaggagttccggctcggcctccgcaacggccagatcctctgcggcgcgctcaacagggtccacccgggcgccgtccccaaggcatgcgcacacgttgtgttcgttaatttgattcgctcccgctgcgctgtttgccactgtagcgtgatggttggttgctgtgatgttgcgcgcgcgcgcgccccgcaggtggtggtgaacacggcggcggactccgtgctgcagccggacggcgcggcgctgtcggcgttccagtacttcgagaacgtgcgcaacttcctcgtggcggcgcaggagatcggcctgccgtgtttcgaggcctccgatttggagcaggttcgtgtcggagcgcgccacccggcccccatgcgccgttgcttgcagctgcagcaaagcggccatcaccctcatcgtcgattgctttaggcacactctcttgtggagcctgtgattttgacgcgcgccttttttttgcctttctgggcgcagggagggaagagcgccagggtggtgaactgcgtactggcattgaagtcgtacggtgactggaaacaatgtggtggcaccgggccatggaaatacggggggaatttgaagccgtcggcttccggcaagtcgttcgtgaggaagaactccgagccattccggaggtgccaatcgatgaacgagggcgaggtgccttacgaggaggctggattcagcggtgattatcatcttgattccggtgacatggttagctccgtgcttcaattttgaagctgctttgtatttgtcttgttttgctagacgatatgcggctaaacggttaatgcttcgtgcagtcgacgtcacgccctttgaaaatgttggttagtgcagttttgtccgacaagaggcccgacgaagttccacaggtaggccaatcaggttccccattttttagtaagctgtttactggttcaatgggatacatgcaagcagctttccctttcatgtgatgctttaccggttccttggagtttttatgctattgtttgcctgcagctcttggagtccatgctgagtaaactcgtcgaggaattcgagaatcgattgactagccaacatgaattggtagatatcatctttgtacacttcttatctgttgtttttgaaatcgttttctgcgtgacatatggcaatatgtagactgggccgcctggaaatgatataaacaatcaaatttttaattcattggaacaggtgaaggcggctctgaaaaatggtacagatggcaccaaatccttctcgaaatcaaaggttctggttgaagccaccccaaattctaatgagaaaaaggcaagctataaatttgctcttatttagtatgttcaaaatatttgttttcaaccgctgtaggaatctctgttgcaatcacaaaaatagataggtgtaggttgctagcagctactatttttagtttccaaccaacatttcttttgcttcctctatagatggatacgatagaggtttactccaaacatagacaaaccaaaaaggaagcatatggagaagttacactgaagcaatattcaatgctacaactacagtcaaagcatgttgaggtattattttaattattcattttatttttcattgtcttggtggtgattaaatatttatattactgcttgtggttcttttctttaggaactcaaggctgatattagagctacaaaagctggcatggagtttatgcaaatgaagtactccgaggacatcaacatcttaggtaaaatgggcatgcccgaggtgcttaattaaactaactattttaatataacgctaataaacaaagtatgcatttgcaaattttattccaggaaggcatctgtttagccttgcacatgctgcctcaggttatcatatagttcttgaagaaaatcgcaagctgtacaaccaagtgcaagatcttaaaggtatgcttgttatatcgaatattcatgccaagtgtttctggaccaattaaggataaaaatgtgctgtgagaagcagaaagaaagcatgtattttgattattttccatgtttatagggagtatcagggtatattgtagagtacgaccctttttacctggacaagtaagttcttgtgctgtgggttcaattgatgagggcaatataaccatcatcactccttccaagtctggaaaggaaggtcgaaagacttttagcttcaacaaggtgtttggcccttcagcaacacaaggttttctacctgtccatttctcaattttttttcgagctcttgaatggaagaagatcgaatggttttttgtcgtgcagatgaggtgttcttagatacccagccccttattcgctcagtacttgatggatacaacgtttgcatctttgcttatggccagaccggttcagggaagacatatacaatggtgagtacagtaacaatatttggtcaatatatatgactgatatcaattaatagtgtttctaaagcatatactaccatggattcccttcatgtaccattaacatcttctctatttcttttatgtagagtgggcccaagaacatgactgagcaaacccagggtgtaaattatcgggcactaagtgatctatttaagcttgccgaacaaaggaaaggagcattcatttatgatattgctgtgcaaatgatagagatttataatgagcaagtcagggacctccttgtcaatgatggtctgaacaaaagatatcctcacaacagcatgtttctatcaaattgtgccactttatttgtgttataaattgctttcacaagtaaattattttgtactgctgaagtaaatagtcttccttaacaagtatatacattagagattcgaaataattctcagaatggacttaatgtgccggatgcaagccttgtctgtgtcgcatcaacaatggacgtgatggaattgatgaatgttgggcagaagaaccgtgcagtcggcgccactgcactaaatgaccggagcagtcgttcccacaggtaacccaaccttttctgtgtaaaaaaatcacatgaaataatttgaattgataaatgaacataatgaaatattctcttaatcttgcagttgcttaactgtacatgttcaaggaagagatttgacatcagggaccattcttcgtggctgcatgcacttagttgatctcgcaggcagtgagcgggttgataagtcagaggtcactggagaaaggttaaaagaagcacaacatataaacaaatcattgtcggctttaggggatgtgattgcttcacttgcccaaaagagtgcgcatgtaccttacaggaatagtaaattaacacaactcctgcaagattctcttggtaagatttaaccttcttgcaatttcttaatgtgctgtcactgactgctgagtataatttatatttcctcgaattttaacaatgcgtctacaggaggtcaggccaaaaccttgatgtttgttcatataagcccagaaagtgatgctttaggagaaagcataagcacattgaagtttgccgagcgtgtatccactgttgaacttggcgctgctcggttgaacaaagagtctggagaagttaaagaacttaaggagcaggtttgtttctgctactatgctttgtatcatattttctcactgcatttgttgtttaaggtatgcatatattctatctctatccagattgctcgactcaaatcatcattagcaatgaaagattcaggatcagagcaaaacattaaccgtgaccctgaggcatttaacatgaagatgccttcacctggcttttcaaataggcgacagggtagttgtgagttggtgtctagccaaactaacttcagacaaccaatggaggacgttggaaacatagaggtactaatgccttgcattatttcttctataaacctttctacgattcatatttgtttgacatttacaagttacacaagtgatattagcaaattatgataatacaactgtcctttcagcggccatgctgttgttaacgtttttgtcccatcatgtttgatctggtttttatacaggttagagccaatccaacattaagacagaagaaaccaagctttgatctccaggacttattagcgtcaaatgattccccatcatggccagatagcatttcaagggcaaattttcaaatgggagaagaaagagtgactattggtggggaatggatcgataaggttgtagtgaacaacaataactcagtaggtgattgggaaggcgacagtgcagctttacctgacttcttttaccaaaggtaccattcaggtacaagagataagcaatacctgagaaataactcaagaaaaaaggacggaaatgagtttgagcagcaaagaccaagattttattccacaaatactgatgattctgatgacattgacattgcaacaagtgattcctcagaatcagatgcactatggcagttcaatgtccaaagcatcaatagttcaattagcgagaatggttcaaagatcaagaaaccacaaacgaagctaagagagagctcagataccaggtaaccattttttttacattaacaacttttttttacaacaaacattattttttaagaataacagggctaataactcccttgtcccgtttttgttgaagtaaaatcatcctacactgttttagcacccacaatactcatggtataaagcagatataaataatttaactatgatgaactgaacttgaataaacagtcatatggacttggatattagcgtattacttgggactacactaattgtgaattgtgggttatgactaatagtgcatggatggaaaattatctttatgttgttatttaaagatatagttcacctcatgcataatagtgattgctgtgaatttcaagattgtggtctgctaaggctagtcacagagttgctaattctctgaaatttaattagtatgaaaaatgtgtactggaagtacatatctattaaatattaatcccattaacttttggttcttttatatttggttgatactaatatttatttaaaaagaaaaatatataatctaaactataacatactaaactattcgcataagatatatcattttactccatgaaaggctgattaagatattccatgcttccatgtatttactcatcaggacaccactccattctcaaataccatctgcttcgagaaaaacctccaatggaaatagatctggacggcaacctttaagtggtagcgatagcaaaaggctctcatcaaatggtagacatgctggtacaaagtagggactactacaatgatcatgtgcatttttttttcttggctttctttcagtgtttgtcatgagagattgcgaggtttttctcgagtacagcaatgagtgacaataaacccaattgattgtctcagtgtggtgagttgtgatctcaacaactggtgtgtgaggccattaacctttttttttatttggcctatcaggctatgttgagttcttgctaattctttgtgtattgttcataatatatataatgaagagaaaagaaagagaattggttgatcaaaagcgggtgcataatttctctctttgaacgcttttatcttttgataaaggttctttccaatgtccttcgtttattattctccagtattctaacaagtacagcttttgctttggttggaattctcttccacgggtccacgctccatgaagttcatgttcatgttcttgtacattgatattgatttatgtcagctatcgtgtcatacagtgacactgctagccaaacttgtgctgctgatcatcctggaaacctggaaacatgtttttgctgcagaggtgatggtcctgaagtcttgccttttgcttaagttctggaagtgctcgttggattgtacataccacttcattcattcctgtaagtgaccatgcagaatcatgtctgttgtagctgtggtgcataccatctaatacattgcagtgacatgttttacaattttactgtccaacatatatctgagctttagacagaatgactacagtatagtagctttactttttcttttttttttgaagggagttgagcttacctttagtgcaataaatgttactccctccatttcatattactataatttataagtcgtttgacttttttcctaatcaaacttatttgaccaagtttatagaaaaatataatagtattttcaacacaaaacaaacatattatcaagtatattcaatgctagatttaataaaactaatttgatattctggatgttgctaaatttttctataaacttaatcaaacttaacaaattttgattaggaaatagtcaaacgacttataatatgaaacggagggagcaacacatttgttggaggagaagagcattgcttggaggaaattcattatgcagtcttggagttccatggaaaaaagaccttagccgagccccacaagaccaaaatcccaactatggcatgaaatgagagaagggaaagacgaggaggaagaagataaacatggtcttttacatataggtctcatggcattatttatttatgagtaaatttcagaaaactgcaactttagtgacaaaattatcagtttgttgtaacaatagcgtgggaaattatcacaaaactgtaacttttacgttatatgctgctacagtacatataggtgacaactgtagcagcatataatataaaagttgcagttttgtaataatttctcacgctattgttacagtaaactaaaacatgtcgctaatgttgcaacaaactgatagttttgtcactaaagttgtagttttctaaaatttactatttatttatttattttattgattgtaatgcaacccaagtgccacgtaggtgccagatgataccagtgtgaactgcataggaaggtaaaatgaagaattggtattgataattgagggaggttgtatacatgatttttcgattgcgaggaaactcagattgtaatatagactttctttttctaatactcaccaggaatctttggcccagttagtctagctacaaagcactgcctagtagttcaaggccagagactggtccactaagcgttgtgcccagctacataatcatggttcaatgcccaatgaggccttttcggaaacttagagcataatctagcaattttcggcgactatgcaacacgctgtgcatgcatgaagaaggatcgagttcagttaagattcaagagcaccgatcttacaagaaaaccatccgcgtattcaacgggcaagtagacaacaactacgcaaagtctaattaagcagcggcgacccaaagcccatgtttgccagccgaggccaactcaccgcagggaaaaggtgagctgtcctaccaccaacaaagccacgccgcgcgaccgtagaaagaaaagcctacgcggctacgccgtttcaccgacgactggacctctccttcacggcctcgtctcacccaaccctagttccttttaggacgaaaacggaatgaatacggaagtataatgctcatatcatatttgtttttatatttctttaaatacgaatacggacaactcaaaatagaaacaaatacagattacttcgaatacgaataaaaatcgaatatgatcggacacgaatacggaaacaattttttctcggaacacgaaaaatcaaatcaatttctaatataaacaaatatcaacatatataattagttcattttatttaaaatgtagtataatttataaatatttatttaaaaaattaaataatattaatagtgtggactagtattaagagatgaacttctattaaaatctaaaaatgtatattgaaagtcatagagttataaagatttggggtatgtctcatggcttctgcggatatccgaatagcattgttagtcggatatccgagttattatccgtatccggcggaaaccctgataccatatctgtattcgtatccgggaggaaatatccgtattcgtatctgtatccgagctatctgaaaattatccaaaccgaaagatatttgtattcgcttttctctgaagcagcgaaaactattcgctctgtttctaatagggttgtgattttgttctctcttgttcaccttaagttgagtaatcaccgccacaaaatgtttcaggcgattttgtttgcatgatcgtttggacttggggaatgttgtaaagtgaagatttgtttcgctactctctctattttttagcgtaccttttaaactgctagacgatatgttttatgttaaaactttttataaaaaatcgttttaaaaaataaaataaattataattcataatttaattttgaaaaatactcaattaattaggtttttcattttacatgccactaattagccattttcaacctgtggttgttagaacagcccttaggttaatggataaaagcatgctagttgtgtttttacagcccgttgtgtcaaaaactcggaggtcatgagcaaatttgcattttttgggatttgaattttagaattaatttgttaattttttcattgctttcattacctagacttccttttggacaactaagaattaaaatgtaaaaatataaccttaattatttttgctactttgataatctattttcgatttatagactgtagcaaaaagaaaaaagcttttcaagcagtgatctgggttcaccagctgtactcaccactaaggctatgttcttctcctagttttccctcttttattttccgcgcgcacactttgttttttttaccagggcgcacacgctttgtagaaaaattctatatgaaagttgtttttaaaaaatcatattaatttattttttaggaaaaaatagttattaattaattaattatgtaataatatatatttcgttttgcgtgtcgggaggagggcagcacctaactcatgctcctactagtttttgttatatttcttgttcattgaattttctcatagaaagggacattatgcttgatctggtggtgtttggatcagggacttaactttagtctctatatttagacactaatttagagtattaaatatagactacttacaaaactaattatataaatgaaagctaatttgtgagacaaattttttaagcctaattaatccataattagagaatgtttactgtagcatcacataggctaatcctggattaattaggctcaaacaccacctagcatgcataggacgaggcatttaattttacttataacgagacgtgccaaaaaatgatatccacataacggcataaaactaaacagctgcatatgaatgtaaagactaaataaaataattgcaccaaatcttaagtttttaaatgcatttttggaaaagcttactactggtactactattcttgtactcatatgtggagttgtggacttgcaagcaatagcacatgggtccataacacctgacaccaaaaccacctgtggtcagtcaaacatatccattttagcagctggcaaccatacattcaaacatgcttaaaaaatcttaaaaacattactagtagtcctcagaaccggacaacctgcggctaaatccacaatatgaacacacttttctttaatccaactcagatttcttaatccaaaagttgctaaccactatcgaccagctggcctcgctgctgctgcaagcttgcagaaatgcaggcatttggcaagcacatttgcaccgaggccccctatttcacctacgaattacaaaaagatcccacctcttctactatcgtcagctaattaaatcgttgttcctcagttcggtacttcttcttccttcactctccccaccaaattcccccaaatcgcagctgttcgccacccgcattgcgccgccattgcctccaaatccgagtactccttgagtaatctcagatccatctcgggttcctcccgccgttggcagcagccggagcttttttccgcggaagaaatggcgccgtttcggtgagttcttggcagtttgggatgatgcttggtgggtaggaggactaggagtgcggcggctcggggagaggctgcgatggagagcgccgccggggaggaggggaaggctgccccgtcgcttcccctggcgaccctgatcggccgcgagctccgcggcggcggctccgagcggccgctcgtccggtacggccacttcggcttcgccaagcgcggcgaggactacttcctcgtcaagcccgactgcctccgcgtcccgggcgacccttcctccgccttctccgtcttcgccgtacgtgccctccccccgtgtcgcgtttctggtctcgtctcgggattccgtgatgctgatggcgtgtcgggttttgttcttgttcttggatctgcggtttggcaggtgttcgacggacacaatggcgtgtcggcggcggtgttcagcaaggagcacctgctggagcacgtgatgagcgccgtgccgcagggcatcggccgcgacgactggctgcaggcgctgccgcgcgcgctggtcgcgggcttcgtgaagacggacatcgacttccaacgcaagggtgagagagatcctcgcaatgccgttgaaacttgaaagcctggaccatcgccgctgtgaagatgttaactttgggggatgttgtgtgagtgtgattgcaggggaggcatcagggacgacagcgacgctggtcgtcgtcgatgggttcacggtcacggtggcgtctgttggggactccaggtgcatattggacacgcagggcggtgtgatctcgctgctaaccgtggaccatcgtctcgaggagaatgtagaggagcgggagcgcgtcaccgcgagtggaggggaggtcagccggctcaacctgtgtggtggacaggaggtaagctgctagtaaatattcttggaaagaacttcaaggatacattcaatgctgtcaaagcatttctcattatgggttttgatgtgaaatcttgctgttgttttaggtgggacctctcagatgctggccaggtggattgtgcctttcaagatcgattggggatactgacgttggggagttcattgtgccaattccacatgtcaagcaagtgaaggtgaaattttaagagtttgatcaaatgcaaggagtagcttatcgcaatgaacttaactgtgtatgcttttcattctgggaaattgtagctatcaaatgctggagggaggctaataattgcatcagatggaatttgggatgcactgtcctcagaagctgctgctcaggcatgccgaggattgcctgcagagctggctgcaaagcttgtcgtgaaggtagtttcacgtgtggtttcagtttcttgtttatatcttactttatatggaatgcttcactatcttgatcatccaactgagatccattcatattgtacagcaagcactgaagacaagtgggctgaaagatgacaccacctgtgtggttgttgatatcatcccatctgatcattcttcaacacctccatcactatctccaaagaaaaaccagaacaagttgagatctcttctttttggtaggaggtcacatagttctgttgg

SEQ ID NO: 66220 - DNA, 597 bp, Oryza sativa
atccgaaggttaaatcacacatcggctggaggtccgatgtcatgaaatccacaagattagattaaacaatgaaacatttgttgtcatcggctaaatccaacttatatgtacatgcaatccttatgagccgatgcaacatccagataactcaccggctgaaactccgatgaaacccttattggcaatcaagaagcaagctagagattatgattctaagcatgacttagtagatcaaactcaactgatgcagcactaagtatgaaaagaaacataatatctagacaatcaagccgttgactgagttttcagggtggtagatgtctaagctaatctaatctagcaaggcgatttagccgatactggcagaaaccctaaaacgagaagcagccgatagagctaaattgatatgctgacactagattaacagagatatatgataaataggtaggcaaatatatcatccaaaccagagcaatccaagaggtcgaatgtactgatgcagccttgaacgacgccgacgtaaacgatacaattgcctggactggcggaacattggacttatcccttcgccggagatcgaagacgatgcataggaca

SEQ ID NO: 66221 - DNA, 1068 bp, Oryza sativa
  unsure (1)..(1068): unsure at all n locations
ccgcgccatggatcgcctaatcgattgtacagagttcatcaggatctgtgtatgaaggagctacaaagtatcagccagcctctccctccttctgggttcccgatctgggaaggtccagtcccaacccaagcctgctctccctatgggcaaggtcctccttttatatttcaaggggataccacatgcacccctctctctttttgtgtggggacttatcctatcttttcataaatggacggagatttgtatggttgccgtctgaatgaccttctgatgggacagcccacacctacctccactttcgccggaagcaagcgcgacgtgggaacatggctgtctgctgacgatatgaccagtgtcagaccggtcacaaatcggtcattcttgtccaccacgcgtcagtttatcaatctgatgttcgcccttcttcatacaatatcttgcctgtaatggttaggatgaagcctggcatatatctgaccggaaccaacgtgccatctccaggaggtaacacgccggctccggctagggacgagtgcttggaggctctcgtcctgacgggatggggcgaggcgtgcgtcagaccgcctgtcgccacctaacccacgatctgaccggtttgtgactgatcacagaccggatgaacgagcgcgctgtactgcattacgtgtggcgtgacgtgctcacccaaaccgcaataaatgcggttaggtgagccccgctgcgctcacctaacccatacacgcggcgcaaaacccacaaggggtcggggcgcctcggccctcggggccgaggcgggagcggtccgaccccctcggggagacaaagaggagggcgaacacatcaccctcgggcccgacgccccccgagggtgccaggccacgtgggcgattgtgtctgcctcaagcctctagtcatgatactcccggtcccatgtcaccgacaaaccgggactaaagatcatctttagtcccggttcgaatgctgtcaggacctgtcangccccccccggaatcttgtccccgttggtcccaaccggccttaaaaaacttactttttttccggggg

SEQ ID NO: 66222 - DNA, 1786 bp, Oryza sativa
cctgcaccccagcaaatgctccagataatttagtgattcataatctcatccagatctccacagattctgttggtttcggtgttaccctcatgagcaaaactcggtttcgtagcctgaattgcgggttttcccagcggcttctgtggatctgtcacatggaaatggaagagggctgaattgtgaacgatctgcatggcaactttgaggaaaacttcgaggaagggaaaacaccttgtttgcgtacgtttcccaaactactagacgatgtctttttttaataaaattttctataaaaaagttgctttaaaaaaatcatattaatccatttttaaaaattaaaattaatcatacgataatgacttacctcgttttacatatcttctcaatcttctcttctcctctcaatccctcccctaaaaagagcttagaagagagagttgatggcaagattcgttatgagagtttatctttagtccactgtattgtttctaatacctctctaaaatctcttattttagaatggaagcagtagtatttaagaggcgttttggtattttaaacacttacaattctaccctattaaaatattggtagtgccaaaacttatctagagtttaacactaccaacattttgatggtagggtactaaatcaaacaagccttaagttcacgacggacaaccaaatttagcttgctatgctatacttagtgaaaacagaaaaaaaaaagaaaaaagaacatcgagacatactagttaccttatgtgccgaaaggccagaagaggcggtgtgcttcaaaggatagcaaagcctctcactctactagataagatagcaaagggagaattggatgccaagagaaactaatatttacagaacagtttaactaacatcctttgcaagttacattcttttcaactggacagactttctatagaaagccatatgaaagctcagaagtgggaacatgccgaactagcagctcctgcagctgctgaaaacatctactacgagggggaacctcaaacctggtacaggatttggcgatgccatcgtgtaactaactagtcattggcgactaactctaagtttgcattctctaacctctggaggacaagcttcttctgtggagcaaggcctttcgcgatcgccacggagctcacgtcgacgaggacggtgtcgtcttctttgaagtcgcccttcaggacactgagggcgatctcgttctctaccatctgctggatcaccctcttcacaggcctagcaccgtagttagggtcaaagccgagagagccaagatgctccacagcttctggtgtgtactgcagatgaatcttctgttgcctcagccggttcttgactcggttcagctgcaagtggaatattttacaatttttttgttagatcaactgtgagaaaacctctaaagcacaattaatatttgatgctatggcacaggtgggtctattagagtagtcatgtaagaataactataagaggtttacctggatctccacgatgcgatttatctctgtggtgtccagcggctggaatacaatgtactcatctatcctattcaaaaactctggccggaatgactgccgagccatgtcaatcacttgcttcttcattatttcataaactgcctccttgctgtctgatgtgtttctaagcgtatcaagaatcaatggcgacccaatgtttgaagtcatgatgataacacagttagtaaagctgactgttctgccctgagagtcggttattcttccatcatccaaaagttgcaa

SEQ ID NO: 66223 - DNA, 3460 bp, Oryza sativa
cacgcattcgattacagattcatagtaggccatcaatgatgattcttttgcatgtggacccccactcagccaccattcccatctctctcctgcttttcgggctcgcttcacccttttctaacattttttgatgacacccttattaccaacagatgacacgcaaacctggcaaggtatggtctccacacccctttctcttgcacgtaagcaatctatctacgtggatggataataccacacgtcatatgtatgtattgtgaatggcttaacgggacaatttaccctgctgaaacgtgcagctacgtgtttctgtaccaactacagatttactccctccgtcccaaaataagtgcagttttgcactattcatgttcaacgtttgaccgtccgtcttatttgaaaaatttttatgattagtatttttatcgctattagatgataaaacatgaataatactttatgtgtgactaaatgtttttaattttttcacaaatttttcaaataaaacggacggtcaaacgttaaacgtgaatagtgtaaaactgcacttattttgggacaggtagtacttatcagagcagatcagatcagatccacagcacatttgcatcgacaaccgtgaacccagtacaagattcacctgccggcacaaatttttttcatttctctctctctctctcttctgttccgttttgtctggacatgacagttgtacagtttggcttctgcatagagcatagtttaactggccaaacagatcgatcgatcggctctatcaggaaggatgcgtcttaattgctagcctgattagttttctgatctgagggtgtaatcatcgtgctaaactatactcaccttgtctggcagatagcatcgaacagattacagtgatgatcccaccgtcgctacgaggcaacagaagaagcaaccttttttatgtccattgtaagagactgagtaaatcctaaaactaatggtttcttcaggtaatcggtgacagttcactggaatatgcggaaaatatataccccaaatgctagctatagcatctttggatcaaaggaaacggcatgaaatcaaaatcaaatttaaaaagatttttttcttttttttagcggttaaaaagattttttttattacacagcaaatgtgcatatgcacaacactacactcatatacccacaaatgcgcctggccctaacacaagctaaagagaagcaaacaagcggtgcatcccttatctcactagattcctattgagatttctattgaaagcccacttaaatatgtgtaatattcataaatttaaatttaaaaggatttctaataaagagtgtgactaagctagtttgtaaggttaaatatgttagaattaaaaaggatgtttgtgtttgttctaaaatttatgtactatgtcgctaatagcggcatcctaatcctaaaattaaaatgtctcactcactgagaattgtaaagaacataatttgatcaaacttgtcaacaaatgtagcatgtaattaacaaataaaaatataaaaagaatcaatgcatttcctctaaaaattcatatactccaattaaagggttcatccacaccacagccagtaacatttgatcaagttttgtccataaatagaggatattctcagtaatatgcaagtttatttggtacagctgcatagtggttactcaagcaatctactccctccgtcccaaaataagtgcagttttgcactattcatgttcaacgtttgaccgtccgtcttatttgaaaaatttttatgattagtatttttattgctattagatgataaaacatgaataatactttatgtgtgactaaatgtttttaattttttcacaaatttttcaaataaaacggacggtcaaacgttgaacgtgaatagtgcaaaactgcacttattttgggacggaggtagtacaatgttgcaattttgtcggcttccttggcgcatcggacattaggtccaccccttgttaaacgagaagtacaatgtgttgatttcagaatcgaccgacccaatgccaggccacccctgacagccgcccggactcgtcggtgaatctgaatgtattttggccaagtacacattggtagagtaaaccggatgcttttatctaacgaaatcttcattagagcttgttcggttaatcacatgagaaaggaattgaaagagattaagaggattaattttacacctcaattttttttttagaaacacggtacaaacattgacactcatagcacacacacacactcacccctaaggcatttatggaagattgggccggcataaatccacacctcaatatgtatagaataaatcatatctaaaccttatagaacaaggcattttttgaaaagaaaagaaaaccgaggcatatgccttagcactaggcgtgcaattgaacagtgaatttagctcgtctgtgttatctgtatttttaactctaccctacctcttgcactgtccatttctttgtaaagaaaaccgcaccgtccatttcaaaatattaagattgtccatgcacatattaaattctgtgcatatagaatatatcgccgatagattcgatcatcctctggaccattcatccaggcttcgaatgatccatccgttgattcaattcgtatatatgcacagcccaaacataattaagtagccaagcagagtactccggcaatacaaaccgaaatttcaaacaatctcacgcgagctttgaattaatgccaaatttatggccacgtcccctcgaacgatccgttgatgtactgtaataactaatcgacctacaccacgcacgttgatgtactagcaccattattccatagatcgaggtcgacgagacgagacgatcgtcctgtttgtaaaaataaattaattattataaagtttaaaagttgatttaatctctaaaaagtgttgatgaaaaggtttttccttactgtttagaatcgtaaaatgtgtggccgcacgatataatccgtaatcggatagctaaaaagaacacgtcaaaccacatggtgtgggccatggctaatgggcgggtgaacgcccacagcgatcacccccccatccccatgtacgcttatctcccccttcctcctccatttcttctattcctactacaccataaaatttttttaaaaaataagaaaacaaagctagaaaaatttatgtatggaaatactgtatataaaaaaatatttgaattcaaattcaatttaaaacgggtatgtaaactttcaacttataaactttgattctataaactaatattcgaattcaaattcaaatttgaatcgggtatgtaaacttttgacttataaattttggatgtataaactataggtgtataaattttaaatgtatagaaatactatataaaaaatatttgatgaactacttgcaatcgaagccgtatcttaacggccgcg

SEQ ID NO: 66224 - DNA, 26553 bp, Oryza sativa
tggttacaagaatgacacatcagatcaagcaaagcatgacttactaatgactgggaggtccatctcgaggccgacaagctcaaggagtttgaagccatccatgtccggcatgtggacgtcgctgatcaccaggtcaaactggtccttgttctccctgagcagcttcagggccgtggccgcctgaccagttgttgtcactgcaaatcacaccacatcaaatccaatcaggccagattcaacaacacaatacataggcaagtcaaaattatcaaaagaattagtactactactattttgctgcaacaaggaaaaaaggtcagcagaagataatccttacacaaccaccatgtgtgcaacccaaagaacagtagaaaggattggagattcagacagaagggttgaaattatatcgaagaaaagagaggggaaaaaaactttttttaagaggaaaggggcaaaacccgttcttgagttgacattacatggccgaagaaatagaccaccaagaacaacagaaacatctacgagtgaaactgtgaaagccaagcaaagaagaactagcgcatcaccaaaaaaaacaaaaattaaatccaagagagagagagaaaaaaaacaactatagaacagtactaaaccaaaacgaaaaaaaaattgatcgatacagcacaagctcaatccacaaccatggagagaactcgctcgctcgctcgctcgagctcgagagagagagagatggcagattagcagcatgccgagatactggcatcgaagcaggaggttctcgaggatcttgaggcaggtggggtcgtcgtcgacggcgagcacccgcatgccgaccgggaactggtctctcccgccgccgccgccgctcacaccatggcctcccaccctcccctgcctctcctccaccgtcatcttcctccaatcaatcaaccaatcaatcaaacacaaacaatctcccaaactcctccacctccaagcaacccaagaaacagcactttcttggatccttaaaaataaaaatccaaaggtcaaagcagggtgagcgagagcgagcaccaccaccaaagagagagaagtgcgggatggatgcgatgataataagaggagaggagaggagagagagagcgagaggtaggggatgatggatggatcgcggattgggtaaatggaatggattggagtgaaagagaaaaaaaaaatttcatatgcagtgcaaaggtggaaaccttttttttttatttccctcctcgcctttattttccttttacgcttcccctgtttcatgccatttattcgcctctttaaatccgtccatcaaatatggggctgtgggtcggggcgtgtttcgtgtttgtgctcctttttttgagagagtttcttggtcaccttttgaatttttactgttactgtttttgcatttatttggtggtggatatgggtcgtatgtgctttgtttaatttggacttaggtgaaatatgccgtatttgaaattcgcacgctttatagaacccgaatcggttgacatatagtaagatgatgtgcgtcactctaatgcctcttaagattctatatttcggtgtagggtttaaatatttttttccaacaagcatttatatgtatatatattttgttatgtaatcacgactttaaaataacgctagcaattacgcgacacctattcggagatgtgggtaggtgtttgtactctctttaaatctaatatcaagacaccttttgaattttattatttttcatctatttttatagtagatataagtcttatgtgtattacctatatgatttatcatatatatgcatgaaaatatgtgataaaaatatatacatgcttgaaaacgaatcggttagcatatgatttgtttacaattacgatgcctttaagatttttcattgtataggtaaggtttcaagtttcttttccaacatttgtgtatatgtatttgttgtgtaattgtggcgttagagaaaatgtactccctctgttttgggttatatgactttttagcatgctagaaagtcttatgacttgaaacggataaagtagctcgtaattcaatcccgattatctactgtattgcataggcatgtgagcccgagggtatgtgagtgatcctcgttcctcgcaattacacaactggttagggtggaaagcaatagttttggcatttctcaatttaattaattagtcatcatccaggcacctctttttctcctattgttggtgctgacgtggcttgagctggcctttgcggctggtttatggagtatataacttgattaaagtatattggtgataagattagtgatgcttgacagctagatgttacatccatgcccgtcttctcccacttaattcttcctctcatatttcttgcatgctaggcagcacgacaggatcaaagattcacagatctatatagacacgcacatatatatactatctctcatagcttggaaggaaggaaaaacattttaattagctgttgcaatcatccctaatttcttcagtttggccctagaattaaggaaggcatctaaattactgtgagatgtacaatttttttcactcaattttatcctatccaaatccttccctttgttagttttccatatagcaaaactcctaattccaagacatacgggtagagttcttttcccatgaaaaaaaatcatttaactatggataaaatttcctttttcacttttcataccctacataatctttgcatgtactttactgaaaatcttctaactgaaatagctgttgatgattttgctaactgaaaactaaagcaaaatgacctactcctattgagtattgaccttcccatattcctgcagggaatggccaatcagccgccaaaaaacccataaacaaatttgcacatgaaatagctggggttgtttaatatgcgtatacgttgtccttgcatcttatattatactgccccaagtacgtgagtgatcagcagtacattattggctcacacaccctgtgttttgtactttgtgaacaatattctttaaatttattattgttcctgcctttttaattttatatgagtattagatccgtggcaatattctaaggtatcagtacacgtcaacttgcccttaaggaatctcatcttgggcacaagagagctgtgggtgatttcttttttataaatctcatcgattatttttttgtaattaagtagctaaacacatagaaaattcgaagaccttaattataatgacaatgagaaattaaagctcgatcggatccaacaacgtgcaaattgttcgtgagaagaagagttatggtatcaaagtactggccacgataattgcgtaattaaggagggagcttgatttgcataaaaaattgtggcacacgcattacatgagaattaagaaatgtagaattaaaatatttattatacattcacaaaagcaatggacaaaacaagtgatttttgcatagctgtgtggattaattatagtatgtggtgaataaatagttgatgactaattataaagaattatatacatgtgaaaaccaataataaaatagaagtgtgtagacttcacctgctgtttgcccctataataatccaaggtatattttaaggacccccactaacccaacatatccatgcaagcaaagatgaaaatctcaaaggctagcaagtgtgctacacaaagtgccaattaagacagctcctgatctcatctcccacaactaaggcctgattttttttgtctctaattattttgtctatcttcctactcatggaccacatattctgatctgttttgttttgttgaatcctaagaccaaacccacccaaaatatgccccccatcctatatatcatacaacctagtgcttcgacaagttaatgctagctacaactaagtaggccaatgtcacatctaatactagcccatatattttgtcatgatatgtaactttggtcttgcatccatttgttggggtccctcccatatttattccaagtggcaccatgtatatataggtcttcaattcctttgtgtatatctgtcttttagctctccttacttttagcaccaacacaagtatgagaaaaaagagatatggtgcacttgaacaaaatttgaatgatggagttcactttaagtgcattgcatggtctagctcactccccccatgttgtgttatgtctccatcatgaaaagccatcttttgcccctgagtacatgtgacatattcctatatatccgaccataatagcaactgtggctttttccaaaaaaaaaatgttgttgattgaaatatttttaactattatggtgctctcatgtcatttggaaaccgaaacaaattatcagcaaggttttttaaaagcaaaaagaatatggattttgagcttgtaagttaagtatggttcaatgacatgatatcctcgttcttatgacgcctcctcttcatttccacatgtcataattcgaatacacacaattaattaacctttttaaaaaattaacatctaattcaaacggaacatatataatacacatgataactttgctagatttttcataagaattatgttgtcgatgaattttctaactacatccatctcaaaatattaaagtacaaagacagctaaaacatagtagtactatattttaggatatagtatgaaatacatataattcttgctgatataattaattaatgaagtgatggccagaaattgggtaaagtactagcactagctaaagatatctacacagccaaacctgacatgtattagtaaaaagacgagtaaatcaaataattaattaatcaatcaatcaagaaaaaaatgaatggatccagtaccttttgtttaccactctagcagagctgcgagtttgcattgacctagagagaatgcagtgctgatgagtaggagtaccaattcgtgcatcgtcactctctctatgggacacagctagctataacaacattcatgtcagattgggctagctaccaatgctgcttttgagcaccccggatgtggtactgctactaccaagaatggcctccatttcttttcctttctctaattaatctggttgctttgctttaagtttgcttctttcaagaagacactgattcctactagtatctcaaaaagaaaaagaagggggaaaaatattcagggtccataactaataaagtggtcagtattttggtgcaacatgtcagataaaattatggtcatttcctagcaaagttcagtcaagaaattactccatttttcatagagagagagagatgcagtacaatattttttgaccaataaatactgtatactcaacaagagaaaaagcagtttcactactgtcaaagctgcttctctgatctctctgctgcacatagtagtaatgttactattataatatctggaacagagcagtgctcggtttaagcctctctgattagctttaaaatttacagtgatttttatgagctactgacccagtcagccagccaggagttaatatgagccagggatcagaagttcagaacagagaggctcgtgcatggtcatgcactcacgtactctactactgtagtctactgtatctatctatgagactatggccgtattgcattttttttccttatctatgagactatgaccgtattggctttttttttttctttcgtaatttgagaatgttttttttacttggtctctatatccaaccagatatatgtagcctttttaaactaagaatttagtctatcaaataacccaatatgaaattcgctccagtggagatttgaactcaggactttggggtgctagtgtgctgctactcaggtcactgtaatcactaagctacatgcactttcaaaaataatttatgtatgaactgtaagaaatatttttatcatccttagtttacatggctaattaaattacaacggtttgtagtgataaagtatacctcgagtacgtaacgtagcaagcaatattattcatacacagagatgcacaggttaatgactagtagcactaaaaatcctttctcacataacaacacaagagtactcctactatcgtaagaaaaagttttatcagccattcagccttaattcacaaggttaaattacaacggtttgtagcaaagaaagaagaaagtatacctgtaatagtaccattgtactccctccgtactcgtaaagaaagtcgtttagaataatgtttaagtcaaaccttgggaatataaatcatgaataactcctaagttgttgagttttaaaatgtaaaaattatatgaatagatttatcttgaaaaaaaatacttttataaaagaatacatgtatcacttttcaataaatatttttatagaaacaaagtcaaaattgtgttttagagaccgtgtcgttaccctaaacaacttcctctatgagtacgaagggagcacgtaataagtctaatcggctcaaattacccttgtacaagaaacatggccattgcaatggctgcaactgtgcaaacacaggaaaagggtatcgaacatgcccaacgtagccatcatcgttcatgcgcaaaaccacaggttagtattaaaaacattaaaagtactcaaatatttttatatttgcaaaaatgttaataatacgaattatcaatatagggcctgttcggtggccattgctgcggctgcagctgcagccgctgcaacggtacatacgttgttcagatcgctatgatgcagcggcaacgctgcattgcagctgcagccacgggctgccgaacacagccatatttgttaaaaagtcagtggtgatatattatttaaaaaaaagaggtattaccaaatttttgtaagatagggtgaggaggccagtgtttggttcgatactttatcaaattttgagagtagaaacttatagaatcaccaaatgttggtagaattatgttggcaattgtatattgttcattgccttaccagagaatggtaagaagtgaataagctcgaagattttgtagaggccattactattaaacttgctcaaacgctgaaactaatctttgctattaattgcctgatacgaaattgaattccggttttgtacttgggcgcagtactactacagtacactactgctgctgcactatcccatgttaaactgcaagcaagtcagcaagtgcgcgtgtgtgggtgggcccacaaaaaaaacgaagctagagtgtgggggcccgtagcggtacgcgacaatgggtttggggggcttgtacgtgggtgggtaaagattccgtgagaagattccgcactcgaataccgcgtgtgctctgacatgtgggccccaccacccccaacgtttccgctaactaatgggtgcgctttggctgccacatttcgccatttttttttctcttttttgctatgcgcacacacgtctccagctatgctctgtttcatttcagctgctagctgctgctgcgatgaaagttttaggaaaaccctgttcattggtaatgccgttttcatctttttccacgtaatcttaatctcaaagggggcctatgattaagattgattaaggagcacctaagacgaggaagttactagtatatgatcaattgattttttcaattcttgtaaacttgaaaaatagatttgtttaatattttagtccagcttctatatagtattttttttttcacgaaactcaccgtctagcctttaaaaaacttgctaacataaatcgaggtataacctacatcttaatcagaaatgaatgggaccataaaaatgctagtagtgtacattttttaaaagaaaaacaaatgatgcatcaatgtcacaatgtggttgttttatattacaagccatgtaaccaaaggagtaaacatattgtgttagttgtaagaatggtcttataggttgtacaacagtacaaggtcataacgtcaatatgccatgcttgatacggtagcaaaagccaatggcattcatatatgaagcataacatatttcatccgagggatacttcaagttttgtaagatatgtttgtagtttaagaccgtttagagtcatttccaaaattcaagaccataaaagtgaagggataatttggacaattccatcgtaacgttacacgagttgtaaaaataataccatcataccattcatatgtgagaatggcaggcgggaccaagacagatatgtcaatgacatgtacaatggtattttctaacttcatgatttttgtgatggtaccaacaaactgtaaaaaaaagagagaaaaacttccacataaagattactagtatgtttccgcctatacaacaacagtggttgaaatacatacatttctcatgctctataacgctctaaccctaaacccttactacccccaaagtgtctttttctattgcttctccctaactccctttgtgcgcctgtgcgtgtgatatattgcccatcaccaatcatgcatgatgatgtatcgatcgttaccaaggagccagaccaaaatgtacctggcgctcacatgttggccgagatatatattactagctacatgtgatttgtgatttgtgagctatagaaagctagctagcttggcttgtgtgccccactcagatggatcaatttcacctagtggaatgtataattggaacctgcactgcacactatctattgtactatatatgttgactgatgaagaggcaagggattggtgatggctagctcatgctgcatataattggtccaagggatagatgccaacgttagacttattaataaccggcctttttttaatccttcagggtagatcttaaggtttttgttattcactattaattacttcctctgatttttaccatatgactttgcgtattgagttttgacatacattttactattcattttattaaaaacacgtaattatcatttattttagtgtgactttttataattaaagattctttaaacattacttatattttttatatttacataaaggttttgagtaaggcgaacgatcaaaacatatggccaaaagttaacaacgttatacattgaaaaccggaagggagtaattttcttcctatatgaatgtcatgtcatgggttgttaatgattttgctccatgttgcgctacgacgtgtggtcgagaccatcgttgatgcatgcgcaacaacactcaaatggctgtgttgtcaccaccaacaaccaatgccgctgtcatcccgatgaggcacggctagaggtagtaatggatctttcttctttttacaaaatgtgagggctgggctacaaagaattggactaaaatttagttcttttaaataagatatttaagggttaaggtaagttatgaaaggacccaggagttgtggcccattaccgcccctgcacatggctccatgccaaggcatcaccttccgtaggcgaggttgggcagggcatgtgctcccaattctagaagggccacattggtacatcacgagcactgtataaggggttactgctatccgttgatatcatcgacaaatcgtgataaccaatcaacaggaacaggtgaacttcgaacaaattttaccaaaagatttaacttctaaagattttatttgaacttggtcgaattgttgcgaaagttactgacagtaacgcaaatcctgaatcatgatgacgaggtatggtatggtggcgcccatatggctatttgcgatgaaatgtattcccatgacgtggtatggatctacagattacatctgcaaacaattcaagaatgacggtttctttttcctcttaccagcgaattttccacgatgtcaagtccaatttaaactaggtttcaaaaaaaaagtccaatttaaacgtacacaacagtaaccagcaaataaattaaaggatggagacattcgccggtaagggtcaaggagatcacaaacaacattcatcgatcttatcagtttcgctttgtcttcatcgttgcagtgacctgcctgtgaccaacaatggaattgtatgcattttaccccgtgtgcttgactgcttgaataatcaatcgtgcgtgactacgtgtgccgtgtacgttccagatagaaatttctgtgaaaccacgtgaaagcattcaaaatcactcgcaaaccacacgttttaaacaagatttaggtctctttcaaacaaattaaaaaaatcataggaacactagaatattttcctacgaaaataatacaatggtatcctttgaaacaaattattgtttcctacgtgaaattaatgggtcattttagagcaattctagaggaaaatgagtatgatgtctctcatatgtttttctccctcatgtatctagaatttctatgtttttcatgtgctaatcaaatggtagttttgaaaatccttagaattccactgaatatgacattatattcctacgtaatattgttcttttattactgtatttttattaatcctgcattttaaatgagcccatagatttatgctagtagtactaatccctccatccaaaaatgatcatcttatatatttacccaccaacgccaaagataatttaaactgtattaatcaaaacaccatgcatacattctcccacaatgcatgcatcgattaaaccatcacgtcaattacaccctagcatgtacgcgttctcccatgtggtattaattgtattcaaataaaatacgtgtctatatagttatataatgattaatttgaaaatttttggattctattacatgatgatcaatttgggaatgagagagtaagtgaacataacatgggaggagtggagacgatggtccccatcgtttggcttatttcctaataagccaaaacatagcttattaggaaataaaaataaatttgtgggtaaaacttttataaatatgttttttgtgacttaaaagccaatgttaaaaaagaaactacgttaaaaatatgtcaaaatcaatattaaaattaagcttaaaaatttaaaatttggttttttcttttagaggccatccgatggggctggatgaagagtagcttgcggtgagagtaaagttggcggtttgctggtttcctggaagcaatcattgcttgaggcttcttgttgaacgttcaacaagcttgtctcgagtctccacacaagggagaagaaggggaagttgcatgctgcgacgactacaatttcccacggtgacaatcatggccatggactcacgaatctccacgccacgtcggatcactctctcgtactagcagtactcctttcgtcttattttaagtgaaattatagtttctgtatctaattttaatcgttcgtcttatttaatttttttataattcgtatttttttattatgagatcataaaacatgagtagtattttactcgtgacttatatttttaaatttttttaaataagacggacgatcaaagttgaacgcgaaatttaaaaagggacggagggagcactattttttaatatattatttatctcttcaccctaaaatacatatagcatccacctaaaaacccttagggcacccacaatggttatctataagctctctacaagagatccatgtcagcatattttcctacttggaagagattaaatgaagagagagagcaaagctatctactaacatggagatagtctatagagaaaaacgaggcaatggattagagagctatagatacccatgtagacataccattgaagtggtttactattaatctagtctattattgaggtgtacatgttttatagatagcaccttactttaccattgcgggtgctcttatattttgacacgaaaaagtgcttcgacaactacgaattctcggaggttggagtagtcgttttcatctctatggtagattggtggtcgtagcattcgatctggccaaaccaaaaaattcgttccagcttcggtctttgagaaaattcggccatcacgacagaacgacatggtcgagctgaaaatccaatcactcgagtgcttttcgaattgataaattatgtcttttttaaaaaaaatatacaaagttatttttaaaaattatattattttgttaattttataataattaatatttaattaattatgtgttaatagcccatctcgttttacgtatcttttatttttcctttttcttaaatatagcgtaccttccaatatttaagctatttggtttggggaaatatccagtgaaaaccattaaataagtgaaaattcatgaaaaatatatctaaaagttttttaaattcatgaaacaattattaaagatggatataggtatgaaaaacattcataccaaatcttaagacaaactcaactttatttgagaaaaacacaaaagacaggtgagtagggttctattactattcaccacctgaaatttgtctttttttattactctataataaagttgggttcaaacttgagatttggtaagaatgtattttatgtctacacctaactctactaatttatttataaatttacaatctttgtggtctagttttcacgagttttcatttattcgatggttttcactagatatgtcctcgttcggtttcggttaacttggatcggttttcggtcatgaccagaatatatgaaggtttcaagagataaaaaaaaacttacaaataacaacaaaatttaagaaagtcctttacaacatattttgacaatcttcagactggcacatttctctagagccagggccgggataaaacacataactaaatcgactaatgcttgggattcatgtggttcttacacccgaattctaagttgttgacccttttgcttttccaacaatttgtacatatgtaattgtcgttctattagatcataaaaaaaagatgaaatttctgttttttcttctagatgaatacgatagtgtgatcgtttctcttagtgcaactggtttttttaagatgctctggaatctaattaaatagtgtaaaagaaaatagtaaacaataaataatgcaccaattcgcataattctttttttttttgaaatgactcacacaaaatagtgtgaagtttcatattgatatagtagaagaaaaatacaaaattataaccttagaggttgtaaccagggaaaaacagaaaataaacacaccccaccacctctcgttaacatctccgcatgcaaccacggagaagatataacaccaagccaactacctctaaacgtgtccgattgttgctaaattaataagggatcacaacggtccactgaatatcaactccacacatagaagatcgtcggcaagctcctggtcacatagagggattgagaaggaagaggaagataaagaagaagattcactcgtccctcacgtcaatctgattccaacttcttacttgtaacttcgtgatctcttggatgaagcggcaaaaaaggccaatccttcatcagcatcgtaagctagtaaaggtgcgatggaacggtgcaagactgctcaaaacaaagcgccatatggatgctaaaactagctcaaactagtgggtagtggctgcataaaaagaggaggagaaaagggcagttgaagctcaaaatttacccagagtttgtccacaacgaggccataaaaagagcacaagccaaacacaatccactaattttatcactctagtagcagtagtaatttacaatccgggtagagtaagagcaggtacaataatatcaggctattaaccagctataaacatattttaatgagataaatgatgagagagaagagtagcgggctacagatctaagctgtagcacggactccaagacacactgtgtgtatatgacagatgaatatattaatagtatagtaaacaatctttgtatgaattgactatatataaattggagctggtagtaggcttgtactattagacttgctctaaataaactcacaagtagtagtaggagtagctttcaccaaagccgaaggattctcattctccccgccggccgatttataaccgcagcagcagtcaaccaccaccgtaccttttctccaccttctcacgccaatttgtcgccgtaaataaaaattttaccaccaccactttctcccacgcggcggcgaggcgaccgctttgctttctccggcgcggcggccggcggctgaagcgtgggcgggggttggggcctgtgggggccccgggaggagaggaaagcggagcggttgctttgccggaaaaaaagatggagtgtagtgcggtttgctctgttgctcatatccatctcgtcttccgcttccctccaaattgcaatgcggctttgggcccaaatatggaacgggcctatgtctgggcctaaattgttcgtgggctttctgggcttccctttttcccctaccagaaagataagataacggatttgctattttacttgcgacggatttttgggcttctattttttccccgtaggattctacatcaagatttgcgttttttatattcacttatggttgcactcagttacatagaactcaccctcagttgcatggcacttacacttagttacagtacatcaaaattagattttacattttttttatctagatttacgattttcaacatgtttgtttcttttttgggtaattaatttaaaatggttcatatcaattgatcaaaaattctgcaagattcaaagctataaatatgtcgaaacattaataggtagtccactgataatggaagcaactttatttggagtatctttatcttagaggaatctagtacaataggaagagagggaaataagagtaaagtgcaccgatggtctctaaactcgtgtggatgtattatttatgttcataaactcttaaaatgtaattttagatatttgaacttatcctcggtgtcatataagttctaattggctctaaatcacctcatgtgttgatgtggcatgtaatgacagcgtctatgtgtaaaaacatcgttttcttctctcctttttaattttatttttttttcaaaattagaaaacattttttctcctctctcctctctctctttttttttatttttcctatgtgactgacatgtgggtgtcactacgcatagtggtcactgtggtgccacatcagcgcatgatacgggttagatcccgtttagacccatatgacactcagggcaagtttgagatccaaaaaatatattttaagagtttagatatctagatgatatacccatataagtttaaaaactgctcgtgcacttcgcttaataacagttcggcttgtctcctcatcagcttagatcatcactttgcttggcaatatgacaatagaggcagcagcagagggatggaaataattggtgcaggtgatgatgcgatgcaaccaaaataaccggataaagggggttaggtgtcaggatgaccacatgaatgaccgatcgagatggcataacatgataagcccatgcacacgagttaacaaggtttactcgacaattcatatattgccccccgagagtgtatgtgtgcacatatagttcttattgttatcttggttgtaatatatgcttaaaactatatttacaccatatatataacatgttggtccagtcatcagtatgacatgcaacagatacggttaaactttcattacaatatatttgtaaatctcgatgaataattataatatttatgatttaataatctaaaaagagatatcaatgttcagagtttcagaagtttgcatccgcgaaaagagtttcaaaaatttaacctagactatatttcctccgtttcataatgtaagtctttttagcattgttcatgtttatatttatatagatgttaatgaatctagacatatgaatataagtaatgctagaaagtattacattatgaaacggagggagtattatagaagatatcctttggaacagagaaaacaaatatatagaggattattcttacgggaactgaactatttcacgaaacaaaatcctgtaaaattaattcatgtattatataagggagccctagatccatgttttcaaacccgatggagagggagtgaatacatgtattgagatgaccactccagtagccttttaatttccattttaatctctgatctgatcggtaaactctcattaccatataattaaggtcgctagcaaaaatgtcaaacaagagatctaacatgatgacaccaagatcccggcatgtcgcttggtttctgccacaactttatgtcatcaaattaattactacattagatctctggagtttgaatcagctaaaggtgcttagctgcaggtttcttgcaagatcagaagagtgacatgcatcagcccaagactacagacaaagagtagtacaaaactagagttttattttccactgattatctcatctatctcatcaggtacatgtgaccaactcttaatttagtttcttaaatacgtttacagttacattaattagtatatcccgatccatttggtttatatatctatggttacttcgtcttcgctagcccgtgtgtgcacatttaaaaaatgaaaatgcatacgtgcgtgttagacatgttttttttttactagtaatggcagtataacttctggtaaacacaccaattatgcacatagtcatttttgtatgtatacatgcatcaagttcaactgcaagaaattaaaaatgataagagaaattaaacagcgtcagtctctttctctgcacgcacgtaaccaagcatgcgcacgagtgctccttcgataacgataagctatataattttgacatggatcatcatcagcttagtttagttttttttctgcggctagcaattaattacattgtaacttataagtaagagcttaattagttccacattgtgtagagtgtgtgtagattgatcttattcgactagaagatcgatttatcatttaagtttccaaaagatcaccggaggattagtttcagatgaactcgaaatattcagaaaatgatatgatatctcatgcagtcagttcgatggatcatctcctttatagttttccttttgtgtttcatttttgtgagctgttcacttctaactcatagtcatgcttagtggcccaataaccggatcgaaaaagatcattggatcaattcttttttagatcaactcgaaagattcggaaaattatatgatgtttattacggtcagggtcagtttacatagtagagcatacgtgcatggaatgatggaaagagatgccaagtaattcttggaattaaggttgtaaaattactagtatttatatacatcgatcaacacagtggggattatttacattactgcacctacagtagctgccattgaaatatgggattgggaccacccgtcaactactgctactgcaagtgcagtactgcagaggatccgtgtcccgatcaaccgggacaccagaaatgtagaagcaagaaaaaaaaatgcaggagaagaaaaagctagggtcatttccagcagcaaaaatatgtgtccatatgtgtgtttttttacaccagcaatttcacagctttagcgtcaggtcgagttgacgcgtttgatcgtctccgtcgcgcggccagtagtagccgacgtttccaccgccccaccaccaccgctcgccgccgccgccgtcgccggccaccgagatcgccggcggcgcctcgccgtgaagcacgcgcgccatccaccccggcgacgccgacacgaacgcgccgtggtggatggcgaaagacgacgacgacgcttgctcgccgccggcgcccgcgccggcgccgcgcctggcgagcgtgcgctcccgcttgtgcgcgttctggtggccgcccagcgcctgcgagctgtagaactcgcgccggcagtagtggcacgcgaacagctgccgcggctcgccgtcgtcgtcgccgtcgcgttcctcctccttcgccggcgccggcgacacgacgagcagacgaggcgccgtcgcctgccccggcacggcggcgcccaccgtgccgatgaggtccagctcgacgagcccaagcgccgcggcggccgcggccgccatgcgacggccgccgccgacgaacgtcacgtcgcctcctcctccggcgagcttgctcatcccttccatggcgcgcgctacgtcgacgaacaccaccacaccaacttaacttgagatgttgcgacgcagtgcaatgcaaggtcgtagtatatatgcaggcaaagtaccaaagtctatgcaagaagatcaagcaaatgatcgagacggagggcatggtcagctggtcacgttcacgtaacgtgacagtgacgtactccgtgtcaatgttgccattatgtcataaataagactatccgtttcacaatatatgtactatatttattatgtcctatccggtgaagaatttaagatgcggttactgcaaattactccttttaatctgccccgaactagatgtttcttttttccgaaaacgcagtacagacacggacgtttataatgcgcgcacattcacccccagtaaacgggcacacgtacaccatatccatatgagcacgtttgaaatattgacctgattgacgaagtcaccacgggcatacaaatatcatatccctatgagcacatccgaaagactgacccgacatatcttgagattgacgaagtcaccaaggactaacccgatatattttgattttgacgaaatcaccatgggacatatcttgagattgacaaagtcaccacggactaacccgatatattttgattttgacgaaatcaccacgggtgtctcgctgtcaataggtatgccgcatatcattgaaggaataattaatcgcaaatgcgagtacctatgtcaaatatagaatttgaacctggataggttggttccaacacaaggaacctaaccaattaagctttatatgcttgcaaagacacctacagatagacatgctaacatacaaatttgaattaaattggttcatgtatttagtagagatatctaagataatctcttatatatttttataggatttctatatggctgttgacagaaaattaaggctaatcttagctaggttcgtgctctaaccacctagatctttctcctctagctccaacgactggtgacgtcctaacgagttagagtttagggtctcagattttggggtgggggaagggagaagaggaaggagatcgcggggtttagagagatggctgtgggagacgacggcccaacggtccgcggtggacacaggcggacggcgaggtagcaatggctccaaagctgccaagatggaggaggggcagagggccgatgttggcgatgagggaaaatagagcttgtagttaggagatgacggttggtggtggcgtttctagcaacggggagctgtcgaagataggaaagaaggcgccgcaggggcactcgttgccgccaacttagagatgagaggggggggggaacgctgcgatgataatgacgaaaagagagaggagggttagtggtaaatggcacaaatcttaaaacaatccaatggtttagattttgcaagatttgtaatggcattttttcagtcaaacgccatacagacagtccctatcgtttagtagtttgtaagagagcaccggaggtgcagtgtgcatgatttcgaaccattacgattcaagccctacaacaacgaatatgcatgtgtgcttctaaggcctttcacagtgggcggaacttaccgtggcttcgtctcacgtggcaagaaaagtgggtggggcccatagctatactcggttctccggttcctagcaaagcaacgaggaacttcgctcgggcgcggggcccactcggggcgcgggcccacttggtgagcacgcgggcgacgacgactccgcgcccctatgggaggtcctcggccgctgcccatggcgagtcgccggcgcggctctctacttcaatcgccggccgcgtcggccacgccgcccccgatctggtcgaccggagctcgccggccaggagcggcccgcttggggtggagagggagatgcgggcggccccccaagctcagctcagcgcgacgacgacgacaccactgccgtcctcctctctccgccttctcgtcgtcgtcggttggagctgcttcgcgtcgacgtcggtggtggccgagccgccgccgccgccgccggagaggcgagctccggaagaagaggaagaggagagagcaaaatgttcggcttcgggcaccacggccaagaccagccaccccagcacgtcggcggcggcggcgcgcaccagcccacctttaatatcttctgccgccgaccaacccgcgcgacgagcaccagatcccgaccaacccgtgcgacgagcaccatatccgcgcacgggatgaaggcggcgcccttggccacgccggtcacgagcggccctaccgctcctccgcttgccgcttgccgaagatcagcccgaggacgccgccgccactgtcctcccgcaccgccgctgccgtcgtcctcccgcgccgccgccaccgtccttctcgctccgcctcctcgtcaccgcctccgggaagagggagagtcgggcgtggcagggacggcgcgcgccgccgcgggcggcggcagtgacggcgaccaccaccacagccgtagtgctcgctgacgacgggggcagaggcgacgggggcttgagcggaggcggcgagggaacgggcggcggaggaggggagagccggcgccgttgggtgacgagggaggaggaccagttggggatttggtgtcggtgaagatatttgtgggccccacaagtggtgcttgcactgtgaagagagtgtcttcatcctatgtgtcatcctgtggtaactcatatggggtgcttgcactgtgaatggcctaataaaatttcagtgaagttaatggatctataaacggttcaaatcctatgaccacgcataatcgagtgtgctttcaataaaaatttagcgaggattagacctatagttttgcaaaattttagtgaagatcaacagatctaaggtccatatcctacaaccacacacaagcggatgcgctttcagtaaaaaaaaaatgaggttcacatatctttattttcattatattttgcaatttatattttattttgttggattagtttgtacgcgtggtaaactacggacaaatattaggaaacaaagagaacagcacaacaatcatcaggcaaagcaaaagcaaacagagtttgcttccggcgaggggaaacggctcacggatggtcggctgggctgatgcaaccgagagagccgctcgtgcgggcgacttgttgcagagatgaggcaagtgatgccgacttgggcaataggatatcattgatccctatccccaactgaacaagtgtctcaaaacattccaacggccaggttaagaaattcagtaggaaaccatcatttcagagcaggtatgactgatactattgtcaaacaaaagcgaattaaaccatcattcagaaaagaaaaaggcagtggcggcagcagcagaatttgaagcctgtccacactggaatggatttgtcacctgagccaagcaggccaaagcttcttgcggtttcttgcacggttgtgctgcaagagcatgtttaataattccatgctatgtgaaggaaagcagaagaaccctgaggggtatgaagataaggaatcaacggtgataccattcatgctgtgatgtttcttgagaagtaaatagaccacacatgttttcctagttctgtaggcagttgtacaggataatcgatcgatcgaacgaacgaaccatcccctacgcgatctaggtctacgggcgagcactcagtccatccttcccttgatcactctctcctgaacctctgtgggagtcctgcattaaccaacaagccaggaaaacaaatttcacagattcagtaaggacaacgacagcattagagttttcatctaaactcccatgtttagtgtgagtgaaaaatgatcatatatggaacttacacaaggagaacataaccaccccagccactcaggcaatctcgatcaacagaagcctgcagcgcttgtgagatcgtctcgaatagttcttccggttccttcaccaaagaaaattgtgacagaaaaatgtcatgtttacagtgctcaaggagaccaaactataagtaaaataccattctgcagatagttttcatgtaaactaaccatgcttggcttatacatggactcacaagcaccatatagtgattctgaagcagtgccagaaaccacaaaatctttcgctagttccctgcttacaagaatcacctttgattagtatgaaccttaaaaatataaaacaaggcagtaaatcagcatatggtacaaagtgaaaagataggtatcatcaaatgctactgtgtttttaagaggctagagacttacagtgaagacgaaggtaggataaagtttgagaatggaatacagctatatctaaattaacagtgtgttactaagaggcttgagatttgtcgtgaagaggaaaataggaagttgggaagaatacagctatactaagttaacggtgtgactttttgtagggctgctattaaaccctacaatcaagacaaaccctcttaaatcacctaaatggctacgtatatgagcaaatgaatggaaatgacaagcataatcaaacttaacctgagattcaacttgaaaaattaagactaaactagaagtattaaatatgagattatttactcctacacacactcccaaggggtatgggttgtatgatatttatcattataccaataatacattgtttatggtaccgttgagaacttcagatcagttgaattttggacaataaatttagtaaacgactaaaatgagacgagagaatataagtgatacatacttggcaccaatgcaatccatggtacatataaatggctcatcattatctcctaatccagcaataactggttggcagaagtacggcccaaacctataccatggaaatattctataagctgtttgcatagttaagtcaatggagagagaaaatacaaaataagacgagatctgtgagtttacaataacagaaataccataggtttacaaaacttccttgtacatttgattatttgaatgatgaatgattcaaagataggatttgtgaatcacatatgatgtaaaggatgtgttaagccaaaaccaagaattttacacgatggttgttaaggatgtgcaataaccaaaaacaagaattttacacaatggcttcagcacagtgagaatcaaagctaaatagctaatatcttgccctacagatcagaggaaatcatatcaatcactagccccactcgaatagcagcaatgattctcaattttcatcaagttgatataagaattaacataatacaactaatacaaggcatgtaagaacgactttgcacaggaatttcacaattcagtaaagcaaatattacttcctactcatcttacacatgaaccagttacttagaacgcgatcatcatcatatcatcatatcttcaaacagggctagtgagcattctaacctcttctcgtagaggagcgcggagacgaggctagcgaatgcctggggcttcatgtccctctcctccctcagctggtacagtttgtgcctgaacaccagccgctggtacctgcaaacacacggcgcacatcaaaacccccccaaaaccctaactaacaagcaactcaatacgccggttctagagcaaaatccgagagttccgggacacccacagcgtctgggcgtcggtggcgaggccggagaggccgatgtagagcttgtcgtggatcttgaacaccctctggaagtcggtggcgaccgtctgcagctgcaccccgaggcgccggtcgctggcgatcgcgaagcagttcttccccaccatcgccaccacggcgctcccgttgtactcgaagatctgcagcgacacgaaccccaaatcccccgccatcgccgcggatcagacgctagggttttgtgggagcggagaagggggagggggatcgcggggggcactcaccgacatgaccggcgccgatgggctcgacggctgcggcggacggcgaggaggcggcggcggcggcgcgcggcgattccggttggtctccggcgagcgagagaaaaaaaataattaaagaaaaaaaaacaagcggcgagtgtgatgtatagagaagtgaactgtaccagatacggatacgtacatgggcccaaaatccagcccattactgataggcctgacgccgctaagaggcccagttttgtgaggcccgtataaacataagattatctcgtgggccctgcccataataagggtttacattttttgcaggccatttttaaagaaaaataaaaagataagagagattacgcaattatgctcaaatcccctgaaatttggtttgccattggatggagtggtattggagaaacatccatatggactttgtgggaaatatcatactcactccgttttttaatagataaccccattgacttttagaacacgtttaaccatttattttattcagaaattttatatatatgcataagatataaattgttgtaaaacaactcacaacagaataaataaaacgaatggtagtatgatgctggaattcatatgtattattcttctctgtatttgagcttttctgtgctaactcaactggacatgccatgttaattgctttgcttttactctactgcaatttaaaattatttgcatttcaaatggtccaacatatttgctactagtactagtacgcaactgaagcttgcaatcctcagatgcaaggacgatttgaggcgcattatacttagtactagattactagtacgacgtgagattaacttgagataatccagcatatgcacgtgaagaaattaaatgaatcagatgcattgagtacctcttccagtcaagaagcttgtacgattgtaccaactattttatactcctaaaatataggagtaataagttttagttctaattctagaaaaaaaaacttattttattttgagacataggtagtactagattattttatctttggaattgaccaatccattttatctcaaaatatagtttttttttgtttttcaacgaaattaaagaaaagataaaaagtaaatagtcggttggaagtcactgaggttgtggagatatggagtattttgaatattttatgactatatatagaccacccttgatactatagaaataggtatattttgcaataaaatgtgaatagtataagtagctatgttttagatggagggagtataatccaaagctactctaaaattttaaagtgtatttcaagacttaacaattcttggatggtaaactgataatgttctcaagcttgataagcaagaacatgaacagagagattggagaaatgaatgtactactaaaaaacacatctacattagactttatcacactaattttgaagctctcttcgcttgccgatgaatgtaggagaatatcctcctctagaattgttttatatatttttgtgatgacccaagctccacaattccatgaaaaggccaaaaaagtgtatccttttgaaatttggcagaaaattcctctaacaatcttcatttgcctttcttagaaatataatctaaataaaagacttgaacataaattaagcataacacactatacatgcatggaggttaagtgggaaaggggggatgactaagctaacagtcaattaaatttaagcataatctcttggactttttgcatgaacaactcacttgcctttcaggtagaatgagacattccagacaaagacaagaaaccgtggtgctctgccccccagcaccattgatgccaataattatacattcggtccaagaagacataaccagcagtgtcacattaatccctacttgctaaagcaggtatggatgtgtggtctccaactaacctcatcaaatactatctaattatgcgcagacatgtccccatgggtcattacactgaagttgctacaatattacatggctctttttcttgcatccaatgacaatgcaaccatatgatattatgatattgtcttgattaatttcctacctaatatgcacatgctcattagttcactttgtttttcctagccatgtatagatccttggattttgaaaagggttagttagacttggatttgaaaagggttagttaatctaccagtgattgtgattccatttgatatttgagaactgagacatatactcctgtaccagctattacctcaatgcaatatgtttcactgacgagtgggcctgctagattatactactgtaccagctaacctttagtttggtcatgttgaaaagtacattgccattgtgaataagacagcagaatagtagatgtctctattcacaaagtacagtaagtggaggtcacactactcactacacctaccaaatcattattctttgtacaatctactacttaaaacattctgtacaagactcat

SEQ ID NO: 66225 - DNA, 20743 bp, Oryza sativa
  unsure (1)..(20743): unsure at all n locations
cgcgcgacctgatntttgcacgtgcgcaagtagcncatcattattgcggtttgggtgagcacgtcacgccacacgtaatgcagtacagcgcgctcgttcatccggtctgtgatcagtcacaaaccggtcagatcgtgggttaggtggcgacaggcggtctgacgcacgcctcgccccatcccgtcaggacgagagcctccaagcactcgtccctagccggagccggcgtgttacctcctggagatggcacgttggttccggtcagatatatgccaggcttcatcctaaccattacaggcaagatattgtatgaagaagggcgaacatgcagattgataaactgacgcgtggtggacaagaatgaccgatttgtgaccggtctgacactggtcatatcgtcagcagacagccatgttcccacgtcgcgcctgcttccggcggaagtggaggtaggtgtgggctgtcccataaaaggtcattcagacggcaaccatacaaatctccgtccatttatgaaaagagagagaggggtgcatgtggtatccccttgaaatataaaaggaggaccttgcccatagggagagcaggcttgggctgggactggacctttccagatcgggaacccagaaggagggagaggctggctgatactttgtagctccttcatacacagatccaccaaaacacatgagtagggtattacgcttctcagcggcccgaacctgtatacatcgctggtgtttcatgctctttcgagaggtcgcgatctttccacatatagacagagcttgggatttcaccctgagcccccggccgaaccggcataggggggcctgtgcggtctcccggtgaggagcccccacactccgtcatctggcgcgccaggtagggggctcagcgtgtgttttctgagctctcgcacttttctgtgtgcgccaagtttttcttgttcagcctaatggccgggcaagcaaaggcgcacgacctctctccgagtgtgagcggcgacgacggggagccaaacccacgccgtcgagctcgtactccaccgcctcctccacaccaaagtcctaagcagggggaggcgctcgagagggtcgatagatccgcggcttcaccgatcgcgggcgatggaggagaacggcgagatggggagcgttgcctcctcgtctatggcgacggcagcacgccccagggcgcgcttcaggctgctggcgcgctcctacgtcactcgcccgtcgtccctgacccggagtctccagcccagcgatggctggacgacgtggccaacttggtcatgacggcacagcagcgcctgggtgctggtggacggtcctccaccaccaggacctccggcgccgctaccactggctccgtgtcgtcaaggcggagggcgcggcgagcggcggctgttgcacgccattcggctgctactccctcgtcggcgccttcgactcgggacgatcagcgtggagagccggatgcccgcctcgacatcgagcgccggcgtaatgaccggcgtgctccccacgcgacggagggcgcctcttcgtccagagtgtcgcctcgacatggacacgaggaccagccctccgtgcccccggctggtggtgtcggctgtagagcctttgtggcgagtcttcggaatgtccgttggcccccaaggttccgacccaccatcgctgagaagtatgacgggagcgtcaaccccaccgagtttctccaggtctatacgactgggattgaggccactgggggtgatgacagggtcatggcgaatttctttcccatggccctgaagggataggcgcggggttggctaatgaacttgccacccgcgtcggtccactcctgggaggatttgtgccaacagttcaccatgaactttcaaggcacatatccgcgcccaggcgaagaagcggacttgcacgcagtacagcgaggggatgatgaatcacttcgctcgtacattcagcggttttgccaagtccgcaacaccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacctggaacccctccggttccggagtggcagcttctgccgcccccggatccgccgctcagacagggcagcgtgacaggaggaagaagaagaggtcggtccattccggcgacgagggtcatgtcctcgccgtcgagggcgctccgcgggccacccgaaaggggaggcctgcgagcgacaaaaagaaggaagccgacgctccctgacctcggctacttggaagagcgaaggtggcgcgcggcccttcgagccgcgcgctaccagcagagcctgcggcgctaccatcagctccacgtccgggtccgatcactctgcgtcgacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtatcaggtcttgggctcgggccaaccccacaccccccgggcgtgcagggttggccgggggcttatcttttttctcttccgtatttcaataaaagcattttcgatttcttaaaggctgtatctgtgctgttatttccttttgaagaatcttggcttgaaataggtcactcgtgctcaatcctaccctcgggggctcgggtcggctaaaatcgccaaacggggcccagaaccgagctgtgccccggggcgtggtgaactccggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttgttcaagccaagacacagaaggactatggcacagaccatcctcgtctcatacacagaacaaatgaaattgacacaaaaatttcctctttatttgattgcagattaaatcagcctataacaagaagggggcccgaaggcctcggaagaagaatgaaaagctattaagattggcggaggcctgggggctcactccgacgcgcctgggtagccggcctcgccgtcgctgtcgtccgcaccgtcgtcaccgcactcctcgttggagttgaaggcaaacgcgagccgaggggccgctccttattgtcggtcggttttcccttgctgatgcgcgcgatttgcgaccgccgggattctgcccgaagagagagagagagcagggaggagaggcccccgagccgaacggcggcccaaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggaaatgtggcccctgacgaagaagatcggccccgccgaaaggtgcagcggcccgtctacttcgttagcgaggccctccgggacgctgagacccgataccttcaggcccagaagatgctttacgctatcctgataacttcgaggaagttgcgccattatttccaggcgcatcgggtcacggtggttacgtcttatcccctcggccaaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagcttgtctccgcccccgaggccagctcgagcccatcgcagctgcctcacaccgccctttgggtgatgtagttcgacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgttcatccggtctgtgatcagtcacagaccggtcagatcgtgggttaggtggcgacaggcggtctgacgcacgcctcgccccatcccgtcaggacgagagcctccaagcactcgtccctagccggagccggcgtgttacctcctggagatggcacgttggttccggtcagatatatgccaggcttcatcctaaccattacaggcaagatattgtatgaagaagggcgaacatgcagattgataaactgacgcgtggtggacaagaatgaccgatttgtgaccggtctgacactggtcatatcgtcagcagacagccatgttcccacgtcgcgcctgcttccggcggaagtggaggtaggtgtgggctgtcccatcagaaggtcattcagacggcaaccatacaaatctccgtccatttatgaaaagataggataagtccccacacaaaagagagagaggggtgcatgtggtatccccttgaaatataaaaggaggaccttgcccatagggagagcaggcttgggttgggactggaccttcccagatcgggaacccagaaggagggagaggctggctgatactttgtagctccttcatacacagatccaccaaaacacaggagtagggtattacgcttctcagcggcccgaacctgtatacatcgctggtgtttcatgctctttcgagaggtcgcgatctttccacatatagacagagcttgggatttcaccctgagcccccggccgaaccggcataggggggcctgtgcggtctcccggtgaggagcccccacactccgtcacggttggtaacacaaaccgggactaaagatcaaatatgcccgttacccttttgaaccgggactaaagatcatctttagccctggtttttattgcatccgggactattgtggaaatcggccgaccgacgaaagatggtttctccaccagtgatacatgccgatgtactagcaacgatataaatttaacatacactataaattgttgcattgcgtttgtatatcataaccagacaacacagagaggcagggggacgtagttttttgtatggctgcgaatcagttttgatatatattactatctcatataattatttgatggttggaacaatataaatggcttatgtttatatatagacaagattatcttacgattcgcacagttttttatagggagtaattttcacgcctcgtgtttttatatatggataaaaaaatactatatgaattggaaagggcatatttacggtgactctaatttacaggttaagtcatagacttatgagcattcgtatttacggctatttatccttttagtagtaagacggcgtatttgtcaacaacgagatgtccatataacttcgtcaactagtctagtttttttaatatgcttataaagatatggtgtgtgtatatgttcatatcggtaagtgtttgcgttgtactgtgtaattctaaaaaaaagtgagctaggtagcgttacgagtatattgttgggaaaattgatctctcggtttgaaagatcacgctagaccgttttccacccgttgtctacgcaaaatcagagcgatccaatctgttaattcccgattaactatgcgccgtgatcggtggcacccaatttatttcctattgagtcgcccccgattccccacagtgctaaatataaaaggggaggccggcccaacagtagatgacaatctctctcggtctcaatctaaacccaatcaacattggcgctggaggggaaacgtgtggcggttctaggatagtgtaggtggcaaccggaaggctgccgctaccccgcaaccggcgttctcactgctacgactacttcccttacgccgacgatcacggagcagttcgagggacttcatcctctacttccactccggttgatggtattggagagggaacaacaagaatcgcaacggtggtttcaaataacggtcagtaatcgtaaaattccgtattagggtgatcatgtttagactaagcactcatgttaatagatcagtagaatctacatatatgtgttcgtatcgggtttctagaaaattttacaacgaatagggtaatactccctccgtttctaaatatttgacgctgttgacttttttaaatatgtttaaccgttcgtcttatttaaaaaatttaagtaattattttttttcctatcatttgattaattgttaaatatacttatatgtatatatatagttttacatatttcacaaaagtttttgaataagacgaacggtcaaatatgtgataaaaagttaatggtgttaaatatttagaaatagagggagaggaagtactgatatacggagtaatcagcaaaaagatggaccatagccgtcgtgttggactcctccatgtaagacgacccggaacagcgaaaagaagaagcgcacgtaagaatcggcagggtcaaagctagtttctcaaaaaaaaaaagataataagaataatataataagaaaataaaaagaaaaaaaatccccatggagacgaaacgtggacaaaaatcgcagccgtcacgtccatctccgcaagaccgcggcgccaaacgggtcaaccacccacctctcttctcctcatccccatcccattcccatttctctcgcgcgcacggcgccgcgcgcgacgcgagacgcgacgcaagccatcaccaacacaaaaacatggcgtccaccacctcctcgcccacgcgcgcaccctcctcctacccgtaaacgacacccacaccgacccgcctccgcctgcgcggcgagaaaacccaagaaccccccacgtaggcaagacgaggagaaagaggattgcaagacgctgtccatcgaagcatgccatccatggcgcctcctcggctataaccaggcgagagagagagagacgagacgagacagccaagaacacgcgcgtgcgcgcgtgcgtgattcttagtttagcgccttcccccccgcggccgataataacacggtggtgggggaggtgttcgtccgtggcgcgttcttttgtcccaggcgtgcatggccgagacgccatgacgacgacgacggcgacgaacacggcgacgaacacggcggcagccatggaggtgaccaaggcggtcacgcagctctgcgcgcagggtgggggcggcggcgggagaagaagggggaggggcaggccggccgtgctgcggctcgacctccgctggggccgcctgctccgcctcgccgtcatcagcagggtcgtccgcctcgtctgggaccagctcctcgcctgctcctcctgcgccggcggcggcggcggccgctaccgcaggctcggcccgccgccgcagggcgtcgccgccggtgccgtcctctccccgctccccagggacgccgacgacgacgctgccgccgccgaccgcgacgcggccgatgtcgaggacgtcgtcagcctcaaggtcagcctgctcggcgattgccagatcggcaagaccagcttcatggtaacttctcccatctcctcctcctctttcaaccaagaagcaatcaaattctgaaactcgagtcagcaatcgaacacaagaatcatttcttcttgaattcagaatagtcaatccagatagtaaaaagtaaattaatctattgggtaattgattctgcaggttaagtatgttggggacgacgaggagcagaacggcttgcagatgacgggcctgaatctgatggacaagaccttggcagttcggggagctcgaattgccttcagcatttgggatgtggcaggtaatttgcacaagcatatgaactacaaatgcaggatttgtttccccctttatacttgcattggttgaagaatcagattttttttttggtgtgcctaaacttgctttgtttgatgagtttttgttgtgtgatggaatgcaggagacagccagttcctcgaccacgtcccgatcgcgtgtaaggacgccgtggcgatcttgtacatgttcgatctcacgagccggtgcacgcttactaagttagtgttcctatcagtctcacagcatcataatcttggatcagattttgagtaattagaactttcaatatctgtagtacttattgttgattatattatcttttgcttgatgcagtgttatagattggtatgagagggcaaggaaatggaataaggttggtacattgttcttctataatcgtgtggttttcattttttctggatgtgttctttaggattatagctgaaccataggtagactgtgcactgaaaaattgttacagtattacaagttgctgctaaaacagtaactagcagatgggttcccacaatccaacatatgtcagagcatgcctgcagatcactgtttctgaacaatttagtaatgctgatacttgttcatatgtttttatcggtgctctagctgaacagtgaaatggtgtccttggttcttggtattgtagctgaacagtttttatctctcttttgttttctgacagacggctattccaatcctaattgggacgaagtttgatgacttcgctcagcttcctcttgagatgcaatggaccatcgttaacgaggtacgtttattaatagtttcttgcaatcaaaatattgttcccccttgcctttctttggttcttggatatgcagccttcagcatctccaatgtttgttagcatagaaagatgagaccttttcttggttctgacgatatgggtttgggctacacatgtttcttttatctcaaacgctgcaaattaaccagataggtcagaactttaatcttgaattagccttttcatggctaccaagtgctaatagcaaatcagaaatattcgaaagccaaccatcccctgaaaactcccattttgaggttcagatttctgaaaactgctactgaatcaaaattttctcatcaaagatttgagcttctttctgtaggccatgaacacgaaatttttttagcttgatcgcatctgcaattaattaagaatacctatgtgaaaacgacaagagagcccaaatcaaacctgaatcgagtacagcatgctaccaattatgtttgtgcagaccgtgctgacctgatagcaccatatatgaatgcctattactattgcaacattgaatacagtggaccttggttgatcagggggagcattcgttaagtaggcccaaacacgtcttgtcttcgtcttcgtctccggggaaggaggctcgccagtcaccactaacaacagccgggatgatcgagtcaaacgatagaaaatttattaggcaatggatataatttctgttttgtttgtgcccatttgtttgcatcttgtccaaaccatacgacgatcatcgatccctgtgggccttacaacatacagaatgtagatcgatggtcactaatcactcgacatgctaaaagcaaggaaaagctacatcacaactaaccgaaaataactcctcgtgctactgggagccctcatgcttgaaaatgtagttgcgtttcttttcagccacagtgaatatcagttcactgaaaagtttttgtaactaatcctagaaactactgtttgaccaggtttaattctgacaaagaattcgagaacacaaaaccatatgcttcgcatttggtttactgttgttaaaaaaacatgttgtattcgaaagaaactcctctgatgtaatgccctctgacatgtgggtccacgagttatgggctccatatgtcagtcccttaaagtcggaggacagtaagttagaaggtttttttccgttgtattcttgtttctgatggaggattttttttttctgaaatttcaggccagggcatacgcgagagcgatgaaggcgaccctcttcttctccagctcgacgcacaacatcaacgtgaacaagtttttaaagttcattacggccaagcttttcaacttgcggtggcgggtggagcgcaacctcaccgtcggcgagcccatcatagacttctgaagactctacacccttacactgacaaaatgctaggcaaaaaaacgtacacgagcccttccttccctccccttcgtcgtcttcctcctgacctttctctcccggtaatggaggccggccatggccatggctgagcagaactgagctcttgcatgtacatataggtgaaagaaaaaagaaaaaaaaaagaaagaaaaaggatcaagttgagttcgtcgttgtcgaggtgttatcccttcccttgtgcagtgcaggcaagggcagaagaggaaaccgtgagatgttgtctgtaaccctcgtcacagtgtatagtagagtaggagtttaaccgatccatgtaatataatcctcaccgtttttttaacaccagttttagatatgggtactcatcgaaccattcgatcagtttaattttttttttttgcggggaaaccattaattcgatcagttcatctaaagtctaaatgaactaaaatctacatagtccctcgtttcaaactaagtatatgtccaggcctccagggatacttgtactacttctatcctaatataagagcatttttagacgtgagagaaaaataagaagagaaaattacctaaatgttctatattaaacgagagatgatggaaagtgcgagggtaattgaggataagatttttttttgactaattcaccaggagggagagattccccacctgaatatattgcgtcaaacgaaattacacagggcaggcttcacctacgcaagtgcaggaaccctggaggataatagcaaaaaatacacggggagtcctgagaagagaatacaaaagagaggccaccttcccaaaataacagcaattgaagtttgcacttgcaagaaacccaaccgaaaaccagagcaacctaaagctaacaccctagctcatcaacaaccatatcgttatgcaaacttggaaacgccagagtccacgccggagggcctttttgccacaagcatgtcagctatggattaacggcaaccaaaagactgaggaagtcataaaccacccgcattaagccgtcaaaatccaacttaatcttgttgctgcttggatcagtgcccgccgacaccatttgggggaaggaagcctcagagaagggagggccactaaaggttgcggccatagagaccgcccgcatcgagtcttcttcaatccgactataacaaattgctagctagttccacgccctccaacgcccttttagggaaggaagcctcaaaggagggagggccgccgaacaatgtggttgaggacaatccaaggaaaagggtggagacgaagagggagctggacaaaagataagtggtagaggggggaatcctacagctgaaagaacgtcaaccgcgtcaacagggaaggctgcaagaatagtagccattcaagccaaagaaaaccgtaggcactaacataaaagacctgacctaatccatcaatcaaggagcatgccaaaaggagatctagagagagggagaggcactagcgaatcctaattgacggatcagagccaagcatgttatggcaaggagctcgttggctagctcaagggcgcctcaaagaggagggaggaggagggatggggatggaagaaggtgttgggcaaggtcaccggtcccgcggggagaggggggtccgaggccagagcctgccaccggtgccacggattcgaccagatccggccgctaggagcgcggatctgcacgccaccagtcgggggcgccgggcctagccttcatcgctggccgaggggggggctacaaggagccaagccgaggccagacaccgcccccacggacaacacgtcgccagacagcaccgctggcgactgccctccgcggccaaggagcacgaccgctccttcgccaggaacagcacaccgtcgccgggacacacgccgccgcaccgcctccaccacgccccatcgtgccaccgcgcacggcattgtcgctctcctccggccaggtccagaagcagggtgccggatccagccacgggggcgccagatcagaagcttcgcgccgcgccgatgtcagcccccacccatcacgcgccacgtcatcatcctcgcgctgagccgtcgtgttgccgaggaatggcctcgccgccgccctcacagctggcagcgcggaactccggtggtgcgctccggcggcggcgaggggagaagaggaagggagggggcggcgggggctagggttcaccccctgtgccgctcgcgcgagagggcgacgcggggttgtgccggcttcgtactcttccaattgaggataagatgaactgatgtgataagtagtatgagattgtacttattttaaaacaaaatttgaatataaaatcatacttattttaggaggatgtagtatttgggacttggcagtaattttactgttcttggtattagaaggtaccatttattttatataaaacttggtatttctcgaggtataaaaaacatacggttaggaccgtaacgaactgtgttagctgtaggtttgcatctgttcccaaggtgatttaatttgagcaattgcaaatagctttttcttctttcactcggcagctgaatcttgcttggtggagtactcgggccgtgcacgttcatccacgggtttgatttgacattggtcatgagcgcgttttagtggacaaagtggtggttagcatagtgaaattgtcaacgcgagaagcagaaaccaattgctgttgctgtcgccggtaccaatactgtatggtgttcctgttccatcagaattcagtcgagtgcatggcagctcattcttgtggcccatcacacaattaatctccgacgatgtactgtacgtagtggagcatttagattagtaattctcgaatacattttcgtaagggttaagtgggcatatgtaacgtgttcactccttgttactatctctgttttcagatgagtgacatcatcagcatagtccgcaatacacattttatcatcataacaattttacactataaaaaacgatttttcatgatgttaccctataatttacgctggcggccatatgcaaaaaccgtcaacaaaaacataacaataggtggggggctacggaccaccagcaaaaaccaatttttgctggtaaccacgctaagagaaacgcctaaaaaactactctatttttcgaggcgggcctcttaagtgtccgccagtttttctaggcggacctcttaggcgtccgccagcgaaaaatctcattttcactggcagtaggtaaggaggaccgctgcaaaaaaagttttgggcgaatatataaatctaccgtcccccacccccaccgctcccttctcccttcccccaccgcgtggcccctccgccgcctctcttccttctctctcggtttcaccttcttcctcccttctccaccgccgtcggctgccgtcgcctctaccgcctctccgcggcggtggggcgtggcctcctcctctccgccgctagccgccatgagctcgggccggattcggccgctgcgacgacggcggaggccggatctgccgccgcaacgacgggggagaccagatccgtcgccgcgatcgccgcagggccactagtctctaaagtctaaattatatatttaaaaaacattacgaatataactttatgaaagagagtttctcataaaaatataccaatataacttttcatattttaaatatttttacgtctattaaatttttaaggtttcaagatttgactgcacttataggagatactactatacaagaatcaacgagaagcgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctnctnctcctccccttcgccgcacgacgggaagatcgcacgcgtgcttgtcctcgtgccagtccacggctccgcgcgccgtctttctcatggtgtttcacaatttgtaggatgcgttctttattcatgttgatctgccgtagatggggggatcttgagccggaggagaggagtagctagtttctttgattatgcgttttggggtctagcggattttaacatgagatggtttctctttagcgacattttttttgttcatgttgatgtccacggggattgttctagttatgtcatttttatcttcaagacttaaatgctttgaatcgcgggtatagaccagattattgtcgtgaagatcgacgtattttccgagctgaccctctgcatgctgaaaattttgtagtgggttatatctagattatatgtgtattgttgtcattcaattagcacttaaacttctgtagcataaacattttcatcatcttcctgtgaggacatcggatgagttcctttttttttctcttcttgttctaaaattgttcggtaatcttgtctggctttgactgatgggctccaatgatggcatgaaatctttgagacctgacattcttgtgatgacaaacataagcatatttcctgaggacccaattgaggttttaaccattggtttgctgaatgtgtcttcagtgttgaaaaatttggacacatttgcttcaaattatgcacattcgactgttgtttataggcctgcgatgtccattccacattcagtatttgttaagctgactgcttttgtttcaaatttgttttgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggtactgtgacagtttatatatgattatgcagtgttgtgtgtgactctctgttcattagaaacatatggtgtcatgattgatgtatcagtgctatgtgtctgtacaatgcatgtggcaataaccatcacgtagttttaattgcatgtggctttcagctgtgcatttttcttgttatgatacatggttcctgttttcaggcaaaaaccaccaagaagatcgtgctgaagctgcaatgccaaagctgcaagcattactcccagcaccccatcaaggtattatttcattgtcaagactccagagctgaaaatgaatcattattttgctggatgtgttggatgctcacttgcataattgttctctgcagaggtgcaagcatttcgagattggtggagacaagaagggcaagggaacatctcttttctaaattgcttgctacctactggatactaaagttgttggtctactgtgcttcaatatttcaatgttattaggagcttatttaagcataccatatcaatgtattcaagtatcatcgtctgacatttactctagcaaggattggctttctgctgaatcaagttttgttgcttaatgctcattgaatccaatgtgatgcatgtgtttatattttgcagcaattttatcttacgacagttctatttcccttagtcctcagtatccctttttttttgttatcttaccagctgtctgttgattagtagttagcaaacatagagcgacccactttaatgacttcccgtgacatgaatatgacctcgagagattagtctagtgaacttattcagactgaatgttgtattgttaactgtactggcgtttggtcagtatctttcgaaagagattgaatgtagggacgtaattttattgcaagataattcatttgttcttgtggttcagtatcttggaaggtcttgtgatgttagtgaattcttttcgtagcattgcagtacttgctccgtccttaatgcatgattcaataggctacgcaatctcgtttgtagcaatgaattttaaaaatttggaatcgctaactatcgtttgacagatttatgagccttccatcattcgtttttttaagctgtcagatggttaaaaattataatttattatgaaccgaataaatagcttcgaacaagctaagctatgctgatgtagaaaaaaaatagttcgagaaccgtggtatatccccccccccaaaacctccccaacccacccataaaaaaccggatggcagcaatcacaacttagcattgcttctcatagcaatgttcgtatactataagtgcaggttagttcagacttcagacacctatggtaattgttttttattttgttcgttaggtggtgtttgggtccatggattaaactttagcctttatgtttagacactaatttagactaaatatagattacttacaaaaataattaaataaatgagagctaattcgcgagacaaattttttaagcctaattaattcataattagagaatgtttactgtagcatcacataggctaatcatggattaattaggcttaatagattcgtctcgcgaattagtccaagattatggatatgttttgttaatagtctatatttaatacttctaattagtgtacaaacatccaatttggaaagtgctaaaaaattttagtcccttccaaacacccccttattatttttatcaaatagccacgtaagcgtcatctcaatagcacgtgggacaaagacccctagtcaaaggcgtcatgtcagccaaaaccagagacattgctaccgagggagctcgtttgcatagttgaagaaggcgccatgtcagccaaaaccggagacatttttatcgagggacctcgtttgcatagttgggttgtactccctccatattttaatgtatgacgccgttgactttttaatcaacgcttgaccattcgtcttattcaaaaaattatgtaattatcatttattttattatggcttgatttatcatcaaatattctttaagtatgacataaatatttttatatttgcacaaaaaatttgaataagacgaatagtcaaacattattcgaaaagtcaacggtgtcatacattaaaatacggagcgagtatatggttttcggataaggatgaaaaacagacttagcgactataagggaataagttaactaatcataaaccgtgcgaaaaagatccaaaaacatacggagcgacaaagtaagggacctattgtgaacttatttgagggataaagtcacttccttaactacaagggaataagttcacctgacgtccctcaactttatgttgagtttgtctgcggtccccaatccgcgatagcaaaaatctctacccctcaactatcacaaaccgtgcaaaaaagatcccaagacaatattgatccattttccccggttttgctgatgtggcatacggtgggacccacatgtcagcgtcctgtcttctcctcttttcttttttctttttttttcttcttctctcttctcctcttcccttcttcccctagcctgagaggccagcgggtgggcgagcaggcgacggtaggaggcagcagcggtgtgcggagcaggcaaggggtagcaggcgacgggcgagcgacgacgcctcagagagggtgtggtgtgggcgtcgctgtgctgtgtcgggcagagcgaggtggcgtcggtggggtgtagaggacgacggcagatggaaccgacggcggatgctgtaggggacgatgacgcggaggacggagtaggccgggagaggatgacgctgatgcgcttggggtttcaccgggagaccccgccttcaccgtcttcgtgccctcaccggagtcgttccacaacgtcctcgggctgcggcatcccaacgacagcgttgccgatgggtgggtctcacattttctttctatttcacttacatgtgagactcacgtattattttatttctattttgttgactaagatgtcacgccagcgaaaccaagacatctatactgccatgggatataaattgaacggttttgtatatttaggggtgaagatttgtggtattgaggataagggatgacaaacaaactcggtgtaaagttgagggacatcaggtgaacttattccaactataaggcaacgcatcacggcccatggcccatgggatgcgcattctggcccacaaagcagcacacgctctctcccccaccagtaagccctagcctccaggagctcagccgtataaagccgcagaccttctccttcccctccccgccgccactcgccgcagcgtctcgaccagacaagggagcgcctccgaaaccctagctccccctttcccctccgcggccaccaaaatggtacgcttctccctcctccccgtccgcctctttccgtcgcacgacggcaagatcatgcgcgtgtgtgtcctcgtgccagtccacggcaccctgctctggtcgatttgtagggggattgcattctttattcatgttgatctgctgtagatgggggcgatcttgagccggaggagtagctagcttcttgttgatgcggtttcgggatttagagatttaacacggagattgatagtttctctttagcgatttctttttttcttgttgatataatgatatccacggtgattgtactagttatggtttttttatcttcaatgctttgtattattgtttttgatttgtgggtagagaccagattattgttgttaagatggacggattctctgagctggtcctttgcatgctctgaagcgcagaaaatttgtgtaatgggttatatctggattatgtgtagctattaacttctgtagtaaacattttcatcttcctttgaggacatgggatgaattcctttttttcttctcttgttgtgctaaaattgttcggtaatcttgtctgtggctttgactgatgggctccgatgatggcatgaaatctttgagacctgacattcttgtgatgacaaacataagcatatttcctgaggacccaattgagtttttaaccattggtctgctgaatgtgtctttgctgttgaaaaatatgtatacacatttgcttctgattatgcgcatttgattgtgttgtttataggcctgctatgtgctttccaacaaccagtatttgttaaatttgtttcatatttgttatgtatataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggtactgtgacagtttatatgtgattgcgcagtgttgtgtcttactgtctctcttcattagaaacatatggtgtcatgattgatgtgtctgttcaatgcaaacatgtggtaataaccatcacgtagttttaaagtatatgactttcagctgtgcatttttcatgttatgatacatggttcctgttttcaggcaaaaaccaccaagaagattgtgctgaagctgcaatgccaaagctgcaagcattactcccagcaccccatcaaggtatttttgcaatgtgaagattcaagctgaaaattctcatgaatcagtatctttttagatgtgttggatgctcacttacataattattctgtgcagaggtgcaagcattttgaaattggtggagacaagaagggcaagggaacgtctcttttctaaactacctactggatactgaagttgtgggtctactgtgcttcatacttcaatgttattaggagcttaatttaagcagaccatatcatgtattcaagtactctagcaaggattggctttctgctgaatcaagttttgttgcttaatgctcattgaatccaatgtgatgcatgtgtttatgttgcactgcaattttgtcttatggcagttttatctccctaaggactcggcgtctgctgttcgttatcttacctatttttgaatcctagagcgacccacttaaacat

SEQ ID NO: 66226 - DNA, 2114 bp, Oryza sativa
ggatgatgtggcgtctacgtggcagtcttgaccgagtttttatcctacgtggcgcttacgtggcattataataaaaaaaagaaatatgtaggacccatatatcattccacaaataaagtattatggaacccactgaagcacggcgagtgggtcccataatacttaccttcttcctcctccctcccttcccttcccttctctctccttcccttcttcctcctccctccctctctctcccttatctctctcccccggcctttctcctcaccttggccagagtggcggtggggagcggcggcggcagcgggtaggagtggtggcggtggcggtggggacagcggtagggagcggcggtggcggatttggttcctaattgtcggaatttgctcgctgtgctcgaatctgcgttgtgtggattttttccccagtgatttgtgggtgttcgaatcgcatgcatttggtgtgaatggcttgaaattttgttggtgattgttgttctgctgaaatttgttggtccgtttcagttggaactcgcatgcgctgctgatgttcacggaggggttagatcgagacgccctcaagtgggttcgtgaggtgagagttcgagctcgccgtgctcctcccgaagtgggtcccataatactttatttgtgtgactgacatatgggtcccacatatttctttttatttttttttattctaatgccacgtaagcgccatgtaggataaagactcagtcaagactgccacgtaggcgccacgtcatccaaaaccacctccaaaatcaccaagggacattgtttgcacaggttttgatagttagaggagtcgatatacccggttttgtggtgggaggatatgaatcatactcggccgatagttgagggagtcgaagtatactttttcctactactaagtacagaagatagctaatgggccggatagttgttctgtggactgggccttgtgatcacagtggattatgcggcccattagtcggaaacggctgattaatcgggaaatgacggtaattaggagttcacaaacgactaatgaacaccgttttgtaaaaacatgacggacaactcaccgtctccgattgaacggccgtatcaaccgttttccacaatactggttgacgctgaccatcccaccaacgtggcagccgagccgatcccctagtctatgtggcaggggctcagcgccaagccactaatgttagtaccagagcaattggccctgagctttgggacttagttgctcgcggccaaaccgctgagccggcaaacctcagcgctacagtatttggcgttgaccctaaaggatggttgccgatcgaagcttggaccactttttttctcctataatcactgcttttcccagcaaaccactatgacatctgcaggtgactctgacacaaataaagctcctctcgaacctccgccgtggcatccgagcctagttagaggctagaaccataggcttgagaccacacgttggatcccatcacttccctgctagaaacattggagtactatcttgaagtcatactgtagttttttttattagatacatacgttcggtgaacacaggtgagttagttcatttcccggttcaaagtttcttgcatatgagataccgagaaacctcttattgcgttcgggatggtggaaagaactgagggcttattcggatggaaaaaacgcagctgatttgcattcatatggattaatttctatgaataccattcggactgtaagaatgaagtataggaaaatcaaaataacttttccttttctacaagttgtacagagaaaacatagaaattttttcattcattctaaacctcttgaaaaaaattatatggattggtgtatgcatacattcctattcctccacttttcctatttctatgggttaaaattcctacaactcgaataaggcctaaacttatgttggcacgaaaaataggacaatagtatataatgtaataaattaaatattaacaaaatatattgtttagctgtttagcaaacatgctcaacgaaaacaagtactccctctatcccaaaatataaatctaggactggatggggcatttcctaatacaacaa

SEQ ID NO: 66227 - DNA, 15992 bp, Oryza sativa
tttgctgctttcagtttctacttctgcgtgttgttttttatgctacttgtgcagcatagatgtacatacatacgtatacttctagcacctgcatgtttttttcccctttttgtggtccaaataatgggagcagcagcaagaggagatgaaactgaaactggaagctgtggcaaccatcccaggctgcgcgaccaatggtccattggtccccttcctcctccaaagctcaagctggagggactgtctggtcccaacggcaagtgcttcaattccaaataatgcatggcctgcatgatgcttcgccgatctgttgttgccctttcaatgctattcttgcattaggtgtgtttcttcaatgcgcgctattaagccttggtttaaggttttgattgttctcctggcctgtgatgcctgtccgcgttcaatccccaagcttgaacaatgtcctgcgctacagtgctggaggagtagctcatggtgaaacggcgagtccgggggtcaaacctactctacacatgtgcaaccctgaaacccggcgtggtctacgtgtgctacagcgcctgccttttgtcctggatggatagcagcatcttgctgaggctgagctgtggactgtggtagtagtacgctggtatgacccgtcatgtagcagtacactagtactgtagcagtagtcgttttcctgtgaaagtttcacacaggatgggcaactgtttccatgcctcgagttgattcttggtgattggcactttggcagtgcggcccgctatttttctcagttctggcagttaagtttgaccgagaattcgtcaaagtatttttccgatcttgtctgaaatttatgcgattgctgtgttctaaatacatgcttaactgccagaaggtagaagaagagaacggagaagaaggcattttccgatctcgtcaaagaaggtagaaaaagagaacgggaatagggcataacagagcggagagcacacatgcaaacaacgtgtgatgaaattctaggaatacaaactggccaagccagatcaccggcacaaggtttgcacatgggacaggaggaagatgcctctgtccttgatcggcagcgccattaaatcaactcctaattgagcttaccgatgactccagtcagtggattacgactaactaatgatcgccgattatgccccagtcagagtgagaacccgcggaacttgcatttgttctggcggtatctgcttatcaattatcatcaatcaacttatgatgaacatgtggaggtgtagttgcactacgcaacttgccatgctcctctcttcattttgcagttgatttaaactctaacccaccttaataaaagctgtttttggctcaagttgaaaaaaaaaacaagatcagccatgacattcaggtattactgcgaaaaaggagggcttgaaatttggtcgattagccgctcaactgaacagtagtagcttctttaaaagaaaaactgaatagttgccagctgtacgtcattcgtcactgtatgccagacatacgcaaagctacagaattggtcaaagacaaggcccatctagaagagcgaaaagaatagggaaaaaatacttttatatattgcccaagaaaatgccatacatctgaaaacacgatgattccttcacaaatatgccgagaaaagtattcctggaccaatatgaccgcatcgctgcagcttgcaatgcaggacaatgttaattgtggcgtgcaaaagcaagtgatgcaggacgggcggcgctaattgacgtagaatggttgtttgatgtacttaaattgatactagtactagcatctaatgcagtcattagccttaaaagatgcagttttcagttgattgattgcttgatagaggctaggcgacggcgattgtttccagcactaatcacacattcacaccctcgctcttcgccgtaaagcaaatcacatcctccgcaaaagggtaagaaaagaaaaggtgaaacaaataacaaaatcgcaacgatcgacgatgccattttacccggtgaccgtggcgtgctttagactggatattttggctcaatttgctcggtaataatatacgtagtagaaaaggaattcctagttgtgcctcctattgcagcactcgtggtaccaattgtgtagttgacctctacaagtcacccggcccgctggtgtgaagaaaattactttttagtccttcctacgaaggagagagagagagagagagagagagagagagagagagacccacttgtcttttacaagtccggctagctttataaacctttgatacgtatttgaataaaaggtattttaaaaaaatatgataacctccctttattagtggattatggatttaaggttacacggcaaattatcaatgaaaatcttattccagaaatctggttgatatattcatgatagtttaatgaggatgaatggagaactttgtgccccttttgtttttttaaataatggaatagaatccatttgttcaaagagttacaaccaattattacaccaattcaaacaaaccaaaaacacatggcaaaaaagtcataaaaatacaggcctaaaaggacagaaacacacgctaagtactaaaaacaaaaacaagaaaagactacaaaattattgaattctatttgtgaatctccatccgaagttggcaaaaagttgtatcacatatttgcagttgtgcccaggaccagagccagtgtgttgccctgaaaagaacctgcatataagatatagacagtgatttatcaaaaaccatatcatctctactcaaccatagagcccaacatatagcggaagctcctaccagaataagtttactggttttttttatcaatccccagaagccaattctcaaaaatatgagatatactatgtggaatatttaaactagaagaaaattaaaatgctctccaaacaaattttgcataatgacattccataaataaatgttggatagttttattttttatacggaagcaacatttcagactaccataccaatttcttttaaccaatttatcctttactaagacaacccctttaaacaggtgccccttttgtaactgtcttagagattgtttgtatctttgttggcttcttttaggctttataaagaggaatattttatctactttttcatgtctaggatatcactattaacaaagtatttttgtttataggaagggatatttattcaacttttttcccctgatattcatgcaacatggtggagactgagtagtcaacctcatacctttctaacctgatctttcacctttgctgaagaggaagaataaatattctgaccttttctaggctgtgttcttccccattttctcaacccacctctctcgtttttcacgcgcacgtttttcaaactgttaaacggtgtgatttatgcaaaaactttctataataaagttgtttaaaaaattcatattaatccacttttcaaaacaaaaatagtaaatacttaattaatcatgcaataaaacgaactttgttttgcgtgcagggaaggaggggttcccaatcccctcctctgaacacagccttaagaagtgtaagctgagtgctactgtgaatcatatatacatttttaggttttgtgagatatttagagcatcgaacaaatatgtagtgtgcaatatatggtaaaaacacaaatttgtagggccacatttattagtttgtggtaattaggacttatgagcagtttgtcatatagacagcgtcatgataaaaacaccctttaaaggaaatttgatgatttattattatcattaagatgatggatttgatgatctgtccaactggcccgcacgttattgatacaaacgattcgatatgttattgtcatatgatgataagcagcaatctacagagtgataaatcatcaaatttgaccctttaaaaatgagattttacttattcgctacgatagttgaattatcttcgtgaaattgacgtaaaattaaggataaaaaagattgtacatactccaattaaactaaggctgaaactagtcccttttttatttatctacatgcgtcctgtctctactctagaccggtcaataccaaaccttggagatcagttgtcatgataactcgattaacccgtgtattaaacatttggaggttgacaattacaaaaggatgacaaaaatgatggtacactgcaagactggagtccacccggcaaagacacatgatgcgaatccgcgtacaaccttccacaaaccgagcatcgcgtgtgctactcctgatttttttttacttttaaaacattttttattttttattttaaaagtaaaccattttaaaacatatttataaaatttgaaccttggatgctagctcgtctagcatgctaaaataatattgtcatgccacttctaacgagcgggacggtttaattctaccataacaacctagcaggacaatgctatcacgcgattcaaatagcgtgggagtgtacttttgccactccaactcgttttgcgtgaccaataattcagatactaaaaataagtcttacaaaactttatttttaaaatttaaaaataaaaaattactactcccctccagcctactccctcagtaaaaaaactcaacctaacaaatagaacggatcgaaaagaaattatttagattcatgttattacgaggagtcacattctagtctagttttttttttcgaatggagtagtctatatctagcaaacagacgaacaaataaatccatttttattttcgactcggagcatggtgctttttttatttttggctgtgtacaccctccagcctactctcttctttggctgtgtacaccctgtacatacataggccgggtttaatataaaggaaaaagtacgaattaccccctgaacaattgcgacagtatgaattaccccccaaaccacaaaaccattcataccagacatataaccccccctcacactgttttgaccggttttgatttcaacttgtacacgtggcgccaacgtggcaatccagtcagaaaaaaagtaaccgttggggcccacctgtcataacccttcatcaacccaatccccccctctctctctctttctcgttgtctcgcacacgtgctcggacggctggcagcggaggaggggcacactctcagacgaccgacggcggaggcgaagctcgtccggaactccgtctgtggaggcggagatcgcccgcgtggtcggcggcggaggcggagcttgcctcagttgcctgggagtccggcggcggaggcaaagattgcccaagcggcacttgtacgaggagcacttgtacgacagggacaccggcaactgcaccgccggcgtcgacttccacaagtgcggccacttcgtcttcatggtttgactcaacttcaccaggatcggctgcgcccgcgccgagtgcttcaacggcggcgtcttcatcacctgcaactactacaaagacgaggagcagccggctgcccgtcctacctactcctagttgcatgatatgctcttcttcttctctcttatcaacaccttacttgctgcctgcctgcctgcctcatgtacatatagctacccgaaccaccgccgccgccgccgccatcttcttcgctcggaccgccgtcgccgccttctcagcccgaccaccgtcgctacactggaaaggagagggaatcggaagagaaggagaggggaaagggatgagtggcggccgtggccctcctgtgcagctccatctcgtgcgtcgccgtcatggacgcggccaccgacaccgccctccgctcccgccaggacgccctccgcctcgagtgcgactccctccgccgcgacgccgcgctcctaccacgcccgcccccgccacgcccatcgctcgctctcagccatgcctaccgcccacctcgcccatcgccggctacctagtcgccgctcccggcgacatctgagagagagagagagattgagaggaagggaaaagggaaagagagaggtgggtcccaccatgttttatttgtttttggctgacaagcgggtcccatatcttttttatttgttttgctgactagagtgccatgtatgcatccacgtaggatcaaaactgccctggatcgacataggggggtaattcatccgatttgtaaagtttagggttaaaaataactggtattagagttgaggaggtaactcgaacgaccgcgattgttcataggtaatacgtactttttttttctaatataaatccattatctaaaaaattttcgactcggaaacccgcagggcgaaaaaaaattctaagagggcagccgctgggaatttctcccacctcccctcccccacacgaagcgaagcgcaactcggcagcggaagccgcgcgcgacgacgatggccgccgccgccgccgactacgagtaccgcgcctacggggcccccgccgaccacgaccgcccctaccacggccgcgaggtggtgccgtacggggaccgccgcatcgacgtcgtcgtcaagcccccgggcaccaccaccaccaccaccacgaggtcgcctccgccgccgctgccggtgaccaaggttgggggcgggggaggaggcatgggatccgcctggtgcttcagcgacccggagatgaagaggcggcggcgggtggcgagctacaaggcgtactcggtggaggggaaggtcaagtcctccctccgcaggggtttccgctggatcaaggccaagtgctccgagttgatccatggctggtatggatcacttcttctccccctatccttttccttggatgattttatcatcacctcgaagcaagcgctctcttgattgctgtgacggccatggctggtttggggcctgatcacggtggagacccatccttcctctgtgcaatggatttttgtccaagaaccaaattattccattagccttttcttcggtttgtttgcgtttcatctttagaagtttcagcatattgaaggacagccacaggaattcagcaactcacaaactggtcactagttttggtctatcaatatactgttctacttggaagtagtagtagcttgcaagaagaagcgaagatattcatttgttcctgcaaaatttctctcatctgatctgtattccgttctgttgttttcttcagagccgtgggatcttggtggagttcagtttgggttggaacacgatacaagcctgcaaccatgtgcaaggagtgtactcgctactactaattttctgccaaaaatgcggaaggatttgtccaagagaccgaggggaactgttcttgggtggtcaggttataggaaaggaaaagaaaacttgttaggagctttctgatgagattgcttctcttgccgatgctgttgttactgtctgctaattctagcctaattttttcaacaattttcctaagaggagttgaatcttcgcaaaggaatcgatccatttgcatgagacatcgatcgctatcttgtttgtccgtgatcttgtggaggcctatactttgatttcgtacgaagaccttgcaaataaccaggtcgtcgtcttcttcttcttctttttcgttagtgttttggattgggacagattaccatttgtatagcctacgtgatgaaggcatgatcaagcgaatagttagaggagaggaaggaaaatcatttgaattgtatttccaaatgagagcaccttcagcaaccctgtttaggtgaaatcagcaaatccacgatataaatgcaatgctactacgtgcatagttgttgtagtttaccctgtttctcatgttcctacaggtagtacaggactacagagaacctcaaacctggcaactgttgttgcttgtgccatcttattacaagcctgacaaatatttgccctgcttattatagtatatatatggcatttgtcatacactaggtgtcaattttgttatattcctgatttaaggcagactaatcaagcacaatgacctgtacaggacgatatccaaagtttaattaggaaactaattactcaggagacagagttcaacgaacgctgatcattcctactactactagcagacgagtattactttcctttgatgaaaagcagacgtcaagacccatacgcactagcatcagcgtcaatcagaccatcgactaccattaccatcaactgcagctggagacgatggctgtcactgcagctggagagggtggccctgcctttgccggaaattaggccggttggagaggtttgcgaatacgagacgtacgtactgtatgccgtgacaggcccagcacaacgagaacagcagcaggtgccactacggatggaagggagcaggttgacgggaagcgattaatttcctgtaccaaccgccacagttttgttttcccggtaggtagaattgatctgcaacgccagtgccatctttaatccgactgggccgtttcgttgttgcactgacacgatagctgtgtgacattgtgcctttacatggacgggtcgacgtgtcgtgtaatcgtgttgcttgctggatgaaacaacgaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaattttgcaggcggcccccttgccgccctccgcgagggcgattttgtactgtgcggggggccgcctgcaaatgggcggcgagggggcatggaattttgcaggcggcccccttgccgccctccgcaagggcgattttgtactgtgctctatatttttgtataaatatcaatagttatcaaatctttttatattgaaaactatacaagattaaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagagattgccttcagattgtcaattatatagcgtcgttttcactggaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggattgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataagtgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggacggtgagccagtaagcctggtcgcgtgtgcacaaggacgaaagtcctagcggtgctctcgcagcgacggcctcttctgtgtacggctcccagatgacgtcgctcggctggagacggtcaaacttgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatattagtacaaaacaatcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccgatctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttgaactaagcgaattactaacacatattaaacaagagtacaaacaaacaaaagtgtttagtccgaacactcatcacgataacattatgatacaacaccgaataattcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacatattatttcataccgatgcacttgtgtgccttgagcaacaactcgatgtctccgtgcctttttgattttatcttccatgtactttgtcactacgttgccaaacactatgttgtcatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatataatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggacacaatgctaacttttcaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgcttctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctttggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagtagggcttcgccgctccccttctgctgccctcccctctctctcttttgttttttttggatttttagtgaatataatgaaatttcacagaggagggactgggctttatagggggagaggcaaaaatcgccctcccccagggcggcaaggggg

SEQ ID NO: 66228 - DNA, 2161 bp, Oryza sativa
attttaaaagccaaggggggccccgggaccagccacacatttccactgacacgcgctaccatttgctactatttgcatgcaaaccacaaactctacaaacaaagccgcctcatttctccaacattaaaacctctacttcccccacaaaaaaaattaagaaaaatcgattttttttcctcctcctccacttttcttcgcttcctcactaccaccttctcgttgatcctcctccccgttcttggctcccctcgcattcgtcctcacttcccttcttccatgggggttcgccgccgtgagtgaggaggaggaggagtagtactaggaggaggtgaggccatggagagggtggaggatccggacctggaggacccgaacccggacgtgggggagctgttcagccactacgacgggctctacttccgcggcgcgctcgccggcgccggcttctccgtccagtggagctcgccgccgtcgcggatggccgggtagggtcccttgctcagctcactggccctctcaatctcttgctgagggtttcttggaggagctgcattcttttctggtctttttttcttcttttttaatatatccagaaaatttgcagttcatgggaggagttagtagcatctcggtgtgatgctgtgggagaaatctttgtagcacacttggggtgttttgctttctctgtgattctctgcacttgctgctgctgctgctgctgctgctttgattttttttgttcgaatccctagcaagagacggattgatcatctcttctttttccgggcgatttcagagggagggagggtttggttttcttggtttgttagttctccatccttcaatcgacaagcttcagggtgttggtgatctttcacgaaaggtttcgtctttttagaaaaaaacgcgaatattagggaagtagctaatatcaaatactaattattagaaggggtggcttcgaacccaggtcccactaccttgtcgagctaatatcaaatgctaattattagaaggggtggggcttcgaaccaaggtcgtctagcccagtaccttctcgagctaccggaagacctcaatttcgtctttttagcatttggcacttgaagtgacataaatggcgccgcttttgtgcacttcttgctgagaagagcttcttgtctacaagtagatcatgcatattgtagtttgcatcgatatagattctttttttttagattggcactttggggggttagtactcaacggaaaccagtaatcgccggtagaaaaaaaatgttttgggatgaaagagaagtacataatctgtgaccaagttcattcataactgtctcttgttagtgtgcgggtttgcttaatgagatttgtgcatgatttctagtagtacctacttttggatcacttagacggatagtaaagactaaaaacctttaaaaattaaatcattagcagttcattatactcggtgaagtaggctgcattcattgggtagacaataagaagtttggtgatgcttctagcattctgcttaatctgatggttggccgggttgggtaatgggttatgcatgtacagtacagaataggttggggagatcatcagccagtgacgtggatgaaacagcatgtatctaaaagtttgtgtcagatagcatttccccatgattgatggcttcagttaagcaaatcctcctatcttcttgagaatacagaacatgcttcactatcacatcagataaactttagcaagagaggaaaaaaaatgttgattttgggattaaagatgcttgttagtatataactattttgttcaataaatagctgccctctgtaaagatttataggtacatcttggggaaataactagtttgtttgtctatgcagttcttttggatcgtgtaccttcggaaaaccggataataccataacattgtctgaaactgtgctgaaatatcgctcaagtattgatatgaagaatgcattgctgcatcagatgatccatgcaatcttatttgtaaagcatcataggaaggactgccggtaaatgtttgcttgtgttagctaataaatcttgttactctctgcttaatttcagtgaattcatgcaggggtcatggtcctatttttcgtgcttggatgactgctattaacacctgttctat

SEQ ID NO: 66229 - DNA, 708 bp, Oryza sativa
catcacagtacaccatgaaatccttgcgagtatccggcaagattaacaccggcgaggaaaccagcttttctttgagagtctggaacgccttctcgcattgcgggctccacacaaatttctcttctttcttcaacaactgtgtcatgggtcgagcgattttggagaagttctcgatgaacctccggtagtatcctgccaaacctaagaaactgcgaatttgagtgactgtcttgggttgcttccaatcggtgacggcggtcactgtttcggggtccacagcaactcctttagcagatatcacgtgccctaagaatttgacttcggacaaccagaactcacacttgctaagtttggcgtacaattgatgttcccgcaattttcccaacaccagacggagattgtcacgcccggaaattcactagtaatttccgaacttatttgtgcataaaatcctcgtccaggaatcagccgacgtacacaaactgacaattcaatatacagattcatcaataactaaagcgaataaatacttacttatgaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaaggtgagcatatga

SEQ ID NO: 66230 - DNA, 745 bp, Oryza sativa
  unsure (1)..(745): unsure at all n locations
cgcgggtgaatcggctcgttgcncgtgttcattggtcaactttggtagttaaggaccgtaaacagcgatgatggttacgaaatattgtaataaaccccaagtcgtcgattctttgtcatttgaaaatccatagcagcggtgtcatgataaagattgggataatgatgattccgatttgaagtggtgtgtaattcagtcgagtcatatctcctaggtctgaagtcgtcgaagattttttgttcacgcgattcgccttttggacccatctcatcgaaaccttgaagcaccatatccccctacctggcacgccactttcgacgggctatagccgcctacggtatttgtagaatatggaaattgttagtgacatggtatacgcgagattgaggtaaaagaggcaggagatggggacttttatacaggttcggaccacgtaactaatgggtaatagccctactcctatcggctgaagccggtgttgccttttatatatcaatatcacacgagtacaatattggagaggacttaatctagtcccggtcaagctttaaggcccccacaaaccccccccaatgaactctacatgggcggcggtagtgtttctgcctctcgaattacacgcgagattgaaatgnatnnnngcttgctaaaccccnnnnnnnnnnttatccgtccggtagcnnnnnnnnnnncnnnnnnnnnnnntnnnnnnnnnngtctctttgtccaccttgatgaaaaccat

SEQ ID NO: 66231 - DNA, 1687 bp, Oryza sativa
aataccctactcctgtttggggatttgaatccgccgggtgtgtattgatctgacgatcaggttgtgtcatctgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtgtgggtatgggatacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcagatgcatcgaatagatgcacctgataggtgtaacccccgactatgtggttagctgaacaaaccaaacatatagtcaaggaataagttatccaattaaccgggtggtttttgataattatagtcaaccaagtgacttgataccaatatatagtatatgcggtgtgaatccccgaataatatgatccaagtgatataccgactgcttggcaaaatatgatgcgtacaacctaaagttgacaacatctttgaaagttcacatagcaaaacaactataaagaagcttgaatgctgtgaataaagaaatttccaaagtattgggcatacgccatgcgcacaatgctttaacagatgtgcttaagtccctaaaagacacatggtttcaccacacctggaaatatatggcatatgtggtgtaaaatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatataggctgcagacatattaggcctaggccaaaaaatacgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttaagcatagaaaatagactcatgactatgaatccatgtggaatgtatccggaacaagtccaaattgaaggtatgatacttgtgtttgagctagtaagcccctgagcatatagcttgtccttctgtcgtagtcaccattgtccattgatggtagcaatcaaaagtgatgaagtt

SEQ ID NO: 66232 - DNA, 18602 bp, Oryza sativa
  unsure (1)..(18602): unsure at all n locations
aggcgcgttgggtgggtaaaattttacttggtgccaatagtttctagatttccaaggaatatgtgattggcacaatatattttttttacacagatatgcataatcctggttcacaaaatcttactactacaagttaatcgcaacttaaaaattcgtttctcgttgattcttgtatagtagtatctcctgtaagtgcagtcaaatcttgaacccttaaaaatttaatagacgtaaaaatatttaaaatatgaaaagttatattggtatatttttttttatgagaaactctctttcataaagttatattggtaatgtttttttaaatatatagtttagtctttagagactagtggccctgcggcggtcgcggcgacggatctagcctcccccgtcgtcgcggcggcagatccggcctccaccatcgtcgcagcggccgaatccggccccgagcttatggcggctagcggtggagaggaggaggccacgccccaccaccgcggagaggcggtagaggcgacggcagccggcggcggtggagaagggaggaagaaggtgaaaccgagagagaaggaagagaggcggcggaggggccgcgcagtgggggaagggagaagggagcggtgggggtgggggacagtagatttatatattcgcccaaaacatttttcgcagtggtcctccttacctactgccggtgaaaatgagatttttcgctggcggacacttaagaggtccgcctcgaaaaactggcagacacttaagaggttcgtctcgaaaaatagagtagtttttttaggcatttctcttagcgtggttatcagcaaaaattggtttctgctggtggtccgtagccccccacctattgttatgtttttttggcggtttttgcatatggacgccagcgtaaaatatagggtaacatcacgaaaaatcgttttttatagtgtaaaattgttatgatgataaaatgtgtattgcggactatgctgatgatgtcactcatctgaaaacagagatagtaacaaggagtgaacacgttacatatgcccacttaacccttacgaaaatgtattcgagaattactaatctaaatgctccactacgtacagtacatcgtcggagattaattgtgtgatgggccacaagaatgagctgccatgcactcgactgaattctgatggaacaggaacaccatacagtattggtaccggcgacagcaacagcaattggtttctgcttctcgcgttgacaatttcactatgctaaccaccactttgtccactaaaacgcgctcatgaccaatgtcaaatcaaacccgtggatgaacgtgcacggcccgagtactccaccaagcaagattcagctgccgagtgaaagaagaaaaagctatttgcaattgctcaaattaaatcaccttgggaacagatgcaaacctacagctaacacagttcgttacggtcctaaccgtatgttttttatacctcgagaaataccaagttttatataaaagaaatggtaccttctaataccaagaacagtaaaattactcccaagtccaaatactacaatccttctaaaataagtatgattttatattcaaattttgttttaaaataagtacaatcccgtactacttatcacatcagttcatcttatcctcaattggaagagtacgaagccggcacgacccccgcgtcgccctctcacgcgagcggcacagggggtgaaccctagcccccgccgccccctcccttcctctcccccctcgccgccgccggagcgcgccaccggagttccgcgcggccaactgtgagggcggcggcgaggccattcctcggcgacgcgacggctcagcgtgaggatgatgacgcggcgcgtgataggtgggggctgacatcagcgcggcgcgaagcttcggatctggcgcccccgtggctggatctggcaccctgcttttggacctggccggaggagagcaacaatgccgtgcgcggtggcgcgatggggcgtggtggaggcggtgcggcggcgtgtgtcccggcgacggtgtgctgttcccggcgaaggagcggtcgtgctccttggccgcggagggcagtcgctagcggtgctgtctggcgacgtgtcgtccgtgagggcggtgacgggcctcggcttggctccttgtagtccccccctcagcattttcagtacaggaaaattacaatacattagatttagggtgcaatcttttcagcttatgaacttcgggatatgcataccactgttctcaaactagaaattttctacatcagcattgcctggctcgttctaagctatttattcggtttataataactagcatggtggcctgcgcatattgcgcggctagcatcattatattttctctcatataatagcatatatgttttctcattatattattataatatattacaatgacaacataattttaaattttgcaataacttttcaaaactactaatgtgtaataactactctagtctcctcttctaatatttcttattttttaattctgaatttcagctatttctaaattgtatttctatatggactctgttttttctttttctctgattaatgtgagaatttctatgccatgagagcgaacctgaaagctcctttttattccgaattttagttggttttaaattccaatatgaactctatattctacttctaatattccttattttttaattccaaatttctattttttttcttaattgtatttctataaggactctatactctacttctaatatttcttatttttaattccgaatttcggttatttcctaattgtatttctatatgtactctatactctacttctaatattccttatttttaatttcgaatttcagttatttcctaattgtatttctatatggactctagtctccacttctaatattccttattttttaattccgaatttcaactatttctaaattgtatttctatatggactctagtctcctcttttaatatttcttttttttaattccgaatttcagctatttctaaattgtatttctatatagattctgctttttctttttctccgattaatgtgagaatttctagatcatgagagcgaacgtgaaggctcctttttttttccgaattttagttagtttgaaattcctatatggactctatactctacttctaatatttcttatttttaattccaaatttctattttttttcttaattgtatttctatatggactctatgctctacttctaatattccttatttttaattccgaatttcagttatttcctaattgtatttctatatggactctatactctacttctaatattccttatttttaattccgaatttcaattatttcctaattgtatttctatatggactctatactctacttctaatattccttatttttaattccgaatttcaactatttcctaattgtatttctatatggactctatactcctattctaatatttctttttttaattccgaatttcagctatttctaaagtgtatttctatatggactctagtctcctcttctaatattccttatttttaattctgaatttcagctatttctaaattgtatttctatatgaactctgtttttttctttttcttcgattaatgtgagaatttctaggccatgggagcgaacgtagaggctccttttttttttccgaattttagttagttttaaattcctatatggactctatactctacttctaatatttcttattttttaattctgaatttctattttttcttaattgtatttctatatggactttatactctacttctaatattccttatttttaattcagaatttctattatttcctaattgtatttctatatggactctatactctacttctaatattctttatttttaattccgaatttctattatttcctaattgtatttctatatggactctatactcctcttctaatattccttattttttaattccaaatttcaactatttctaaagtgtatttctatatgaactctagtcttctcttctaatattccttattttttaattccgaatttcagctatttctaaattgtatttctatatggactctgtttttttttctccgattaatgtgagaatttctaagccatgagagtaaacgtggaggctcctttttctattcctttaattatataatagatttaggagtgtaatatttaattcattactataaacaattgtcaataacctatccaaatcatgcatgaagaatggaacaagtactacaatgctacgaaaacagttcactaacatcacaagaccaaacattgctacgaaaacagtttcactaacgccacaagaccaaacattagtatcgaccttctaagataacaatcacaagaccaaggcctatcttacaattcacctccatccatggtattccataccttctatctcatgacgaagatattgaacaaaacatagtatagttaaccatatacgaaattcagtctgaaaaatggaagttcatcagactaacctctcagggattcatgtcacaggaattcgtttaagtgggtcgctctaggattgcaaacataggtaagataacgaaaaacagacaccgagtacttagggagataaaactgccataagacaaaattgcagtgcaacataaacacatgcatcacattggattcaatgagcattaagcaacaaaacttgattcagcagaaagccaatccttgctagagtacttgaatacatgatatggtctgcttaaattaagctcctaataacattgaagtatgaagcacagtagacccacaacttcagtatccagtaggtagtttagaaaagagacgttcccttgcccttcttgtctccaccaattttaaaatgcttgcacctctgcacagaataattatgtaagtgagcatccaacacatctaaaaagatactgattcatgagaattttcagcttgaatcttcacattgcaaaaataccttgatggggtgctgggagtaatgcttgcagctttggcattgcagcttcagcacaatcttcttggtggtttttgcctgaaaacaggaaccatgtatcataacatgaaaaatgcaccctgcttttggacctggccggaggagagcaacaatgccgtgcgcggtggcgcgatggggcgtggtggaggcggtgcggcggcgtgtgtcccggcgacggtgtgctgttcccggcgaaggagcggtcgtgctccttggccgcggagggcagtcgccagcggtgctgtctggcgacgtgtcgtccgtgagggcggtgatgggcctcggcttggctccttatagtcccccccccctcagccggcgatgaaggctaggcccggcgcccccgactggtggcgtgcagatctgcgctcctagcgtctggatctggtcgaatccgtggcaccggtggcaggctctggcctcggaccccccctcccccgcgggactggtgaccttgcccaacaccttcttccatccccatccctcctcctccctcctctttgaggcgcccttgagctagccaacgagctccttgccataacatgcttggctctgatccatcaattaggatttgccagtgcctctccctctctctagatctccttttagcatgctccttgattgatggattaggtcaggtcttttatgttagtgcctacggttttctttggcttgaatggctactattcttgcagccttccctgttgacgcggttgatgttcttctagctgtaggattcccccctctaccacttatcttttgtccagctccctcttcgtctccacccttttccttggattgtcctcaaccacattgttcggcggccctctctcctttgaggcttccttccctaaaagggcgttggagggcgtggaactagctagcaatttgttatagtcggattgaagaagactcgatgcgagcagtctctatggccgcaacccatcgccgccatagacgtacggacggccggctacaacacaacacagtaactgtaactgaagaagccggcgccaccattcccgccgccaatatgctcgccgccgccgcctccgtcaagctctccacggccgggaccgccacggcgcccaagatggcattattcaagcccctccacctccctcccctcttcgccgccgccgccgccgccgccgggccacgtcccctctccctctcggcgcgccccctgtaccggcagcaggacccgttattcctggcgtcgcgcgtcgcgtcaccggcgccgccgccgccgtccgccaccgccgacggcgcccggccggtggaggctgcaccggcgggcgcggcgccggaggaggcggcgaggcgggccaagatcggggtctacttcgcgacgtggtgggcgctgaacgtgatcttcaacatctacaacaagaaggtgctcaacgcgttcccttacccgtggctcacgtccacgctctccctcgccgccggctccgccatcatgctcgcctcctgggccaccaggatcgccgaggcgcccgccaccgacctcgatttctggaaggccctgtcaccggtgagatcgcattgaccatggacaccatcgtctcctccttcttgattctgttctattctgaatctctgacgcgttcgttggatttggggattcgtttttgctcgttgtgggacgagcaggtggcgatcgcgcacaccatcgggcacgtggcggcgacggtgagcatggcgaaggtggcggtgtcgttcacccacatcatcaagagcggcgagccggcgttcagcgtgctcgtctccaggttcttcctcggcgagcacttcccggcgccggtctacttctccctcctcccaatcatcggcggatgcgccctcgccgccatcaccgagctcaatttcaacatgattggtgagtgagcaaacactctgcatctctctgtctctccacctgaaatcctggagatacttgcagcagatacaccagaaatatcctcactttttgattaaaaaaatagatattatctccaagaattcttcagaacaagaactgtccattaaccaaagatatgttttcttatgtcagataaagaaatatacaccagccacgaaaaagtgcacaatttgttcataaacctgacacatcacatcaatctgttcatcgtgtattgctgaaaattcgatgcaggattcatgggggcgatgatctcgaacctggcattcgtgttccggaacatattctccaagaaggggatgaagggcaagtcggtgagcgggatgaactactacgcctgcctctccatgctctcgctggtcatcctcctccctttcgccttcgccatggaggggcccaaggtgtgggctgccggctggcaaaaagccgtcgccgagatcggtccaaacttcgtctggtgagcctcacatgcttttctttgtaccacttctcaccgtttcactgtcacaaccatcacgtcagttgagatttttgggtatcaattgggcaaaaaatttctagtgataagtgcttgacctaagctttcaaacagtttcagcatgcaacactttgtactttcagtaacatcactcaagtattctatacaaaaagaaccattatcaattaatatagatataggatcgtcctatcactatcatttcctcctaagcggcaatatcttcttcagttcattctgaaagagaaataagaagtatcaaaagatttgatgatatttttgtgtgataatccagctgattcatgtggccatggatttctctgtggttttgtaggtgggtggcggcgcagagtgtgttctaccacttgtacaaccaagtgtcctacatgtcattggacgagatctcaccactgacattcagcatcggcaacaccatgaagcggatctccgtcattgtcgcctccatcatcatcttccacacgccggtccagcccatcaacgccctcggagccgccattgcgattctcggaactttcatctactctcaggtagattttccgcacatgttttaccaaatcacatttttcacaaaagagccaattcatgaacataagtctgaatctctaaccaaaaaaaaaacatctcattttttcaggcgaagcagtaatggcataagcatggaaatggcacccgttttcgccacaagtcgcgactcggtgctcgggatgtaacaatgctatgagcatatatccaaggatcccttgtaatatattagatcttcttttcttttcatttttctttctctaggtgtagctgccaatgtttcttctgaattcgtcgagttcttgtactatgactatgatgatgtagagaggtggatctgcctaaataaagctgttagattttttgcttgaccctttgctgctgctgctgctgcttctgaattttgtgatgtggtccaaaacacaaggtgtggttcagaatgagttgggggctaccggttagatcggagagcagaagcagtgcatgcttgacacactacggtccggcttgttttgttgctgggtgatggatgatgggtacagggcatggccctgaaaatccttgaatagtcccaactggcgctgtgcaatttgctcactgagatctctgggatggattcagcgttggacacttgcgattttccttacatgaaatgagaattttaggattctggaggaggcatataccccaaaaatgacgatctgttctggaatcaagaacagcttttctgggctccaaaaggccaaagccttttagcttcaaatgctagtagagtaaattgccagatggatgcactttactacacgaacttgtaaaagacttgtttcggtacatgaatttgttcgatgcatgtgaaacaaggtcaaaatgacacatcataatcaattttactaagttatacactgattaggacgagatgtgcatatggaggtggacatgagacatgcatttgtgctttattattctttgttctaccccttgcactatttctcagtatttttgtgtctttctccatacaatctttaggccttattaacccctttttattgaacaaatgtatatgtacttagcatttttctcacacatgtgtttatgtagtatcctaattaacactaaaataagattagctttgttttttcttttggccttgattcacatgcacctaacaagttcgtgtatcaaaatgagcgttttataagtttatgtactagattgcttccacctagcaagttcgtgtaccgccaatgcaatttactcatgctagtatttggagaaagcatataaccaaatgacggtttgtgcttgaatcaaggatagcttttctgggctcaaaaggccagagctgcttaggttccaatgaagatgtttctttcgtgctttttgggaggatcactgcgatggcactcctccgatgttgctacttgcatatccttctatactttatttaacttggctacaacttgaaaatgaacgcaaccaatcaccacggctgtccgatccaacagcattttcagtacaggaaaactacaatacattagatttagggtgcaatcttttcagcttatgaacttcgggatatgcataccacggttctcaaactagaaattttctacatcagcattgcctggctcgctttaagctatttattcggtttataataatttaggagtgtaatatttaattcattactataaacaattgtcaataacctatccaaatcatgcatgaagaatggaacaagtaatacaatgctacgaaaacagttcaataacatcacaagaccaaacattgctacgaaaacagtttcactaacgccacaagaccaaacattagtatcgaccttctaagataacaatcacaagaccaaggcctatctttcaattcacctccatccatagtattccataccttccatctcgttacgaagatattgaacaaaacatagtatagttaaccatatacgaaattcgatctgaaaaacggaagttcatcagactagcctctcagggattcatgtcacaggaattcgtttacgtgggtcgctctaggattgcaaactcgggtaagataacgaaaaacagacactgaggacttagggagataaaactgccataagacaaaagtcacaattgcagtgccatctaaagacatgcatcacattggattcgacgagcattaagcaagaaaacttgattcagcagaaagccaatccttgctagagtaaatgtcagacgatgatacttgaatacatgatatggtctgcttaaattaagttcctaataacattgaagtatgaagcacaatagacccacaacttcagtatccagtaggtagtttagaaaagagatgttcccttgcccttcttgtctccaccaatctcgaaatgcttgcacctctgtaaagaataataatgtaagatagcacccaacacatctaaaaagatactgattgattcatgacaattttcagcttgagtcttgacaatgaaataataccttgatggggtgctgggagtaatgcttgcagctttggcattgcagcttcagcacaatcttcttggtggtttttgcctgaaaacaggaaccatgtatcataacatgaaaaatgcacagctgaaagtcagatacattaaaactacatgatggttattgccacatgtttgcattgaacagacacaaatcatgacaccatatgtttctaatgaagagagacaatcacacacagcactgcgtaatcacatataaactgtcacaataccttcttgtggaaaacaggcttggtctgaccaccatatcctgactgcttacggtcataacggcgctttccctgggcagacaggctgtccttacccttcttgtactgagtgaccttgtgaagggtgtgcttcctgcactccttgttcttgcagtaggtcttcttggtcttgggaacgttcacctatacataagaaatatgaaacaaatttaacaaatactggttattggaaagcacatagcaggcctataaacaacacaatcaaatgtgcataatcagaagcacatgtgaatcgatatttttcgacagcaaagacaaattcagcagaccaatggttaaaacctcaattgggtcctcaggaaatatgcttatgtttgtcatcacaagaatgtcaggtctcaaagatttcatgccatcatcggagcccatcagtcaaaaccagacatgattaccaaacaattttcgcacaagataaaaaaaagaattcatcccacgtcctcaaggaagatgatgaaaaatgtttactccagaagttaattgctactccctccattccttaatacaaggcataacttgtttggactcggagaacaagaaaacctataactacccatcgtaccgatttattccagcgcgttccaatgcgtgacgctttgatcagttcatcgcatctagtgccaaagcagcatgcacccgtgtcctgcagtttttgcgcgtgcatgcaagcatccgagtggtggatcctttgcctttaaactaatgaaccgaatatcatgagctcatgcaaccatccattcaatgcttgcatgcaccaagtacggagttgagcagttgccgccttgtatactggtacttgaagaaaagacggttgcgccttgtattaagaaaagactattgaatgacagcaatacacataatctagatataacccattacaaaaaaattccgcgtttcagagcatgcatcttaacgacaataatctggtctctacccacaattgaaaaacaatcacacaaagcactcaagataaaaatgacataactagaacaaccaccgtggatatcattatatcaacatgaaaaaagaaatcgctaaagagaaaccgcgaaaccgtgttaaatctctaaaaaccccgaaaccgcatcaataagaaactagctactcctccggctcaagatcgcccccatctacagcagatcaacatgaataaagaacgcaatccccctacaaatcgaccagagcagggtgccgtggactggcacgaggacacacgagcgcatgatcttgccgtcgtgcggcggagagaggcggacggggaggaggaagaagcgtaccattttggcggccgcggaggggaaggcggggagctagggtttcggaggcgctgccttgtctggtcgacacgctgcggcgagtggcggcggggaggggaaggagaaggtctgcgactttatacgggtgagctcctggaggctagggtttactggtgcgtgtgctgctttgtgggccagaatgcgcagcccatgggccatgcaccgtgatgcgttgccttatagttggaataagttcatctgatgtccctcaactttacaccgagtttgtttgccatcccttatcctcaataccagaaatcttcaccccaaatatacaaaaccgttcaatttatgtcctatggcagtatagatgtcttggtttcactaacgtggcatcctagttagcaaaataggaataaaataatatgtgagtcccacatgtaagtgaaatagaaggaaaatgtgagacccacccatcggcaacgttgttattgggacgccgcagcctgaggacgcggtggaacgactctggtgagggcacgaagacggtgaaggcgaggtctcctggtgaaaccccaagcgcgtcggagtcatcctctcccggcctacttcgtcctcctcgccatcgtcccctacagcgtccgccatcacttccatatgtcgtcgtcctctgcaccccaccgccgccaccccgctccgcccgccacagcacagcgacgcccacaccacaccctctctgaggcgccgtcgctcgcccgccacccgttaccccttgcctgctccgcacaccgccgccaccgcctgccgtcgcctgctcgcccgcccgccggcctctcaggctaggagaagaagggaagaggagaagagagaagaaagaaaagacaagaagaaaaaaaagaaaaaagaaaagaggagaagacaggacgctgacatgtgggtcccaccgtatgccacgtcagcaaaaccggagaaaatggatcaatattgtcttgggatcttttttgcacggtttatgatagttgaggggtagagatttttgctatcgcggattagggacctcagacaaactcaacataaagttgagggccgtcaggtgaacttatattcccttatagttatgaagtgactttatccctcaaaatgagttcactttaggtcccttacttcatcgctccgtctgttttgtgatctttttcgcacggtttatgattagttgagaggtagagattttattgtggattaggaacctcagacgaactcgacttaaagttaagggacgtcaggtgaacttattcccttatagttaaggaagtccaagtggactttatccctcaaataagttcactttaggtctcttactttgtcgcttagtctgtttttcatccttatccgaaaaccatatacaatccatccttcaaagtgtgcaaacgaggtccctcggtaataatatttctggttttggctgacatgacgccttcttcaaactgtgcaaacgagctctctcggtagcaatgtctccggttttagctgacatgacgcctttgactaggggtcttcgtcccacgtgctattgacatgacgcttacgtggctatttgataaaaataataaggaggtgtttggaatggactaaaattttttagtcccttccaaattggatgtttggacactaattagaagtattaaatatagactattaacaaaacctatccataatcttggacttattcgcgagacgaatctattgagcctaataaatccatgattagcctatgtgatgatacaataaacattctataattatgaattaattaggcttaaaaaattgggttaattggatacatgccattgtaaattcttcagttttgaaatataccattactactcaactatttggaggtatgccattataatttttcaggtattggaaatataccattacataccccttggatatgtctaacaaaaattttggaccaaattgcccccgtcttcttcctttgcctcccccatctctcctgttctgttgttcatcttcttcctcccgtttcttgctgctgtgagattaggagtacacagtaatagtcactttgtcaggatcatgcacaagcagggccggccctagggggggtcagcccgtgcgcacgcccgagtcccccaaaatttagggggccccatggcggatgggccatggcccacgacgcccccagggtcagcatcgctctcagtcctgaatcatgtatggtatcgaagacagaagacgaagaggagcgaaggaaaagtgaagcgatctgactccgttcccgtcgcctcgatcacgcctcgcgtcgcgttgcaaacggtaaacggcggcaaaccgcaacgcaaacacggcaatcggcagcaaatcgcagcggctctgcatgactggctgactacgtcgattggaggccaaccgcccggcggcgcgccctcatcggccgatcggctgctcgcgcctcgcagtcgtcgtctaaggtaattttctctatctttctttttcctctttatagatcaaaaattattagcttgtactacttaataattaatgattattttttagcacaacattaatcatattgtcaagaaaatatgtatccggtagcgaaaaaagaaaacggaaaaaatgttcggatgatttcattgaaattttagaagaaacttttgaaagtgccaagtaagtgtttatgattatattatttctctttgaaagttttaaaatattatatatagataattttatcatatcaaatattaaatattacatgtttataagactataaatatatatattagtttatgtatatatataggggcctccacgtaagtttttgtcctagagcttgaaaactcaggaccggccctgtgcacaaggcgcgctcgtcgacgagcacgtaatcggtggacgtggaccacgccatggtgaagccgctgtaggcgaatgactccagctgcaccgacaggggcacgtccttgggcgtccgggtgctggacattcaagaacgacatgctccgcgtcttggttgttgcagtagacctcggggaggctggaaactgagaaggtggtgatgcggccagcgaagggaagaagggaaactagatggtgcagcacaacaccgccgttgctggccgagaaaggagatgtggaggaagaatactaagataccagatccaaaagggaaagaaatggaagaaagaagatgaacaggagagggtggagacaaaggagaagacgagagcgatttggtctaaaatttttgttaaacacatccaaaggttgtacagtgacatatttccaatacctgaaaaagttgtaatggcatgtttctaaatagtttaatagtaacggtatatttcaaaactaaagattttataatggcatctatccaattaaccctaaaaaatttgtctcacgaattagctctcatttatgtaattagttttgtaagtagtcaatatttaatactctaaattagtatctaaaacaaagactaaagtttaatccctggatccaaacaccacctaacaaacaaaataaaaaactaaaaaaaaacaattaccacacgtgtctgtagtctgaactaacccgcactcatagtatatgaacattgccatgagcagcaatgctaagttgtgattgctgccatccggtttttttgggtgggttggggggcagcttatgacagttacaaactttggaatataccacggttctcaaactaatttttttctacatcagcattgcttagcttgttcgaagctatttattcggttcataataatatataatttttaattcattactacaaacgggattgcgtagcctatcgaatcatgcattaaggacagagcaagtactgcaatgctacgaaaagaattcactaatatcacaagaccttccaagatactgaaccacaagaacaaatgaattatcttgcaataaaattacgtccctacattccatctctttcgaaagatactgaccaaacgccagtacagttaacaatacaacattcagtctgaaaaaggaagttcactagactaatctctcgaggtcatattcatgtcacgggaagtaattaaagtgggtcgctctatgtttgctaactactaatcaaaagacagcaggtaagataacaaaaaaagaaaagggatactgaggactaaggtaaatagaactgtcgtaagataaaattgcagcaaaatataaacacatgcatcacattggattcaacgagcattaagcaacaaaacttgattcagcagaaagccaatccttgctagagtaaatgtcagacgatgatacttgaatacattgatatggtctgcttaaataagctcctaataacattgaaatattgaagcacagtagaccaacaactatagtatccagtaggtagcaagcaatttagaaaagagatgttcccttgcccttcttgtctccaccaatctcgaaatgcttgcacctctgcagagaacaattatgcaagtgagcatccaacacatccagcaaaataatgattcatgataattttcagctctggagtcttgacaatgaaataataccttgatggggtgctgggagtaatgcttgcagctttggcattgcagcttcagcacgatcttcttggtggtttttgcctgaaaacaggaaccatgtatcataacatgaaaaatgcacagctgaaagccacatgcaattaaaactacgtgatggttattgccacatgcattgtacagacacatatcactgctacatcaatcatgacaccgtacgtttctaatgaacagagagtcacacacaacactgcataatcatatataaactgtcacagtaccttcttgtggaaaacaggcttggtctgaccaccatatcctgactgctttcggtcataacggcgctttccctgggcagacaggctgtccttacccttcttgtactgagtgaccttgtgaagggtgtgcttcctgcactccttgttcttgcagtaggtcttcttggtcttgggaacgttcacctatacaaaacaaatttgaaacaaaagcactcagcttaacaaatactgaatgtggaatggacatcgcaggcctataaacaataatcaaatgtgcataatttgaagcaaatgtgtgtacaaatttttcaacagtgaagacacattcagcaaaccaatggttaaaacctcaattgggtctcaggaaatatgcttatgtttgtcatcacaagaatgtcaggtctcaaagatttcatgccatcatcggagcccatcagtcaaagccagacaagattaccgaacaattttagaacaagagaaaaaaaaaggaactcatcccatgtcctcacaggaaaatgatgaaaatgttcatactacagaagtttaagtgctaattaaatgacaacaatacacatataatctagatataacccactacaaaattttcagcatgcagagggtcagctcggaaaatacgtcgatcttcacgacaataatctggtctatacccacgattcaaagcattgaagtcttgaagataaaaatgacataactagaacaatcaccgtggacatcaacatgaacaaaaaaaatgtcgctaaagagaaaccatctcatgttaaaatccgctagaccccaaaacgcataatcaaagaaactagctactcctctcctccggctcaagatccccccatctacggcagatcaacatgaataaagaacgcatcctacaaattgtgaaacaccatgagaaagacggcgcgcggagccgtggactggcacgaggacaagcacgcgtgcgatcttcccgtcgtgcggcggaggggaggaggaggaggaggaggagggagaagcgtaccattttcgcggccgcggggagggggcggctagggtttcggaggcgagcggcggtggcgggggaggagaaggagagagaggtctgcagctttatacgggtgcggtcttggaggctagggctttactggtgagggagatagagcccatgggccgtggtgccccggctaagccccgcaagatattgtgggcttgtggccgcactttcagcccatgggcagtagtgccccggataagccctgcgcgacattgtggccgtttggttggtaaaaattttactcgtgacaatagtttctagattttcaatgtatatgtgatttgcactatatattttttttacacagatatgcattatccttgttcacaaaatcttactactaccagtttatcgcaacttaaaaattcgtttctcggtgattcttgtatagtaggatcttctgtaagtgcagtcaaatctttgaaccttaaaaattttatagacgtaaaaatatttaaaatatgaaaagttatattggtatatttttttttatgagaaactttcttttataaaagtatattggtaatgttntttttaatatatagtttaatctttagagacttgtggncctttcngcggtcgcggcgaccgatctagact

SEQ ID NO: 66233 - DNA, 2177 bp, Oryza sativa
aaaaaaattaagtttgattgtgacaactgacaaatccactaattaatttgaatctttaatttcatctatatgcatgtatccctcacgaaaaagaaaccatccaacatatatcatcatcctccagagcacattggttttatgaggaaagagaaaaacacatccaaagttaatctcttatgtttccccttaaagatataatgaaagtacaacttcttgtctctgcattaacgagagaatgcacacaatcattacgctgccatgatctaataaagatgccaattgccaaaataaattagatcacatctaaagtttctctagttagcaaagtgttttttttccctggattgattattatttttgttcttccatgtatatatatatctcacttgtgtaggagagacatatattatatgccctaagattatatcctgagtacataatcacaaatgcttgctttgtccagaatatttgttggattgatgccctagaattgataggttttggcctatgttctatctaattaatttatgccacttttctcaccctaaaaaaatgttctaattaatttgatttgatatacaggatcgaagctaggtgatcttagctagtctatatagaaaacgcaaagttacacatttagaatctcatttatttaaagagtagtgttcctatatcatggtatatgtcattgtagcttggtagctaaattaattgcaatggtgtcatgaacttgacacaacataatccataattcaaggatgcatgcatgcctctaccatgcatgcatctagctaaaagctaacatggatcactaactagtggtaaacttgtaattaattaggccccattaatctccatctaggttaacacatttgctaggagagatgcaagctaatgataggacatggatgactgcagagagatgtgagagatagcattagctaggtcctacattattagataagcacaaagatatatattttatgccagggctagctttgcatgccatcatacacaagcgcacacacacacacttgttaatcctcctaatgatcaaatcaagctctcacacaagctattatacaaaaggccaccattgtttccttctgatgcttactttgcatatcacccattaaccaattacttaattacttaattgtttctcctcccatggcccccacatgtaatacacacaacctgccactctcatccctaacctgccaacctatgtgtataaattcccagctccttccctcccatctgagaagaaagcagcagcagcagagaattcatcacccagcaagatcagtcaggatcagctagctaataagctagctacaagcttgattagtcacaaaaccacaagacaattagctagaagtatatactgagatgggtgaggaggagaagatcatggcagctgggaagaagatggtgagagtgagggagttcatcatggagaaggacttaccggcggtggaggagctcgagcgcctctgccaggccggcctctccggcgacaacggcgccggcggcggcggcggcaagaagaagaagagaggcatgtcgctctacgccgagcagatcggcgacccgttcgcccgggttcgccatgctccggaccacgtcatcctggtaattagctactccatccgttccaaaatataaaaatttaggaccagatgaaatatgtcctagtacagcgaatctcgacaggcagcctgacactgtgttgttgcatgcactgtgttaatcttacagtgatgttcttgatgtgattagttgcttgggcgtgcgtaattaatgcgctgtcattggctgctttgatctgtgtataggtcgctgagtgtggagacgaggtcgtgggagtgatcaaggcgtgtgtcaggatggtgaccagaggcagcagcagcagcttgaggaagacgaagacgaagacgaacaagtttgtcaaggcggcgtgtcttcttggcctcagggtgtcgccgtctcacaggtgatcgatcatccacgccgccatggacgaccatgcatgcgtgtccaagctaagctttgtagtacgtgccatggcgatggcgatcgagctagctggtgctgacgacgacgaggtgttcggtcttttgcaggaggctcgggatcgcgacggagctggtgcggagagcggaggagtggtgcgc

SEQ ID NO: 66234 - DNA, 30317 bp, Oryza sativa
  unsure (1)..(30317): unsure at all n locations
cggcaagggggccgcctgcaaattctttgacggccgtcgcccggaagcaaacggccgtctgccacgtcattttcgccgccctctgagagggcgatttttaaaaatcgccctcccagagggcggtaggcgactccttccgtcaattttcaaaatggaaaattatttttgtaaaacttttaataaaaaaaattataaataaaaaaaattcatgaaacaacacacaggcgtaactaacatcagtgatatttgggccgaaagagcccatgtaagggttagaggcccggtccatccaaacttgcggccgcatcgcggcatccaccaacgaggccgtcatctcggcccgcgcgcgggcattgggccacggtggcatctcgggcattccggcccacgtatcggtgtaacggcgaaatcactagccgcacacgcgagcggagccggaggaggagacggagccggcaggatccaccactgctccagctctctccactctcactccccgattcgccggcgagcaggcggcggcggcggagctcaaggcttcctctccgctccgcaggtaaacaccaggcaccatcccctcggctgtggctcccccgttcctcttgtcccactctctcttggccccgaccctcgggagtccggcgctaccgaatccgtcttccccccggagctgtcgaaggagcgccgcgtgcggccgtgctactcccaccgacgccgcgtcacctcgaaggcgaaggggctcttctcccctcccctccaatggactgaggcgtatcccgtctaggccgatttcttctgttgagacggaagccctaacatagctagattgctttttccaatgatttgtcgcttgctaccagcaatcaaatccttgtgttattttttgcttgtctgtggccactccaatccacacatatagtcgcatatttgatttgattttattactcgaatggcagcttgctttgcaaaattttcagaagcgcaactgaaccctcgcgcctgatatctaaatagctgctcacgaatccacctcccttattgtgtaccaggtaccaagatgaaggtcaagattcttcagtggcattcggtggcttcttggacatgggacgcccaggatgaaacctgtggtatatgcaggatggcattcgacggctgctgccctgattgtaagttccccggcgacgattgcccgctcatctggggctcctgcaaccacgctttccatctccactgcatactcaagtgggtcaattctcaaacatccacaccactttgcccaatgtgccgtagggagtggcaattcaagggctaatggcatctgaaattatatcactagtatctagtttgcatgtttccttgtagagaactgcaggaaaacttttctggaacttagaaatgttgtcttcaagtactatgtactaatattttctgcaaatgctgatggtcacaatctgctaagtgaaactgtgagccagtttcatatctgtagtgtccttttgggagtctgatcgagcaaatgaattgttacatttgaaaggctgaataatctgaggttatcacaaattttctcttactgtttattttcagaaagattatatatttgtatttaccaaccaaagatgattaattgtgttcgtgtagactagtacaaaagcaatcatgtaacatctagcaggttgtgtatattttttccctgtaattcctaacttcatcaaagcatctctccctttgaggagcaactgatagaccctaacctaaaaatgcagtatgattcagaacgagttataccagtgtttgtttatatggtgagacccattgtacagtcactcacagaaagttttatcttaataaattcatgacatgcttacataacttaaatcactaagtgctgattaggtattgttctttgttttgcactcagagttgcacgtgcattttggattttatatattgaaagctaaattttgatataggctcgtgttagcttagaattgccataactcaaatgtaaggatctgttccaagtatccccttccacctataaaattgcatcttgtacatgttaatattaatactgtaccgctgtatatcagtatatgaccaacaaagaactgcagaaccttttatatttatgacctagcaagtgacaggatgaatcaatttgaatgaatgaaaaaaaaacattaatgatgaatgttactttgttgtattgtggtaaatgatgttatccattccctgcaaaatatttgctctctagtttacttaggaaaaagtacgaattaccccccccccccactattgtggtcgtccaaattaccccctgaaccacaaaaccagacattcttcacctccaactatgtaaaccggacgaattacccccctcgacctaatctgcggtggttttggtctacgtggcgtacacgtggcagtccagtcaacattctatttattaaaaaacatgggacccacctgtcatatcctcttccattgttcctctctctcttctctctctctctctcactctcactctcactcttcccctctctctctctctctctctctctctcacgcgcacggcagcaggcggcggcggcggcgcacacgcaccggaagcggcggcgaggacagccgcaatagttcgagggggtaattcgtactttttccttttacttatctagaaaatgcaaacaataaaatctgaaagctgtgtaattggggattgaacacctttgcataacttcttataaacatctcacttttctcatatctgcgtctattcagggcagatttatttgcatgttgctgaatggtgactatgtggctgggtgcatttcactttactcattgtctaccagtgatcagagcagaccttttttgcctgttgagtaaattgtggcctttgtggcagggcgtatacatttatgtgtctcataatttgttgtcttgtactcttgtagaatattgcaattatactcttgtagattaaatttgtgcaagtaagtaatctattgttgttggcggctcggctggtacgctttcgagaatttaatctctttctttcttttgcaaaatgagtagaatttcagccttcttggagaggtttgttctctttgcctggttactagatagcctagaagagcattttttaaatttatttagtcaaaagtgatttttagtgatatttccagaaactgtgctaaaaattaccatgtttctatatccaggttccagctcattcttttcattttgataagcaaactaggtgtccttttttcataagcaggaagggaaatcttaggataaattagtacccttcctgtttttaaaatttattataagatacgttgaagtattcttttgaaataaaattggaatttaaagcaatcttccaggccgttaattggggccatacagactgggtcttcacttttctaatgcctttcggtctgaattatgtttcgtatagctgctccttttcttttcagggcaggaagctgcacctcgtccatgttgtgctgtccagggtccaggctccaggctcgcttgcaactgtgggcaaatctcgtggtatttcgtggccgctactccaccatttcatgctaagcagctaatgcctgtcgggctaatggcatcacgcatttcattagctactgacaaaaaatgatattctctcctcctgatgatggttgccagcagtgagcgttacagttaagcttgttctccaaaaatatcatattgttctactacttgcagatctcccattctacatggcaccaaatttcaggtgaactgctcctttccaatggagccttggcacgaaagcgacctggatttttcgaggctgccactacgtgacaacaattgtgataggcagtttggtggtggccgcatgcagctgcttgccttgactgaaaattgattttccagcttgtgaccactgtttctggctgtcagcttgctccggagatacataccatgtgaccccatggatcagtggcatggaattcctttggtgttttcaggttgcttgaatttctgggaagcttcctgttaggctacaacgttaacagtgtttgagccagttcgtttttagtactccgtacatttcaatccgtggtaagacctgaaaaaatttcacgtgtgtagccatgctctgatttaagcctgttcggtcgctttgtacagcagtacaggccaggtcatctgcattggttgctgggtgtccgtatacgattttacctgtgcctggtcacctggccttgctgccttgcatatgataagctgtatcccagtgaggcttgactcggagtaaactagtgccattctgaaacgggcgcagccgcggaaattacgctgttatggtggttgcagacttgcagctcatggcagagcgctacgcggttcacatcttaatcaatcgaggaagccatgttccccactgacgagcagcagccagctaccgagcatggtgcgctgttacccttggacattggatactttggggtatcattacgaaattgttactgacgcagcaacgttgtagggctagccgggcagcggcatctgtttcccgattgcagtaaatgcaagtgacgagatcgaggcaaacatgagccggaactcttatcttttcgtctatgcttatactccctccgtacttagagagtcgtttagaacaatgtttaagtcaaatcttaagaatataaatcatgaataactcttaagttgttgagtttgaaaatataaaaattatatgtatagatttgtcttgaaaaatactctcataaaagtatacatatatcacttttcaataaatacttttatagaaataagaaatcaaagttgtgttttggagactgtgtcgctgtcctaaacgacttcctttacgagtatggagggagtacttatcaaccaaaatttaaattttcaaccttaaatttaaagatgtttttaaagtttttttattgaagtttattttttcagcctttgcttttagatcgctaagaatacatatataaaagttctatttacaaattactactttctccatttcacagcatcaatatggatgtgagaaatgttagaatgacttacatcattttacaaatatagcgtttggtggggccgctggattctggaagtaaccgagaatgatcaaggaaaactcgtcaagttctggcacttgtcagagtgaaatttcggaatactatcctcctgataattcgattactagattcctgataattacccggacgggcaaaccgtgtcagggaattcggtttgtgcatccaaggcacgaaacgggtgaagtgaacagagcggcacgtcggggcgacaagggccccaccgttcagtttcagtggcacgaagcgacgcgacgcgtgttcgcatgacccgccgcattccgcggccgtgccgaaagtgtgaacggtgaacctctcccctggcccgcgggccccaccccccaatcatcttctcctggccttcagcctccagctgatgccaactgccatgtcagcaactaacgcgctcgcttccttcccgcctcgcctcaacgcaaagcgagatccccccctatacctattaatacctcatcttgtcgtctcgtatcatctcatctcatcacatcagcacacatcacacgcgccgattccgaagaaatcaatcaaccaactactaggcgaaagcaagagcggatcgggtgctgcatttcgcggtcgttttcttcctctgaattctggtgtttgcggttgcggcaatggcgttggtggcggcagcggcggcgaatccgaagcagaaacagaagcagcagaaggcgtcgatcgggaggcgggcgtggcggctgctgcgcctggcggtgctctgggcgaggaagggcagcgcggtgcacagcctccgcctgctcagcaacctgcggcgcgccggcgtgggcctcggcgtcgtcggccgaggcgaccgcctggggtacggcgagcgggagtactcgatcgaggagacgccggcgttccggttccgcacgccgtcggcgcgggtgctccgcctaatcccctgcatcgcccccgccgtcccggacacgcccgggctctacggcgacgaggaccgctacttcttcgcccgccgcgacacggagcccgagtgcggcggcggcgtcgggtattacgactacaatggcgagccgggcgagtgcggcggcgtggacgacgagagcttccgcgacggcgcgatggaggagcagctcctcgagctgtccatgctggaggcgagcgccgccgccgtgacggaggacgccggcgtggacgccaaggcggaggagttcatcgccaaattccacgcgcagatgaagctacagaggcaaatctcatggctgcagtacaacgagatgatggagaggagcctccgctagatgattattcctacccaataagatccattttttgcgttttgtttcaccgattcaaattcatacaccagctaaaaatacagagatattgaggagtagcttcgtatacgtacagtacagatcaatacatttttaaatttatttttcttccttgagcattgatattggtttggttcattggttgcgaattgatatctgtacattttgtgcattgagaataaacgagcagagcagaaatttcagattcaggaggaggcttcttcttggacgcgcagaagaacatgcagttgctttggctcaatgtaagctgtactgctgtgtatccgcatggtacacttgcttgattcaattgtggtattactctttacctaatttgttcgttgggttacataattagatgtacgtacacctggatcttgaatctaatgatgacagcatttgacgatattaatgaaaacccgtaccaaggctatgtttagtttctaaaatcgaagagaagtttggagaaaattggtagtttagaaaaaaagttgggagtttatgtgagtagaaaaattttcgatgtgatgtgatgtgatggaaaattgagagttcgggggaagtttggtttgaactaaacagaaaatttgtttatggatgattatagtgaattcgtgtcacaaatgagtatgttcacgtcaaccattgctgcctttctagtttgatttcacgccaaaattaaaggtttggttaaaattagaacaatataacagaaaagttaaaattttatgtgtgtagaaaaattttgatacatgaaaaagatagaagtttgaagaaaaagtttagaactaaacagggccttaaccaatcagttcggctcgactgatctagacatcacagtttatgcactagtacgaccgatctgcctgtccttgtttgcgtcgtgccgaccgaccgccacgccgtggctgggtctagcggaaaccagcgacctgccctgacgccgtcaagcggcgaggattcagaatcctctgctgcaaggctggaatggaaaaaggctgctaacacaaaccgagtctggcgatcgaatcatttctgtacctgttattactggtactataaatcagctttaaaattttttatatatattattaaaatatgttatattttgggagtgtttgggaattagggactaaatttagtccctctcacaaaagtataagttcctaccataggaacttataggaacttatgcttttgtgagagggactaaagtttagccccactttagtccctccaaccaaacaccacctttgtatttggtttattttgaagtgggaacagtaatgagtgatgtatagagtaatccacgtttcaccgagctgctgttggctcgtagtttttttttcactgtttaaccactcgtctaattcaaaaaaatttaaaattattatttattttttacttactttattattcaaagtattttagacataacgttttgttttttatatttacataaattttttaaataagacaagtgatcaaacaatataagaaaaactaaaaatccttataataagacggagggagtaatttttgggcagatcgtctctcggaagtcgagagcaagaacgtgagaggttattattccttgaccgaaccgagctgatccctgtaaagaacgtggtgcgtggaagatgggccggacgatcttcggaactccatgtgaagttgcaaaagtcttgacggctatagtccttgcacgtttgattgggcttttcagccatgaacaacgcaaaaccacaactagaagtggtctcggggactgaattttcccttttgtctttttctttcaaaaaaaatattttataagtagatcagtgataaaacttatttcgagaatggaactttttcaacgtcattatcattgatgtcgtgattcaacatactaacgctagcgtcatctctctagcctcgtcgtgaaagctaggtcacttatgttaagagcgaggggccaatgacattagcactgataacctatttatattttttaaaaaatgatttatctgtaattaaaaaaactatttacaaatagttccttagagctagtgtcattgacattgaggctatatttagttaatattttttattattacaaatagatcatttttacttttttataaatagatccttggcgtcaatggcattagcaccgacccccttcatacaagtgacttagttttcacggggaggctagtgggacgtcactaatgtcattgatgtcgaaaaagagtctattctcgaaagaaattttttagggtgcctatttataaaataagttcttaaaattctaaaatatatataaaaaatccatatcttagggatagaaaatatgccatataggatgagactaagattaatgttagcggtactacctttcccatgtacagtagcttcaagtataacacattcattatttttattgcccattttaattttggctcctccattttacattcaagttcttatataattttacaacacaaactcctagataacaaaatacactcacatattaaaccaatagtcacagccgttcctcccttcaccatcatcgatgaccgctccaccatccttctcccactccggccaccgcaacatctcccgcttcttgctccggccaccaagctgctcccctttcactcaaatcttaaaagtgtggagttcatcttcatcgggtcgccgtcgcttctcctctcttaagcggcgccatgaccccccctcctcgtcgtcgtaggctacatatggataagatgggggtggctgactggcagtcgaggaggcgaggtgatgtctggcaatgaggtgagcctaggtgagacgtcggctcgtctctttcaaggccaataccggtgaatccccaagctcgacgccaaatccttatgcatagtgtcttcctgctcattgtgggcttcatctccactgtccagtcttgtcgttcacctagaacatgccatagttgcaggccaataaatgccaacatggtgtagatcaacatcaaaacaatgagttccccaatacaactgctatctctatgttcttcgaccatcatttttccctatctcctctccaattgcccttcccctttgcggccgccttctaccaagaaatcaagcgaggcagaggggaccacactggtcgcttgggaggtacgccgtcttgacacaacgttgcttttggccatgtctacaccaccatgtggcttcagggctgcaaggcactaatgttgtctacaagccacagttggctctaatgggcctatgcacaactaacaatggcaaacggtataaaatttgtcaaaaataaattatttttaaattttatttgagtctaatagggttaccgcggttttacatttaccgtatctgacggtaagcgcaattactgtgtggttaccgcctttttgtaaaccatggctatgagtggtgcttatgcaaatttgttcaggggtaagcttgcaaagttgcactgagtggtgcacatacaagttcgtcctgcctagggtgtgtttagttcacgccaaaaataaaagtttgattgaaattggaacgatgtgatgaaaaagttggaagtttgtgttcgtaggaagtttgatgaaataaaaaaaactagcatggtggcccgtgcagattgcgtgcctctgcgcgcctagcatcattatattttctttcatataatatcatatatgttttctcattatattattcaaatatattaaaataacaacataattttaaattttgcaataactttacaaaactactaatgtgtaatattcatattatattttatatacgtgttagttattaattatttttaatatcaaattttagttatttgtaaattatatatattcctatatggactctagactcatcttttaatatttctttttttaatttcgaattttctgtaaattatatttctatatagactctatgctcttcttcccatattatttatttttatttctgaatttttattatttctaattgtatttctatgtggactctaaactcatctttcaatactatttaatttttaatttcgaatttcagttacttctaaattgtattcctatattgactttaaactcttattccaatgtttttcttaattttaaattttagttatttgtaaattgtatttttatacggactctaaactctacttttaattttattatgtttatttcaaattttagttattttaaattcctatatggactctatactctacttctaatattccttattttttaattccgaatttctatttttttcttaattgtatttctatatggactctatactctacttctaatattccttatttttaattttaaaattctattatttcctaattgtatttatatatagactctatactctacttctaatcttccttatttgtaattccgaattttggttatttcctaattatatttcaatacggactctatactctacttctaatattccttatttttaattccgaatttcaattatttcctaattgtatttctatatggactctagtctcattttctaatattccttattttttaattccgaatttcaactatttctaaattgtatttctatatggactctagtctcctcttcgaatattccttattttttaattccgaatttcagctatttctaaattgtatttctatatggactctgctttttctttctatatggactctagtctcctcttctaatattccttagtttttaattccgaatttcagctatttctaaattgtatttctatatggactctgctttttcttttttctccgattaacatgggaatttctagcccatgaaagtgaacgtgatgcctcttttttctattcctttaataatataatagattaaaaatttgaagaaaaagttaaagaactaaaccaggccttactctagtcaatggctgggataacgcacctgatctagcatgtactcccagacggcaagattgcacgcccaggattacgattctatgcatcggctacaaaaaaaaaagttgtggacgatactgatcgccggatcccaagattcaaatcgatctggtggcatcggctggtgctgacctgctgatgcaatcgccggccctgccaccgaaccagtaccaacggctcaatccaatccgggcccacctgtcatacaaatatccacgacaactctcccaacaaaatcatttttttcaaaccgcccctggcccaccacccagatgtgtttgacccggggctccaagcctccaaactctcgatccgaacagcgcccacccaataggaccacgccacgtcaccgcctacggtgttcgctgctcgatcggacatccctgccgtccgtcacgcgcatcaagattcgcgcgtggttcgccgcacgcttcagccacacccctcctcgtgatgggattccccttccgcaccgagaagaatttgaaatcctggtcgcttgaaaaagagccgttgcctcctctttcatcgttttccccaccacgcacacaccacctgctcccgtccacgccacggcgcggggactctcaccgacacgtgggacccacccgcgcgtggggcccacgcgtcagcctcgctcaccaccaacggtagtgcggggcccacctccccccaccccccgaattcgaaaaaaaacccaccaccattcgtgctgccgcttgcgtgttgttattactccttggatcgactcggccagcataaatgccccgcctttaatggcttccccgatctgatgcttccgccctccgcttctcgcctcgccgccgccgctgccgagaataccgccgctgcggcgctccacgtcgtcgccgtcgccgcgaggccacgtcggtaggcaggtactcccccgtgttcttctccccgctctctgttgttaggctcgtgttgcgtcgcgatcgatttgatgaggtgtttgtggctccgatccgttggtttctgtacgggtgaggtgaggtggatttttatgattgattttgtggtaggtgttgtattggtgattttttgttgcgggggatcgagcggatcggatgctgaagaacgggggagaaaagtgttggttttaagtagagattgtttgggatttgaagggagttgctacgagcgatggggacggagaaaggtggagcaaagattggtggcggcggcggaggaggaggaggaggaggaggtgggggtgggctgttcaacctgtttgactggaagcgcaagtcccggaagaagctgttctccaactcacccggtaggtgttcgctggaatgcctcgctagttttgttcttcctctgttgccgtgctttcttagccttttttcgcgtcatctttgttacagagggtgctaagctcgtgaagagaggcgaagaaaccttgccgtctgggcgcctccacttggtgagtgatctctgatcttgtcgttgcccttgctctgcgctgtgatttgcattgtgccgtggaacttgtgttcatgggtgtttgcggtattgtatctgcagattgatgatgatgaggggattggtgtgtcaagcttcaaagggagcagcgactacagctgtgcttcctcggttactgacgaggaagggcgtgagatgaaggcgccaggagtggtggccaggctcatgggcttggatgccatgccctctaccggggtcccggagccgtactgcacaccattccgtgacacacggtcgtttagggacagccagagcctaaagagaagcccagagtactccgggagtgaccagttcagttatgtgccacgaagagttgatggctacatgaggaagccattggatctgagagctcagaagatgccgagcagcccgattgagaggttccagatagaaacattgccgccaaggtcagccaaacccttaccaatgtcccatcacagattgttatctccaatcaagaatccgggatttagttcagcaagaaatgcggctcaaatcatggaggcagcagccaagattcttgagccaaggccacaggtcagttctagggagaaaatctgctcatacagtcctgcgcggattcctttgaggatttctgagacacgggagaatatcccagcttctcagagggcagtgtctcggcagctgcagtcatctcggaccaatcttgagctgcctgatgtgagattttccagggggcagcaaatgaacaggagctggaatagcgaagatgacatagtgatctttaggacttcatctgattcttatgagattaataaccctggcttttcaaagaacaacaaggggaagtccatttcattggcactgcaggcaaaggtgaatgtgcaaaagagagaaggattgggttcttctgggaagaattcaggaggacagaaagatcgtgatgagtgcagaacaagccaaccttttaggagtcagtccaatgcccagaagaataagcagcagaagaagccgtcatcatcaggtacttcctcccctgtccttaggcaaaacaaccagaaacaaaattctatggtaagcagaggaaagtcagcaccaaacaaatcagtctcaagccagcaaggtagaaagatggctggagattcctcaactgggaagctgaagaatgcaagcaaaatatctaaaggtggcagcagaaaggatattgtagaaagcataagttgtgataaggaaggttcatcgtcaaacaacaaggactttccacaaaagaagcgtttgatagagaggaactccaccaatgagaagggtatgttcgtgcctgaaaaatcagcagctagacttcagaagcaagttcaacctaatgttgtcatggatgagcacattaagtggaacaacgatagtaaagattctacagatgtagtatcatttacctttacctcaccattggttaaaccatcagcaggaccctccagactgtcagggaagtgggatacaagaagcaattttaatttggatgccataaatgagaaggatgattcagacaaaaagtccgaagggctctcatcagtaggattgaactttgtaaatggtgatgctttgagccttctcctagaaaagaaactaaaggagctaacatcaaagattgagccatccatcaactttactaggggcgacacatttgtgcccgcaaacttttccttggaagagcccgtggtctcctcttccagcaattgggatatggaaagcggagtatttgactgcagcccttctgaaggaaaaccttctcaatatgttgattattgccaatcagcgcagtcatcaaccaaaggccaaattttccgtggaagtaaattacaggtaaacaatagcacagagccacacactacccctgttagaacaaaagtatacttccatgctggcaggaataatcattttttcagtctatattcatcatttatctttgacaaaacattttttgaagaacttcctctttatgttaaaatagaaaatttggtcagcatatccattacatatttaaatagcatttttagggcctaatgtttttacttgaaatctttattttcaatgattgaacactcatttgctgcatactggggaccaccctaatgtttatgaagaaacatcaagcttccctccataaatctgtaaattccgtcattgtgttattgaagaaaaagatgatacagttccaaccttctgcaggctgacatttttttactgttttttgaagtttgaactctctgttgtgttgaacataaacattataagtgtgtatttatgatttaagtgattccattaccagctctcgtcatttgttcattatgcttgtcttctccaccttgatcctcgaatattttgcttctcgggtagttaggtgttggtgctgagccatgtacatgtccagtagatttctctgtgttatggcacatagattattctattatactagtgttattgattttggtatgtctgtttgtgtggcatctcctagctagtgttattttatttctgagaaaattcacatctgggtgtagtatttgttatgctatgtctgtttatgtgggcatcacctagcttgagttattttagttctgaagaaattccatttcatcttaggtggaggaaccagaagaatgcagcagcataagcaacgcaaggaaagaacaggagcatgaagatttaagtcccctctctgttcttgaaccaacctttctaaatgagagttgctggtcttctgattgctgctcaggcagtagcgatggtaattcaacttattgaaattctataatttgtaatttctaactgtaccatttaccttttcctgagtctaagtcatgcttagtctttacaggaagcaaaggatattcatcatcttctgaagttaaaaacatgccaaagaatttcctaagcaatccaccatcagtggatgctgaggccaagacaacagattcagtgtcttcttcatcgattgatgcatcagacacctcagcatcaatagatgcgtcggacatctcagatatcacccaatgttcaaagaaatctagaaactcagagctggagtacattggggatgttctaggcaatgtcaacctgacaaagggtggattggggtcattattcatcagtcaagatgatgtatcggtgatggacccccacctctttaacaaattggagagcatgaacttgtatacacaagggaaaaaaaatttggaccggcgagggtacagaaagctcctgttcgactgcgtaagtgaatgcctggagacgagacgtctcacatacttcagggcaggatatgcagcatggagcaaagggatggcagcgatgagcaggggcatagaaactgaagtctgcaatgagataggtggttggaggagcatgggcgaatgggtggaggatgaacttgtcgacaaggacatgagcagtgggctgggcacatgggttgattttcgggtggaggagttcgagacaggagaagagttggagagggaaatactgagctcactggtcgacgaggtgatcggcgacgtctttgtgagacgacgggacggcaggagtgtaaatttgtaatctgatctcgagtgttgttgtttttgttctgtaattttgttttgttaagttatatccatccctatttgatttgtcgaccagacttgatcaaatcagttatatatatgtgttgatttgagactgcatagtaatctcaatcaattcaaatactgaatgtgctccccttggccgagatgatttcaaggactgcaagttcaagtgacaatgttatactgggtaatactagtgcatttgaacgttcttatacctgccaatgtaatgcaaaggttatctctacaagctgaagccaccagttattactagtaataaactgggaattgatttgcgcctcacaagttgctggaatgctcttggtgatggacataaaacccctcaggttcagcatgatgtgttgatgtggtcttcataaataagaaggttaggatcatattcatgggcgtgccgacaggtcacgctgtcctggcctagcattctcgctagaagccagatgccagcattatttgtccaatgccatcgagatcctatcctatacatttgatgtgtgatgttatttggttctgatccagttctgcagttcctgtgttttaacattggttgatgcagttcctgtatttttctgcaactgcaatctgttagtttgtgacatcatgctatactgtactactccatccctcctaaaatataatcattctagctttagtattagtttaagtaagtttatctaacacgtcaaataagtttaaaatttttagttgaaaccaagtattcactatcgtaaatataattcagttgatctaataaggatgttcactatcataaatatataagcttaggatggtttgatttagaacaaaactatacaagtgattatattttttagagcgatgaagtagctttttgcatgtggggcgcgatcgaaacacgtgatatatggtttctccagcgaagtttgatggcggcggcaacgggataaaatagaggactcgactctgtcaccgtgaaaatgggcgacctacaaaactgagagactggcctacatatggtgttgggcttgtggagggatcggactaactgttcggtgtgattgcaccataccttctcttaatttcaaaatatgggaattctacaactaagatttttttttaaaaaaaatacgtactagaccgatatatcttttcagtgcgattgcactgtaccttctcttaatttcaaaatatgggaaattctacaactaagattttttttttgaaaactatgtactagaccgatatatcttgagattgatgaagtcatcacatgcatacagctgtcgacagttatgccatctgccattgaaatatccgtaaatagtagaacatgtgtcaagtctataactaagggcttgttcactttatagccattttgaaccattccaaaatttggcatttccaaaattttggcaaaatgacaacattatcaaattttagtagcatatattaaatgtgatattgttaaatatattgtattattaagatagttttgaaatgaggcaccacattcgctgtgggggttagaaattctcatattaatcggagaaaaagaaaagcagagtccaaatagaaatacaatttagaaataactgaaattcagaattaaaaataagtaatattgaaataacagtccatataagaacccaatataagattaatagaaatttagaataaaaaataaaaatcgaaattagaaaaaagaaagaaagaagagttaagtagaaatacaattttaaaataactgaaattcagattgaaaaataagcaatattaaaagaatagtccatataagaatgcaatacgagtttaattaaaatccagaataaaaaataaaatccaaaactagaaaaaaaatcaagtaagaatacaattttgaaacaactgaaattgaaaataaaaaataaaataaattcgaaaactagaaaaaaggaaataagagttcaactacaaatacaatttataaataactaaaattgataataaaaataaatactattgaaagaagagaccgtctagaactcgagtaatcttggatatggtcttttctcggtcgatgcattcccttctagggtcgaagtaaaaaccgctcctcactagtttaccgaaattcaacaaaaaccgataaaaaccgatgagtttcgatcaacgccgtataaaaaccggctgatactgactggttttcataaaccgagaccttgcagtttcacgaaatccgattgattttcgtgaaattccatcggttttgtgaaccccgttgtacacctaggacggtagatagtctataactattcttgcactatttgaaaatttgatgtacggtaaaagaataacggttttgaattttttaaaagaactggtttatgtttcttaggatagtgagtctatatgcaagataagttcgttacgattttaggtcattttgtaaatccgaagacatcatttactacttactgtagaacagtacaacaagaaaaaaatatcttcaaaacataaaaatattatggaaccggaagggcgctacgcatcagatgtcctgagatttgcattatatgttaaaaaatgttgcaatgtttcattgctcgaaaaaaatgtttcaacatgaattgttttatgatgtttcatctttcactgaagaatgtttcaccgctttaacgaaaatgtttcaatcaaatgtaacactcaagaacggtaacaacaacaacaaaaacacattatgtgcaacatccaatattgatttaaaaaacatttagaaaagacatattgcaacatcgcaaaaacactgtatgcaacaatgctcgctagctcgacctcgtccgagcgccgccaccggagcctaggcacagtggaggcgtgcttcgcccctacctcccctcgggccgccgcaccgccgcgcttctctgctccggcaccgccaccgcctcgtcgctccgcgtccgcccgcttcttgtcgttgctagcacacacatggggagataagagagaaaaatgaatggttggaaataaagattagattgactgccggagaaagaagatagagagagtagttaggtgggacccactaggttagcgtccgattttttatcatatgccggacgtacgagttaaagcattttcggaagaataccagtactaccgctctagacatgtactccctccgtttcaggtcataagatgttttaactttggtcaaagtcaaaccgcttcaagtttgcccaagtttatataaaaaaatagtaatatttttgacttgagatattataaaattatatgtaattattaattaaaaaaactaatttagtaatgtaaatattattatatttatctataaacgtagataaatttaaagcagtttgtgttggactattcttatagcttgaaacggagctgagtatcttaccactgttgtaaatttgttgtgaaccttgtgatgccctcgctggactgttccttggatcaaagacgtggcggcagtaggcacaccgcccaagttggattagttggagcagtaaatactatacaccccatccaaggaggcgtagcggctgacccacccccccnnntnnnnannatnccatacatttcaccgcccctgccttctcctcttctctctctctctccnntcataacccctcccatcccatctccctccaccttcccaaatcccaaccctcnttccattccatcccacccccccgccactccatccaaaggcgcgccnaggcgccatggacgactacattcgacagcatctgctccaccccattctccagcgcgccgtccagccccggcaggtcgcctgccaccggcggcggctacttcttcagcgcgccggccagccccatccaccacctgctcctctcctcctcctcggttgcctccggtgtggtgtcgggggcggggtatggcggcgtgggcgatgcggagttcgagttcggcggccccggcgggcccatgatctccgccgacgagctcttccacaacggccagatccggccgctcaccctgcccccgctcccggatctcgaccccggcagcgacgacgacgacggcggcggcggcgacttccgccccgggccggtgcgaggccgcgagctgacgctgcggagcgggtccgtgcaccgccgcacgcggtccatgtcgccgctccgcggcgcgtccccgcggctcaagctgctcaatgcgctcgtccccgccccggatcttggctccgagccaactccatcgcactcggctgggtcggaggaggccacgccaccggtcaccgcctcgtcacgctcgtcctcctcctcctcgacgtcctcgtcctcgtcctcctcgtcgtccgcccgcgggtcacggcggtgggtgttcctcaaggacatgctcctccaccgcagcaagagcgagccaggcggagcccacgcgcacgacgcccccgccaagcccgagaaggcgtggcagttctcgccctcgtgggcatcatcgagagacaggatcgccgcaaagctccgcgcggcgaggtcaccactaccaccacagccacaatcggaagcgtcgtcggacgccggcggcggcgaagaggcgcaggcgacgcgggggcgcgcgaggggcggcaagggcaggcggcgctcgagcacggtcgcggcggcgcacgagcgtctctacgcggcgcggaaccgggcgcaggcggaggagatgcggcggcgcacgttcctcccctaccggcagggcctcctcggctgcctcggcttcagctcccgcggttacggcgcgctccacggcttcacaaaaaccctcaaccccgtcttctcccggtaaaaaccaaaggcaaacgcctcatcggccaaaaaaactccaaaatagagagcaaatgggaagagcttaaccaagttcttcgctgttgcccgttaattaattaatattattatttcctgtgtaagcgaagcttgtactactttgtttttttttcttttcctttttctgccttcgatttgtgcttgggttttgtataggcaggcagcgtgagagggataacaggattcctcccttcgttcggaggcgttggtggtagtagtagttgtcacaggtcagtcacatcaactggaaacatcagcggttggtaaatgtggcgcgaagcagaatgcctggtgatttttttccccttcccctacccattcttgtgtgcatggaactatcatctcaaccctgtactactcgtagtaagtggagtatatacacgttctactaagtgtcatcttcacatgagattcttgtcactgcattgtgtgtgtcaaagcacacatgagtatactagcagtattacgtacacgagcttttgcctactccaatgcgttagatttgcttttggtgaagagccgtacggccgcagcaaagcaccacctttcctttcccgagccacggtacgaaacaaaaagatcgcccacgcctccacgcgcaccggttccaatttccaaggttcgtccgacttccgctgctcgccacgagccccgggagttggcgtcaccagtcaccaccaccaccaagcatatcgtgtccgtgtcacggtggagccccgcgcgcgggccagccgcgtgagtgatgaatgaatactagtacaacaagcaggcaagcggagggggcgcacgatccacatggggggcgggggcctcacgccgggcacgtgccgtgtcggggtggtggtggtggtggtgcccgagtcgtcgtcctcctcggctcgacggctcgccctcccctcctccagtccagctgccgccgcataattggggtgtttttcgagatccgcagcgcgcgtgcggacggggaaaaaaatgggggaaaaaaatggggttccaccccgcgctgactgacgtgcgggcgccgcgggagggtgttcatccatgatcgcgcggtttatccggtcaatctcgagttcgcgacgtgtactgtgtacatgagttgctgctaataaatatattgtcccttgaacaaaccgatcgataagtatatgatcgcgaaaaggtacaacttgattaatcttatgtgctcggatgaaggtgcggttcttattaggggaaaaaaagatgatctgttttaagtgtttgttaggagacgacgtggtaggcattttgagctgacaagtacactcctttaaaaggcttttgatctagtttagtcctgtacatgcatggatgaagctagcgttaattagttatcacaacattaaccactcttccagatcagtactagtactcgtcatcacaggaacgggcttcatcttgcacgtgttaatctagctgtcgatcgagcttaattatctttcttctcttttttgcgaacggtacattcagcaatacagttgttgtcttaatcttcagggtgctgctggactgcggccatgacagatgcttagtccgcatgggtcatggctacggtctacgtagcgcgacgtgttaaccgattgtatcagtgggcacagcaatcggccaaaagatgaataatggaggaacaagctgatttgtttttcctgaaaagtttgggggacccaacaaataaacgtatcactgttgccgttagtaaatttctcttccagaagatccaaccagctagctgagatgtgtaaaagaaaacggagcaactgatctccatacaagatgctttacttcgactctgcagagtgcagatcgatactatatactgctactagtatacaacagtgtccgaacacttaatttctgttgtgcctcctgacgtctacgactcgcatacaatgcaccacagcggcagcatgattagcgacgctccaacgccaattaaaacagaccgagcaagagaactcaaaacagctcgccgatgagatcgctgtgcgatgaacgccaccggacaaacctgcatcatgccgccgcacagtcccggccggtgagcaatccaattcgcgcccaccggcagagattatatacatatgggccctgaaatccccgattatattctcgattagcatgaacaaacacgtattagcggcccaaagctcgtacgcagcgcgacccttgttcgatcgatcggccgccgcgacatcaatacaactgcatgcgaccatgatccatccacgcataggaggtttgatggtgagacgtcgccatggatgaggaatttctcggagagttcagagactttcagttaagttccagacgcgaggctgggtttagccaggtcatgtgagcgcatgtgatcggccatcaatctccttgccacaagctgacagtcgcgcagtggctggccggctgctacaatggattggtcccgcggctctcgtacgcacgctgcggcgcagacacgcacaattatttgaggggtgtacccgcgtacatagaggctaaaaagactcacaatgagtgaccccggtttgacgtagctagtagatcgatcgatcgcaaaataattgctgaaaaggagacacgtgaatttgtacacatagtgggaggaaaaagctgaaccagttcagtcctaccttagtgcaaatgatatccccttcctgtagagatcaaaagtcagttcacggcttatggcagatccacaattaatacaggtaggagtaggagtttagctacaggctagtagaaacaatacactgtaattagctaggactagggtagtataagtacactgtgattacactgtataagtctaggtaacgagggagcaaagtcagccctaatcttgtgcaccaaaaatctgactgtaatcaaagtaaaattatgtcgtcataaatatagcaataccgctggaagaaagcaccgaattgacagcatcctaaatatctttgatcatgatttagcacgctagagtaacgccatcgacgaacgggcgtacccgtacatgggcagcatcgactgatcgatctcgcacccccatttattcagaagatcttaagaatctgacgcgagtgcctgattcagactgcgacaccgaaattgaatcgatagttgggaatgctagctagccaagccacacacgtccgagcgctgccctgttcaccgatggatgagctggtacggctgtgccgatagatcgctttacctgccgtactggactaccggtagcgatcgccgacgctacagtcgccggacgctgacctcgcagcgagcgctcgccacggcgtttgtcccccgcgagacctgacggagcgagacctcacggagcggacgagcatgccccgccagaggcgcgtactagctccagatgcgcgcctgattcgatcgggacggcttgtttggctccccgtctccggcgccggtccgggctggccagtggccactcgtggctcgttgattgctgccgcgcgtgtgctcatcagctcgcgtaggatctaaacgtgttaacgttgatggcgtccttgttggccacgggtcacgggtgttctgaatttctggagtagtcgatgtccaccatgctttgtttacatcgcgaccgctgtactggtaacttgcagagttttgcgtctttgttgcgccaggtttggctctgaaattatcactgtcaatgtcttgaaggtgtcgtccggtccatcgatgattcgatggagtgatctcatcttacgacaataagaagtcgatgatttggtggcggcacaagtggacaatttctctggactatcaatagtacgtacgatagcattgtacgtagcgtgcgtagtttcattcaatagagtgaggaaaaatttcaaggctagcacccaggtaagacagtagcaaggaacgaaaaaagaaagccccagcatgcactggtagcgcctacacacaactcacaagaaggctagcaccggaccgactgtcactagaccaacaacgaagctacagtcggaccgctcaaaaccaaaacctaatagacgagcaccacactcaactctatccccgcctttgggattgaaaggagagagagtgagagagaagaatgaaaccgctcttccccacaaggcccaccaacatagccaacttataaagctaaggcaccgctacaagaggataaacatctagagagagcatgcacaaattgttggagagacgttttggtaggggtctcctagacgacatctccaagaagaagagcgacgatgagtactaacgccgtcatccgtcgaggtctcaagaaaaccaggagtccaggacatggttttcacccagcagccccactaaagggagaggaacgactcattaatgcccccaagaggaagaacaacgcccgaagcaccattgtttctcctatcgatctgaagctatcgctccatttctccaccaccggtcattctctgtcagtgtatggacatcgtcgtgccaacgcctcctgccggcaaacctctacatgcctttgtggaatacccgctgtcatcagcctccctatcgtcgccacaccggccgtcttaccatcgccgtcgcccacactgacctcccgacgccacccacgccggtcttccacaaccatcatcgtctctgacaagccccctgccaccactgtctatgtaccgtgccgctcgaccagatccgtcgtaggggctcccgtgggctccaccatcgtcatcgtccatgcacaaatgtgcccgtcagcaccatcgccgtcttctccaatgccgatgctccctgtcgtcactgtcgctgtcgctgaggttcgccacatggggaagggggactacctcccttgttggagaggccaagtcttgacggaggggcgctgaaattggccagaggggcatcagatctagcggctccgttcatggtgcgctccctctaccctatcacctttcctcctcgtgccgcctccacgctctcagcctcgctgcttgcatctcgtcctccacccttgcagtctcgccctcctcggaggcaccatgcctcctccgcgcgagcacaccgcaggactcctctgtcatcgacgacatcctcctcctactccccatcgccacaacctcctcctcctgcccggtgatgcgtggtcagtgccgccccctcccaatctggccacgagggggcaaattccgtctctggtcggatatgccgcaaccggccccgacagcgtcggacctagccgctgttgcttgccgcccctccactcgaaccttgtcagcgccccagccaccaagtcttgcgtgaagggagaacgtcctgccaccgccatccttgccgccgcccagctttgcctacggttgctcgggcagcggagagaaggaaggtggggcagtggcgggactgcgacgtcacctcccgtgtcattttggagcagagcgacacgagagtcaagttagcaacatagtactagtagtataataacacttgtagtatcgccttcagtttactaaggttgtgtttagttcacaccaaaattgaaagtttggttgaaattgaaaatgatgtgacggaaacgttagaagtttgtgtgtaggaaagttttgatgtgatggaaaagttgaaagtttgaagaattattttggaactaaacacggcgtaaagacgacacgaaacctcgtgatgggctgatgtctcgtcactgcagaaacgctgtaatatgcccatgtcgaccacgaaatctatatgccattgcttgttgctgggtgctactcttctcgctggaacagttgcatcccatacggaatgtgactgaactgacgagaatgactgtaccaaacttattcttacacactgggtgggtttaattcacatcaaaactggaagtttgattgaaattggaacgatgtgacggaaaagttgaaagtttatgtgtgcaaaaatgttttaatgtgatgaaaaagttggaagtttgaagaaaaagttaggaactaaaccaggccactgtcctggagaaacagacaatacagaactggtgaaaaactctattagggttcaggaacatctttcagacttgttttattggtgagaaacaaacaatagtctcctcttctccatctaaaatgcaattagctcaatcttgttgtaaaatcaaaggtgtttttgattattattctgtgatgaacaattgggcattggagattattggttttgttatttagaatttattcacgaggtggttttggagatgattggatttcacaggtgatcacaggattcgtcattttatgtgaccggtcagaccggactctggtagctggtcagaccggcgtgtattgcacggtcagatcggcgtagcccgcggtctgaccggccgtactgtgtcggtttcggtttcgggttgtttacttggatattcgtgattatttcataattatggcttctagatggatactatacgtatgtattactgttgtttgctactaatgagtcaagttggagattgcttggtctcggaatatggtttctttgtttatttgatgtgtatgtgacttgatgcctcgggagagtatttgcggtgatggaccggaagtcggcttgaggataagacgacgtccgtggtggtcagagatcatgcaggatacttaggctagaattgatgcacatggttgatggagattccatatggcatacgatgaaggtattgtgtgcgtatgggatgcggagtcgaatttagaaggagtccaaatttggtacgattggttatgtaaagtttctttcttgtactagtgggtttcctaaggtgtttaggactcctagtatgagtttggttcgtggttttaggctgcctacctcatgtataaatacagggggagcgtgaggcttcccggtatcactttacagagcaattgagttgagttttgagttagggtttcgagtttagtcgaaattttgtaaggagtgctgttggtgcactttgtaaacaaagagagaatcaataaagttgtcatccactttaagagttcttcgatttgtgtttcaccgagtttcggcggtccaaccagcgatataccggtggtccgactagcggcaagcggcggtcagaccggcggcggcgacagtgagcggcagctgatctcgacggtcagaccgatcgatctacatcggttagaccgacgttcatcaggcggtcagaccggtgcatacactttggtcagaccgcgatccgtcgaattcgagggtaacttttatttccgctaaaagttttcggtttttgggtataccaaccattcaccccccctctggttggcttagttcttgtgattcgatcctacaagtggtatcagatccttgttttcttctttggatttttatcaatctagagtttttgccatggttactcccgctatgttttcaactaagcctcatgttttcgatggaacggatttttgtcattggtgtagtagaatacaatcttacattatggctgaagattatgatatttggacaaaaagtttctcatccttatgttattcctgaagagattaatactgctgctttaaaaactgagtttgaacaaaattacaaagctcgcaatattcttttgagtgggatttctcgttcggattatgatcgtgttgctcatcttcgaactgctcatgaaatttggaatgccttgagtaattttcatcaaggaacaaataatattaaagaacttcgtcgtgatcttttcaaaaaggaatatattaaatttgagatgaaacctggagaagctttggatgactatctttctcggtttaataaaattttgattgatcttagatctgttgattcttcttatgatactaattatccacaacctgagatttctcgtcactttttgaatggtcttgacatgtctatttgggagatgaaagttacatctattcaggagtctgttaacatgtctactttgctttgaattcgctttacactaaattgaaaacacatgagatgaatcttctttctcgaaaagttgattgtaagtcgagtgctttggtttcttcttcttcttctttggatgttgatgcttcttcatctaagcctttttttcttgctgtttttaatgccacatccgatgatcaactcgaacaaatcgaggaggaggatttggctttggttgctaacagaattgctcgagctatgaataatgccaggaacaggaaatgaggtggtccaaatcgttgctttgaatgcggttcaattgatcatcttcgttcgcattgtcctaagcttggaagaggcaaaagagaagacaaagatggtgataagaccaacaacaacaagccgaagggttcataccaaaggaggaagatggagaatcttaggaaggcttttcaacaagtttgcgccgccttcgagccactaagtgatgtagatggtgaaagtagagatgatgataagggaaagaacatctctgatgtttgcttcatggcgtgtggtgaatctgacacagagtatgaagataatgaggctttggtggcaaggaaggagaacgtgtggatcgtggattccggttgttcgcggcacatgaccggtgataaaaattggttctcctccctcaagaaggcatctaagactgaatctattatcttcggtgatgcttctacaagtgtcgttctcgctacaggtttggttaagataaataaaaattttgaattgaagaatgtagctttggttgaggacttaaagtacaatttgctttcggtttcacaaattgttgatgaaaattttgaggttcactttaagaaaactggaagtaaagtttttgattcttgtggtgattctgtgttgaatatttctcgctatgaaagaatgtttaaagctgattttaaaaatcctgtttcacctgtgataacatgtttggttgctaagtttgataaagatgtgatgttttggcatcgtagacttggacatgttggttttgattatttcactaggttaagtggtttggatcttgttcgtggttg

SEQ ID NO: 66235 - DNA, 2093 bp, Oryza sativa
ccagggagacagtatatctttagtggatgacattgacaggcatggcaggcgcgtcagaaccgtagggttaaataaagacggtgagcgaggttagagttgaggccgtcaaatctaaaatggttagaaggtggagggtgatggtggtaacttggcgacgagaccgccataacaagaaaataatggtcgtgtaggggaacctcgccgcagtttggaggaggagaggaggtgtggatgggaaagggaagggggcaaattccaatagaacaagtctcaccccaacgaggcagataacgcaccatgcttgttagaaatcaagtggcgcatgcattgtgggacagaaaagaagaggggaaatgttactgtagctgttcaaatttgcgcaatttatatatgctgggaaaaactaactttaagtttgaatggcgtactgaggaatggatagtctcaataattagtatgcatattaataggagttaggagtaatatctacagaatcccttttgtttgtatactctaaattcgtgcacatgccctactggcatgctcatttaattccaattaaatttatatatataatattaggaataattttaggaagatagcccacttgtcttcttggcaatcataagggcattaataaggggtgaaagtttggttgaggtaagattaaacaaaaattaaatgaattgcactgcaattttgaacttgagaattagctacaggagtacattttaggatgggagtagtagctatttgttctatggtgcatttgcttgggggagttgagggcatgcgagtttaaagggataaagttattattttcttgcttagttttagagaagaataaattgcattagcggtacatgaacatgtcaagtaggtgaaatttagtgtatcaacttgtaaaatactcattttggtttatgaacttgtctgatacagtaaactaaggctaaaatggcacggtaagacccatttttatatggtgaacattataaattataaattagtagatgatgtgcgtgcttacagtatgtaggttatatttgtaaacttagtttccactttatctttctttgtttctttcccttacactattacttggtttttgtatgcaatcattacaccttattatatgtttatccttattagacacatgttcacagtgagtttaaatcaacaaaattaatcttgccatgtgattttgatgttcttcacacacaccaaacaagtttgtgcatcaaaacgagcattttacaagtccatgcatgcaatttactcttttgagaattaaggagagagcctcctactcccttcatacttatcgtagtgaacaatgctattgttaaattttaaaaactttatctataatggatttgccggctcagttttcgaagatgctcataggggtagggtttacgtacgtgcgttcatagaggtgaatgtgcgtgcgttgtgagtgtctgcgttgtactgtgtaattttaaaaaaataacatctaaaatatttatcttaaaattataaaaactagtattaaaattaattcaataaaatcatatatttattattttttatatgttgtaataaaaaatggtcaaaataatttttgaagaccaacttcttatctaaaccgataagtattatcaactcggaaggaacactttttaatatctagataatgggtgagaggtgagagggaatgccctcgatacatcttacaaatctcagttcttacttgaaatctattacatagaactctcaataattaccaatacttcagtcaaactagaggatgggacttaaaaaaaaatcaaactcatatcaattttaccaccggtaatttctctagactcctaatattctcatccaaagtcgatactccgtttaggtttgtttggcaaatgggataagaaaatagtatctcctgatattctcatctaaaatcatagccatctattcttcacacctcattcaatcctagccattcatccactttctttttttttttctgatcccacatcttataatccatttgtcaaacgtaccctctgttcgaaaatgcaaaaactagccgagatttgagaaaaaaaaac

SEQ ID NO: 66236 - DNA, 2451 bp, Oryza sativa
gtagacgcccaacagcggcggcataataggccaaccgtgtaggcggaggcaccactcggcggcgacggaggcaggccggcggtgaagtcgtagacgcccaacagcggcggtataataggccagccgtgtagacggaggtaccactcggcgacgacggaggcaagccggcggtgaagtcgtagatgcccaacagcggcggcataataggccagccgtgtaggcggaggcaccagtcggcggcagacgaggcggccggcggtgaagtcgttgttgttatcagcaatggcagtggcgaagacaagccggcagagtggactcgtggccgatcgaccggaaagcttcatggtccaaaattgattggttgcatgcatgtgtgccaagtgttcggtccgcagtgcatgctatctcttgtcttgactgagcctgcaggatccaaatctggacttccacaaccccgatatgaaatttatatgtacgcaagatgttaatggcttataacacattgtccggttggcaataggtacgcgaatgagcatgaacgacgtttcgaggggtgttgtcaaagaaaaacaaaggtaagaaccactttggcaacaaattcgacaaggtcatcagcgattcttatacgagtctacgcaacggtcactaaagttccaatagcatgtgaagctataaacatatcattcaggttcctaggcatcaaacttcgccaatgttacttagggtgtgtttgtgaggaggggaaaagagaatatacgcaaaaaagggtgagtcatcagcgtatgattagttgagtgttaattattttataccttaaaaatggattagtaggattttttaaccaacttttgtgttgaattgtcttgcgaaaaacacaccgtttagcagttcgagaagcgtgcgcgcggcgaatgtcgcgaccgggaaaattgccttttcccgaacgctagtgtattaatccccgtcccaggaaaagccggggtacaccatacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacttcttctccaaagcttctcttactgaagaggggaaggattgagcaagaatgagtacaaccacagtactcagcaagccacaccggcagatgcatgattaatgcaagggggtacaaggagtaataatataggggttaagttttgcagaaaagcagcatttaaaagtcacttagttgcccaaagccattttataaagacgatcctagagctacacagtattattaaacaaggccgtgaaccctcacgaacctgccttaacccaaggcctatgatgattcagaccgaactggcaacccgaccctgggtcccagctcgtcctaagccaacccaggccaaccattccacattttagttgttgagcaaaattttaagaattataacactgacttgggtacattgctcggcttgcccataaccgagggctcggctattcgaatagattatactctgatcagaggtgtacatctttacccacaagacacgtcttcctcacgtgtaaccacgtgccacataccaccacggtatacagacggaagacgtgacatagtttctaacccatcctagccttagacaagagtaccgacccaattccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccagagtgtccaggtgatatgaaaatttcccaaagtctatagttgtaaaaccacctaaggttacctaattagattgcgaagcatctacctaaaattaaactagtggtgtcatgagtagagagtccactagttgaggttttgtttgcctagagtgaacaaggtagtaataataacaataacaataataatatggtcataacaaaggtaaataggcatggctaagtaaaacagtgataacgcgggaatttaaataaagcgataatgcaataatttaaatcaacataagtttataaaatgggattcaatatgatcaag

SEQ ID NO: 66237 - DNA, 2628 bp, Oryza sativa
ttttgccacctacatctgatttgctaattgcaactcttctagttctagcttatcatcacccaaattaattaacccttgattaaaagccaaagctattaattatattccaactccaagtaaattcaattcctccccatctagctaggcagctagcctttaaaaccatgcacaccttcaagatacccaagcaaggagatacccttgtcatccaatggaatggatgattcccttttggctccttttgttttgagataacagtacggcttataatatattctcctgtgctaattaaattagggttcatgctgagctagtactactcactagtactgatgtgagaggagaatgttgggtgacatgtataaagtcttctctgtgttgaactggacacgtttccagttttaagaggctgcttagatggctaggaaataaacaagagatggacacatggcaaacagctagcttaattagatgcctttctgtttttaatctgtattttcttcagatagtacatgtacgagtagctagcagaaaaaggtgttaagctttatttcatcattatttgggagttaaacctaatgaaagatgtactatgaataaaattaatattaattagcaatatattaagatatatacagatgagttagacttttgatgagaagcgtaaataaatatcttggggggcaccccgcatgctttcccaaataactcaacgtgatttttaatgggctaatgattcgccttatataagcatatgagagctaagctaccatatatatatatatatatatatatatatatatatatatatatatatatatatatatatatatatatatatatatatataaaattaactattgctgatagtttgacgaaaagccgtgatcttgttaaagcgatatattctcatatctatatcacccgttcttcttggtctaatacaatgttctagaagtgggtaatatgtgaaaaaagggaaaagttctctttccaagaattacatatatactatgcaaattaaaacatttgttacatgaaaaaaaagcatttcctatacaacaaaatatcaaatcatgctgtgttttttgccagaagaatttcctatacaacaaaatatcaaatgcaacaaaatatcaaatgctctctcaagaacacctaagagtttagggaatcaagcgagacacatcgcctactgcaacagcggaatgagcacccgcatcggctgggcaccgcagggtacatcggcaaggaggcaatatgggcccaagaagatgcagccgctgcagcagcgaatgtccatgccccgttttcagacatccctgaacaaagagctcgcaactgggcgcgggcaaggggtaaggtcaacccggatggctctgtcacatttgagaacaaaagagatgccgtcgtctatcaggaactggtgagttcactacttaacctaactaatttccgttcgtataaagtagaagttcgtataaatgactcttttttttctagttgggcttggttgctgaacaagcttcacaaagcaaggttgagtccgcgccgaagaggcgcgaagatgacatcctcacaaaggcgctcggaaccaaagaacatcctggccggactaggggaattggtagcgatgtgccctggaagcatggactcccgcagtacagttcccaatacaagaaacggaaagtctccaaggaagagagggacgctcgtttgaaggccgaacttaaggttgaggtcattcaagaactagaagctagcatgaacgctagggtggaagaaagggttaacaaggtcctcgccgacatgaatataccccgaggcacaacacctgctgtgcatccaactcctcgtgcacaacacgacgcgagtccgtcacagcataggagtagttgtgcatccacagaggtgctggcccctggtctcccggtcgcaccactagctgcagtggaccacatagaggtaattgatgttatctgatccatatctaataaaaaagcctttacacgttccaatattaaattcaaactttcacatatgtagggcgtagcacagtgtgtcctactggcgagggtccacccaactttcgctcccgaagtcgctgagggcatggctttcaagccctcggttacagacaaggtccacggtgcagacctgctagctgggtatgccaaggtgtccatcgatacagtaaaggacacctggtcaggctatccgctgctcgtgccccccaatgatgaaatcatgactttgggcgatgcgcacaagacgttcatacaatggcctaaagaagacatagttgtgaagatgactcctcgtccaagtcgaccgacggagcttacacctcccaagtctaagctatcaattgaggctccccgtggaccggcattgtcagtacctcattctcctggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggcagcgacatcgatgccggtgagcaaagcggggaaggtcgtgagggcgccagcccaa

SEQ ID NO: 66238 - DNA, 2486 bp, Oryza sativa
  unsure (1)..(2486): unsure at all n locations
gctgcttctgaagaataatcttgttgttcaaatgttcttcccaagctcgaccttcttaaccagccgcaaggtgttgtggaagatggaatccagtattccagcaacctagaattcgcatgtcatttcattagccatgtacacttgatggattcagagaaaaggaaaagataaaaaaagggtgtgtgctctcaccgtgaaaactcctccaatgatagcacaaacatttgtgatgaaatgggagaaggattttggaagttcagttaccaagaccttggaagtgatgataaaataagaattagtttttctttcagttatgaaccaaacgaagaaaaggtgagatgccaacctgcatgggagaaggttcaaaatggaatttcacaacaggaacatagaagctgtgcaccaagctgctgtgcgctgtgtattcatactcctcaaccagtttcaattcctttgatgatctcagtgtaacaagctcagttttcacaatttgcaggtaatgctcaatctaagaatgacaaaaaacaaaaactatgttactccataagaaaccagaaaatttagtgctggaaggcatgcctgctgtaatcatcttgataacaaaaacaaagcaaaatttagggacttacagtaacgttggcattgacatcaccatgcttaacaatgtaggattgaccagctaatctatcatggtggccaccaacatagggagttagtcttttcagttcattaaacatctttgccgatagccttttgccaaaagagaactgtgttacatagtgggaaacatttatctgggatggatcaaaggagtgggaaccagatcgagctgagattacaacactcccagggacctgataaagaggaaccagaaatcaaataccacagatagagatcatcatcaacactacaactattacacctcagaagttcatttaccttttttacccgcacaaaaccttctattctgcatccactggtcaatggagcagggcgttttgcaggatcaacagtcttattggatttgtcctccaaagctagaacatgggcatcttttgggatgtttgcaacataagtttccattgcctgaggcccaaaaaaatgtcaggaattttatccacaatttgacaagaccatgaacaaagtcagtgatttacaagcaaaggatagttagccttttgttctccctaggaaaatggggacaataccttttacaggtaagctaaagcttagggtgaagaatatatcatgcagtacatcaagaaaaataagtgggtaacagaatatacataccgctactaaactctcagtatcacgatcgccgtagtatgattcatgatcatggtgaccctggttttccctgcacaaatgtcaatttgtttgtttctggaacatgagcaaaaaaataataataatacaagtcttgcgccacaggttaactctcagtagagtatccggaagactgtaagatttacttgaacttacttaagatcactccctttacggaaaatgcgaatggatggataaccttgtatatggtgcctgcatttaataaattaaaacaatgaactgtagtccttaatttaatgacgaacaagcataacaagagcacatataattaggtaaaactagtgggagaacaatttaaggcttctattgaggagttgtggttcacatccaatgcgcatagcttgaaatgttactatgtgcatcaatggcaatggcactattacacagaaaccagtgtcatcagaagcagaatggctcattttcttataaaaacatggtcagtaacaattagggttgtgatctatggaataaaggcttttgaatcattccaaatgcaaacaagtccagaaggcataagcatccactgaaccaggataagaggacacaaacacgaatagctcatgaaagatgtggcataataatgacactttgttggggatattaaaaactagagtaaagtccatcaccgcnnncttgacatgtgtttnaaaggcaatgcggtccctagacgttcttgtatagcgagataatacattagcttgtgcgactgagtatcccggaaggattagcgatatgagcgcattcttattggagcaaatcagttcatgcttttgacttaatgcattatacgataagctacacaatctccgttgtagttatgaatttaaaattatatattattatgaaccgaataaatagttttccatgaagactcgcaatgctgatggggacaaaatataattttagaaccttaggatattccaaagtttggaacttgcataagctgnccccaacccacccaatataccggatggaacaattacaacttagcattgttgctcatgacagtgctcatatactatgagtgcgggttagttcaaactacagacacgtgcggtaattgaatttttttacttttttatattgttcgctaagtggtgtttggatcccagggataaactttacgtgttaatttg

SEQ ID NO: 66239 - DNA, 22687 bp, Oryza sativa
  unsure (1)..(22687): unsure at all n locations
cgtgcgattcgtttgcatgcgctnnnnnnnnnnnnnnnnnnnnnnnncatctgggtcaaataggacggtctaaagactttatatttaaaaataattcataactttttcatgtgaactctaatgaaaacaaactttatatcaaacttgtagccctcgacgcgatctacaactttgtagttgataattcctttattttaagtcattttttgacccaaaatgtaattttaaaattaaaattacaaaatctataaacatgcaacaatattttgggaccctaaacagttttaattcaaaaaattttcaactacaaagttgtaggtcgcgtcgagggctacaattttgatataaagtttgtctttattagagttcacatgaaaaagttatgaattattttttggtataaagtttttagaccgtcctgtttagggaccggggtgacacaactgaacaagttggaggacctaaacgagtgatctgcaagtttagggaccgggatgatacagtcgaacaagtttaaggacctgaatgatcgatttgcgagtttagggaccgggatgacacagcggtacaagtttagggaccggtgatggactttactctaaaaactaattaactaaatttctcttggtacatggatcaaaaagggatttgtaaagttcatgttgcagcctaaatatgctttgtccttgttttggatatgaataataattaagtacagacgaacctcctacacaagtcaatttcttcagtgcagtcaaccttggcaagaatgattctgccatccatttcaggatcatatctgcagaaaaaaaaaacaacatggtatagattaaacagcacattaaaaccacaaaacacaaacaaagagaaacagtatgtacctctccctcattatttttgcagtcttctcccacgaaggtttctggaggaagatcaagtaattagaaatgtctccatttgttagttcaataagccgtgccatacttacattactttaccagcaataatttactaatcatttccttacagatagagtagcatatactagaaaatcactaaatgcaaaggaacaagatgaattctaaccaatcgattgctccagtaacaccagggggcataaaaattaacaaccaaaacaggatacctgaaaaggaagtgcatgataataatcagtggaaacaatatttgggctccgaaacaatacaagagggattaactagatataccgaacggcacttcaaggaaaaatacttgaggcaggtaaaagtgaagattatcaccaatttgccatagacaatctggttgaagtgattggagctatgaatataaagtacatttctccatgaatgtgaaggagaaagaagacagcatacatgaataataggttgaccgttgatatggtattgaaacgcacaattgctaaaatgctatatgttatgtgttacggataggtggatattgaaatacatatttgaatacttactggtgtgaatagctatcaaaattgcgagaggacaagggaactgaaccatcatcatggttttcttcaacatcatctccatgtttgctgaccgtaggaataggtcctgggtggaactcggatccagtaggcactaaattccgatcaattgaatatttgcgaacagttttcggtatgttcaatctgttctgcatgtgttttgaacagaaactttaaggttaaaccagcatggagaaaaactcgagctacaaaaggcaagatatgatcaagaaatgcttatagatagaaagttagttaggaatttaggataggtttcattcttttgacatgcacagaactttacaaaaactgataaattgtcatatttcgtatttttaacattggtgtaaaatatacatgtagagcttacttcctccgtttcacaatgtaagtcattctagcattttccacattcatattgttgttaatgaatctagatagatatatatgtctagattcattaacatcaatatgaatatgggaaatgatagaatgacttacattgtgaaacggagggagtacttttaaaagctagtggaaagttatttgtaatggcaagttaacaagaaaataaagtcaacaatagtttttatggaacgcgcaagatgagcttcatgtccttcaatgatatcctcattctagacggcagatgaacaaaaacagagtacatgaggtcaagttagaatcttactgttcccagaacatcactgacatcaactgatgcaaattcgcatgaaagtgcaggaaagctgtaaatcacagaaccagatcgtgagcatctactggaaaaacaaggaaaagttgagtccagctttgctgatgtcattccatagaaaacaatgggcaaccagctagactaatgtagataccctcctatgcattatcacatacaaataaatgagcagtgcctgactagtccttgtttgctggaaagcatcaatttcaagtataaacaatggctctcaggttcatatagaccaagggttgaaagtgttgagtaaaagaacaacatcagaattattctacaaacatattactacaaatggttggatctggtaattaggtgacctttgaagataaatgaattaactgagaatcatatgtttttttccacaatgcaccaaatgagtacaaatacattgaaaagaatgtactgagtgcctgacattaattaacgctgtgctttgctgttgcatatatagtattccattaaaattaatcacaatagggataaaattactatcagcagattagagaattaggaagacattagttctatgaaccataatgatagcagtattatctatgtgatcatgaaggttctcattttgtattctaaccttattacttgttgagatgtgcagcatgtgccatagaatttaccttaagttaaaatctatccgtaagaactccccatctgaactcctatcaacaatcacagatgtgctagtattgactgctaagtaattactcagttcctgcaataacaattgaacagatttagcttttcagttgaaatgaacctttaaactagtctaaagcttgattaaggaatcagctcagcatagtgaaaagtatagcacattgcaagccttaacaagcaacagccaaaattatgcatatgttccggagtaattacaatatacttgggcatatacattacttaactgccactttcaaggttggatggaccaattgataattcggtcaaaaatattcaaccaaaataggttcagttaagaatctagcctatcatgaagctctaatagtcaattgaaacagatatcaggaaaaacgagctattctcaatcatcaaatgaaacaagcaaatcgagactctacattgatccggcgatagcgattagctacactacagcagttggaatggtagaagacaactaatctgcatataaataaataaatgctctatcattttagtatggctctgtaccaaatttcagtctacaatcaccaaatggaacagaagaacagtccaaccattttttgtttgtttccctaaagactggaaccagagtgaaaaaatgaaatctaaaaataacagtgcaatcgctaatccaacgaaaactgaccattccaaacaaaaacaccatagctagtgctgctacaatggacaatccagccccagatagtgatgcctcggtcaaatccctaggaattttcctgcaagcacgaaaagaaaaagcgcatcaaccaaattacccatctcagtagaaaatacaccagacattacactactcgcaacgaccgcacgaatggtcaataccaccacatacgcccacgcaaccccgattttctcggtgcatcaacgaaccatcacaaaccatctactgcaatcgccagaacagccaggcaagagaattcacccaatccgaacccggaccagcacccccagccgaggaccgcgtcgaaatcccccccgcgcgcgcgcgcacagggagtaccatagcaagcaatggagggagagagagagagagatcgggagtggaggggacctgtagaagtcgacggacttgagcttactgaaggagatcatggctgccggcggccgggccctcctccccgccggtgacgaggtgggggtggggggaagagatcgggccgccggttgaaaagatttgaaagaaagaaaaggaaaaggaagaagaaaaaagccaaattttttgtgggggttgaaaaggaagaagaaaaaaaagcttgtccccttggggtcaacgttgttacgttcaaggttcgcaaaaaatttgcggttggaactggaaactccatttcttgcccgcgtcggtgttctttggttttcttttctttttttttctttttttttgattggaatagggccgtatacaaacgggtccatccgcgaaactagttgataacctatgaattcccttgccgctttccacgccttaaaaatgtaagtggatcaatccataaatctatttatagcttgaattagtagataagtcatgagtcaatccacggtttaacaaactaattttgcctacaaatagattcatgggttgatccgttagaatccttatgaccgattttaggataggtaaattggagtattttggataaggccataggataagagtaatctaattgatttagagtgatgtggtgacaaaataagtaaatgatgatgattttgcagcggcatcttttttaaaaaattatttttctgtagcattgaaattgatgatattttggtcctacatgccaattggatatgtaacaactcattaaattagaaaacatatgacttgtatgattttttttattcaattacacattagacacacacccacacacactattaaacatgtaacaccatactcacacacgctcacgcattatgtgagcgcctgagtttgtacttctaaaaaaagagacaaaaatcaatggcacatcactcatctcactaaaattttgttgaaagttcacctatatgtgtaggcaaaatataatattcgtggtatcaagattttgaaccctggtgaatggtggagtcatacgcctacgactctatcaccatataactagtgttttccctgcatgacactttttaatctcaagtgcaggataatattcactaaataagtttcactttggaccaccttttattacgattgtttcactttacattactctttaactaatgttttcactttaaaccgggtaatcttactttgtgtcactttggatcaccatcaactcttttatccatctacattaaatttgtcatttgtcaaataaattgtctatataaagcggtgggagttcactgacgaatcagagttggcgtactcaaaatcattcgtatgcttgaaagagagtaagggcaatccaaaatgcagcaaaagtaatattactcgatccaaagtgaaaacattggttaaatagtgatccaaagagaaataccggtaataaaaggtgacccaaagtgaaattttactaaacttttaaactatcaatttatgctaaattaagtttacaaaaccaatattaagttcacaacaatatgttactttcaaggcaacgcaaatttacgcgtatataccacctttacttttaaactaaaaaatgatattctattgatggccctttaaagaaaatttgcaactgtatatggcacctgaatggttatgtatcaatcatgagaggaatccaatggttattacttttctagatgtcatggttcaatgtacattaaattttataacaattaactatatttagtggattgtaaatgcatatggcatatggatggttgagatgaaagcatgagatggatcaaaaagctactattttctagatgtagggatgcaagtgggtagtcccgctacccgcataaaaacccgcttgctagtgtattttttacatcatagtacaaaatttagaagaaaaatgaactagaagtgggataagcgggaaaaaaaaacccgcttgcccgccccgcttgcatccctatctagatgacatggctcaatgcatgtcaagtttatggttccaactatagtaggatatatagatatagatatctaaataatctatatttgttctatagtagttgatgtgaaaatacaatactccatccatccttaattataagggattttagttggatgtggtgtattctagtactacgaatctggatatactctatgtccagattcgtagtattaggatgcgtcacatccaaccaaaatcccttatatttagggacgggggaatactacataacacttaaggcctgtttgggggagcttctatctgctgcagcttctcccagaatcataagctcccccaaacagtacagcttttggtccagattctaagaagctgtagttgtagaatccagaagatgaactataagtcagaagctgggaaacccagcttttccagattctcagaagctggctaccaaccagttgcttctcagaatcttaagctcccccaaatatgcccttagattttttatgtatcaaacatgagagggatccaatgactatgtgttatagttcaatgcacattaagctttatagcaataactattcttagtggattgtaaatgcatatgacaaatggatggttgagatcaaagcatgagaggtatttttttatggaagaaatatcaaaacaagttcaaacaccaccaaccatttattaatggtgattttgccatccaaataccagcatgtccttttgacttttatggtttaaaatgctaactagatgatttaagtatgtttaaaacaaattttcggtgcggcaacaatatatgctacaacatgaagactgatgaggacatcctccactattacccgctggcaaagacgccaaagtcgggcggcgaccgtgtgagcctttgaataatcccaccttgcttagcttgggaggaagaagccaccttaaaagggagagccacccttcccttattggactagtcttttagagagattaggcctttccccgagtgggtgtgcctaagaactgttggggtccgggcaaccttaagttattaggccttggccgaccccacctgagctggattgttatcatttgatacggcaaccttaagttattaggcctcggccgaccccacctgggccggattgttatcatttggtatcagagctgggcccttgttaagagggtgggaatgatgaggacatcctccactattacccgctggcaaagacgccaaagtcgggtggcaaccgtgtgagcctttgaataaacccaccttgcttagctcgggcggcgaccgtgtgagcccaccttgcttagctcgggcagcgaccatgtgagcctttgaataatcccaccttgcttagtttgggaggaagaagccaccttaaaaggagagccaacattcccctattggactagtcttttagggaaattgggttccccgagtgggtgtgcctaagaactgttggggtccgggtaaccttaagttattgggtctcggccgaccccacctgggccggattgttatcaaagactaaattaaatagctcttaagaaagtattataattggttttaaaagtcgatggatataaggaaaatcccgacctagaaactatatggtacttatcatactcgccatatcatatatcatataggtactacgtataaaaattgtatgcccaaaatggtttcttcaaaataaattcttatctaatctcatctcccttgctccttgtgttaattcttgtttcttgcatagagctggtttctttatcttttgccgttattcttattaactctcttgccaccttagtttttcttcttatgtcacacgatatttaatgctatgtaagctagctgaaatagagggttggaactaccctaacatatccggttctataagtgatatatttctaggtttacaggttgtgtgctttacttataaaaaaatatggcatacacggtttcttccatatgcaagccccatcgaataaggtcaaaaatcagttgttgctcgacaaaaatcaaagtaggcgatagaaatgcttggttgggtccagctagcataaaagcaaatttttttggaagaattgaatattgatagtactatatctctagctctaacacagttgtacctacatatatggaacatattcctttaatcatacatcaatttctagtagtacgttacttagcaccggtacttgtatttattactaattattttctttaattatagatgatgtacctatcaacgacgagatacttataatgactttaaatatgtcagatcagaccttgaaaggtgttcatatggatagagcgtgtttgtttatagagtgagtatttgcgcctaaatgtaatgtgtgtcaagaaaagaaatcccaattccgacatcgttttttaaaagaaaactgcaacctgagcaaagacaaggacagtaaaaaaacaaacttaatctaggatttcaatgacgtctactgatcttagggcctattcattttggaggaatttaaacatataggaatagtaaaagtggaggaataggaatgcatgaaaacttcaatccataggaattttccaaaaaggtttgagtggatgaaaaagtgtctatgttttctctctataacttgtaaaaaaaaactttgtttcctatacctacattcttattaaccgaatgatactcatatgaattaatccttaggaatccaaaacctttgaatttcctccaaaacgaaagaggacatattttcatgaaaacgagttaagtgttgaaaactcatgaaaatcatatcaaaaagtttcgtaaattcatgaaaaaaaatactagagataggtgtagatatgaaatacattctcaccaaatctcaactctaaactcaacttcgtttaagaggaaaaaaaagacaaatttcaggttaatagtaagaggacactattcacctgaaatttgtcttttttgttacacctaaataaagttaagtttgaactggagaattgtgaaaatgtattttatatctacacctatatgtagtttttttcataaatttataaaacttttaggtatgattttcatgagtttccaacacttagctcgttttgtccccaaacggatatgcccttcagagggtttacacaggcttacagccacaacatatggtgtccatatatgtttgcttaggtaattagaggaattcactatttctttaaatatataaatcatttgattcattaagtgtaacttgggtcaaatttgagctgaatcatacataaaactcagaatatatagttcagcatctgatgaagcaagtacaccagtagtacaagactacaagtgcacagatcatgaacaaggcgcgaacgctttaacatactgaaatcttgcagatgtgccatgcccttctcttcaaggggcttccatcttcagtcaactgtttcaaccaccaattgacaatgttattgatctgcctcctccttgtttagatctttgttctatactccattttcccaatatttattttccatgtatatgctttccaaactactaaacagtatatatttgtaaaagaatttccatacgaaagttgctttaaaaaataataatgatttatttttcgagctttttaagctaacacttaattaatcatataatactgatgtgtcgttgagatctgtgtgtggaaagggaagggttccgaagccgtaggttggaactcagataatgtccaaacttcctgttgcttcatggctctctttcgtcgtagctgttcatacatgctgatcaatggcgtataggagcttgaggttaacccctgataggaaagagaatctatagacaagcttctgtgacaatatatagccttctctctaaacaatgtgacatgtaaacccatcaaacatctatgtccaagacggcaagaccccagccagcccatgtgaagataagatgaatgaaaattgtagctagatggcccatcaacaccagtatttgcattgagcggccggtccaccatgttgaattaacaagctatatgcaatgtactttcataatacatcaccaaacactaaatagaaaaactaacttttcttttttactacatataggaactgcctcgcagatttagttaacaccatagatctttcaccagctttgtttcgtaatatgtttttaggccaacttggttaatttggcaatcccatccaccgcgggcgagttaaatgtgggctcatctcatcatctgacctcaaggtagaattttcacatgtttaggctctgtttagttttcaaaaacaaaaactttctacccatcacatcgaatgtttggatacatatatggagtattaaatatagacaaaagaaaaaaaataattacacagtttgcgtgtaaattgcgagacgaatcttttaagcctaattacgccatgatttaacaatatggtgctaccgtaaatatttgctaatggcggattaattaggcttaataaatttgttttgcagttttctggcggaatctgtaatttattttattattagactacgtttaatacttcaaatgtgtgtccgtatatccgatgtgacaactaaatccaaaaattcttgggaactaaacaaggccttagctgaaatccatatgcctatactaaggctgtgttgtttacccctctttcccaactcacttttctccttttcaaactgctaaacggtgtattttttataaaagttttctatatgaaagttgttttaaaaataatattaatcagtttttcaagtttttttctcatacttaattaatctcactataataatcacgtgctttgttttccgtgtcctccgcaatgcagcctaaactaccacggcaccatttaccctcaaggtagtatgccttttttttctttcataaaggcataagttaagggctactagtatactgtacaatagtcctagattcagtcagggcccattaatttgagatgcccaatccctatcagtccaagcaaacttccaaaaagatgtgaataattagcctcggaagatatctgagcgtttctccgagcaaacttcccataaactagattgagcatgcgagtttatttaaaaaaagattgagcctgtgagcaaaattagattgccaataagcctctaaataataagcattttctacgagttaaaccttatttccaccgtataggtgcaaataaaaatagcacaaaatattatggtttggtccaagccttgggccaaagctcgagactgagtgagttttgatggcttaattaatactccctccgtttcaggttatacgacgttttgactttggtcaaaatcaaactgtttcaaatttgactaagtttatagacaaatatagtaatatttataatactaaattagtttcatcaaatcaataattgaatatattttcataataaatttatcttgggttgaaaatattactatttgttttataaacttagtcaaacttaaagctgtttgactttgactaaagttaaaacatcttataacctgaaacgaagtagttattttctccggtcacacatatttaaagtttaagataaaatttgattaaatttttataattttgactaccaataatttcttaaatacttagtttaaccagcgcatatgcgtttgcattttccttgtaatttttctatgcaaacctaagtcgtggattttgtagtggtgggcagctctatccaatgattgccgtgtattctatgtgaaaaaaccatcatcccttgaatcagatgacaaatgacaaaaaaaaaaaacggattgcaatcttgtcaaagatacggggtaactgggacaaagacaaataacacaatcaaagatttcgtggttcctcccatacctctccatcttggcagttggttcagacatttttcatatttcctatggaatcttgcaatcttttcttgatttctctagtcatgctatatatctagacgactaacagaatttctgttgaaatcttgcagaatattatattgtttgtccagaattaacaaattaatccagtattttctccataaatcgattgagtacctaccaagtgctccaaaaagaaaagaacaagatatataatgcagttgctggaatacgctgaaatgcctacatctgggattaaattatactcaagttgcaactctgtacttgccgatctattcatctgtatacaaggatcgagcaccaaccttctaaaattcttaggctgaggagagaacaccttttaaagaacgaatagagaccatttgagttgacaaattattttacagaaagatcaaactctgaattcaaatttgattatttgacccatctcatcagtgtgtgtctgaactctgaataatgcagcttactattttgttgcatagatcaaaccaagataagggtgtgtaagggtgtggtagtggtgttggcacgtaacgtgatgcgtttttcttattttcatgagcatagcctttccgaaagagtgattttgcagtccttaaggagatactagtaggtaccaaatttgcgctaaaacttttggtatctctcaatgactgtaaaatttcttttttaagaaaaactttaaaattttaatatgaagatgcataattcttttgcgtatttttgaagaaaaaaaaagatgcatggttccctctctgaagctaacaacggtatgaagctttatgtgatcacgacatctcaagattctcacatgtatgttctaatgagccatgatttgtgagtgagcacaatccagcatttgtttgagaaatggagcaatccaacaggccaactgtactaacctcctgtatggataggagagaaaaaaaacgagcctgcaaaaagaaaaggaaacaagccaaggcagcatgcatgtgagctagctccaacatattatgttctttgtcactcaccaattagctctctctctcttggtaggtgaagcatccatcactcgtacggaaaccttcttgtcagtacaacaaactgttgccatctctgaagaaaaagaaaaaagaaaagaaaagaaaaggggatgaaaaaacatgcaacaacttgtggttgatccatgcaccatcaactgaacctctgaaagacggttcgacacttcgacaggacagtgtaatgtaatgaggaaaactgcaccggcctagctactgaaattttgtactttgaatatttcatattggaagttagtttaaaaacccgtttaaaaatataaatttagatatgaacatagataagcgcttgtctagattcatagttaggattggattcttttttatgaagggagtagatctaaacttgtgattcaattatttacagataatttaatacaaaatatctgcgttgatcaataagtagttatggggaaaaggcaaaaagaaacatgaattgtcttttcaatgttttggcagaaaacagtctactttatgtgttgttcctctcctcaaattaaagctgagaactagggccaacaagaccccaggaatcaatctagttttggtatctgaaaacctgaggagcactgtagcaggtcatatagcttcagttgtttgacggtaacatgattacatcaacatacaaaagaatcataatttcacttccttgcgacgggataattgtccctgaaatataaaataaaatattggtgaacattgacttcttgtaaattctttgatgttttgcaccattccgcaaaataatttccaacttgttgcgattttaaattcagacggccggagaatataaatcatggatacacgggcagccaagacgtggataagataacatatttcaattttttttctcatatgtgccaacaaccttaatgccgggcacatggacacatgacagttttctcagtttgagttcattatatttttttttccattccccccccccccccccccaaaaaaaaaaaaaatcttctccaaacactagtcctcaaggacattcaagaggctatctttgttccacttgtttctaactttctgtgaagggtgcattacgacataactgatgatgattcaggccagagtgattaattagtcttcaagatgttctttaagggacaagacactgtctaagtagtgattaggatggtacctaataaggattggggattaagataatctcttttgtttatttattatttattttcagagctagccaccttttggttggaagcttcagtaacatgcaggccaacatatatggcccaaatctacaagtgcaatgtactattcttagggcttgtttggcaaacctcaaacctctagattttggagtttataggttaaaatataatgatttaagcatctattcttcgtgatctaaaatatgaacaagatggtgcggtgcaaagaattcttgcagctggagctccaccaaaaggcttctatcaaaataaactggtagcacacatgaaagggtatcaactaattttaactttgaagtactgtcatctaaaaatactaattttaagttctgaagctaattaatatatttcctgttcatatataagaactcataagatgaaaaatgcagaagaacatttagattaagatgctaattaatctgatctcttcatatatctttatggggcaacaggttcagttaaaaacatacaaatttagttatgctggataacttacccagcaaattttttttgaaaggttcggttgcccggttacactagggaaaatatatgtgaccagtaaaagtaaattagtatgacgtgaacaatcgcatgcatcaattttcttatcctacgtccaggattcactactacacatgtggtttccactacatgtattttctcgctatatattttaagaatgaataatgagctacagtgataaccggccagaaactatatattgaattcagctgcgtgctcttgaataattcatgttaatcaatagacacatcaaaagaaaaaaaacatgtcgttattgagggacctccaagcgtgatgaggatagagcaattactttgccataataacatcatgtactttcagtcattatttttcgcgaatgcgcaaaagaattgcatgtcaatatatttctcaaaaccttttttttttcattttaagtacacgatatgatgtcccacattcatttattagcaatgtcgaaatctcagattaattaacatcgcacagtagttgacgacgtagaattcgttcttttctttgatctagacagcgggcaattggttatttggatcagtagtcaagtgttcagacagtaacaagatgaaccatgcatgagacgtacaaacgaaaaggctatacataggtgtagctctcaagacttcatgcttgcaaacctaactcctaagatcgattgataaggctacgaaagatggtgaaagaaaataatgttttaacatgcatgaagggacaagctaaaggtgccaaattagggggaggtcatctagcccttaaaaatttaattggtttgttaataagtcctttagctttcaaatcttggcaacagtcaagcacttaactattctcccttcatgaaagctactccctaaccactacttgttcatgggctgcaagcatggtcattgcacatatatgctgcctttatgtttatccactttatctccttagaatgaaattcttttagcatcaagataaccctaaatttttagcattgcatttgctaattaattagctactcgtgggtagtaatagctatagctaattagctacatatcaggtaactgagttaacaggtacatccatgatgtaattaaaaggagttggtagatagcccatctgatcatgctgataagctagtggcatcggctggttgggaacacttattttacatcgaacaaaaagtgagagacatgcatgtaaaggtagagcattgacatgttctgtaactcatgtgttagtcattcactcatttgtgaattgtgaatatactaattaatactaatgtcttactaagttacatggcctctgatcaatcgttggaacttacctgtatagctatatatgtgcaggacagcaggagagcaactcaccttaattcattaatttgtactgcacaacatctcaaaacaccatgtaaataaccatgacaattttgtaccatttgtaaccatctatatatattgttgcttttaggagcatccatatagatatctaataaaataaactgcacgcacagagcataactagtggtaagtaaaacaaaatggaaaaaaaaatgaaacaaggagagcaggagcggtaatatatattcacatatattttcacccaaaaaatatatccacagtaatctcagcacactatattttttggtcatttatcccacacacattcatgtaaggcataaaccctacacgtgctctacattgaagttctcaaattttcatccatggtagtgtagcaacatggacaaaggaaacaaacaaagccccttatcctttagctctccacatggagttacactcttctgactttgatcaacaaacctcaccccctctaccattgcatctgcatagtccatcccctctcttccacgatcatctccaatcccaacttccttcaaggaaaaaaaaaagagacaggatgttaaaacaagacaatatttttactacttttctagaaacctgaaaaaaatggatggacaatttataatagtatcttttcaataaaacaccaactgattattgattgaacttaattaattaccttggttaggtccctggtattgcacctccttttagggctcaattccagctgtgtcaaagcactgacctgaaagatgcaaatcaaacaggcaaatcaacaccaactagctagtaatctctaatttttcttttctttatttcttttttaaaaaaaaaacaaagactctctagctttaagccttcatagcaacaaaaatatatagggaattaagctagctgtaactaccttagggctatttactggagagcttgcggtatcctccagggaatcatcatgatccagggccttgaagaccttcttcttgagcttcttcaactccttgtacctatcaggcaacgccgcagccgcgggagcgcaagacgcggcgtcggagatcatagaatcttcctctccttcctcctcctccagctccttctgatcactgcaatcgccatagacgccatctccgccatgggagcagtatgaagaagcaccatgatcttcttgactcttcttctcctcctcggacatcatgaaatccacaaagtagtcggtccaggtgctctcctccggctgagcttgagcagcagcagcagcttgctgatcttcactagtactactgcagctaattatggcactcctcatcacagatgagccactaactaaatcctccatgcttttgatgttacaagcaaaggtggtgatagctaaagctgatcaacttaatcgtacaagcttctatgcttgtgttgtacccaatgatcgaatggatgaattaatggatggctttgcaaagatgcatacagcctggctctctatatatataaacaggagagagagagagaaagagaagagagaggtgtgaagctgaatgacatcacgaggagggaggagaaaagaaagagtaaggtggttggggtgttaagatcaacagtatatgggcactgtttccgttacaatttttttttttaaaaaaaaggaaaacggagaatatttttgccttggtttcagaagttgcccgacctaatcaatcacgcctcctccttttttttttttgttatagtgtatacgcaggactccagccgcatccccttgctcatctgaatccatgtgacatagtctagctagctaggctctactcaccacaagatgattacttgtattccttgcattatatttaacggataaatgcatgcttcctaaactaccaaatgatgcggcttttattaaaaagatttatatatatgaatctcttagaaaatcgtttcaactttataatagttaattcattcggttgtatccttggataattgtcacgaaccaatcggtcactcagcatttagctcaaaagaatagacacttagattgtcaatatattactggcagaaacctgttaattctcaattcccttgttattaccctcatatctaactacgtaagagaagtttcttttaaaaaaatacagtctctctgtaccttctcaagagccttaaattaatcgtactccctctatttttatcaacatgacgttggttagttcaattttaaacatcaaataaaaacagaaggatttcggtaataatttccacaaaattgagggggaggatatagatgtgtttacctgcaggtagttcaggatggacatacattgtcaagctcgcagcaaactttctgaggaaaaagcatatgcctgcaccaatcgctgcgttgaaattgcaagcaaaggtaggcatgatgaattgatgatgatgaacatggcgacaccggtctctgcagcagttggtctctctctctctgttggtttggtccccggccgttgttaccgttactgacggacgtacgcacgcacgcacacgtacgcacgcaccgaatccatcattagtgcgccgcacgtcgtgagagccatataagtatatagtattccttgcaatacgctgcagcaatgagcaatcattgagatatcaaacttgtatatgtatgtgctcgcgccgaagaaacagtccgggaaattccgtaccatatgacagcttaattaattaaagcctaattgcattcgatcacagcctaactaggttttcaaagatggatatcagtactagttaagacaccatgattaattagctctcaaaaaatctttgcttgctgatcagtacttgatcgggccacggtcgacaacgtgcagaccaaaacgtgttgtgtgtatggggaggagtgatagatttatgtccactgttttgatcttttgacacaaacttgagcctttttaatttcctatggattaagaagaagatcaatatagtttagtaacctcgctttgaaagtgtagttaattgatggtatcaaagccacttcattataataacaagtggcatgcattttgcttggtctaactagattacaagcaccggtttcagattttcagcgaactgataattaatttcaggtcatgggagcataacacagtggcccaatccccatcaacaacgtatcagctacggcattttgggtgatgaccacatgacacagggtgctataagtatgtagcctaattacctatacaagattaatcgtagagacaggatggctgacatgctgatgagcagtagagtagtactaaccacacctctaatggatgattgattggtgcccatgtgttgtggttgacaaaaacttcttctttgcatggcagcatggcaccacatctcctggttttctgcatgccctctggcaaacagacattcctctggaagaaaaggaaaagtgagaaatagaaaacaaaacctgtcccttgaatgagtactgagaaggcaaatgtacaacatttagaatctgtcctggagtatggactatggaggtacaaattgcacctaaaaagagagaacatttcaatagtaaacttgaaagagatgcatgcaaacaaataagacatgaaagggatctgtcatggttgctaaaacgacttcacatagacataatttgcttattttatcggtactatatttgcaacgtttacatcgaattttaagtggcctagactgattaatattctgacttgtgactgaaacaaaagatagagcagcactgtaaagcatttagtttcttctgtagggaatagcgagttttcatctaaccgatcgagtgataaacaagtaatttgtttcttctctaaagaaacattgttggctcgttttcatctgcctgttcattgtctgaatgaaaattgatgttcagattatgtgcctcacaacttctgcacatggcttgtgttttcataatagctagaatgattatggtgttgaaagttatacctgaattcgtttttgacggcgtaaatcaaattagcacttctggggttccttttgacatttcagagccaaatcattgagtttttccctactagtatgtttgaagggctaatagaatatggcccccatataagaatccatggcacgggagcattgacttattgggacaaacatattagtgccaccgtacctgccatgacttgcttacaagacctgaaataaagatgaaaatgattcagaggtacatgaatcaagaaaacagaaatattgtatgtgcaagaacaaatgtaagggtaattagggaacaaaaatcctttgagaagactaacaggctgtacagaaaatggacgaatgtgaattgtaatgtgttatatagtactagtacttatcattatcctagtaaatagtgggaatgtgggatctcagctgttgctactaatcctcgcttccttggagaatcttaaggatttgatttaatgatgttgtccatgttttaagctcagtggtggcaggcaaagcgcaggaaaaactccagctacagcttcatgctagcctgtctttgggacaaaaatcattggaaatgcaactattactccaactagtcaacagcaagaaaaggctccaaatattcagtgcagataattcaatataagaaagaatatgctgttcaatacaagacagaaacttagcagcatttctatgctgggaatattaatactatgggggttgacacatactaagtatgatcttagaataaaaccagagagatgtatgaagttaatggcaagccagttcataggatagcacggaataataatactatcaagtatgtcctaaattgcaaaatcattaaaaaaaatgcagcggaaaatagctttttgtacctatcagcaaaatgcagggtccagcagtaactggaatattttatgccacagctcatagatattaggtgctatctgggaacaatctaggtggaccattagagagtttagtctttaggtactacaaactagatatatagaaggtagctaatcaatgtgattgctgaggttagctgttgcagccaatttagaaacatggataattttgtatgtattatagatatactccaagttaaaagatagagatgcctgagaacaattgacatcaattgcatgtctccagaactcggaagcttcagaactaatgtacctgtcagattatcaattggcaaaaaacggagctgataatcaacttaaccatatgggcatacagggagcaaactaaagaagttaatatgcaaatactaaattccaccaaagaaacagcattgtacaatcaggtcacatggataggaaatctctagacatatagatatatccaaatttcactgcactaacagcaaacctagtataaatagtatgtcggcagtttgttgcaggaaggaacataaaggagaagcataggtccaaagtaagcaatctgggtaccattagttaacaaagattatttgcagcaacagcggtgagaagatggaatctacataacttgtggtgcttccagatgccacagctgcatgtttggccctagaatcatctcctgtccctgaaacatagtaaaggtaaacagattagcaaaaggtaaggaaagctcaaaacaagcaaaacgtcaggcaaatagcaaaagaagtacagctttgcatttccgacactactaattcctatcgtatttcaaatactttgtttactgaagggtacatgccggagatacatatcaaatctcagctgcaaagaatgctttttcttggtgtaattccagggggaaaaaaatgcaaaccagattgtcacaaaatcaaaatgaagatcccagaagcagaaccaaaaggcacaaccattagctgacaacacaaattctttccctatatactaattcaacaacgtgaacagattttgaaatcacatggtcacaggttccatgaaaaagacctaactgatattcaccccgtatagagtctacagaggccatagggtgataaaacaattctcacagcataagtttattctccttgaagaaggtaatattcttgcagatcaggagatgtgcaacatccagaaatttgcaaattttactgggatggagaaccactaaaatcaccacagcctacagtcctgcaagcggatgattgataagagcaggcagcaatcagccagcaaagcattgatgttctgaattcgagcccgggggaatcaacccgtttcctgttttagctccctggacgatagcagtatagcaccaaaccccagcacggcccgagtctccatcccatgccgaaatgaagtagggaccgacagggaatcagaaaacgagaggcaccaaacgctcagcccaaaaccaccgccgcgcctccctcgctcgcgcaaaccgtcgaacacgtcgcgggcatcatagggaacctcgtgaccacgagaccgcatcccgcacgagcagcaatggcaccatcacctcgcacttaccaatgctgtgagttagcacgcgcgcgcgaaggcgagagagagagagagagagggcagtggcatcatccatccgatatcgccgccgcctcgttttctcgcgcgcgaacggcggcgcgagagaagatgatgagctgctgtacatcaagttaagcgcataaaccctc

SEQ ID NO: 66240 - DNA, 1381 bp, Oryza sativa
cctttttaactttgtttatttcttttcaattattatttgtgctctgaaaattccactaaaatttatttaagcattttaggcttttaggaaatatacaaaaatcctccaagcctcatttgacttttatctttgcacattttaattgttgggggctttcacatgaatttttacttattctttgcacaatttcgaggatagattttagagtcgatttgggacgcgacacgagatctttcggtttgcccaacacctccatgtcaaatatcccgcttcctaggcatcttgcatttagataggttgcaaaccgccttgaatcaaaagcacaactgcgctagcctccttgtttcagccgctggacctattcaaagagttagccaaagaaatatttatgtacgtagctccctattcggcgtgcccttcagtaaaacgggcatgaatttttcatccgaattctttttaggacttacgacaacccgccatgtctttttttccgccataagtaccatatgagcggctaaaactagaacaagagcatcatacccggcgccgtccaagtgcaaagcacttcctatctcaaatacgactgcttcgtcgtaacccttagcgagtaacgtggcatattcaccatagatgtccacgacatttacttctcgtttgctctatacgctctaaggctgcctttttggcatccggagaaaaaaatccctccttcgccgcgcgcacgcttctcgaactgctaaacggtgtgtttttcgcaagacaattcaacacaaaagttggttaaaaaatcctactaatccatttttaaggtataaaataattaacactcaactaatcatacgctgatgactgtcgcgtcccaaaacgactctaaaatacatcctcgaaattgtgcatagaataattaaaatccatgtgaaagcctccaacaattaaaatgtgcaaagttaaaagtcaaataaggcttggaggatttttgtatatttcctaaaagcctaaaatgcgtaaataaattttagcggaattttcagagcacaaataataattgagaagaaataaacaaagttaaaaaggttttataaaaagaaaaaccctaaaagtcttcttttccccccttcccttcttgggccggctcggcccacttccctccctctctctctctctcccccgcggcccaatcggccccctccccgcgcgcgcgccgctgacgggcgggcccgcccgccaccctcgctgacgggtggggcccacccgtcatcccctacctcgcgccgctcccgccgcccgcccgtgccctagcgccaccgccgccgccgaattcgccgcatcccgccgttcccgcgcgccataaagagggggaaatcactcccgtgattccctc

SEQ ID NO: 66241 - DNA, 611 bp, Oryza sativa
cacccgtacgacctctagcgcagccaaccaacatcccgcccaacctcgccagcgaccaatatcgccggtcagttgcaaccaatgcctttgctgtactaacacgattgaataaagcattgacgatctgaattgaccacccctctgcctgattccatcgcttgtcgtatgtacgccttctctatagcatgtccatcacgcaattacctcatcaacaccttcaaaagctgcctctaggaaccacccgctccgacttccgattaaacaccatcaatctagtcgcgagccgaagccgacaagttgcatgccgtcttctcagccgcgaacgacccgagtgctatgtttagccgtctccctgtcgaacgcaactcatcgaaaggcccaggccaccccgcccagagtgatcgatccacccaccgagaacgccgatcgcctccagcttcaatcaacccgagcgtgcggccgcacgtctccctattgagagtagctcaccggaaagtccgagccacccgctcgaagtgtccgacccaccaattggatcaccaatcgcttctgccgccatcaaccagagcaccacgtctagtcatctccctgttgaaagcagccatcgaacg

SEQ ID NO: 66242 - DNA, 12403 bp, Oryza sativa
gatacatgctcatcatcaaactcccaccattgaccattgctttcgtcctttacatgtgctacatagtgcccactattggcagcactacccttgtggatcaaaatagcagacaggccatacgtataactagatgaaggattggataaccgcttccccatatctagctgtcctgggaaactgaatgccgaagaaatctttttctttgttgttgtctgtggacgaaacgagttagacaaatttcttgctcaaatacacaatcaaacgaacaaacaaacagaaggaatataaagcaagctacacctttgggaggaatacatagcgtttcagctgaaaattaacaacaggaggaagtgagcgaagttttatgcaacgagtggcatctacccttttctgacatgactcacagaagtactggttctctccatccagtgcctcagtactcaaatagtcatccaaactttgttctagattatttaaacctttaatgttaagctccagttcgtaaaagtcttccatctttgaagatgcttcggaatcccttccacatgatgagcacctaaagcataggatgaataaacttcagctctacgcaaaattaaatgtactatgaactaagtatatcattccctttaacatctgcaggctatgtgaatgtgaacataataagtgcatgggaagcaaagatcttgctaccggaaagcacaaatctacttgatcttttcaatcaatataagaacacaacatcagtcttatcaatcaatacactgcacacatgtttttaagtagtaaaacaatataactatctggcataactagattcatgcagctaagaattttttagaacttctacacaacaaaaaacactaacaaaaaaaaagatatgtttgaaaagatgatagtacaaaccaacaagcataataaccttggaaaaaaaggaacttctacaaactagaaagcttatttccctttcctttccaaagcctaacataagaccattctaggaataagactcaaagatcgcatgagaagcatatagcatttaccctaccgagtaacatgggacacacttccacggaacaaatgctgcacaatggttctagcccctggaaccttggaatgacttagtgaaccctcgagcaaagacaaaaataatgtgaggaattcatggctgtcctgctggacaccattatctaattccaaggtttttataaaaggtgccgaatcaatgaaagccattttgctggagtgtagctgagcgaataaccgagcaagctgatccagcacagggtgcatcttcaagatgtcgggctctagagagaaaatgcccaagcggaaggaggtgttcatgtaaaggcactgcagtatgctgtttgcataacaggtagcgcccaggttagtcaatccagcaggcgtctcagtggagtcacgaagatccgtcgacgggttaggaccaagggcgcgaatgatctcgtttgttctctgccacaggccagatttcctcaccccattagcagcagggatcaacccgcagaaacaattgggtgagtccttggagttcccatggcaaccatgacaaacaggtttccacaccatataaagttgtttaatatcgccttttgtgattgctccagtggaatgtatcttcctgcatagcagacaccaattttttttcaaaaaaaaaaatcatcagcaagcaaaggcagcggcacctcaagactagcatatcaaatctccacagctttggccaaggcgacaaggcaatgcagacatacttgaaaacagcagacgggctctcgcagtcatcagcccgcggcctcttgctcttatttcgtgtgtttggcctgctcattgtaccatcaaaatcaactcaccaacgccaaaccaaaaccgccgccgccgctccccttccctgtagatggaaacaagcggaggctacagcattagcacatcagcgcgcagggaaccaaatccaacacctactccgatactccgaaacatgcaggaactacgcggaatctcgcggtcatactgatgattcgatcgctgaaacccgccgccagtgggggttagggattacctggaacagatgctcagtactccggggtggatccccccagtggcgcgagggggagaaggtcgccgcctggagcagccggagcggagatcggcggcgggggcggggaggaagcggcggtcgcgggggtcgccgtcggtcggggccggagggagcgaggccgaggcggagaggaaaggacggtggtctcctcctgccgcgcgcggttcggtgcggtgcggtgcggtgcgacgggtgcggtgagctcgggttcgggctcgagctcgcaacgaagtttaaacgaaacgggaaattttggatggataggcacggaaggggtagtaatttaaagcgtcattaatgcttggagattttttttcctttttattttgtttggccttttcctctaagaaaataaatgatggaagatttttttgggtcgactcgtagccatacgttgcgatgtcaaagctagaaggcccaatctcttcgctaatcgccgtgtgaatctagaagattttgttgttatcttccggaatcaaagctcaagatacgaaattcggataacaaaactggatctctctagtgcccgtaatgtgatcgatctgcatcaatagcgaatctgcgaatgggcctacatttgtaattggaagtagtggtagtatggcccatcaaattttgcagtccgggagttgtgttatggttgggctgaattgatgctgtatatcggcaagcctgagatagcccgttcgcactttgcacgatgggtcaggccagaagcatgggcccagagtaggagcggcggatggagcaggtgttgggccaggaggcaatccgctgagccgggacgtgaagatacgtgagctcaactccaacaagggcaaaatgagcagaataggtatatttactgatcaaggaacggctgcaaaaggaatggggaaatggaaaagaaattatctcagaccaaaactaaaagttgtatatcaacctgacaagcatattagaacgtagaattaaataatggcctatcgtaaaactcggaatgaaatgtttagcacgatagcaattaaagaatgtggtgcggcattccattctacttatgtaattaaagaatgtttagttccaaactttatttttaaactttcaactttttcatcacatcaaaatttttctacacacataaacttttaacttttccgtcacatcattccaattttaactaaatttttaattttagtgtgcactaaacacaccttaggtggccaatggcagtaaaaccagaattcaccgaacaaactagctacatccaaaaagaactcgccagaacgtgcccgcgcgcgcggcaatcatagcttggatgcaaaggaacttttcgtcactcacaggcatccaccaaccaccgacctctctaccctgacggcctgaccgtgacgtcgcaaaatcaattaacacgtgaattcgaaagcaggacgcttgctagggctaggggtgggttacttcattagcacagtgacgactgacggctcagtttgtttgaaagattagcccagtattaattataagagctaatgtttagttataaatcagtaggctaaacattagtttagggttgtatgtttagatccatgggctaattcaaggctaaaagttgaagagagagtaaaaagagatgagagagagagagagctgctttttgatactccccacacaaaattagccccattagcactttttggaggggctaatgttttaaggggggctaattcactttagcctcaaattagcccatctatttaaatccttgagggctaactgagagttaaaaggtggaggctaataattagcctatagaaccaaatagggccgagcttgcaaccagcggcttagctagcggttgagatttactggagacaccagaaagggagtgcgaatgtgcgatcgggaatcgtcgcgatcgcgcatatgaatgtgcaagaatctttcaggtcgacgtcgcccatattttacagcagcgttgggtttgcactgtagcagctgccacagagaaccgaatagtgcctcttctcgagttctccgttcttttgacttgattggcttgccttggcgaatgatcggccatttatatcaaaaaggaaaaaggaaaaaaaaagttccctctcctagtctccagagaaacaaccgctattttaaaattgtaataataccattataattttacaaaatttgatatatgtcatcctgataccgatgactcatatgggtcctacatattacttagataccgatgtcatatctcaaactttgaaaaattataatggtatggttccaaattacccttaaaaaaactgatccccatatatatgctgaacactgcattttcctttcaaatttacgtacttcacgtacgtaaattcgtaagaacatttttcctgcctctaattcacagcgtcaagtagctgtttcactcaatttttctggaccttctctggcgttggagatcatgcggcgatatactacagtacacgcctgaacggccgaacgcgacacgtacaggaacgtggcgagcgtcccgtgtagcagtactaaccaaaaaagcttttacatgcaaggacaagggctattacatgcaaggacaggtccattttacaagcaaggacacggctactccatttcgctacatgcaaggacaaaccccttcccacgtgggcccacgtcccccgccacgcggctcccctcgggatcacgcaacccggtgacagaggcactgcccgccaccacatggtgcgcgttgcctatgggccagccaccgcttgtgtcatcctgtgggttttgtggctcgcagctgcgcggcaccccacccccgcagcggtgcgtggaccgcgtccagggagcgggggagtagagtagacgagacgtgagccgcttcggttccctccaggaggttccgccacggtcgagacgcggtgggccccggcgcggtccacgtgacggcgccagcgggcctccacgcagccaaaagcgccacttggcgattctcggccgcacagcccacgacgggtggctgttttgcggtttgccccctcagatttctgtgtgtttttttttgctttcgagaaattaattaatgtggatgatgttttttttttgggacgtatatggaagagcagtataccgtatactccctccatccaaaaaaagacaaactctatttttccgtgtccaacgtttgaccgttcgtcttatttaaaaaaattatgaaaaaaattaaaaagataagtcacgcataaagtactaatcatattttatcatctaacaacaatgaaaatactaattataaaaaaattgcatataaaatagacactcaaatgttggatatggaaacctagggtttgtcttttgttttttttaacgaagggggagggagtacgttccttgatacatggcacgtcgacgttgcctttcccatgtaggagtagtactatgtactacatcagcacgtactagtgtacttcatcgtctacacggtgtgaagaaagtaccgcgatgtacttcgttcgagtcaccgtagagtgaaaattagcgaagtttagtcctatacttcggctttgatcgtttgtgcagcttgcgggccgcagctgcgagcataaacgatcagccttttcgttggacgaaaagcaaattttcaaataccagaaaataggtacgattggagaacaggaatacgtacccgagtaagctactagaatatatgcactcattttatgcgtgatcatatatggttaattactactatatcaatgcaaggttaaattcaatacacacatgaaaataaataacaaatataatgcaaatgtgatcgtacttttcgtaatttgctttgttagttttcttctctcttcatgcacagattaaatttaaccttacattgatatagtagtaatatataacatcacttgtatggtgtttaacttttcataattgcttgagccatttgctagaaacgaggataatttagagttaaataattttcctactaacaccttgaggatgcttaagattatgataaacacctcctgatcgagtaggcaactggtgagaccgaaaaaaataaagctgatttttttattattatttttagagaagggtatattacccggcctctagattcaaccttatggtactacttatgtcactgtaaccactggggtacatgcccttttgttaaagttgaaatttagacctttgacctctgattcattttctagatattctcatctatagccaccaattcttaaaaggacgtgactacacagctagtgataactggtttgtctaaactagctaccactccatatatgagagacactatccacctatactttaaatacaattttctcttaaactactcatccgatctacgatccgattacaccgttgtgttcgtaacaattaaatatttataacaagatcccacatgattatattttgatgaaaaattataaattgcttttataatatatctaaattacttttagatttcactaaattacttcttagacatatgaaagtaaattcaataaagcctaaaagtaatttacatatattatagaaataacttataacaaaaagaaagtaactttagtgaatgcctttttcattggacgtgactacacagctaaaaaaaaaggaaaaaacaatcgatgattaaatagatttatagagagttacttttgaacaatgcaaaagttactaccaattaacattgaagttacttttcaaaattgttaaacttacatgtgttgatccgtgctgattaaattttatttctagataaatttatattgttattcctacaacgaatttacttataatgtattgacaaagttacttccgttttgttttaagtgttaaattagttttagactatattgaatttacttttatatgtctaagaagtaatttagtcaaatctaaaagtaacttatatatattataaaagtaacgttcatatgtaataaaagtaatttacaaatataaatattttttcatcgtaatataatcgtgtaagatcttgttgtgaagattcaattataacgaacacaatggtgtaatcggattatagattatcacatagattctaagtatcagtaatcatataatccaaaaaaataaattgaaagctagaagctgaaaccgtattctgaaaaactatctaccaacaacagattctcataatcttatgctcctttaaacaaggccctattttgttgtagaacataattgttccctaggtaataactaatccaagaattcacccttcatccagaacacatagtaaccaataatgcctctaatgcaaaaacggtacaaccgatttatatttatttgtatataataatgtccttcacttagagagttaggttctgtttagtttccaaaacaaaaatttttatgttatcacatcgaatgtttggacacatgcatggagcattaaatgtagagaaaaaacaattacatgaattgcgtgtaaattgcgagataaatcttttaagtctaattgcgtcatgatttgacaatgtggtgctacagtaaacatttactaatgacggattaattaggtttaataaattcgtatcgcaatttcctggcggaatctgtaatttattttgttattagattgtggttaatacttcaaatgtgtatccgtatatccgatgtgacaaccaaacccaaaattattctccaactaaacaaggcctagaggtctcttccaaaatagaattgaaggctagactaggaattaatctcttacttatatatcgtaatccatttatcgtttcaatttccgttaccattatccaaaatatacatatttatttgtctagctatcgctattacatattaaaagaatcatagttatttccattaccattatcggaaaaaacattcatatttatctatttaattagttgttgctcctatatgtattaaaaaaaccattaattatttatatagtaatccctctacaatttttcgtggtgatggaaacatgatcaccctgtttgtatttttatcagcagtgatttatcatcagactctctttcacccttaggtttgctgaatttcagtggaaaatttgaactccaaacctctcctgtttaagctcccattggttgcccatttggccaaaatagcttatttggcttattagaaaattaaaattaatttgtaagtaaaacttttatagaactattcgtagcgacttaaaagccaacattaacaaaaaaaaattacgttaaaaatatttcaaaatcaaatttaaaaattcaaattttgacttattctttggctgtttaggccaaacaatatagctataacattgcgacgcacgggacgtatcagtactggtatcaaacaagcttttctaattttgtaactgatcttttactatagtagtttccagcgatcaaatgcaaatagccctcgaaaagaaagcagagacaaaacataataatcactcagaaaacccatccggagaggacgaacttgcaaacacagaactgtatgcctacccacgtactcctacggtcctacctactaccgtcaacttgagattttctccctgagaaaaactgattttaccgattccccccacgcacaacgcacgaaccttctcagctctcaccggtggatagatagatgatactcctcgcctcgccgcttgcctcccccattgcgctcccaccggcggccggagtcgtctcccaatccgacccaaggtggggaccaccctcctgctcggtgggcccgagcagcccggccaagtggccgccgaaacccgctataaatcccccacgctccaccagcctccgattccacagcctacctagcttctccttctcgctcgcttcgcccgcataagtctagccacaaacccgccgccgccgccgccgccgccgccgctagcttccgcggagcggggcgagatgttcatcgagagcttccgcgtggagagcccgcacgtgcggtacggcgcggcggagatcgagtcggactaccagtacgacacgacggagctggtgcacgagagccacgacggcgcctcccgctggatcgtccgccccaagtccgtccgctacaacttccggaccaccaccaccgtccccaagctcgggtacgcacccattaccctcgccgatcgatcgatctgtccaccgatcgctttcgatccggcgtccgtcctgttctcgttttcgttttcgtctcccgtttggtctccgtgtttttcctagctatagctagcgcccgatccagcgagatgtgggatggcaaaaggccaaagagggggactgcgagtctgcggcgccttttgttgccttgctgctcggccaccgtggaaatttgcctgtctctgggattcgatcccgtctgctcaaaacgacatttcttctgagttttttttatatccgctagtttttattattatggctttatcccatggctgcacctgcactgcatgtgaggtttccattaaaattttgcatctgcaagatcgagcagggggacctacctagtaccatatataccactggcaagaactcccaaatttatgactgtttattagcttcttttattagttcaccccatttgttttgtttttttttctgtccatgttggctacgtgccagcacacttgtcgatcatgtttcttgacccagttttatggctgtgggtgcagggtgatgctcgtggggtggggcggcaacaacggctcaacgctgacggctggggtcatcgccaacagggagtaagtgatcactcacgctctacttttctgcctaagctagcttcatctgttttttcttttctgaatttaactgatgatggtgtgagtttaatcaggggaatctcatgggcgaccaaggacaaggtgcagcaagccaactactatggctcactcacccaggcgtccaccatcagggtcgggagctacaacggggaggagatctacgcgcccttcaagagcctcctgcccatggtaatctgtcctgttttctttgacatgctaaccacggaaaagatggtagtagtaatacactgctaatgtgatagtagtagtgctagtacaatcataacatggccttggcctgttttaaaggccaaggttctaaatgaaaagaagaaactttgacttgtggtcatgtcctaaaaaagaaaaagataagtcctgtcacaaaagggtatcaaaagataagtcctgtcataaaagggtgtcaaaaggtgaccatcgtgtgtcacctttgtcatgttgtgatgatgcaagtcaaaatgttgtggtacaaccacaaggttccagcatctttggacaatgattgatctgttgaatacatccacaaatagttttcagatttgcagaacctgtttttccgttttctgatggttatgaaaaaaattcaggtgaaccctgatgaccttgtgttcgggggctgggacattagcaacatgaacctggctgatgctatgaccagggcaaaggtacttgacattgatctgcagaagcagctcagaccttacatggagtccatggtgcctctccccggcatctatgaccccgacttcatcgccgccaaccagggatcccgcgcgaacaatgtcatcaagggcaccaagaaggagcagatggagcagatcatcaaggacatcaggtatactggcatgcatggaattgagcccattttacttcataacaaaaaggaatagtattctgaattagttatgtctacgaggcatgaacactaggggcagaaataacggaataccttcaggcaccagcttataacagaaaatagtattcacatgatatggtgtcaaagcactaaatatatattggcactttcatatatcaaaagggctccccgaagagttatactactgaagtgaacttgtttcgtaagattagttccagtctgcattaagatggttggaacaacatgacaaacttgtgactatgaatgctgtaaacattagacatgatattttttttattacttaaatagggagttcaaggaaaagagcaaagtggacaaggtggtggtgttgtggactgcaaacactgaaaggtacagcaatgtctgtgttgggctcaatgacacaatggagaacctcctggcgtctgtggacaagaacgaggcggagatatcaccatcgacactgtatgccattgcctgcgtcatggagggtataccgttcattaacgggagtcctcagaacacctttgtgcctggtatgtaattttctgtgtagagtagtatgcggtttattttctcaggttcatggcttatttgtttactgtgtacagggctgatcgatcttgctattaagaacaactgcctgattggtggtgatgatttcaagagtggacagacaaagatgaagtctgtcttggttgatttcctagttggtgctggaataaaggtaccaaccatatatcaaatcctttggctagcttttcgcattgaaacgtcgatattcttccggaaacttttttttatatataacctgataagaactttggcttttgttttcgtagcccacctcaattgtcagctacaaccacttggggaataatgatggcatgaacctttccgcacctcaaacattccgatccaaggagatctccaagagcaatgtggtcgatgacatggtctcaagcaatgccatcctctatgagcttggcgagcatcctgatcatgttgttgtgatcaaggtttgcaatttgtccatggattcttctgcagcagtatgccattaaaaaaaaacttagttttggattaaaacttgtccatgtattcttctgcagtatgtgccgtatgttggagacagcaagagggcaatggacgagtacacctcagagatcttcatggggggtaagagcaccatcgttctgcacaacacctgtgaggactcactccttgccgcgccgatcattcttgatctggtgctccttgccgagctcagcaccaggattcagctgaaagccgagggggaggtaagagttctgatggactgagatcaattgactctctgctgctctgcaattgccaccctttttgccagcaaaattgactatgttgttgtttcacttgttatcctgtgcaggagaagttccattccttccatccagtggctaccatcctgagctacctcaccaaggcaccccttgtgagtgcatacatgcatctgtactgcccattaaccgttatgttctttcatgatataccaactgatttacttatgtcacgaaaaattcgtctcctggaacaagttcctccctgcacaccaatggtgaac

SEQ ID NO: 66243 - DNA, 6960 bp, Oryza sativa
  unsure (1)..(6960): unsure at all n locations
cgacgggccgaagaaatgagaaaaagacgtggtgggctaacccaggacgaagcgacttgatgggctgnaaatgcgagaggtttttgggctccgaacgccaattaatgggcctgttcgggactccatacaccaggccagattcggaaagctaacgcgcgcgtacgcgccgctagcgcgcgactccatttaactcgattagcgattccagaggacgtaactaactcaattagtttaggttaatgacggtaattaataaaatatttccttttctccggaattttttttactaaaaaaatctggaaatgctctttgccggtcgcccggtgcggagggagccggatcgggcactccccccgcgccccctcccccacgtgcctacttaggcccacctatttatgctcctcttttttccacaaaagatgtttcacataatgtatttacaatgtttcactatttatagatctaatgttgtagtaaattaaaatactcttttgcaaaaaaaaaaacccacatattttagaaactctctattaagggaattttgtttattttttgttccacccaaaatgtttcacctagtgtactcataatatttcactatgtatagatctaatgttacactgaacgaaacattccattgcaacaaaaaacccacatattttggaaacccctattaagagaatttggtttattttttgttccaccgaaaaatgtttcaccgagtgtactcaaaaatgtttcactatgtatagatctaatgttgcagtgaactgaaacattctttcgctatttgctgaaacattgtttttatataaggtgaaacaacacccaatttaaacgagtgaaacattttcgatctacttagtgaaacaattctgatatatctggtggaacatcttgcaacatttaaaaataattcaataataagataaaagaaaatttcgtcgaaatatatccatgcgtggtcttgttttgaagatttaattgcaatgaatttaatagtgcaatcggatcatcatttggataagtagtttaagagataaatcagtttaaagtaattttgcatgtaaatcggacgctgacgtcagcgcccgattttaccctctcctgatcggacgcccgaccaggagtcatccaaaaaaatctatacgtgaaaaaaaattctcacttaaaatttaaaacttttaactcaaaatttgaaaatctaaattcaattttttaatattttcaactagaaatttaaacttttaacttagatttgaaacctttcgacttaagatttgaactttgaagtcaaaatttaaaaaatttcaacttaaactttgaaaattttcaactcgaaatttaaatttgtaagacaaattttaaaaactttcaagtcagatttgaaaactttcaactcgagattgaaaactttcaagtccatatttaaaaactttcaactcaaatttaaaaactttcaaattttaaaaaaaagaatgaaaaaaatatatggaaaatacgctgaggggagggaggcaaaagggaaaaaatcacgaaaaaaaaggaaaaatcgtgctgaaaatcgctaaaaaaatcacacaaaaaaaagagaaaaatcgggaagtcgcaaaaaaaaaaaagccacgtggccggtggaggggcgcgcgccaattagctcccccgaccagattgggccttaaatagacaccgttgtgtgcccatataggtttattgaatggaaagaacattattttttatcctgcatctgcttttattttctctacgaagagagtggctagggtatttcaaagaattttatgagttaagctaattcatttgaacttccatttaaattttggtgttcgaaagaaatcagtacgatgagctcacatccttgatgaaaaatgggactagaaatataatcaagttgagcatgtgtacattagttgtgcctatatgtgcttttgtatactactcctgttctcaagcaatagttatcttttctagtgaagtaaaatctcctaggaatataaagtatttttatctcaactttaaactctcttaaataacatattatctcttatattcgtggcctgataaagcatattattacttacaagttagtacaactaatatactactagagggtactattctttcttattgttttctttttggaagatcactagcaaagtagtgctactcttgctcgctagaacgttctgtatgacaacagtacataccccaatcatgtggctgtaactagcaccacgagtaaacttggccggatctacctaccgccagcctcttgaaaccaaagtgcatgccaaacagtctcccgtcccatactgccatacatacacacacacacacaagagtacacagctgaatatatatacgtgatttccgtgtgactacatatactcaagctcacgcacgcaccgtgacctcacttctgatccgcgtatatatataatctgcacacacattttgctctcccttttccacgtggggcgagacgtacgtggcgcgtggccatgtacgtacgtacgactcgccgatggaaacagcaacacgcacggggaaaccgacgcgcatgcgcgcacgccttgatcgaaacgccgtggcgcgtcgaatgatcgcgtggtggtggtgaaaaacccgcacacggcgctcgcgcgcgccgcgcagagaaaaaaaaaatctccggccgcagcagaggcgcgcgcgctgcaggttgcagctgcggttgggcggggcggggcggatgcgaacaaagctcgcgaggtgacaggatagcacatgcgccgatggccgcggaaggaaaggctcggaagcagacggacggcgcggccgcccgatgctggtccgcgcggatgccgggttggtgtgggcagcgacagctgacaaaacgtacggcatgatgatgtgcgtgtgttgctcctcatcctagctagtagtacgtactgtactgtcctagtagcaagcaagcgaaacacggcacgtagctaggagtaagactaaagcgcagctaccaagctgtacataacatatatacgatcgacgatcactaaacctcccagcgctgatcgatcgatgggtagcagtcggcaatgtgtgtgtgtgggtagatcgatggcacgggttaaaccgatcttaaaagaaaaatgacagcacgaaattccaacggcacggagagtgagagatcgagtacgttacaaatacgtcagtacgatccggaatcgatcaatcgtacgtgcaagttgtatagcatagcatatgtgtctgtcttctcgattccctgaaaacgggagctttgcccatattcgtcgaatagtagtaacattacagtaccatttttcttggacgagcctttcctaattcatacagcacgatcacccattgctagttccgatcgatctggatatctgatcgagagcgccttctccactccaagccgcgaggcgatcgatcaccattcaccaatttcaccacttgctatactagcttagcagtagttgccattcaggggaagcagcagaatggaaatagcgcgcggacgcccacaaagcgacgacgcgagcgaccaaattgcacccctaaacgacagcgccttgtgctgcagcgtccgtccgtcgtcgtactgggctattggcatactctctccgccaaaaaaaaaaaacctgattttcgtgtccaacgttgtactgtttttcttatttaaaaaaattatgaaaaaaattaaaaatacaaatcacgcataaaatattaatcatgttttatcatctaacaacaataaaaatacgaattataaaaaaattttatataagacagacagtcaaagttggacacgaaaacttagggtttgattttttttttttacggagggagtatggtgcatccctctcgccccaccccgaaaaaaaaatcttcccgcacagtacgcgcccccacgcccacgtcccacgtgaccggggtccctcacggacggccgaggtgtgcagatcgcgcgccacgcggggccacggcctctctccgccgctaaaaccccccctcctatagctcctcctctcttggcgctagctagctaggtgacccgcacacgccgtcacgcagcgagcggacggccgcgaggagcccgggaggacaggacagggccccgcggcacaggacgtgtcgacgtgacgtgccagtgtgcccgcgtcgtccgtttggtttcgatcgtcgcgaggtacgcgaggagagaaacggacgacggatgcgcgacgaggtctcggtctcgggtcggcgtgaatcgcgtgaagcttccgccttccgcgctcgcgagggcgaaggtgaaacgcagctggtaggcggctacgctggtggtgaggttcgctgtaccggacggacggcgagaggctctctcgggtcggggcgtacgtgagaattagcggtcgacggtcgttgccggcacagggccgggatggctcttctgttgacggctcacctcctccgaggctccgactagtagtgtgccagtagtgttaggttttgtaccgttgtggtgggtacgtcgttttccggttttacttcgaaagaacaccgttggttgcaaataattatattcgacaccaacttagtagtatattttttaaattttaatcattttcacagttttgttacagtactagctccttataattaaacagatgatattcattttattattggttcatatgagcacctcgcgtgatggcgtaagcccttataattctgagcttaattagggagtagttagtatccatatatatcctcctatgaaaatgcatgttgacatcaatattgatgttgattttgcaaggtgggagattttgcaagtctttgagcatgtttagaatttcgaaagaactcatttggctgctatatatacgtacaagcagcggtcaaatgaaaagccctcgtattgtaccacccaacaaccaagaggcaagccaatgccaagtggccaagagtgtgaaaacacttccctgaaaatgctaggcaaattctcttcacaattttaaacgtgcgtaaaatatacgttattagtactacatgttcacaactgtaacgatacgtagcccatacgcaacatgaaaaatatgcatttctcgaaaaaatattaattaatatacaaaatcacttactaacaattaaaatgtagttgtcgatgtttttctattttgaatgtagaaataatcattgagctatttcaacatcatacacacaacgaacaaagaattgaggaatcaactgttatatgtaccaaaccatgaataaattggtatggtaaaaatagatatgtgcaaatgaatgtgttgatttagtattagaaaaattcctgtcattattttatcagaaaagagaaaatatttcataaatgaatacctgagatgtgctaagatttgatcattctgtttcatgcattctagcaaaaacggattctcaaacagtaaagatgaaacatatacagatgaacatttccatacattagatactactttgtgcagcaatttagttagggcttgttcggaacggagggattacacaggattttgtaggattggcaaatcctttggatttggccatgttcatgcattcggttcataggaagcacgtgtaggaattttgtaggaatactatagcaaccctgtgaaaatgcgggaattccataggattctgaacatccactcacacctcatttttttcattagctaccacagggtagatgctaatcacgttggagtgactagatgggaactaatattttattgcttaattatactataattatactataatatatgagatcaatattaattagaacatttctatggtttatatattcatgtattccgaacgcttcatatcatcaaattccattgtttttcaattatacgttttgcatatgcaatcctatattattcctgtgttttcctattcctatgtttttcctatcctgtgatccgaacaagcccttagcaggcacaaatcatggaagcactagccttttcttaacataatgcatagtatttatgtcctcccaatatggttatagctgaatttaatcgtgcatggtggatcgatagtgcattatatacaattaaccgagcattatgtataaaacatgaccataaattaatcgcaaataattgtaatatcgaaaaacgacacagcggacaaactgtatataaaaaagaaagaaatgcacattttaagaagaaaaaagaaaggcaataattcagaggcagcaaaaatcaaaaacctcactacggtgagaaagatgccatggctggcgacatacatgcacaaaaccggctcccttcttcttcgcgcgctccctataaataccttccttcccccaacaccttccccctacccatcgccgccatagacgtacggacggccggctacaacacaacacagtaactgtaactgaagaagccggcgccaccattcccgccggcaatatgctcgccggcgccggcttcgtaaagctcttcacggncgggaccggcacggcgcccaagatggcattattcaagccccttcaccttcctcccctatttgacgacgacgacggcgtcgacgggccacgtaccctcttcctgttggcgcgccccctgtaccgggagcaggacccgatatacctggcgtcgcgcgtagcgttaccggcgccgaccgcgacgtcacgcatcgtcgacagcgcccggccggaggaggctgcaccggcgggcgccggcgccggaagaggcagcgaggcgggccaagatcggtgtttactttgcaacgtggtgggtgctgaacgtgatcttaacatcttcaacaagaaggtgctcaacgccgttccttaaccgggtgctcacgttcaccgtctccctcgacgacggatttgccaatatgcttaccttctggggccaacagaatcgccgaggcgccctgcccccgccctaaacg

SEQ ID NO: 66244 - DNA, 1082 bp, Oryza sativa
actgatacaaactcagtggcatattgttgattatctcattaagagagtgttcgctatttttttgaaaaaatgaattaatatgattttaaaaataactttcctctagatttttctgtaaaaaacacgtcatttagcagtgtgagaaaacacgcacgtcaaaaacgagagtaaaattgggaacatgcaccaaagaacacacccttaatcaccaaccaaacaacctcttaaaaatacatccccgacatagcattttgctgtcaattcattaaattttattgcaagtgtcctcaacttcactaaaacctcattaaaagtatacctaagtatactttgtgtgcataatatttccattgctgtcaaagaaaccagttcttttctacagtaccacttaaagcaattctccctccactcgtcgcacagaacaggcctcccattgcacggaacaccccttgtacattttcacccttccatggataaataagggaaaatacttggaaaccgaagtgtcttctgctttaaacaaccggtcaatcaaagctctgggaaataaaatgcccatgaattttatattttactgctgctagctcctatagtccctccggtgtgataatctaacagttcaaacacagcattctcaccctgtgcttttcaattaactgtatggaacaagggtaaaggaacaaccatagttctctaaaaaaaaaagctccagacatgacgattagcttctaatgataaaatctgagagaagcaacaaaagaaaggtcggtatgcaaggtgctacatgatgatcaccaatcatcactcattcgtgctgctcgtatatttgcatgtaggcttctgaaagagctaccatctgaggaagagtctcggtaacatgaagatcttgcatttcatacctaaaataaggaatggaaaatgatttacaaggccctctcaactgcaggcacaaaataaatacccatgctaggaataagctgaggagcataccaagcctcttctgatttccgctgtacaaatactctgtaacatccctcgcctggcttgccatcatggacaacgttggctatgagatcatactt

SEQ ID NO: 66245 - DNA, 40650 bp, Oryza sativa
ctgagcgttttattattttctcgccttgtaacataaccaattcccccttctctgttgtgtgctaaactgctaatccgcgaggcaaacaatgcaggaaactaggcatagcatcttgttgtgattttgtaaacaagatggtttatgcagaactgcactatatgcttcgttgctcgcgttattagccaactattatgcaacgaagaggagtagaggatggtgtgatcaaaactgaaaaccgcgggcagatggcgaaatttataggtgatgcccttaccgcatcaaactagattttctatcatacacctatatgagtatactcctatatcatcctcgtaagagcatctccaacagtctctccatcctactctccaagtcaaattttagccattctagcctaaaaacgtgctctaacagcctcttcaactggccaaaaccccctatccactagtcaaatttggccagccagaaatcactggccaaccatgggtcccacacagattcctcctcccctctccttcagctcggatgatgcaggcagccaagacctcgccaccgccgcgagcatcggcttccgtgcaccaggatggtacggcggagctcctcggcgcgggcgctaggccgccgccggcggcaaggagggggccgtggcggggttgttggggagccggcggcggagagcacgacggcgagcatcttgaacccacgctggagcgccaccatcgttgtcgaggtcgctagccgctgtcgccgtcgtctgcaccgtcgccagtcgtcctcgaggttgccgttgccgtcgtctggatccggcggcgaccgacctccgttgcctttgtccccaccggcgcgacgtggattcacgcggcctccgccgtcttgccgtcgccgccttgccattcgccgccgccaccatccccatccactgcggtagccgtcgtcgtttccatttgccagtgttgaggaagaggagagggagaaaatctagaggaagaggggaagaaagaggaaggagggataatagagactgacatatggatcccaatgtcataggctcagaatagagagtttagatggagaggttgttatagtcaacaatgagtttgaccgaccaaatcaattggttaactggctatatgggtatttagagagtctattttaattagtctgaagatgctctaacaaaattagaattttccaaacagacagacagcaaggcgaatcacatgagttccgcgagttcgtgcgtaacgtgtagagcgcgccttgacatctgtgttttcccctctgacgttcgtgcagataatcccgtgacgtgcggagcggagtatggcgtagcatctcggtgtgctccgcgcgctgcagccgtttcctccccgtcggatccgcccgcgccgtcgccgatgccgctgcctcctgcgcccggttgcctctgcggtttcccttctcttcagccctcgccacggtacgagacgtgacgtgcggagtagtacgtttacacgggcgtccgatcggtttattagacggatggtcttgcgagttgcgaccgttttgggcggtttgggccgtcgtgtctcgcggtggcccaagtcggcctgcgtaggtttcccattttgcatttcttttcttttctcggcgtggtgaaaaatctgatgttagttctgattttgcctgtcgttgtgcttgtgcagctccgtgctccgacgtacaacgcgcagcctccggaacctggtactactgcagttgacgcgcattgccttgctgaaaagaaagtggccctcagagagaatctggctggttaatgttgtgcagctccagtgctcccattatcgccaactcctgcgccggccacaccgccgtccccactgggatctcgatcgcctgtttcagcgccaaatagcaggactactttagagtttctttttagagaatggtattttttacccagcctatacatccaaccaagccctcaagcaacttaatctgaaattcgcttttatagagatatggactcaggaccataaaatactactcaggtcactgcaaccattaggttacatgcactttcgcaagctttattgcagagtatatatctagtgtacatgtatgactgccctttgctctctctctctcaatagggagaacaaaggcgtttcacgggcgcatttgtttctcatgtatagtattttcagcatcaatatagaagtgcatctcgcaacgcttactgcgtgatctgttggcgaatgtctgaatctgaatgtgatgtaagcgattcgacgaggcagcgtaagcagccactccactccagccgcgtttggcgtgcaccgcatttgggtcccgggcatggcttgaaaaggtctttggattccacttctcgtgccaatgtgcgcgcacggcttttttttttttctctcatgcaaaaaaaaaaaagctttccaaaagaccacacgatgtgtcaccaaacgtcagccctgtcacgatggattagacgagcatatactcgtttaatgtagctatagaactaacactgcccgtttgcagaaaaatagaaagagaggaaccatccaattgccagttaatataagaaaaaatctatacgtgttaaattttgttttattaaattcttattttgttttattaaattcttgctaacactacgtgtcatgctgtgagtatatttagtttttctataactacctgcacaattaaccatgcccgttttgttctgcagaaaaataaaaaaaaagttttgtgctgcagggaaaaaaaacagaggaaccatcaaactgggtttcagggctgcaggagaaaaaaaaacaatgtgaaagagaggagaaggtcagtcaatcagtggccgatcccaatcgaaagctttttgaaaagatgggctaaaatcaacccacatccacattccacaaagctagcgccgcggcctcatcattccaggcgcaccgccgctgccaccgcacgcacgcccgccacttcgctgtagtttatacgctcgccgtccccggctcatccccaatgcatgcatccatctgccaaagattttccaatcaatacattgccaatttgccatgccccgcgcgcgcgcgcgcgcgtgcgatcctccactagctacgcaccgtggcaaggcgccattttcatagacttcgctagggtgtgcgtgactttgtcagtgaggtcgccgcagtgtaaacgccaaccaaactcccactagcagagtagcagtccatcagcacataaacccttccattccaaccccaattagcactagatcgtcatcgctatcggctgcagcaaagaatggcaggagctgggaggactaggagcacggccatggcggcgtggtcgtactcgtcgctgctgctgcagctgctgcttctctcgatggtcgccgtactagacggcgcggcgacgaccggcggcggcggtgccggggcgccggcgccggcggcggactgcacggacgcgctgctgagcctggcgggttgcctgagctacgtgcaggaggggagcacggtggcgaagcccgacgcgccgtgctgctcggggctcaagggcgtggtaaaaaaggaggtggcctgcctctgccaggcgttccagggcagccagaacttcggcgtcacgctcaacatgaccaaggcgctccagctgcccgccgcgtgcaaggtcaagacgccgccgttcagcaagtgccaccgtgagtaaattaatttctgctcacaatttgatcttcttcttatcttcggggggaaaaaaaagaaaagaaaactgagtctccgtttcttcttgtttgtttatctgatgatgtggttcgtgcgctcttgcagtttctattccgggcgtgactggtggtgctcctggtaagttattgattgctcaattacaaagtcattattttttttcctgattacataaaagatactccctccgtttcaaaatatttgacaccgttgacttttagcacatgtttgaccattcgtcttattcaaaaacttttgtgaaatatgtaaaattatatgcctacataaaaatatatttaacaatgaattaaatgataggaaaataattaataattacttaaattttttaaataagacgaacggtcaaacctatgctaaaaagtcaacgacgtcaaacatttcgaaatggagggagtacatgcacacacatcgttacacacgcgcactgcacgtacctgtctagcctgcaaatgcataacgcgtgttcaagaggatttagatttttgaataaaattggcatgggttttgatgtgttgggaaaaaaaaggtagagcgataaattgcttctgcatgttataaataattgtttttacagagtataattattctgaaaagtaacattacaaaatatgcttttaaataactctttcaaaaaaaggaaatattacacatgcttaaaaaatatttacaaacaaagcttttaaccgtttgatttaactgtaaaataattacagaaaatctcaattaactcacagtttgtaaagctttgtacctatagccttttcaattcaaaaagaaagaaataccttctgaaaacagtcaaacaccgacaaaatggatcagttaacttggcgtccttccattccattaattccagctcccgctccattctccggggctccgttcttcggggggtcgtcgccttcggcatcgcctgctgggacaggaagcgactccgccgccgccaccgtaagagctccggccccatcgccgtcggctgctgtccggcccaaggagacaaaggcggccttgttctctgccgctgtaatcgccgccgctactctgctcgcgcaccgtgcctagttaggctttggcctgcacgggtccatccaacgagcgtgtcgttgcagttgttgacttgtgtgtttgcatatgtaccgagatgtatcttgtgagagtttttccctccatattactacacacttaaaccagcattttttacgttcatgacaaaggttctcacagatcatcaatcttttttagttgcattctcagttttacgacgtgatgcgtaagatcgataaggcctagaacgatcaaagtaaactagtaattgttgttgttttagtgaactagtgatgctggcctaagccctaaagcactagtttgggcccacctccttttgttctctcaaattgattgagcccatccatagtttgggtgtgtcagtttgctttatttcggaggccaagatttatatggaccttacccaagccagtgtcatctccctcccaacaccctgtatgaaaccaaacaaaactagcccgtagtcacacaaacacagctgcttcactcgagacagagaagcgcaatcgcaacttacttagtagctgcgatcatggccacgaggaacatacagcttatcatatgtacacgtgaggttgggggtacctcacatggaatgctcatggacattcgccagcaaacgcagctctggcaaaatctaggagctgcattcacttaagccaaaaagaggcttatagtttaaacttcagatttccgaacaacggatacaacaactgttacatcatccagcttgcccccagagtaacccagatacccaactgcaagagccgcgtcagagaaggggcttctacaggttgccgatctgcccacttccttcgccctagcaaccaggaactccgcaatctcctgtgattttatgcaaaatgatcatgtaaggacacttcacggacagttctatatgagatgggtgagtcttctctagtattttcagaagaaaagtgttaggatctaaccgaaggcttgaggccggcttccaatgatttggagatgacagctgctatttcttcctcatagacattgtcaaaaaggccatctgttgctgtcacaatggcatctccttcttgtagatcaattgtgtatttctgccagcaaagagggacaaaataagttttaagttcatatgaactttatacgaggaaccaatgatagcagggcaaggatgacagggtaagtgctgtggcacctgtacaagtttgaaaggatcatcccccttctcaatttgcaagggaaaattgaagccgtaagtcattggctttgatttttgatatatttctccgtttcttatcaccaagaatccagaatcacctatattacatgcatgaagtacctgtgaaaccaatgagttcacaattaatcaccattcgccaacagtgaaagaaaagagaaatgggcatccaagacatctacgaacatacttgaccatcaaagtgagcaaccaaaacagtggaagaaccaggggatcgtgcttcatctgcagccttagcaagaacttcctcagttctcatctctggagctccttgactctccataacagcttcttacaaccatccattaattctctggcatacagccctgcattgattcctgaggacggaagtcaaatcaacaaatgtaagtggccatattccaaaggatagcaagaatggtgagaaatggaatccacacttaatgtgaaattaggtgaagatagaaatattatccataattctcttcaaatcctccaatagtacatactaacaaactggcttacagactggagcaccctatatactatgtgatatacgagctgtactagagcagaaaataatattttgctgtacacaatgattctttagcagtgccttgtgcccccctgaaattcagttcagtgcctcatttacttagattccatagtttctcagtctcccctacataattttcctattcccctttctgctcgagggtaagttttatgacatttgggactaataactggactatggcatattttagcaacatgatttagtcctatttccatgtgtattacctattattccacaattttgtttggttttacatgttaagatgttgttcatttacactcaattgagctagcaacagatagagtgacaatttaaaaatcacaacaaagcaaataccataataaaatgatgaataaaaatgatgtagagtgcgatattgaaaactatagtagttctatttatcatttgtctttgccttaaacatcagaaaagaaaaaaaaacaaaaggaatgcagccatcattttttaggttgatagtcactgtcagtctctattaaatgtgatctcgcttcccactttacctggaattcttataacttgtctgaattttggagccttacagtagtaatcgaaaataggcacgtcctttatagttatgccactatgaacctaatctcaacatttcgcaatttctaagtctaatttggtgtgcaaatattctgcatcccatggagattaattatgccattagtattggtcaccaaaaaaactcaggagttcaacacatctgcaacgacgaggttacacaacaaatagtagttgagaaagaagaattggtttaccttcaaatgaccattgacctactccatctgctacaccaaaccaaccgtcacaagctataaaataagcatcttcaccacctgtcagcacctggaatattatgcagataacattgtcaaaatgactgaagaaaaatgcgaggttatctcgatggtaatacaacttaacatattcaacaaatcaaatacacgtggacggttacttcaggtataaaaccagatatcaaaaagttgcacaaagaattcaaccgatcaaaatacatgggatacttgggctaaatgttgatgaattatattagtttcaacacttgtttggatagaggctatacctttgtactttcacgtaaaggggtttcggacaagcagatagaacgctataattgtgtgtttgcttcaaaagcttatgttgatgtttctatctttacttctaaggtttaaggaatatgaaaactatagatcacatatagactgggaaaggagcaagaaataaaccagaagcgagataatagtgtttattattcttgtaaaatatttggaaatagcgtggagtggaatgaactttatcagcatgaaagtaaagcttatttcatctctatacaaaaaatacacaaacccattcaagtgaaaaatcaagatagtggtaccatcattctgaagtgcattttttatttgaaggacatagtaaatatattttacagacaagggtcagagaaaaaccataatacctttgaaggatgaggtagcattgctgcacctgaagccaatataagtgttggtagggttactgaagacatcctacataagaattaagcataaaaaatgaatatgcgatctctttgaatctctgcaggttcaaaaggaaaatgataaaaccatgtggaacatccaactttaaaagcaaacaaattacaccagaggcttcagttcaataactttatattcattcaaaaggatcaagctgagtcaaaaccttaaactctaaaatgctaaaagcaatagagctaagtagtacctgtcagagctcttcacctctgaactcttgtttcccctggccacttcacagatcgcttgttcctacaaaggggaagaacaaacatctgagcagaagaaaataacattaccatggtatattcttattcatatgacagcaaaagctccccgaaagttactgcagcctgcggcctataaatttctatgaacagggtcacttccaaattgtgcattgatatcacacaaaatctgagtctcttgagttagttgaacaaacacgcctttcagaaaaagtgatatatgaccgtatcatgaaaggataaccaaataactaacaaggtactgaatactgatatgaagtgtgaaaataaatgtagagcactcaataaaagcatataattgcaagaaaaaaatgactcactaggatgaggtatctaattttcagacgctgtatctttgtattaaaactaaactgattcatataaactgcaaacctgagttacaaacatacagcatcaacttactgatattaagcatagccacgttcacaactatctaggtcatgagtttgcagaaaaagaaataccgtgtgtgggatgtgcactccgtatcccatgtcttgttcttctatacttgaaccgctcgactccgtctccacgtcagtatcaaaatcctgcgtggttgagccgtctgaagcctcagagtcatccaaactcgtctccatcctgtccacaccttcctcaacctgcgtgatggagccaacagacgccacacacggctccagggctgtttccatcccgtccacaccttcttcagacaagacgccagtcacctttgagctcttctcggcgccgcctccatcaacgctcgacaccaattccccttcaccaaggccatttcgaccgtccgcatccgagccacgctccgactcgacaccgacctcagaacttgcatccctattagatgaccctacaacaacaccgggcataacctcttgttcacatcctcgggtatcactggtctctggcagggactccaacatgagaggggagccaccaatagccccagcagtatccaaatttgaactagcctctgacggcgacacctcaacgggtgaaatctcattgattgcaccagcttcatcggaacctgaagtaccacgatgcaacagctgctgctcatggattccgactgccggagaacctaatctcacatccagggcaccctgctcagccaatttgagctcagcgccatcctcagagcacaaaacccccggtccttccggcgcctctccactcaccacgacagcgccggcgtcctcaaaacacggacatccaggcacctgctcgataccctctgcatccaaaccaacaccaaaccaaaccaacaccaaatcaaatcgagaaccaaaaccgaaggagattaagcaagcatgaatgccccttacccacacctgtaggggagcagaggcagagctcggcggcagcgccacaggaagcagccggcgcgcggggcggcgctggggagcatccggcggcgcgcgcctcttcatccatggctaagctagagcctgagtcgaggggatcgagggctttggatcagcacccagcgagagagcgagcgagcgagctagggatcgcgagatggaggtgggggaggacgggaggagaggttaatgggggaggggaggaggcttgtgtgggaggttttgaggtgttggggggcagcgccgcgggcttccgcggctcggcggcggcgacgttttctctcgccctggcggtgcgcggtggggtgggggttttccgcgcggttttttttttatggaatttttttttccgtgtccgctttggtctttgtcggttttaggacaaagggcctcccagaagtttgtatttggcgggtaggagtcagtctctttttactctctttggccgccccacgtgtaaaccggcgtgaccgttggtggcttcccggttgtttatttgttggttcattattttttacgacttgggctgttaattaaatgatcgtactacaattaaagcaaaagatatacttcctccataaaaaaagaatatgtccaaatttattgtactacactatgtcatatcttgatacgatgttggttttttctgggacggaatgagcattcctttcatctaacttcatttctatcatatgccattgttcataaataagttaacatgcttttttaatatgagaaaaggggaaggtcttgccagacctttctgtttcataaaagatttctcttagtctatctcagtccataaattgacaaattttattcttccatatctcttacatatccaaccattcaccaatactacatctccattaataagatgtacttttttgtctttttgtttcattttaatttagtgctcctatgattaaaagttattttagacagaagaagtaattaactgatacagtgatcgatatagtatgtttaaatattcaaaagttagcaatgagttattttttcaagttagtaaatagaaaaaaaaataaatgaattggctcgtagttgttgtgaggaaaagttctttatatggcactatggtagattagaaatgtgtttattcaaatatctctcatgcattccgagggtcaaaactctcatcgtttcagccatcctcgaacacacaacaacacaaatgtcacacgagtaaaccttgtatacttcctccgtcccaaaaaaaacctaacctcgtaccacgacgtaacacattctaatataatgaatctgtacatactctatgtccagattcatttttctggaacgcagggagtacctttcaaaacaaaacagaaagtaaaccttctgtaatcaccaagggacaggcatctaagtctaatacacaatcttcccgcgggcaaaactgcaaaaaggagtaggagccgttgatcagtcgtcgctagtttcggtctgcggataattttgtggatatcaaaaccggcaaagtcgggtagggtcgccacatgggttcgtgcgtacaagtccacactttccgcaaactatcaatcgatccacaccctccacgtgtcgtccccgtcgtccggacgtgtcaccgccatccccagctaacgggaggatgcgccgggcccacctgacagtctcgctgaggccaccccgtgaccaaccatgccaccgagctgctgcaagtgggtttcccgcgagtggatcggatccgatcgccacggctgcgtgattagcgagacagggaggcttatctgtttctctcctccggataaggccctcaattattaaaaaaaaacaaaacttattcctaagttcatcgattggttgattaatgagaaatcatgagtgtgtttttaattagtattggttggataccgtatcataggtctgcggtattcaataccgggagggattgatctgcactgttctctgcttgacggatacgttccaggcaatcattgatgctttcttcccattcttttcagttcagctaaatttaacttgttgttggctactcataactcacctactgttctgttcatctaattaatcgctctcttggtagatgttgaaacgaacaaacttcaacattggacatattctatgagctaagttagctgaatctgaatatcatagtagcatgtactgtttaaagaaggcaagtacagtgattaggcaacaaagtttttggatgaagtgatgaacacaggattggatattgtactctattgttaggtcggatatagatatccttggggcgaactgagaaagactagctagcggatcagagtaggaaaggcttgtctctctgaaagagaatttaatcctgaatttggtttccgggagacatgacatgcctcactgcgaacctcatcttcctgtcagaatcaagaagaggatcgcaaccacaaaagaaaaaggaattttccattctcgcgtcggctcgagcacgcggcgaactgaaaatttcttctctgcaagtaatcaagttgcatgtgctatcttagcttctggaacagcccgatcagctccatttcttggccataccatcgccatagtcagaaattcagaaacagctgcgtgcaatgcaacaagatgtttttgcggtttctgcctgaacaagaacaaggtgtgatgcaattatgcaaaccacagaaccagctgcagcggaattcggaaaacgtcatgccatatgtatatacgagatgtaatcaatgcagatagatattaggttgccgtcattgcatcaatcaactgctatgatcgatcgatatgagagttgcactggacagataacgtaaaagattctgatgcaagttgtgtgtgtggtacaggctgcagatgagggataggatggccgaacctgctttcactgttccatgatgttgccgacttttaattctgtccttaattctttttcagcttgattccgcagcatgcggctgcaggtgcgcaaaccatgctcgccacagcctcccactagcgaattagcgatcgattggcgattgttcttcttcttctgaaaggagacaaaacctgtgttgctccactcacagattccctgcccattggtgtgcccaaatgggatcgctgctttgttgcaacctgaaaaagaatactcgtctcttggaagattcactgttctatcacatgtccatgtgatggtgcatacattgtcctggagctgaaagtttttctttaatggtgactttacgtagatgagatttattatatatttatatcttgactaactcggatcttggcttgacatctacgtgcgcggcgcccgttgctttggcgtgagaaagatgcctttgttctgtgaaaattctggtggcaggaacaagaacctgtaagtctgtaacggccgctgcttttatcctggttgcaagttgcacgaatatttggtctgcaaagttaatttgttcgcctgtacatcggaataaaatgcagtttacaggagattggaatggagagtttgttgatcggtttggaaggaagatgtaaaatgcaaagttgaaaacgtcattagactatacttctgtctgaagacgcagaaataattaatttggtgctgtctttctgcgaatttgaatctgactacctgggagaagcatactacgcaagaagtttctgaattaactttgcctcccttgaccaaaggcggacgaaaagaaaggtcaaaataacactccgaaaattgacgagcagagataaatttcagcagcagcttaagcgtgactttggatagtttctgtgtcggtggccggcacgagatgatggactccgacaacctatctcttacgatgccaccggccaccccagtgaagcaggaaagataattctaacactgaactattactggcttgagatcgaagccagaatatcccagctgcctcttgtcttaagaaatcaggacaacacagtgtttatgtttcttgcatctgatcccttgctccaatgcttgagcatgagtctcggctttcccttctcttttcctaaccacccaagggccagtaagagtgcaagtatctaatcgatggcctagcacggtactcctcggtaggtttgccatggcacaagaccggaatcaacaagccatgtcgctactggcccgtggcacatgctgtcggcgtctctctcttggacgcagatgcctcctgcccaatatctgcgcagatctaggagcagcagaagcatccattccttcccatctgaatcgattcctctccgattctcatgttgccttccattgcaggtacactgaaacacaaaccaaagcggccgcggtgccggtgcacacgcgcggcaacggatcggggagagattgcgtgtaaatccgtaggcaaactcgcgcacaccgacaggcgcgcgtcgcggagtcgcggttaaccgaggcgcatcgcggaggagtcgcgtgaccggtgacaacctaactgcttattagccactccttagccaaatggcgtcgcttctcctgtccgcgtccggtatcttggcgaaaatcatgtacaagcgcggcgtcctggtcgaccgaggctgtcgagatgtggcctgccctggccaggccaatcggttagccaacgaaaacttgtgacctcagagctgcgacgtggaagcgatcgagtcatgcgcaagcaagcaacgtcccaacgcgacggtgagatcagatttttttgcgatgcgcaacgcaatgctgtcgtgaacttgatgtgttcgagaccacacaaaattttactagtagcagactcggatgccacagttgggccggtatgtattaaaaaggaagcccactagtatgtaagcccattaacgcgcaggccttacggcccggtatgtgaagtgggcccggcccgtattcacttttacgaaaagcaccttggagaggaacgaaatggcaagcccactcttctcgctggtgtcgaggagattccccaaaaacttggcccccatttctttcgcatcgtcgtctcgccttgccccgtccactaaccctagcggcaactgcgatctccaaccgctcgatctctcgccggaggctccagatctgcgggaggtagtcgacctcgtcgccggcggtggggtttccgaatcgggggcgaagatgacggaggcgtgggtgcggcacaagcccgggatggcgagcgtcaaggacatgccggtgctgcaggacgggccgccgccgggcggcttcgcgcccgtgcgctacgcgcgccggatccccaccaaggggcccagcgccatcgccatcttcctcactaccttcggcgccttcgcctgggggatgtaccaggttggccaggggaacaaggtccgccggtaagttcgccttgcgcatccatgtttatgttaaactgcaattcgttttactgtgtctgtttagccgcgaattccgttggtatgggacacccgccaaaaatcatgccttccagagctgcttcttgttatctatattctacgctacttcgaatgaattgttgcagccggcgatttggtctgagaaaaaccttttacacgaagtacggtaatggaggtggaaatgcaacatacaaagaatttagcaagaactagagttgtagtagttgtatcacacactgaatggatgaagttgctgcattttctcaaaaaaagaaataactgcgttaatgatacactactattcagcaccttatctgattagttaatctgaaggaaatctgattcttgctgcccttccgtacttgtctgtctccgcataagttcagaatcaagtagctaacccgagaccgatcggagtcctatgagcaaagatattgcaaaattgggaatccagtgaactctgcacaacagtttgcttagaatgggtcccaactaattattgatctcgaatttaggaattaaatcattagattagtaaaatgagagtccaaggttgatacagcttcattttttgttaatttcgaatttaggaaaaaccttaggatatctaaaactaaagattccattgtagtaaaaactaaagaatctataatattttcaatagcatatttttaactcgaacttttaatacaatctatggttgtgataattcaatccaactaaccaatggccagctctatctggttaacgtgggagtcccctcagagtgcccaattagtataggtatagtcttgtatgtagactgtctaggacagttggatgttactattcgtatgcatgtattacaattctactcctttagtaacccctttgatgatgtgagatcttccacatatttatgttaattttatcagttcctatactttgtgaccatttcagtatttttagcatggattctaggatttttgtgctctgtgctccactcttcagtattcagttccaggagaaattttcattaatgtgacagtgtgggtgaaccataactttttgttgtcatcgttgagctagttatatgcagatttgattgcagtggcaatggcatcatctgagttccgttgccttatttattcaatttagtgatcctgagacatttgttaggtcacagtataactttggactggttagattaattgtgaaagtaatccttaatcaaggtgcagcacctaatgatatcatcctccttttatctaaatgtttttttttattaatgaccatacacattaaaaaacaagtgtgttgattcctgctatgctttcctgttatgttgtttgttacaagtaggcctgtagctctgatgagtatcttgccaaaccatgctgtttacattccccaccctcccagtttatgacaaaattgcttgctcatgtttgtcttctggtgcagttcatgttgttttttgttgcattttatatttgtcaattgtctcatcgactgtgctattgtttttgtagtgcactcaaagaggagaaaattgctgcccgcaccgctttagtgccagtgctccaagctgaagaagatgaaaggtacagctcaacaattgatgccatactctatatttttcccacaacatcctcagtttcatcttacgcataagatccatggtacttccttagatttgtcaaagagtggacaaagtctcttatgtgggaggaaataattatgaaagatgtccctggatggaaggtcggccaaagtgtctataattccgggaaatggatgcctcctgccaccggcgagctgcgtcgtgaagattgatgaaatccaaggggcttgccgcagcctaccaaagatgccatcatgtcttttgggcatgcataaggcttttgaaccagaatacccaaaaaaaattgctacgaggaactcactcttaaagcactcgctgtgcatttgttgtgttgatgaaatcttggctaataattggacatgtcaaacagacatttgtttcacatgaactatgctcttttgtggacggaacatctgttttgccctgatgttctcccttctctatgttttatttttttctactctgtactaagcacttcttggtcagtgctttaccttactgtaaacattcgaatgtattcagtctttttagacaaagacacaggaggaacattcaatgtcaagcgcttggatcggatgggtatattaccgagatagtgaacggaaaactcaagaagtcagaatcaagcccgtgatcagatagggagagccaaaacagtgtcactgcgtactagagataaatgaacaagcaaaaggcaactcaagaagtcagaatcaagcacgtgatcagatagagagagccaaagagccaaaacagcgccactgcatgcgtacaggagataaatgaacaagcaaaaggcgaccgataatatgtattccattcgttttataatgtaagactttttagccttgcccacatacatatagatgttaatgaatctattttataatgtaagactttttagccttgcccacatacatatagatgttaatgaatctaaacacatgtatatgtctaaattcattaacatctaaatgaatgtgtgtaatgctagaaagttttatattgtgatacggaggaagtatcacattttgacagtttgattttgtactgtactaggtttgatgaagattggaatgcgaagattgctttgagaaaggcccattgtacggacctcagaacacctagctgaactagcctgggctttattgtttcggccttgatgggctgggctccttctgtgttgacttcccggtagaactggaatcggaatcagagcggaaaaaaagaaagaagaaagaggcagatcagatgacctgacctccgattcggctgatcggagcccaggccccggccaagtttgccctcgtttagttttcaatttttatttaaactttcaacttttccatcacattaaaatttttctacacacgtaaatttctattttttttaaaaactttcaattttaacgtttgtcgagctcgccgtcgacccccctcgtccgcgccgcaggctattcttcctcggtgcaggatggacaggtgataatgacaacagaaaatggcgttcgtgctgcgcctagactcccctagctctgcgcctggcgcaccgttgcgttgagggaggcgttgagccgttgactcgccgctgctctcatgctgtgtttagttgctgaaaaaaattgaaagtttgagaaaaattggtagtttgaaaaaaaatttagaagtttatgtgtgtaggaaagttttggatgttatgtgatgtgatagaaagctggaagttaggggtgaagtaaacacgacctcagtgctcgttaacgtcaccccgattctgatctttgcatggctagctgcatgcggcttctgttggctccgtgacctgtgttgagccgataccctacccaacatttactgcatgatggcactgtaaaagtcacaggcagcagcacaggatccgaagacagtttgcagatgcatgcaagccgagttgatcgtggccatggatggcaatttgcaagggaaagggagcgataaaacaagtgatcggaggtgccagccgtctggccatggctgagcctgagtcctagtaactgacaggagctgcgcggcagtagtacagttaatactgcggcacatttattaatctgacgagacgtcttggcttctcgtgtgcctctgccatgtatcgatcctggccggctggccgctggccgggccttgttgcttcctttcctccgaaacgtttccacagtctactctacagtataattgtggaggtgtgtcatgagaaatggctgcagcagataagacgtcactgagctcattgtgcagattaaaagcttcaggggtgtttagatcgtgttgttaagttttagcgcgtcacatcggatattatatagggtattatatagggtattcggacactaataaaaactaattacagaattcgtcggtaaaccgcgagatgaatttattaagcctaattaatctatcattagcaaatatttactgtagcaccacattgccaaatcatagagcaattaggcttaaaagattcgtctcacaaattagttataatctgtgtaattatttatttattagcctatatttaatacttcatgcagatattcaaacgttcgatgtgatatggtgtaaaattttatgattgaatccaaacaagcccttattagtagccgtagcagcctttcctctctcttttttctttcgctgggtcttctgcttcttctgtgcagttgttccatttggtgatttactgcattagtaacattattacagcagctggcgcggcaaagtccaaaagcgtgagtccatgaggcagtgctacgaaccaacgattgccccatgcagccatgctgcttcaggcttccgctttttacgtgagtactcccatttcgtcgtccttgctgcaactgctagatcatcggacaaacagacctgcgcctgctggtcatgatggattcatggatgtgattgcgcgaatgatggctagaatgtggtgagcaagtctaacagcacagtgcgcacacacacacgttggatttagatttgctaggtgtattttgaacatactcctaagttgatactgatagtactcctaagttacatgtacatcacccggtctgagcatcaatacaagaaggatggtacagtaattgatctggtgagttcagagcgacatgtgggtcaggcttggtcgcaatcaggcagctaaagcattgcattggttgggtgtggccatgaaaattgatgtcgacgtagtactacatgtaggactactgtttactcagtggaaatgctctgcatcaatagaacaggggcaaaggcaatatgctggtactcgctctggctagctgtgccttctactccatcacagtagacatgaacctatcgacccagcccatgttcagccctggcctacgctgatagatggagagtatttgcttgagcgacccaactacttcgtccctcttgtgttctgcttctgaattgctgcatggcgacatggcataatccgtgcaagtttggaacggtacatctagcgcaatgcatgatatagggactaaacataccgtcggtacgttgccttacgctaacaaaccgaatgcataagggacacacttcaaccctcgactctccaggaaatggtcagattgatcaaaccttattgaagcagaggagcagaatcttcagagcattcattgtgaagagcaacacgtaagaatgggcaaactgtatactgctcgtcaccctacatcgtttttcatgaattaatatcaagaacagaagggatgccaggattgcgcgcttcatttctttttattcactagcatttgtagcaccgcagtgtagtggagtagagtaaggagtacctacaagctactgattactctgatcttaaataccctgttcctagctacatgcatgaccatcggggatgagataatagcatttgtagcacgcagtaatattaagcatttttaagattcagaacatgtgctctttttctattttaagtatatagcgttgttaacttttgaacatagtgtatgaccatccatattatttaaaaatttagtgtaaatatgaaaaagaaagatgagtcatacataaaataccgtcactaataaaataaggcataacaaaactagtaacacgtgtacatagttctttacgagacaaatagtcaacattagccgtttaaatagaggtagtatataatataaatatttccatagtactatttatctcataaataaaactttgactgacaataacttttaaaatatttagaatgaagaaactatacttcaaaagtattgccttcgtcctattcttttagggacggagggagtactttaataaaattaaatatttacgtaaattttaatatgttacaatagaaaatcatagtaaaaatatgttttggatatgtgttgttgtccaaaacatcaggaattatagaagcggagtatgattttctttttcctctcttcaatgcacttatatacacattcatagaggaaaaaaaatgtaatgccgcctcattttctccattctggagtgtcagtagcaatgaaataatttgacgcataaatgtattacctgatcatcacgttttcaaaccgataaacgatatgcttttttttaaaaaaatatatactatacaaaggtttctttaaaaatcaaataaacaccacttaaaatttataatagttaataattaattgattatatagtttcgtgtatggcaaaaatgcaaaagctaaatgaggtatcaaacaaccctttatactcctacagtacatgtctcgtagtaccactgtagctactgtcatgtttttgaatttttaaagaaaaagaagacaataaataccagtactagatttttatacttgctgcgatgaggtacatttctgagctggtgctatatatacgtctgttgcagacttgcagtgtttacactttacagtggcgcatgcatggagaggagagacactgtttggtcttgacggccattgatgcagctgatgctcgctgtctgatgagtgtctgaatagtgtcttccattgggtgtctagactagagtctggaactctggatatgtgcatgctaatatagcaaaatgccaggaatgaatgcaagaaacttttcgccttattatttttatttgtaaagtactctctccgtcccaaaaagaatcaacctaaaacctctcacagtgcacctacatggaccggtgctccaccttgctagcgaggattttcgcttacgtggcagaaggaatcgcaccctagcagaggatctcgcacccatggagggcgacgcgaaacctcgttcttgcgagtccatgggcggagaagaaaacggctagcgctcgcactgtggagggcgtggcttcgatgcgccgtgtcctcttgcgaagaaatccctggtttgcccacgaaaactcccctcccgccacagccattcctcccctcccgccacaggcaagaaaatcttcggattcaacaagaaacacacattggattcaaacagaaatatctcacagatcggattgaaagaggagaatcgtttataggttaaacaacgagaaattgaagaaataaaaatcaatagaaaaactaacagatcgaggcgtatgtccaccacaagatgaaaaagaaaaaagaagccgacgccggtagtggtggccgacgcagccgcagccaagaaggtgccgccgccgccaagaacccgctgccgcccaccggatccactcccccacctcctcctcctcgccgccaccgcgtgcactgtggaagaccgcgccgcccactgttgcttgggaggagaggagaaggaggcacggcagcatgggaggcgaggaggcgcaggaggtgaggaggcgcggcggcgcgggaggcgaggagcgacgactgaggtggagtgggaggagccgagctcgtgaccgggaggaggaggaagggtaggtgaaggaaatttatttccttgtggtcatgcgccgagtcacgcgcgttgtggcactctttgccttgtacggtgccttgatccaactaggtcacacaaaataggatccttgcattgtgagaacgagtgtctttgagtcttttttagggctaagctacgggagctggtgcttgcactgtgaatggcctaaaaggatatgcgacccgttctaggacaatgcatttggatgtgacccctcttaagttgattatttttaggacaaagagagtactctgtctcttttcttttttatgatattggtcaattcaaaaatgaactagcaatggagagagtagatcgttagtgtgaaactaacctgggaccgggtttattaaggcctggtttagttctccaatttttttccccaaaaacatcacatcgaatttttggacacatgtatggagcattaaatatagattttaaaaaaacctaattatacagttagaggaaaatcacgagacgaatcttttgagcataattagaccatgattagccataagcgctacagtaacccacatatgctaatgacggattaattaggctcaaaagattcgtctcacggtttccaagcgagttatgaaattagttttttcattcgtgtctgaaaaccctttcgacatcagatcaaacgtccgatataacacccaaaaatttttcttttcgcgaactaaacaagtcctaaaagccaaaaactcaacccactagacactgttacaggagcactgctggtagagtaaaatactgcgagcaatgtcacttcaaactgaactaaggaggtcaaagtgttcaaacttaatcatggctccataattcacgagattctaatcagaccaaaactttcttctgctactgcgaccacttgatagcctgattattgtcctggcaaggcatgcctgcgtgtgtgcgtgcaattggtgggtgacacgaaacgattggttcgaacaagattatcgaaaagctgcaggttagtgccgtttcccatcccatcaaatcagatccaaggacaccgctatcctattcctcccctcggctcggccggctagtttccaaaagctgcaatccagaggctcctatataaggccttgttagttggcaaaaaattttgcgctacatgtcacattgtatatatggacacatatacaaatttcaccaagaaactacgagacgaatttattaagactaattaatcaatcattagcaaatgtttactatagcaccacatgttaaatcatggcacaattaggcttaaaagattcgtctcgcaatttcctggcgaactgtgtaattgatttttttctacatttaatactccatgcatatgtctaaatattcgatataacagggtgaaaagtttctgcgtgggaactaaacagggcctaagtaagatttcaaaatttttaactttggtttaaaaactttcaagctaagatttgaaaactttaaactcagttttgaaatttttagttaaaaggttttaggttttaagttgaatgttttcaaattttgatgtgaaaagtttgaattttgagttaaaaattttcaaaatttgagttgtcgttttcagattaactcgaaagttttcaagatctgagttaaatgttttcaaattttgagttggaagttttcaaatcttgaggtgaaaatttcaaattgacttgaacgtttttaaaatataagttaaaaattttcaaatttcggttacaagttttaaatgtcaaaagtccaaaccgtgcaaaaaaaaaaagcaatgtgctaatcgaatttaattacgtgaatcattaatgaagcggtaatagaaaaaaaaacggtacgatttcgttttccactacatccaaccatcggaccgttcgctgacgcgagctatgttttcgacgcttacacacgtattaggattctcgccacaatcttggtccctgaccccgtcgcaactcacgcaccttaagggcgtttacaaattacaatgtatctacgcgacgttcagtcttagaggaagaaacggcatattcggtgccacgtctccacatgcaagtgagaaccgagtagccaaagttggtcacctgttcttgggctaaaaagcgcacagacgcagctgagaagaggagagagagagagagtgggaaaagcagcataagcaaaagcacagctgcccgacgccgtcgccgctcgggccacggcgcagaggttgaaggagaaagggagaggcgccgagatccgagcgttggcgcgccggcttggggaggatggccgcctctccgcccggccgccccgcgccgccgccacctcctcctagggaggagaccggacggggagaggaaggggccgcgtcgccgccttcggccccaacgaggagaggtggaggcgtggagctcggtgtcggcttggggaggagcttcgtctgcccgggagagagtggtgggaaagtgtgagaggagagagagggagagataaaagtgagcggagagagataggtgagacccactccaagcaacatgtattatggagtatgtagctaatatggttctttagcctagttagaagcccatgcgctgtattttgtacgatacactgtgagtgctctaacaccacacaattgggaggggggatgggggacaaactaggtcgactcaactcattaacaagctagcaaaaggttagcttggcttaacttatgagctgctcattaacaatctcatttatatcatactaaactattttatcatatattaacataataacacttaatggtaattaataatcactaagtatataaagatatggtgatatcttatactaacgagctagctcgttaagcttatggacgcaatagggatcctggatattctatggaataccaaaaaaatctgcaaaatttaatatatgtcgatcaattatatgtctatgtacttaattggacataatacttcattatcgacttctattttcacaacaaattcactccttctatggtcttagctcatgccacttctatcttgatagccaattgtctcaaatctccaaactttagctcactaaacatcaatgatatgacatttgtaattgttgattaaatactcacactttggtggcgaaaaaaaaacctcaccttctatcactagggcgttgtttggtttcatgggctaattattagcctccatcttttagcctgaatatgaaaggtgagggtttttttcgccaccaaagtgtgcccccaaaaatccaaaaaggtgggctaatttgtggctaaagtgaattagccaccatcaaaacattagcccctccaaggggtgctaatgagactaattttgtgtggggaccattaaaaagcagctctctctctcttactctttctccaccttttggtcttgaattagtcaatggatccaaacatgccaacttagactaatatttagcctactaattaatgactaaacattaactctcaaaattagctctgggctaatcttccaaacatagcctagctcagcttgaccaagttctagcttagagctttttatccatccctccacacctccgcaccggcctgagctgcactacacaacacggtgccctccccaaccgctcccccgatcgcatgccgcgttcgacgctcgacgacccaactaaccaacaagcggagaccccgcggcacaagcgcaactgcacaagaccgcaccggaacacaagacctcaccggacaccgcgcacttattgcgcaaacagtgcgtgcatggatggagcgatgtcgctgacgcccgctcggctctcttctctcttgcagtcgcatgcagcctcgcacgcacagcctataccctctgctgtccgcacccgtttttctactggatttttctctgcgtcctctgccctcgattgctggcgttgctagatgcactgcacatgagcacatcctaaaatcacaactgcagatgagctcatgagcacatcctataaaatcacaagtagtactacacgggaatggaggagtaatgaataaatgtacagagaaggagggtgcgtgctgtaaatactcgagatgggcgcttggtacttgcatgtttccattcccattccaattccaaccatatctcctctactactcctactcgagtactagtactaaaacctgtgggcccaactagccaccggcgctaccggtcaggagtgatataagccgctgcgagtgtggtcatcagtggtgagagtgtgagagctagaggccaaatggaggcgacggtggaagggaggaaggtggtgggcagggcggaggcgagcccggagcggggccggccggcgtacgcgccgccggtgaggtcggcgccggcgaggccgatgaggaaggtgcagatcatctactacctctgcaggaacgggcagctcgagcacccgcacttcatggagctggctcagcatcctcaccagccacttcgcctcaaaggtgcacatctgaacatccctgcatcttgttgtatctgcatgctaaatgcatatggtgcttagtttagttaaatcttctatggtgatcaccggttctgattcttttctctttttctttggcggtgtgcgtgcctgaagatgtgatggataggctcacgctgcttaggggaaaaggcatgcctgctctcttctcatggtcttgcaagaggtacctaactgaaaactgcggtcattcatgcatgcttcccacttgtttctctatcttttagtagtacaacacttacttgagcttgatgtagtagtaacattgctgctcatttgtgtgcaaacatgaaggaactacaagaacgggtatgtgtggaacgatctatctgagaacgatgtgatctacccgtcggacggcgtggagtacgttctcaagggctccgaaatcttccctggctgttcttccggtatgtactcatcaggccatcactctacaaagtactcactcggccaactccacctgctatcactactccgtatctttttcatgtgaaactattattgatggactcgccgtttgattgcactgggagaggtcgttcaaaaaaaaaagtactgggagtagtactggaactgccatgactttgcatggacaccatggtcatggtgcatgtacagcaataatttatcgtctttttcagtactcacaagaaagaggccatcttatcaatctgaaaaaggctactatcttcctaaaataagtgctgccatagatattcgtgtccagcgttttgaccgtccgtcttatttaaaaattttattaaaaattaataatattagtcacacataaaataatattcatgtattatcatctaataacaataacaatactaatcataattcttttttaaataagacgaacgatcaaacgttgagcatgagcagtgttaaaactgtatttattttgagacggaaggagtaatttttttctttgttctcacttcacattgtcaactcgtttttcaaatgtgaaaatgggccatgatgggtgctgatagtaaaacacaagtacagctttcttacaccttgcacgtttccttgctgcacccacatcgtaaatcgtgtgtgaagacttcactacgaccctactgtctgaggttaatcagttaattaatgcgtggcggtagaagaagtctctcatactgtagcagcatccatcatccgaattataatggtcacctgtctctgccaaacctgctgtgtaaactgttcaattgtttttttctcctctaaaatttgcagatcggttcccacaccttcgtgtcaccgataggtctccggcgaagcggctggcgttgccgcccagccacaagcagtacgtggacagctaccgggacgacgccgcggaggatcccgaggacgacgagctggggtacggctaccaccggcgagccggcggcgctcgcctcgctgcgaagcccgtctcggcgcgcaccaaccggagccgcccggtggagctgcccgtggaggagacctcgccgccgtcgtcgacctcctccgacaagccccctgccgcgccgcagctgcagccgggcggcggccgcggtagtgacgagaccgagtcgaacagggccggctcgatgctcctgcagctcatcgcctgcgggtcggcggccggcggcggctcggccaagtgccggaccgagccgaggcggagctgcggcctggtgagccggctggcggcggcctcacgcgccggcacggaggtcgacgacgacgaggaggccggcggcggcggcgagctgagccggcggttcggccacctggcggtggaggagaaggagtacttcagcggcagcatcgtggagagcggagtcaggggcactccactgccatccagctcgctcaaacgctccaactcgtacaacgaggagaggtaaaccttaccattaccggaagtggtaaaatcctttgcaaagtcttcgatcgcctaacctgccgtagctagcttgcatctggccgatcgagtgactgactgactgacatcgcgattgtcgaatgcgtatggctttttcctgatatctcatcactcgattcgtcacatctcttgtctaattgtcgaatgcgtaggtcatgtgtagacgtagcatgcaatgcttgtctagactaaacggaaatcttggaatttagccatgacacatgacacaacataatagaggtcaacgaatgagcacgtccttttttatgttggagaaaaaaaaaacgacagcaaaaactgcagaagacagcaaccggcatgcatgcttgccgtttaggaggactaggaaggtggcccgcgcatacacttatatattattgaaaagtaagattattgtttgttcagaaattttgtctcatagattcagggcaaattaaagtttggataatgttattttataataatttaagggttgtatttttcttaaggtatcttataaaaccaatcataaacttttgagtaggagatggattaagtacttacgacttttgaatcattttttttctcgagtaaataagaaactattgctagttaattatcatacagtacatgtatatacataccgtgtagtatggtcacaaattaaaaatgcgagtgcaagatactaaaaattcttttgattaaatcgtctcatgaagacgcatgatatagtaataaaggaagggaagcatatggatgggaaaaaaagaaagagaaaaatgaaaaaagggaggggaggcgtatgtacccgtgcacgtaggtgtgtacctatgtcgaggtgggacctcgtagtatttagtttgttttaagatcaatttaatctaacggtttataatattggacctaccagtttaagtgaaaatcaaataatatatactttgatttttttctaagaatttctaatatttgccctaatttattatagcaccacgtggcagcttgtgagcattttaaggaatttgaaatgactaattagaatattaactgcacaatatatatgtatgtgacatatggtaatatttgttccagcttcgtccatgtttatatacatgtagagagaaattaattttgtggctagcaagccattagatgtctaattaatagcaattaattttgacacctatttacaattgttcagatcaactcttatatattcatcttacgactttgatgatccgttgatcaccatggctcgcatgaaaaaaatatgtacttcctccgtttcacaatgtaagtcattctagcatttcctacatttatattgatgttaatgtgggaaatgctaaaatgacttacattgtgaaacagagagagtagtacttaaagtttaggatagctgaaattgatgaattatataatttatgtgatagctattcgagggtataaatgaatggattgacttctaaaaagttagaaagttgtttaaagatgacaccatttagaaactcataaagcgtgcaaacaaaaatccaaaatatggaatcgggaaaaaagagagggccttaaactccctttatcacccttgtcgtagtaagatttgtattgatattcgtcaatattgcgctcacatttataacataatgattccttttacctgtacaaacaaatagtacaaaatccaaatatgacataacataaatacattatagttgttatgtaatcaactctcggtttcaacttaaacagagctaattagtgtagagaaaaacacaacccatggtgcttaattattctcttgtcgcatcacacctttaattttctttttatgttatttacaaaattaatcatctacatatatgatttgatacgtggcaaagcggtagcgctataatggttgtgttcaccttagatgtctcagacactatgctttatgctttgtaacacgtgcgaaaggcaaaggtgcagacgtgcaatgtgcagcaggcaaaaagataattttggacgctttatttattagcaaacaatagatctgatgattataataataggtccatcagttctagtgtaagtgtaaattagttaatatagattttaaattgttaatttaatgggtacataatataatggtgtagaccttattttgaaatagtgcattacttgagaataatagaacagtgtaataaaatgtagatccaataatttgcataatggagccataagtttaagtgcacatataaattagttaatatatagatattgtttatttgataggtacacaatataattgtgtaaaatttattttaaaatagtgcattatttgaaaataatagtacaaagtaaagagtacaccggcttaagttatatgatggtagattctttgtttgtaaaattatgattatttaaaaaatatatttatatatatatatatatatatggaaaaaagaagaaaaaaggaaaaaggggggggggggggggaggaagcgtacgtatttggcacgggaggagaggataggtgggacccatggtttttagtttgttttaagatcaatttcatctaacggtgtataatattggacccaccaatttaagtaaaaatcaaaggatatatgttttgtttttttcttagaatttctaggattctctctattttattagagcgccacgtggcggcttgaaagcgcttgtagaaagtttcatggacttttagtatataatagatagatttaagttaaccaggcatggcgtatgcacgggtgtgtgcagcgagctgtagtacttcgaattcgcatttttttgccggaaaatactcgatcaaacgtgtacagtatctcgtttggttgcatgctgtgcgccggtgcgttttggcatgaagacagtaggttctttcgtgcttcgtcgacgcgtcatgtaatcgtgctgcacaactgtagactgtgtgtgcatattggtatgggccatcgtccaggtccactcatggctctcgtcaagctcaagctcaatcgctgatggattctgtactaggttctactgtgtcagcgtacgacgttgttgtacatagtactgtaaacgtacggacagaatcgaatctctctgtgttacacctttacacatcgtatgcttttgcctgtaaactttaaaggcatttatttgcaaataacttttggtttttaacctcaggagctcgatcaaggctgtgttacacttttacagatcggtatgcgcttttgcctgtaaactttatggcatttgcaaataacttttggtttttaacctcaggagttcgaggcttggtgtcagcgaggagagatcaacgacggatgagcagatggaaggggaggaagggatgatcagggggagatgcatcccgggcaggaagaagcagcacaagtaacttagctaggtgcactccaaccatcattcagattttcaggaactactgagtagaacattaatctagctagttgtacttttctaagaggaattaaaggagactactcactgtattactacatgttgctggtagatctggaatgttgaagtcattcatcactcagttcagagagtagagtaggggattgattctgcttgtttggtttcctttctcggtgaaaatatgatgaacgaggtcagcatgctgatgccagatgtgcttggtaacagatggtagtatggggcggtgtgtgacgctcttgggtccactgcgtaaaggatggcaatgaataggccccgatgcattgcatccgctccataaattcgtgctccatcgtcctgagttgatgagctctgactctgagcctctgactgtgttgcaggcgcgtcctagcttttgcctgattgtgtatcgcccagcgctcgtatgggcatatggctagaaaaccggtgggaaaaacgggttggctacagatcgaggtttggaggttgtcacggattgactgaaatatgcgtcaccctacacacataaacacagttgcgatcgagtctcgaaagacaccaagagtacagcgagaattcacttccgatccgacgacgcacgagtgcacgacgacacgttgagctcctcagctcggccatgccatgccaatctccctagctacgtatggcaactggtgcagcggtggggcacacgcgcgctaggcgtcgtgttgatcaggttgcggcggtgggagcggctgcccccggatgaaggaggagacgagcaccagcgctcgctccggctggtcgatcggggccatgtgcccggacccgcgcaccgtcgcgaacaccagcccgtcgtacgcgatcacgtacccggcaacgtccttgccgtccgccgaccacggccgccagtccgccgccacccgcagctggagcctctccatcgactgcctcgtcgccgtcaccggcaccatcgcatccaagtcgccgctgcagcacacacaaatatatgtacattgtcaccaaagaagagtacatgacgatgctaggcaggatgaacggaagagctagcgatcgaacacgcagcatttgacggacctgaatatccagatgcggatgcggccggttatcactgccttgatgtatggcagcattgactttggcgagtcgccgaagtggtctaggttgtaaaccctgtcacatttccatcctccaacgtcagagatgggaaagcaagagcgtgcttgcgtgagcttgacaccataaatacctgcatctagtccagggatacttcaactccgtgttcgcatggatcgtcttctgtacctggggctggttcatgtacgcctccacgaagtattgggagcacggatcagccaaatcctgcatgcaaatgcgggtgtttcatgcggtttgataattaaattcaacctgcaaaagcgtgcagtaatatatcatccgtaccatgcacttggaggctgagggcctgactttctgttcgtggcaggtggacgagtatatgttgtagatgtcgatgttgccaatccggctatacgccgctttcctcgccgactcgcagagcgccgacgggtggtcgtcggggtacttgcagctctgcgtgatgagcgcgtgcgccgagtccgatatgaacgcgtgctgccacaggtactcgtacagctgcgtttgctcagccgcgaactccagtatgccgttcccgatctgaacgtagaacatcaccagaattcagaaaacattacagcttcgcggctatctgaacatggccatgcatggcgaatcctgcatactcacggcgattcctttgagcttgatgggggtcgcgtgcgggagcaagttgttgtcgaggatggtgacggcgagctccgggacgtagtggccggcgtagctctcgccgacgatgaagaggtcccgggtcttgtattccgggaaccggtcgagccaccggagcaggaaggtgtgcgagtcgtgcgccgtcatgttgtcccctatggtgctgtacacctcttgcggcttcaccgccgcgtacgagaagcccacgcccacggggctctccaggaacagcaggttcccgtgcgccaacccgcggttcaaccgattgtcagtcacgctcacgcacaaggaaggagaaagtattttctgcacctagtgccatgtcacctaggtgtatgtatgtaatttaaacagttatataaaaaaatataaaatttgataagatggactttgataatataagacaatatacaaatatgcaagtttaaattcgatcgatatatgaagaaacaaaaataacaaattttatctacgttgtacgggtactattcattgtctgattttattatttttgtttctctaattgtagatcaaatttagttctgcatgtttgtgtatagacttatatcatcataattgatgttactaatttttttttaattttttctataactatttatgtcgcatgcaaacgatgggtgccatggcacctaggtgtagaaaatccgtgtccgttgcttatgcttatgtttaccggtcaaaatttgaattttcaaacttaaatttaaagttgattttgagggtttttttatcaaagtttatttttcagccattttttagatcgctaaaaacacgcatatcaaagttttgtcacttcacaaattaatttttatttataaatatgccgtctcgcttatgcttgaaaccagccaaactatggctttttttttgttttttttatataccgatgtaataatgtaacgtgaccgagaaacgtatcctgaccagtaatccaggagtgcgggttccggcagagcgtcttgccgtccgtgtccacgcggaagggcccgatctcctggaacgctccgatgcccatggatgagcagccaggccctgtaaacacagcagtaatttgatgaagaattccaacatgtactcgatctgtttcgatcactattctgaacatactgattgggaacgcaattggatacggaaaaattacctccgttgagccacaaaagaagcggtttgtgggcagcatcaacggaggcttccacaaagtagtagaagagcgacttcccggaagtctcattgacgttgatgtagcctgaatattgctgtagcttcacgtccggtggctggcccggcagcgcggcgatcttgtccgcttccttggagccctcgccggcggcgagagcccggcatgattgcacggagaagacgattgcgacggagagccacaaccacaacgccctgtagttcatcatcatcattgggaaacagaggaagaggaaaaaaaaataatggcgaatgcagattattggcaaacagcggatttatagcaagaaacaaaattttgtgcctgttttctggttattcagttgaaccgcggatgccacgttcgtctttgattcttctctttcaagaccctcccaaatttaaggacgtccttgccgataatagactgttctttcctgatgagctggttgactattttaagcactttattgcccgttaaactttaccttattatcactccaaattaaaattttaaatgtttagttcaaaaattttaaaaatgtggataaacaatactactactgatttgttagatcggaaaggaaaactaaaggcccatagataatgagatcaagcccggcccaaattcgccagacaaccagaagcctaggccctagagcggcgagctgacgccgtgacgcggcgacgaggtgagcgcacgggcgcacagcggaggcgccgatctctctctccctcccagaacccgccatggggagcaggaagaaggcgaagccgagcaggagcaggaagaaggcgaagccgagccccgaccaggccgtggccctcgactacgtccgcgcctgggcgcatcccgctgcctccgcgccgccgccggagccctcggctgccgatgccgccggggacgacttcctgccgcaccaggccgcgcgcatggcctctggaggcggagggagcgtgctgttcgagctccactcccactccaaccacagcgacgggttcctctccccctccgagctcgtggagcgcgcccaccgcaacggagtaagtacacgatctggactctcctccgtttgcctggtagccggtaggtgtttgaggaaatgcctgtgaggtctgtaactcgtatagcggttatattgtgcgataaatgggctcctcagagctgcttcgttgtgtaagggagtaagagctagtttaacagtgagaactaacatgtattagagctgacatgtacaatggattagctataaggttgcctctaattctcttctcctctctctttttctcacttatgtaattaatgcatttaccttggagcatatatagatctagatcttgcatgagagctagcacccttttttttttgggttctttctcattcatataagtttatagatggcttatatagcctactagtaattaaacgtgctctaagggaccaagggttgcacttccaagcatcaccttgacaccttccaatctgttttccagtttcctgtgaagcagtaggtaatgtgcctactgggttcaatattggatgccagccgcatagcctccgtgtttccttaatctgttaactatatttaaatgctgtgatcactcgtactcttggagggtacttatgcccttgaatcagtaccccttcaatgatcatggaagcggccatcggctgattgcgttgggtagttcagagttcagatcgtgctttgcttgacagtgcagcatccctttttctagtgaagtgatcttcatgtatatgctatatctcattgtcccaaagtttgtcttatgtattgggtgcttgttcagatgttaaatcttaccatgtgcatgccacaattttgaatggtagaaaaagaagaagagttagaatggctaaattgtatatgtcggtactacaggtgaaagtacttgccctgacagatcatgataccatggctggtatacctgaagctgtgtcagcggctcacagatttggcatgagaataatcccaggagttgaaatcagtgcactatattctccaaagtaagatatttcttgtttcccatccatcttttgaataaaaaatagcaatgcgatggaattttaacaaataatcgtagttggttcatgccctcataactcaggaactatcatcgcactatatgcctgttccatcttataatattctgttatgttactttgttgtaaacaacatttaagtaatcacaatacgagtgaagttgtttcgttcagagattcctgtaccattactgataattgtagtgaacaagacttcattgtcgcatcttttccgtaaaattgtgctagctagtctagtacctttttgacatatcattgagctatcttgattctaaagaccaagagagttctgttggtgtttacatgtcagcttaacagagcaaggtaaaatcaagcgtgaggatcaagattaatcaccttataaaaatgcgccaaggaatactagctcctctcatctattcaccttatataaatgactattaactacaaaccaaatatgccaatctgttatcaatggtcactttaaccgagcattatatatgttgcattttgtccttgtatgttcatatagctgtccctgatcttcattgtcttaaagggaaatcgctggtactggtgagcatgttcatattcttgcatactatggtatgtgtggaccttcaaggtttgatgatctggaaaggatgctatcaaacattagagatgggcggtacttgcgtgcaaggaatatgctggcaaagctagatagactaaaggtgccaataaagtgggaacatgtaactaaaattgctggtgagggagtagcacctggcagattgcatatagcaagggctatggttgaaatgggtcatatagagaacattaggcaagcattcaacaagtacattggtgatgatggccctgcatatgccacgtaagtgctattgataatgtacgaaaaattcatcctggtgattgtttcacgcggaggaatgtctttgttaaataacggggcccatattttgtgcagaggaagtgaaccattcgctgagactgtggtgcagttgattaatcgtacagggggtatatctgcattagctcatccatgggcattgaagaacccagatgcagtcatccgagcattgaaaggtgctggccttaatgctctggaagtctacagaagtgacggaaaagttgatggtatgtctcttgtaccatacataaatcatttcaaatcttatttgaaagcagcatatgtttgttatttgttagttcatatccaattacaggatcgttgctgacacgtatggactctattccacaggatttagtgaattagctgagaagtatgaccttttgaagatcggaggttcagatttccatggaagaggtggaaaggatgaatctgatattggaacagttaagcttgctattactactttgtgttccttcttgaagatggctcggcctatctggtgtagtgccatgaaagacattctactgaagtttgcagaggaaccatctacgactaatctgggaaagatggttttgtttggagaactcattaattttaatggtttttcatcaacgggttctggtatggatattgttaatctgtgcttatcttcttggttaagtaacaatggcatggaagaagtggaacttgaggaggtaagattgaagcttgcccattgcgtaggtaaaagataatctcaaatgcatgactaccttgaacaatgggtgttccctttatctggaatgtgttttgcaactcaacatttatattttgctatgttcttaacagcccatagacctaatacatattttatcagttagtgatggtgttgctaaaagtagagatgatatagaattgataagtcattaacatttaatcaagaatgaatattcctttggtaatttaacagcttgtcaagagctgcacataattagagcatgcaagtatgctactggttttttaatggagaatactcatttcttcacgggtgtatcagtgaagcacacatatactctcctgtatatgtctccttttcaattctaatcagaactgtcctgattgcttatgtacattgtgtgtgttgtcaattgtgaggcccagtctatgaattgagcctatatggtccatgctgtagttatgagtgcaagtggtaggagggagggtagttccactttgctagttgagtgtgaggttcataccctgtccattggaacagacctgtccataatatccaacttaaacttatgaccattataacaagaagctaatatatagttaatggatatccaattcgatctgatacgtatccattgaccagaaattgtatggttgatgatattcaattcctttgcttcttggaaatgtgaaggtcggcatcagcatgatattgcagttattttgatttttttaacaggaacatgctttcttttcttatttgtcaacaataaaccattatatgcaatttcacgtttgattgttcatctattttcccacagaaatgaaccagggcaaaagatctctgtttgctatatttaattttgaatatctcatgggtttctgtgacatggtaattttatagtcgaaaaaaaatgaatcttccactggattcatctatctatttatttttgctcccatatttattttatacaacgtgatcttggcttcttcctgtcattgtcatggtccaacctaaagatgtgagcgtttcgtttatatcagcaatggctcctgtagtccggtgtctgatcacttcgctctttttgtttgtttcttttttttcttttctttttgactgtgtacgtaaatgtaaacatctaattaggttgcagttcttaactgtgcaaaaacagagtaaattgtacttcggaccacaaattcttaccaaagtgaagtactacccttacaatgtttttttcactttacactaggtattgtcgtcaaataggtat

SEQ ID NO: 66246 - DNA, 572 bp, Oryza sativa
acaaatgggaccaactttgttgtgggctcatgaggaccctgcctaccaagttatacaacaaaattcttcgtcaccgtgtgatagcccaactattaatgacaaaatccacggcgtttgtgatgagcccgtttgtcgccgtgaacatatattatgaccaaggcctccagttattgctaggattggttgagggtgaagtttacgatgactgtttaacgaatttgtcatagatcaatgacgtacggattccctattcgtcacacggaatgcgtagaaagcctatatctattttattgaagccctgggaagcccccgccttccattccccccaacccctctctcaccccacccaaccttgggacttataattggtctgtgctgccatctttaggcattgccggagagaagagatgcttgctagaggaaataaaatagctgctcgtggagaagaagaggtgcatgaatttccatgttcatctaactattaaactatacattggaattttcgaggaatattttaggtgatagaaaattaatccccaaatactaaacccttagaatacattaattttcac

SEQ ID NO: 66247 - DNA, 12367 bp, Oryza sativa
ttcctcccaaaccaccaccattcatttagtgttccggtggtgatccagtgcaacaaattgggtagtaattttgttggtttttggagattgctcaattttggggcaaaatttgagaagaggatggttaagttctcgtcagagcctcatcaggggtaaaaatatcttgctcctcctgtgagagaggaactgttttagcctctctgttttgctactataggatttttccttggctgcgatgctacaaagattgttttggacctgtgcatgatgaaatgttccgtatgtttatttcgctggctcaattttgcaggacttttagctgatcgatgaattgctgttcaagtgaagcggttttaagttccaaagtggcgcttctgaattcactcttctgtactatagtattgccaaaggagaattgctctaataagatgaactgtacaaaaggagggggatttccccttttgttttgcgcagtcatttgtctcatggcccaacagggggcttgcaatgtggtgctaatagcgaataacactaccttgtcatttgatgatgtcgaggcaacttttagtgagtgctacaacttaccaagtatccttgcatttcactactgatcaacaaccaatgcaggcactgcagagtaaacgttaattgtttttatgttacgtgctgcctctataggttatgaatatttatttggatattgcactagtttgtttcctaaacaaatgctgctaatcttgtgtgacaattgatgaatgggatgattgcttttcttgcatcatgctagttgtactgtatgggtcttctagctgttgtacctgtattagcttttactaattcttctctagctatttgcatgtttctttacatttgttagtggcttagtgcgcagtgctatactagtgcctgcatcattctatttgtgttatggacaacttattggcatatcaatcacttgcagctccagaagtgaaagattcaggtgtaaatggtgcaatttacgctgtggaacctctggatgcatgtagtccattgagaaagaaagcagccaatggtcctgtttcaccatttgcactggtcatacgaggtggttgccaatttgacgataaagttagaaatgcacagaatgccggatttaaggctgtgatagtatatgatgatgaagacagtggtgtcctggtttcaagtaattctactcgaatctaccctatgtctcttatggtcctgaaatcaattttcttatgtctaacgatatgtcacccgtgattattacatataaaaaagtgtttctgtgctttgatctgatcgtttataatgtatcatgatactttcttagctacatgttagggatggctgaaaaagaattttcatcatgtctatgtcacaagatgtaaattgtaggaataattagcacccttttaaaaaaacaaaaagaagaagaagcaataatcagcatccttgtataaactggatatattacttgctctgtgcatatatatgcaatagccatttgagttttgactagaaattgttacagtggctgggagctcgtccgggatctacatatatgcggtattcctctctaaggcttcaggagaggttttgaagaaatattcaggtcaaagtgatgtagaggtgtggatactaccagtatatgaaaactcagcttggtctatcatggcaatttctttcacatcactgcttgctatggctgctgttctagctacttgtttctttgtgaggagacaccagataaggcgggacaggggaaggattcctgtaacccgggaatttcatggaatgagcagtcaattggttaaagcaatgccaagtcttatttttacaaaagtgcaagaagacaatagtacatcatcatcttgtgccatttgcttggaagactacagttttggagaaaagctaagagtgttgccttgtcgtcacagtatgttcctctcacatttaaagatcacagttattttagaatagctttgtcagacttgatgatttgggttctcactgtcttcatgttttgtacagccagattaatctgtttctagcagatattgccttttacatattaggatttatggatacaaacgcaacttagcattactaggattaatagaagtgctgttctggcgtgattgataaaatcttccatcaagatcaatattggtttatctatttgtttcctttgctgcttgagatgccaactcaattaaatatgtgctcgctggatttcattttattcctgattccatagcggagtaaatcttggcaacagtgctttatctctgaatttttagttgcgttggtggatggttccacagcattgcttgtgacaagatgatcatttagtgattccacaatgtaattgatatgaaatgattagtgcatccatttaatgcaactgctttagatagttgagtattgcattttagttgatccgttttctatgtggtattatttttgacatgtgtcatgagactttggttgtttggcttttacagagttccatgcgacttgtgtggacatgtggttgacctcgtggaagacattctgccctgtgtgcaagcgagatgcaagtgctggaacctcaaaaccccctgcatcggagtccacccctttgctttcttctgttattcatctgtctgctgaatcaacagctttgtcttcttttcggtcaacggtggcagtatctccccctaggccaataagacgtcatccttcatcacagtccacatcccgcgcttactccatttccagtgccccccgcaattataaccttcaaagatattacactaactcaccttatattagtacgagtagaagcaatgtagatctcgcaaatatgtcatcacaatggtctcacactccggaccaagcatccatgcattctctaagaagtggccatttgtctctaccgatcaacatcaggtatacaataccacatgtttctcgttctgactatggatctgccagcctgggtttatcccatgattcctgttctcaccatggatctccgagttattatcatagctctttgggccagcaacgttcttacctgatgcaccgcaccgagtcagggccaagcctgtctactatggtgctccagtcgccacaatagagtcagtagcagtacaatggcgaatcaggagaagtctatcagctgcggtttaactcgatcattacgtcaggcctatgtacagcattgtcttgattctgatggaagcttgtctgctgtgacatcggatcagtcgctaccaagatgctgattgatcttacgaagttcactgtttcatgagcatttgtgcaagcccctgctagatttgttcctgggagatgcaaataaaacagaaaaatcctatgcgacacaaaactggcaggttcatgcaaagttaattcatggaactatttcgtgccagccaccattgtgattcaacaaggttacttacattgtctgtacggaggggaaattggtgatcttaaatcgaagaaagacttgctgagttttgctgaagaagcaaatatccatcagtctacaaggaatggtttgactttgcgtattgtttgaggcttgtattataggtgatgactttagagttggtgtaatggtgtgtttcttttacattagttattttgtcatgcgtataaatgttacagcttagcaataatctgttagtcggtgaatgttttgtagctctctaatatttattcttttttgcgaaactttctaatacttattctgatcttggatatttgtgcaagtgtgtttttgttgcttcgttcttcctttcaagatcaactgtacctgaaaattctagagcatgtttacgctatgttagctgatgggagaattctaaacttaaccctatgttcactgaaatacaagtttagacgtgggacagatgtctaaaactgtttcgtttctgacatcagaaatgggagaggtcacctcttataatgccagtttggtggaggttttccataagatttctggaggtcctgatgcttgaaacgcttcatgcaaacttttgattcgttgcttgttgtgcctttttacttatttaactgagaattttcttctggacttattaccaggtatttgattatactgtttaattaatgcctttgaatcttttttacaagagcgcaacgtgtacttttacggctacaattatgacagtaccaattaccgtccgggagttcctgcatttgaaataatgcaggccttttagagcatagagatagagggagagcggcgcttagataggggcatgtttggtttatgggatttatccgtaagtttcttcatttcagtcgctaagaatctaaacagagatgattaaaaggactaaaatgtatattaaaactaaaatctattagtcctttatatgagaaaattagtattatatatacaatcgcactaaatctaaacagggatgattaaaaggactaaaatgagaaaattagggttatacaatcgcattaaatctaaacagggatgattaaaaagactaaaatatatattaaaactaaaatccattagtcctttttatgagaaaattaggattatacaatcgcaaaagagtggttttgctgaaataccaccgcttcaaaatgagttattgaaatgccattctaaactgagaggtgtttaccaaaatactatttttattttttttatagaaatattttcgctcaatattattttaatacccctgagacggcccaactatcgtactctttcactctcccagtagatctgacacttctctttcccctcttcctctctctcggacgccgtcgagagtagtggccgagaggcggacggtggccggtggaacttcttgctaccttttagctaagtttctactctctccattccaaattaaccaataaaaccaatgctaatttaaacagcatcagagaacaagaataatttaaatcgcattaagacacgatacacatatttctcccacgatacatatatcttaaaacacattatcaattacacattagttgtatcttaaaacaccttaccaattacacatacttaccaattacacattagcatataagaccttaccaattaaacattagcatacaagcatgcacacatttttcatgttttattagttatacttctttattaattatactctgatgaaattcgttatataatgaacaataacaattttagtttccaatttcagttatatgttgatcaatttaagaaattttatataattatacgatgattaatttagaaagaggaagagaagagaaggagagagtaattatatatcgaccgaggcgatgatcatggattatatagttctatttgaaaaaaaaaggctagctactagctagcagcttgtcgcatagtagtactatgcattattcgtactagtattacatacacacatacgtatacggcctggcttaattagcaggagaggagaggagaggagacggttctagcacgcatgtgcatatgcttgaaggcggggcagggcgcgattacgcttggcggcccaccaccttgtgctgctgctgatgcgcgacgcggccggcgtcggagaagaggtccacgggctccgactctgcgatcttcctgcagccggcctcatcttcttcctcctccggacagacgcggcgagcctggtcgaagagatcgacgggctgggagtcagcgaccttgccggcctcgagcggggtgccgttgatgaagccagtccgtagcatctcgtcgtcaccgttcaccttcgcctgggccgtgccgtgcctcacctccttcttgctcgtcgccatgttaattactctctctctctctctctcttcgatcgatgtatatgatcgatctctcctgatgcggctggctggatatatatataattagttaagcgatcgatgatcgcctttaatttgctatgaaggaacagaatacacacacatatatatatagggaattgaagtgatgaaagctgatgcgaggacacgcagcagcgacgtggacgctacctgttgatttacgcgcctacgtacactctctagaactctctgcaataaactcatctccatgatccatgacgaccagcctccgcgtgtactcctgcaccgacctcaatcgccaaatacagtcagtcggtggacagaaaatgcaaataaggacagagctagcaagccaattttgtctttgagtatggttaattacctcttcatttcatttgatagcgagtaaggttacctctataatataatatatatatatatatatatagtataaaatatacatattgcataagtctaaaatatgctaaattttagtagaaaatcccaatatcaaatttaataaactttataagaccaattcatccaaaagaggttcaagcacaatatgatttgagactatactagccagttgaaaaaaaaaatactgaaacaaattaagactgtgttaaacagtaaaactccgccatatacctacaggcaactaaagaaagtaaggaagaagaaaacgggccttgccctcgtcgctgctcatccaccatcgctccctgcagttcgccaccatcatcggagcttgtccatccagatccgttggacaggagctcaaggctatttggtctgacacttatgatctcgcgtgtcagatctaactgttttggtggctcaagaaggggggcaatagcttgtcaggatgatggcatcatcagcagcgacggcaaggtccgaaatttccaaccgaaatttccgtcatttcggtcccctccgatacgatattaattcggccgaaatttttgaatttttcaattttttcatgaatttgggtaatatttgttcaaattcaactaaattttgttcaaaatttctgaaatttctgaaatttcggtgactcccgatcaaaaaccttcaaccgatagagtgaaccctggcgacggcaaggagaggaggatcccaacaccaacgacagcggtggagatgatggcgccccttgagcttctggatttgacatcctcttcgagtccttccttcttcctgggtagcaagaccttaccacccactagagatctgacaacaacaagcatgccgacgctagagctggtggccatgaagtcgtggctacctgctacagtcactaaagaagagaggatggcctccatcatcaacgagggaatccattgagtggcaatgacgaaataggaaaccctaagctttcaaatgggaagagggaggtgacaggatgtgtaaggtctcaacctggacgtggagtgaagatcgattcgggcctagttaggtgattttgcatcagcagaaccatgccttggcaaccaagcagccgctgtgtgcatccatgggtgcgaaccaccatccatatcgtgtgctgctgggaagggtgacaatgcggaggagaatggagaagtggtcatgtgtcacgccccgaactagctccgaacggaaccagcccgtgacgctccaaattaacctgttaaccgataccagtcccaggaaatagtgctggtatcacaggaagacagaatatcgcaacaacagaggtctctttattacagagtaggagtacagtcatgttgggctacggacagatcccgagctcacaactgcattacaaaagaggaaagcggaagccaagacttggaccaatcatcacaggcgcgacttggaaactaggccgaaaccctaaaactcatcgtagccgacttgctcctggaagaactcctcgtcagcgggatccacttcatcttcttcggcaactggggggaggattatttatatagagcaagggtgagtacatgagtactcagcaaaccatgggaattaagtgtttaatgctggcttcaagggaaaggctgttgtttttgcaattgattttatttaaactccttttcgaaacagctaagtgagtgcttctcaaacgacatggatgagacagtgcatctcgtccggtcggagtatgtgcattgtatcagtctttgattgattcaagattggcacccggccacaactttcaagcggccacccgggcctagctgatcccatcagccacagggtttccaaacatcgaatccaaatccacaacagcaatttcacaaagcagtagtcaaacaaaactacgctaaggaatcaccttacatccacccatgaccgtgggcacggctgttcgaacagtttaataacctctgcagagggggtacactttacccacacggcattactaacccggatcacccagcccgtggggatcagccacgtcgggagacctccaagctttcatgacaaggcatttccaaagccgacacagatttaccatatgccgacgagaggggtcccagaccaacaacaggttaggtcccagaccatactgtgccaggaagcccagggtcctccccgacaccaccccggcgaatccacttgtctctcggcatcaaggctcccctgattagctaattactcagccaggggtgtcccattccacccatgtggtcgtacttgttatatgttcggatgaaattccaaaggaatcggtccttaagtgcaagaacaggaaaccgtgctcccggcacgtcccctggtctgcgattttggaaattcatttagttcgcaagcaccgacccaggcgtcgggtttttccaagtcttttgtaaaacccaagttttacccatacttggatattttaaatttgaggagaggcgttccgatgcgcttgcccgaaggcccgtgcatcgaagcacaacagtcgacaaagggagtttaagtgttcaataattcaaggagggtaattgcagcaattaggattgggaccggcaggctatctcgcaagccgcggccgaattgcttgtgtaaatcctattcatgcaatatttgcggaaaagaaatacttagatttaaattataggtgcaagatgatcaaaggtgacttgccttgctcgagatcttgagcttgattctcgaaatcctcgcattgcgggtcttcgggctccgaaactacacgcgaaacgggacaactcaacaaacggcgaaaaataaagccctattattgacctctaagcgtgccattagatagatctcgagatttgaggaattttggaagttgaacggagtcaaacggtcatacggttgagaagatattgaatttctaagattattggatttttgatctaaaggaaaaggatttagttaaacccttttgaaaaagaaaaagaaagagggaggagaaatagacttccctcaggcggctagggcgcggcccgagagaaaaggccgcggctcggccgagcttaatgggcctgccggcccgagaaggcggcccaaggcacgcgcgagaggggaggagagagagggagacggtgggccaggtccttctcgcgtggtcccgagtgggacccgcttgtcggtggcttggctcaccgtgcggagggagcacgcggcgtgcgctagggtatggggagagagacgcggtgcacgcgcgcggttcgcggaggacgcggatgcgacgggcccacgcgcagcctcacggctcgcggtggaccgcgcgcgcgagcggggctggagggagcggctaaccagggtcggctcgacccggtcttggccgagctggcgccgatgtggcacctacgtggctgccacgcgggccggcgggaggtagacaacgacgtcggccggaacggacgggggacggcggctgcgaacggcggggggaaaccacggcgatacagggaaaagcgagcacaccgggtgggtgcataagacgaggggagacgagccaacggctcggattcgccggagggagttcgacggcggcggattgcgcggcggcatccggcggcgagagaagagggaaacggcgacggcgcgacgggagatcaattcgggcgagctagagcatcaacgcgactccgggaatccattccttgcgccggattaggagggaacgcaccgagggaggccggcgacgagaggcgctaccgagctcgggcggtgacggcggcgagcacacagtgggcagcggcaaggcttggggcggcgccagctagctacggggaggctacacaagcttctatcgaaagctaaggggaagagggggaacgaagagggagaacggggagatgcactaccatgcgggacgaggcgcagtgacgatgggccgatggcacgggagtgatctctccggcctcaggctggggaagcggaggaagacgatgcgcccgaagtccccttcacgcgtccttcgcacgcaccggctctcccggtgcttggcgatgaacggcggaggcgagacagaggggcggcaatggcgcggtggtggcgagcgaaacgggaggaggaatcgatgggagggtgccttggttaaataggaggcgatgtcggtttgggaaccgacctagggcggtcaagggagagagctagagctcggcggtcgcggccaaaacggcgtcggggaggggggtgacgccggcggaagagaagagggaaaaaggaggagagaaaggggggcttgccctttgccactttgggaaaaggcggagggagaaagggcgacgcggcagagggaggaggagctctgcctccatcccttggaagctagcgcgcggagtggcggggccgggtcgtgacaacggcgatgacggcgggggcggtttggaacggagcggtgacacgggcggcaggcccgggctcaggcgcggcagagggctgactgcggcggcgactggccggttggccaccacggcgcgcgcgcgcgggaagcaacgggcggcgcggcgatttgggcggcgtcggcgggaacggcagcgagagcggagagggagggagaggcgctcggcgcggctctcgcgcacgtgcacgcgcgtgcgcgtgcggcgcacgggcagagtgagggaggggagagagagagagagagagaaagatgggccgagagggaatcggcccaccggacctaagggaggcaaaatagacttttcgagaaggattgatattagggatttgaatttgacgatggattggggatttgagatttggaattggcacggagactgacaacaagcaaagaaacaattttcgcaattagggtttttagaatttaaattttcccgctaggcgccacgatggaacgggcgctacatcatggcttcgatcggccgctatcgatagctagttgagcttagcttgtataatcatcagcggataacagtgatcagccctcaagacacagtgatttacgtggaaaaatcccctcggtgtgaggagtaaaaaaccacgggaccaacggtccactccaagcttccactataatccagtacaaatggagtcttctctagaacatctagaggcacatcacaacaacagctacaacatcaagttacgcaattggcatcatccatcaaccatcaaaactaacaagaggcatatcagcaaacaagcaaagaaatgatagatcctgtcatcttcgtttctcagctgagatctcccaagccacatatgcaaattgcacgaaacatggctgaaatgatgatctatgagtcctttccaacctttccaaaaaacacctaatcggataccgtttgacctctcaaactgacactttactaactactgcataatctgtaactgcagtaactcgagttgacaaaccaccactcaaatccggcgctctactcaaccaatcctcatacaaactaaccagactaaagtgcttaaagtgagaaacaaactcatcaagtttagtgccaatccaaccacgtttgagcctccaatgaatgacttgatgaagatcgggtaagaatgcaggctagggtttttcttcccatcataaagagataaggcaatatccaccattgatcaacatatgaattaatggctcatatttgttggactttttcggctgcaataagctgatagtaaaggcttcatatggagagaaatttggcccaaccgtcagcggaaatgctaatgggcgatcgatctcctggagatgggggcagcgatcgatcccctccccctccctcccttcacctgttttccctttttggcaccgcattactttcctattttagtaaatttatgcacctaaaatttatacacatcaagtttacacatctaaagtttagagacccaatatctaaagtttagagacccaaagtttataagtcaaaagtttatatatccgattcaagtttgaatttgaattcaaatattttttatatatagtatttctatacacctaaagtttatagacccaaagtttataagtcaaaagtttacatagccgtttcaaatttgaatttgaattatatctaattcaaatttgaatttgaattcaaatattttctatatatagtatttttat

SEQ ID NO: 66248 - DNA, 14070 bp, Oryza sativa
acatgcagaattgcattctgtgcaggggaaattccatcacccggatgctacagaatagagacaaatgaatttgaatacattagtcatcagtggctatctatcttgagaacacactagacagtaataataagattgctcagagctaagtccattgcaaattacaaatttctaacaactgcctcaggtgtcaaaattaagaacaaaagctgcgaagcagagaaaattagtgcagaacacaggagatgtaattaaatttttgttacatccaactttctagcacactatgcatgcccctctcctgtctcggtgcacataaaaacaagagttctattggagttttaatattgagtttttcaagattaacagcaggctgcccggcaactacattgcactaatgttttgcagtttctatgcaatggtagccaatgcataattaaagacggaatatcaaaaagtatgtgagtaattttttagagcattgaaatattcaaaacactagaaacagtgcagtatgcagaaatatgcatctgttggatatattttgttgagatttatggcaagctgcctcgcaactatgttacactaatatttctccatttctatacagtggtacaaatgcagaactaatgggagaataaaaaattatgtaaatacaatactaatatttttcagagaatctagatattcaaatgctagagatgcagtatgaaaaagatatacgccctatagttctactgaatgccatgtttctcagacagatggatcctgaatatatttctaggactaatgggctactagctactacaaagcaggttacaaatggactaaactgatattgatcaaacgaatattatcaagagggaaagaagctggttaccgcaggtcctgagataaatacgatgcgatcttcagattttggaacagtatcaagaacctttatttcacagcctgtatcattctgaatagacttgatattgtttccacccttccctattatacctccaaccttgtcacttgagcataacaacctaaaagtaaggggttcaggtgggactgagccatggccatgcattagagcttcaggaaaattgggaagatgagcaacatttggcccttgaaaagggagatggagattaggttgcattcctggaggaagaacatctggttgattgaagaatgaacgagatgaaccagaattatgagcaccaagaacatcactctccttaggaggatgagtaaatagcaactgagcaactgtattcagacctttcctgactgagtcgagctctccagtgatctgaagaaatgatatatgaagggagtatgtaatgattttctgatgcaaaatctaacagatatattacaaaaggaccagtagagaacaagataatgaaatccaattctgaaaaattacctggcaaagttcatctcggggtaaagcacataatggaagcttgtcctttgaaactcgaatttcacaacagctgtcagtagacatttgcttaatcacactaccattctttcccaaaagccaacctacttggctgtctagcaccaataatctcaatgaaacatgatttctctcaccagatgcatctcctgttccattttccatttcatttacaaaaatccggtcaaatacaagcaaaatggccttcacggctaatggcattcccttctccagctccagctgcgcctctggctcagaatttgtatcttttgcaacagaggaatcatctgctttcttatcattgtctttccctgactcatccctgtcctccttatcatgatctttttctaaatcatccttttcttccttaccaaggcctttctctgaatcatccatttctttgttactttcatccttttcttccttagtgtggtccttctccattccatggttgccatcaacagaacaagccacacctccgtcgttttccttagtttgcacatgactaacttctctgtccttatcaatggcagttatcacaataaccctctcgtcacaaccagggacaacttcatcaaccctgatttttactccagtctcttgccttatctttgcaatgatgcctccacccttgccaatgacattcccagattttgaagtagggcagagaatgcggaaaataggaacaccaggttgcactatcagttgaggctgctgcaaagaattgtgctttgttttctgccacttgccccgaccattttgctctgaagaattcttttgaaacggcctcttcgaaggcgtcgagcgtgaagccatgtcttcccctgcctgaacacaagaaaagagagcaacaaagattagtgatctgccactatgctacataatgcacagcctgcagcagtggcgaatccaggataaaaatggaggatgggctcaaaagtctaagccaatataactaaaatcagaattcgtacccttacacaagttaaattcaatgcacacacgatcaaatagaaaaaaaaactataatcgaagtctctttggtcaatttatgctctcatcagcttgggtagacaggggcggatccaacttgggacatggggggttcagttaaacccacaaacttttgggggaacaaacaaaccaaactgttacttgtatattaaggttaaggctctggaattaagagaagagcttcttacagatctagaagagaagctagggtttacgcaagcaaattccaaacggaagcacacccggtgggagagagagatgaatcaagctagggtttacgcaagcaaattccaaacgaaagcacacccggtgggagagagatgaatcagaaagaggatgtggatgctcaccagaatcccctcccctcccctgctcgccagatggaggtcggcgcccctcccctgttcagccgcaagatggcgcaagagcggaggagacgagacgggagattttcttttatacgccatggtattttcttttagcaatatgtaaaggtatttgcaaccatctatagcaaattagttttgttaaatttaggattaatatattttggtaatatgtttgatttgtgttatattttcctatagactcgatcaaacttaaataaattttactaaaaaaaagtcaaaacaacttatataatataaaatagatgaagtactttaaatgatgctaatgatgatatctaagttcgccttcaatatcacaagctatcatgtgggaccacaagatcctcacacgtgaatacttttgtttttttatatagcattgtatgcctaatcaattaactgtgttataaacttatagtttgtgcttttactttttatctcttataatatataatatgttgaacgcacagacctttagctagttttttataataattggtgacccatatatcaacagtactgagagaaaaatgtgacaaacaatatgtctcttatccttccttatcatcatgcacgctattattatggtcatcattgaggccgggggtgtcaggcttacagggactcagggaggcaggagtcgacctggtagagagtggagatgctagattcgggctcctccttactatatacggtagttctcccgcaatcaaagggaagaataaaaagaggagagagagttagtgtgtgaagcggtggcagattcattggatttggaggtggagtgacgatagagccaccgaacttggagatggatataatgggatggtccaagttgaaacaaaattgtaaagttagttgttgtcaaagaaaataatggttaaagatgatataatatgaaaacttttaagaatacatagtacaaaatataatttactttttttctctggcataattaaagatgagttgttcgttagccgatagttccatgctatgctaagcccactataattttattgtctctacataatatgattggtcggtttacttagctactactaataatctcatgatatgttggcgtgtgatgatatgggcttctgctaacacgggctgattaattatggttggatagatttggctaaaaaataaaaaacaataacatcaattttgcttaatagtacaacattcaattgtggtctcctttttctcactacatgatatatgattattctctcttatcaatatgtgcataactatattagtatttcccctaattctttcatattgttttttacatatatgttaatttgaactaatatttttttctcacaattaaatagataataaatcgtttttccatatttatcgtacataaaatgagtatagtacattgtataatttggaaattatattacaagtgtatgtaatttaatgtataagatatgaatttatatactacaagttttgactctttcaaaaatgctgcaccacattagataggtagttaagtgaaaaaatattaaaaaaaacatagtcaaagccgtttctttatttcattcaaaacaagacattttggaacctcgagagaatgtaaggaaaaagagaggtggtgagcttgacagcttaaaaaaaaataacacgttgacgtgaggtgagagtgagattgttgcccagctagcgttttcaacgttcggtagttggccgctaaattaatgccaccagatataggtctttttttctttcggtttcattctatgcaaaacttattgtaaatctctaaaatcttagagtaaattttacaaaactatatatatattgaccaaattattgtaaaactatagatgtaagatggtatatcacaaaactacaaacttaacaataaatttatcataaaactacagttttattgtcttgtagttttattgtccatatattttattataaaattatcttaaaatatattttggggttgaaatttttagcattaacgttatctttgagttataatgtccaaactttgtgattgaattgatataaaacctgtagatatccttttgtaataatccaccttatatttgtacttatgtgataaatttagtgttataaatttgtagtttgtgatacatcatattaaatttgtagttttgtgatgatttaactaaagtacctgtagtattatgaaatttactcaaaatcttaatacaaagatacatacaacttatacatattctccaaaatcagttaacccggtgaaaataaccaaatcatcacgttatgctaataattcgatacaatgaaataacctgcgttttttcttcttctcaaacatacccctccttaaaaaaatatattctagcaacgaacctacatgtatgtatccagaatcgtagccagagttagctatcactgtaaccacgcatgaaaggcgcaacaatagactttcaacgagacaaatagctggttagcacggtacatgagacacaccaccacacccatgagatgacgagcccatgacgtgtaaaacgaaacggacaacaacagaaaagaagcagataattcccaattgccgtgcaccaccggagcctcgacggcggcggcggcgcgcgccggcgtggtggggcgggcggtcatgaggtgcacgcccatcacgttggcccccacatctaaatccccgcacgccttttctcgtgtcgcctactcgccccccccccccactttgttttcggagggttaacacatgcattaggtgctaataaatcatcatccagtataagagcaagtttaatagcatagcccaatacttagttccaattcacttataactaatctaatagccagttcatataatatttgcttactatattattaagagcacccgcaatggtaaagtaagttgctctctataaaacatgtacatctcagtaatagactagattaatagtaaaccacctcaatagtatgtctacatgggtatctatagctctctcttctattgcctcgtttttctctacagactatctccatgttagtagatagctttactctctctctttatttaatttattccaagtagaaaaatatgctgacatagatctcttttagagagcctatagataaccattacgggtgccctaatatatggtctcacatatcatatacatattgcgttttagagtccatgctgtagctggctacaaatctgtagcccgcagcttttctctcttatcttttatcttattaaaatatgtttatagcgctgatagtctgctattgtagctgctctaatcacccggggtgggggccagccgcgtcatggcgcacccacgaacctacccgcctgagtcacgcctacatggcccccaccaccccgccccctcgttggccccacacgtcagcctcccgtggcggacacggcacgagtgagggaagggcagagtcattagcattagcgccggggataggggggtgccctgaaaacgtgtcacgtttttccttaaatagagttcacgtttcccaccacctcgtcacgccacgcgcacacgcgcccgatgggccccccagctcacccggcgaccctaccccgcctccgcgtgactgcgaggtggggcccacctaaccgtggtcccctcacgtcagcgtcgcgtgcgatctgggggtggacggggacgtggtgcagcacaaacggggggctcctcctcctcgggcgggggcgcacgggtcacgtggcgtcacgagccccccctgagtcgccttcccgatcccccagcgacacgcgccgcgcacgtgctcgctcacgcggaggaggaggggggccagagccgaggcttccccggctgacggctggagccgatctgagctgagccgagccggtgtgggttcacgtgaaggcggagacgagaggggtcgacttgcgtagcggccaggatcttctgcggtgatcaggcaaagggaaaaaaaagaaagaaaaaggaggtgtatttgttttaagtgaaaccgaaagagcatatagccgtagtttggtgatgtgtatacagatgtaaagttagaagtttagtgtcggctggagcaaagccgtgaaggtaagagagaagcgtatatgagcatatgagattttttgtacgctaccaaccacattatgctactactagaagatatgcttttcatacagggcaaatgtattttttttataaaaaattttctaaccacaaccgtcagccatgtcacatgtgatgttttattataaagctactaattcctagattaatattttggtagttcatctaaaacttgtcgaacaggtgccgatgaattttgaacacatatgttgtggattatttttgtgatattaggtattgtttgatattgacgacgcatatttctgcctcttaccatgagtcggtcggcctaggtaaccgtccctagtggccgggtcttggctttgacactaacacaactaatgttttcgtttcctatacacatatagttttttaagaacaaaatcttgctattaacagttaccttccatgtgcatgaagatttgtgccccttctcaccttcgtcgagttaccaaaatttggttccatgatagtaccacgcccaacttcactagcaaccctcgccaccaccccctagaggcaggggaggttgaggtgacgagcacaaacgacttaaacatgtgtaacaagggcataacaatcttattgtcgctagtctcctatgaaaagtatgagggctagagagaggattggcagtaacgaaggaagccgataggactcgtcggtatatatggtggagtttgaaggcatcgcacgaaataggggaggcaatgaaggaagaagggggaagcggcaagagggagtattatggttagtctgggtcgacaagcgatgctttatacagtgaagtgtcaagatccaaaccactcagcagagatcatgctagtggaggggaaatacttgattcaagtttttatcttaggtgtagcacaagacccccaacgtgtgtaaatcttattcgtcaaggtattgagatttcattacactatagaattattgtaggttccttgattaaatccttagagcaacactaagagactcactagatggctctccaagctaaattttagcaaatatcaaaaaatcaacctccaaaatacttgccaaccagttggccaaatgcctccctttgatgttcaaaattgccagccataatcaatggccattcatgggtcccatgctgatcctctctttctctctcctttatcacctttgcgagaagacgtgactcacacgcacttcctctagctcgccttgtcccagcgccaccgttgttgtagtccatcatcatcgctaactcaagcgccacatcccccgggcacctagtgccaccttacccaccctcccctagcccaagtatgccttgctccaaactactacatcgtcatcttccgtcatcgtccattatcaccaccgacttaaggcgatgcctctcctagcctcctagtgtggccttctttcatagtttcccacccgttgttaagaaggacggagcgaggtcaatagggccgatgacgtcctccaaatcccaagctctacatccccgtctcctcctttgcaaggctgtctatgtagacgatgtcttctcattggtgatagaaggctagaagtagtcattggagagggtagatcgagaaatggcatggaggagaactaggcagaggggaagtatgcgagagagactaacatgtgggtcccactatcatagtggaaactatagatggagagcttgttggagcacacataaaatatggagaattgaagagggatctttttggctagctagccagccaaatgggcaaacaaagagcacaatttgaaaagagagtttagagttgttcctataaatgcatttctctccaagtttacaattgagggggaagaaactctagtttggcttgcttattctacctttacaaccatgattcaattgcatcttaatcagatttaatcttaatagctaaaattacttgcattgctcaatcctattaatgtgttaattcatctttgtccctgcccaaataaatgtcacgaatgccacatccgtcgtggtaaaagaaagcaatatgtcccaaacaaatgtataccaaaatggcttggagcgagtttcccccttcccccaaagccccaaaccgctattgaatggcttaggcatactatatccgccacattgccatatccgggaaagtccaaaaatatcttacgaagtacaaaatctttcttatatccattagtgccaaccgagcaagagggtggggaagggcataagaccccatggttttgaaatttaataaatatcacaaattctacttccattggtgaaagtaagcaagaggtaagctatggcttgtagcgagccggtcctctatgctctatgaagtggtttgggttattaggtatcctacatccatcaacacttataaacatagggaagtttaaatacaacctttttatacacattagtgcctaaggggaggaagaactgaagaaggtagacatggatacgaaaacccctggttttgaaatttcataaactaaatttatttaaaacattgtcatttacccaccagtaaattttacaatttctagctccttcaatattaacataagattgaagaatccatctaattaggatacaaatattaataaaccaaagtcattctagtaaaaaaaactacattataaatcacttatctcctcttgtggcttaacctgattaacaaatagaccaatccctcctcaacctccgtctcctcgaatgatcaaagagcacgtggccactatatgagcaaaccaattgtcctgagctgacaagagtccaaggcttgaattgagctagtttctccacccccacgagccacggatccatcggctcaggttccagtcccaccgggggtagagaaagcaaggcaccctcttcgtcctcctctcacaccttccctcttcacacatcacgcgttgtctcctcctccccttccccttcctcaaaatctcctcaacacgccgccttagcctcagccccagctcctcagccctgcgcatgcttcgatcttggtgaattcagggagctcgtgaggttacaattaaggggaataaacactagtttggcttgctcattcaacactttgcagcagggtccaattgcatctaaattatctgcagtggtcaattctactcattaattcatttatgtccctgcctgaatgaatatcacaaataccatatccatcggtgaaagaaaacatgcggacccaaacaaatataaacaatggcttgaagcgagccggctctcccatacgccacaaagcggctcgatatcctatatctgcaacatcgctacttttaggaatgttcgtaaatatcttatacatgctagtgccaatgggagtatgatggtgtgttggaataggggaaccagccccatgattttgaaattcaacagactaaatttgttgaaactcatgagatataaatgttaccatttctagctcctcaattattaacaagcgaataaagaatccattaataataataataataaccatattataaatcaattatcccctattttaacttaacccgattaacaaatcaacccatatgcttcccactctccatcgactcgacttgaatgctcgtagagcacgcaaccacactgtgtatgaacaaaccaccagcgcgcaaagccgagaagagcccatgggtcggcgatcgagccggctcccccgcccctaacgagccgcggaccggctcggctcggctcggctcgggatccaatcccaccggtgtagaaaaggcaaaggcaccctcgttctcctttcacacctctccccccctcttcttctctctctccacatcacaagtcgccttcctcctccgcccccgaaatcccctcgcgaaccagagaaacctgaggcaccaccatcaccaccaccgcctccgcctccgcctccgcctcctgcgcgcgcggcgaattcgggggaccctcgcgctcgcgtggggtgtgggtggggggagagccgggcgtcgccgtcgccgggggggggggagggtgctcggattcagccagcggcgggtgggggggcccgcctctttcttcttgggggggcgcggaggagaccccgcccgtcctggattccgtggccgcggcgccgattcgggcgcgggagccccagcacggtgagattttcccccgctgccttgctgcactgtgagaattgccgtatctatactgtactagtttgttgttgttgttgttgttgatgatgtggctgctcgctgttgcggaaacagtggaatggatgggggtttgggatggttggggtttgacgagctgggcgggttgaggcgggaggagggtttgcttagggtggaatctgattggccgcgatcggcacgggtgttttggctgtatcctatagcgtgaaaaagataggaaaattactggttgtatcactttttgctgggtcaggtttggatagaattcaatcgtgttttccctccatgtcttttatccgttgaaatggtgccatatgaaatgtcaggattagttataaattctggttgcacactttgtggacgatttctgttatttgagtgggttatttagcgattatgtgtccgcgaatataatctgtactgacgtaagagcagtgaattttttttatcactcatcacagtgtgtttttagctggatgataactgagagttttgttcctgttattctgagttcagcacccgattattcataagtccaaatgatattttgttgcttgtgtatttgtctaaaactgtgcttgtggcgtccagccagtcaattcttgtgagtattacgcatttttagtgctatatttggcctgatatatatactatcttgagtaggtattatggtgatgaagatggaggctgatgaggatggtgccaatggcggaactggtgggacatggactgacgaggaccgagcgctcaccgccagtgtgcttggaacggatgcttttgcttacttgacaaaaggaggtggtgccatatccgagggccttgttgctgcatctttgccagtggacttgcaaaatagactccaggagcttgtcgaatcagatcgtcctggtgctggttggaactatgccatattctggcagctgtcgcgcacaaagtccggtgaccttgtccttggatggggggatggctcttgccgtgagcctcatgatggtgagatgggacctgctgcttctgcaggtagtgacgaggccaaacagaggatgcgcaagcgtgtgctgcagcgattgcactcagcattcggaggtgttgacgaggaggattatgccccaggcattgatcaggtgacagacacagagatgttttttctagcatctatgtactttgcatttccacgccgtgctggtggccctggtcaagtatttgcagcaggcgtgcccctgtggattcccaacactgaacgtaacgtatttcctgccaattactgttaccggggataccttgcaaatgctgcaggatttagaactattgtgctagttccatttgagaccggtgtacttgaactgggttcgatgcaacaggtagcggagagttctgacactctccagaccataagatctgtgtttgctggggcaattggcaataaagctggagttcagagacacgaggggagtggccctacagataagtcaccaggtttggcaaagatttttgggaaggaccttaaccttggccggccttcagcaggcccaggaactggcgtgtcagaggcagatgaaaggtcgtgggaacaaaggactggtggtgggagctcattgctccccaatgtccaaagaggtttgcagaatttcacttggagtcaggctcggggcctgaattctcatcagcagaagtttggcaacggtatattgattgtgagcaatgaagccacaccgcgcaacaatggaggagttgacagctctactgcaacacagtttcagcttcagaaagcaccaccacttcagaaactaccacagctccagaaatcacatcagctagtaaagccacagcaactagtgagtcagcaacagttgcagcctcaagctcccaggcaaatagatttcagtgctgggaccagttccaaacctggtgttttgactaaaaaaccagctggtattgatggggatggtgcagaggtggatggcttgtgtaaagacgaaggtccgccacctgcattagaagaccggcggcctagaaagaggggaagaaagcctgcaaacgggagggaagagccactaaatcatgttgaggccgagcgccagaggagggagaagctcaaccagcgattctatgcactgagagccgttgtacccaatatatcaaaaatggacaaggcatccctccttggtgacgccataacatacatcactgacctacagaagaagctcaaagagatggaggtagagcgagaaaggcttatcgagtctggaatgatcgatccgagggatcggacgcctcgacctgaggtggacattcaggtggttcaggatgaggttctagtccgagtgatgagccccatggaaagccaccctgtcagggccatcttccaagctttcgaagaggcagaagtccatgcaggggagtcgaagatcacaagcaacaacggcacggccgtgcattctttcatcatcaagtgccctggcgccgaacagcaaacgagggagaaggtgattgccgccatgtctcgcgtgatgaactcagggtagaatcagttggggagtgggcgccaccggtagaggcagctttacttcgttcgctggttgcagacaagcagcaagcagtcggttggacggacacccatccacccacctttcagcgctgttgatagaagaagtttgtaggcagagaaagaaagctcagattctgacttagcgatccaaggggaagacaaagctctcaagttaaaactgccattgttgtatggtaggcttttgtggtcggtgtagtttttctctttttgttgtttattggggagaataccatgttcttagtttattgcttgtggcagaaccataaacagtacatctcgtcaaatgcatgagttgggaaagaagtcacctgcttttctgctaattctgtgtttttgtttgtatctcaagtgagttggtgtttatacttcggcatg

SEQ ID NO: 66249 - DNA, 5746 bp, Oryza sativa
acgagacgaggagagagaatgagaatggggcctctccatctccaatctcccttcctcctctggtcccctgcgcctcctaccccaccactcccaccttctcctccaagcaagacgcgccgcccaccaccgccgtcgcctcccttctgcccccacctctccgtcccttgcgtcgggctgccattgccgccgccatgccctccaccgcccggcgccatccggttcccgctctggcatggcgcggcgacgatcccggcctcctccgtgtgccgttcggtgaggggacatttcgtcgagcacctgccgcacgtggaggggcgcgtgcccggtgacggtgagggcgcgttcgccggcgtcccgccggagatgctccctcccaagaagaggctgctgcggtaccacccgtacgcggcggcgtggacgatccaggagatggcgaaccatgccagggaacagggagggttcgggggcaagcggccggctgttcctactcctcccggcgtggaggaagacgacgggctgcgcgccgagctgcgccgcctccgcatctcgcggccggcgctggtgctgacgaagcggctgaccccgtcggaccgcagccgcgagaaggcccgcctcgtcctccccgaggggctggtcaggacgtcgccgctgctgggcatgctgacggcgggggagcgccacctggtactcacgggggacggcggcggcctccccgtcccggcgttcgaccgcctgggccgcgcctacgccatggcgctcaagcgcgaccgctccccgacctgccgctcctaccgcctcacggggcagtggtcgctgttcgcgtcgcgccacgccatgcacgacggcgacgccgtcgaggtccgcgccttccggccccccgcgtggcaggcgcgcctcgagtcccgcggcgagggcggcctcggcatggcgctgctgctccgccggccccgaggccagcccacgccgccggcggccgtgaacgacgccgcgttctggagctaccgggagcgcggcgcggcggacggcctcctcctcctcgcccgaaccgctcctcgccgcggcgacggcggcgtgcagatcacggtgccataggtggtcaccggacgccatgatcttcatcatatgcaaattacccgataaagagtataaacttaatcgtgttttaaaaccaattacaaaaaatgcgaggccttggttcaggtgatcatcgatcgatcgcttgccgctcgatgcaatgtgatgttttggatgtcacctgggtcatcatctgatgtaaacaagaaggttttttggtgtttagctttgtaagttaagagtgatcatgcatggtagtgtgagtgaagaagggtagattgcacattcaactaggacagataaacataggtagatctatatgaaatcgccttggtttttgggtgtacttgtagtgagagagatgtttccatgtgcatgtatgagatgtttccatgtgcatgtatgagtatgattggtggatgatgcaccctggattcagtgcaaaatgtttatcatttcagattttgatgttaagcttgatttgctccatgtattcagagagtagaaacaaagatacgtacgtcgttacacatgacacttgctatgcaccctacgaagtaggaacacgtcaatctcgatcgatcatatgtacgtacatgttaacatgagattgcggacaaccttttgatgtcttaagagccttgagatggataggcatatatctatttaattcatcatcttggtcaacaggttcagcccagtccagtcctagcaaccataagctaattatgtactacgaaataaaaaagagagagaaagatattaacttctctgcagttaggcaaagcagactaatccatccactcatccaccacttctgctgcataacgggcgcctcctacaggcgcagtagttgttgcaccagagctcttcttcaccttctcggcgaggaacttggccgtgtcggcgcccttcacgttgaactccatcaggagctcctcgaacagcgtcttgaggttgtcgttgaacgtggggcgtctactgacggaatccaccttgtccggccgcggcttcagagcggcggcggcggcgctggcgctggcgctgctggtggatgctcccgcgtcgccgtactccggctccttctcttcggggaccaccgatccgaccttgtggccttccatgtagtacctgcatgctgccaggatggtgtgcccgcgctccctgaagtggctggtaacaaggtctgcgaagtgctgcgagggggcaaagagaggagtgttaaagcggcttggaaacttgatttctgttctactttgtgatgttaaaaattggaagtagggttggtaacataatccagcaccaagctatagtcaaatcaaatcatgtgtgtttattcagcaaacttctccgtttcatcctccacctataatcattattttcaagaaaaaataacctttaaccctccatcaatctctatgttctgcgtgctaaccataatcagtactccctccgtctaaaaaaaatgcaacctaggataggaatataggatgtgacatattctaggacaatgaacctagatcctttcctaggttgccttttcttttgaacagagggagatcctttcctaggttgccttttcttttgaacagagggaatacttctatatggcaattgtggcaaagtactgccatgtcacaagcattgtttactggacagggtttccaggttgcattaaagtgacaaatatcctttcttttcagctttagagtctatgcaaaaattaacaaaaatattacctctggaggccgccgaagtgagtagagcatcgtcctgcatgagtgcagaaatgtgttgtcgttatactccatagcaatccgctctccagatacactattggcgtaggatgcatatcctggctcattgaagtagggcttctcattcaaaatgagagcttgaatggagacgagcacttgtagcatggtcgactgagatggattccacgtctcacaaccactacctgcccaggtaccagaagactaaggcatacttttccattattgtataagtttgggttaatccgtagtccgccagagtggtagtatactgactgcaacatcatcaacaacaaatatttcaacaaaataaaaaggtgaaaatgtcataaaagcagtgctgagacttaggcacatactggaggattagcagggtaagagttactaaattgaatatcaaagaagaagagcccatcgtggtacggtgttcccttaggtccgataatagcagccctaagaaggtccattctatcttcagcaacacggacataaatagatgctacataaaacaaaaataatcaggattcagatttctacaatgagaaaatacactgcaacaaagaaagctatagtttgtccaatttcctctaaagtttttttcctgatatgttcaacatctatgagctatgaatggtgagtgacaggatgctaaatcctaacataagcatcattcactatttccaaactcactgcaggattcccaagaatttttacagacaaaaggcaggtgatcagcataatgtaaacaacatttggaaacaaacccaccacaggattcccaaagatattttacagacgaaaagcaggtgtaacataaacaacatttggaaacaaacttgagaactgatagtgttataagaaaaatcaaatctggtccttcttataaggtgcactttaacaaggctcaaagatgtaagttctaagattgagaaggaaaatagctttagtaccctcactagatagtagtaaaagataatggtctgtgcaggcagacataagttccacagtgagaataaaacaataagaggaaatgaaaggaaatagcatcacatctacatgaagccttatcaaaaggacaggatgaaatactagtttctcaaagggaaattcaggttacatatttaaaccatgaacagttgtgttcaacttacatggcacttacatgacgagcatatatagtcaataaaccaaatagtgtaagcagcataatcaatgcttgtgctggattattgaccagcaaactattagcactaattgcatcaaaatgcatggttagtgtgaaaggggtacttaacgatcaactcacaggtgcagccatgcagagaagaaactaactcactatgccagtaggcaaatagctaacctggtagatctttctccaaaagtttccagtcatgctgaatcctcttcacccagtctctctttgtctaatataatgtaaacatggaggaaaaatgaaataacagatctaaaacaagcataaaacaaaagcaaacaacaaattcaacatattaccacatcccctgatgttgctgcataatgatgatcagagaaatttttaacagtgtcaaactgtttgaacaactgagatttatttgcacttttatttgcgctttcatcttcaactgtcaatttggaactgctttgctcttcgttagttataattttctgaagccaaggtacagtagcctccacgcctggaggcaaatccaaatcatcaaatttatcagcaagacgttggttgaagtagtcaccgccatcaaattcataatcatatccatcgccatcatcataaatgcaatcgtcctcgtccagatagtaatcttcttcctcattttctccattatcaaaatctcgaggctctggttctgacatttgcaaagaattacttgtgctcaatccaacttggtcatcagaagaaccctgttgaataagtatgttattataggttaggctaaccagtacttgatgatgtaaaatgtattgactctccactactttcctagttatgacaagaaaagtcacaaaaaagtaagaccggctgattagaaatccggctgactctgcagcagacagatatctatgagactatgaagtgtgcaaataatttgtattttgggtgttttctccagccacttgttctgaagatgtgtcatccagtaggggtaaaagcttcaattgaggcaaaagatatagttttcacttaaacatggggcaaataatagatggcctactaattaactttggggaaaaagataaatttcttcaataaaatggttgtcagtcctcaaagagggaagataaaaaggtgctggtgaaaattgtggagattggagaactgtagttgcacttcaaattatttacagaagccaagatcagagtaatgacatgttatggctggtactgcaccaatcaaccccaaaaaggctagatgctgcatgaatgaatctgcaagccccttgattccaaaacgattaatagattgactacctattatttgaatgttcttaacccctaaatcagtcgaatttccgattatcagatgaaaatacaacggattagatttgcccctccaaacacatagactcaaacagtaatcccacctttccccaatccactgagccgccatcgcacacaatccccaattccccatgactcgcactcgcgagacgcttggcgagcgcgtctgcctgtaatgcgccataggtgccagcaccggcaagccagcaagccattccccaccgcagggccactgcccccacgccgctttcttcctcctctccggcatcaccttcttcccctctggtagcctcacgcgacacgagaactcaacggaaaccgtgtgcgggcgaagaccactaccaaaaacccaaaccctagtgccgaggatcgaacct

SEQ ID NO: 66250 - DNA, 14398 bp, Oryza sativa
ctgcacccctcattctctctcctcgtctcgtctcctcgtgagatgagatggtggcacttggcacccacgccttcagccttgttgttcttctctttgagggggggggggggggggggggggacaccaccattgcaactataaagattagcacgtataacgatggtagtgttgtctcgccacgtcaggtgagacggtgcgtgtgaaccggttttgtatctttgagacgcgcatgggtttatttgtaggtttcctttttaaaaaagaggtttggaaagatctaaatgttgctaaaccgagcgtgtaaagttggggttattgggatggagaagggtggtagtgtgatatggtatgcgcgagaaaatccagcgaggatgtgaaagctagcactggccacgggtagcacctcggattagagcgaagcttatcgggtcacatttgtctggtgcgcaatagaaaacaactccgacacatcactcaaatatgagggatagatcatatgcatcggtctgatggttattttctcagtggaccccatatttaatacccaaggtgatcatataaaacttactttacggtgctctctaatctaatagtgttgtgttacaagtagaaaatgatccaggttgttgatttctaggctataatgtatttccctacatatatgctttagacattttgatcatgcacataacctctgttgcatactgattggcgatacaacaatgtaagacctcgcgatataggttactctagttaaagttactaatacattgaatataaaaactcatcatatctcgaatatagtgctaggattttcaactctaaaaattaaaactttagattttagaagtccatcccctaatgaaaattataaggttacttgacaaacctatttttctcatgggcagactaactcatgaaccatataggtaatagctttcattcttcctccttccttttctctacgtgacgaaaaaccatcaatttctgaagagcgtatattcttctattatactccctccgttttgagttataagacggtttgacctatttcaagtttgattaagtttatagacaaatataataatatttataatactaaatttgtttcatcaaatcaataattgaatatattttcataataaatttgtcttgggttgaaaatgttactattttttctacaaatttaatcaaacttaaagcagtttgatgttgactaaagtcaaaacgttttatagcatgaaacggagggagtagtaagttatatccctcaaccatttcacttcacacatgataaatatacatgaaaggaaaacatatatcagaggtctcttatcttatcaccgaattacaaaattatccctcaactagcagaccttagatatttgggttttcggttgaaggacggttttgtaattcggtgaaaagatgagggatttcaatgtactttttcctacatgaaaaatagaggaagaagagaaagtcaaggcccaacaaaacctgggcacgagccaagcccaaaaaggtagaggccctaaggcccaacggcccaagcccaaaagctactctcgaatctcgagctagccaagccaagccaagccaaaaaaagccctagccgcctcgtccccacccaatcctcctccctcgccgctcgccgtgctcccgctcccgctccggccggcgaccaccgggaagaggagagctcgagatgagcttgcggccgggcagggcgcaccccctcgccgcgtctcccctccacaccccgctccctgctaggcctaggccccagctgaggctgagcacctccaccagctgcgccgccatgaagtcgtacaggctgtcggagctcagcgacgccgaggtcggcggcctcaaggcgcgcccccgcatcgacttctcctccattttcggcacggtgagatagagacgagatggagagagagagagagagagagagagagcgagctacactagccgtggtcactgcgtgaatttgtgattgattgtctctcaaccattgggcttagtcttttttttcttttttttgggtgcgagtaggtcaatccgattgttgaagacgtgcgcatgcgaggcgatgctgcggtcaaggagtaagtgatgatgatgatggtgtagtgttcgatccttttggaccatgtatagcatgatttttgtattgacttcctgggtttggtttgctcagttatacagtgaagttcgacaaggttgcactcgatgatgtggttgtgcgtgttagcgatcttccggatgtggaggtattcaccttgtattagttatatgatgactgcatgtgagtgcttggtgccaaacttgtgttctactagtatagaattatgttgtgaactctgtgtacttgcattcagagccttcaaatgctaagtgatagttgcgcctaaaggcgttaatttgtacactggcgtaccgggggatgggtaaccatgttttcattacttactggatgggtttcagttgccttacatgtgaatcttgaatcttgtagcttgatccagctgtgaaggaagcctttgatgtggcatatgacaacatttatgccttccacgtttcgcaaaagttgcctgaaaagactgttgagaatatgaaagtaagacccatttgttgatcccatttagctctaattccatccctgcctttaccttcctctcataccttttgacttgtgaactcttccctggatgtgttgaagggtgtaagatgtaaaagaataacaagatgcattggttctgttggcctttatgtcccaggtggcactgcagtattgccttccactgcattgatgcttgctgtggtatggtcatgttttcttaaattgtgttaactcatcattctcttctcattgttttttacaatttaatatagtaaatctctttctgccagcctgcacagattgctggttgcaaaactgttgttcttgccacaccccctagtcgtgatggtagcatatgtaaggtacaattttattggatgcaggattgctgctatttctgagaagttgatatgtttgtgtttctaatgttgaattatttggaatcggttgttgctcttgtcctccgcaggaggttctttactgtgctaaaaaagctggtgtgacacatgtattgaaagctggaggagctcaggtaggacatttgatagttcatagtactatcttgtgttccccaatatggcgttgagttaaattattgttgttttctttcaggccatttcagccatggcatggggaacagtctcatgcccaaaggtacttggaatcttttgttctgtaacttgtaggggctatttttaggtgcaccatgcaggggataggggctgtggtcttctctttactctatatatgattgttatagaactgcaaatatgagtatatgacttaaccagcttgagcagtttttgtgattgtattctgagtggattcgtattcttctaatacaaactagggaaatacatatgcactattgattctgtttggctggcttattgtcactagtgttaacttagcagacttcagaaatgctttagttgcactagtatttttctgtactcatttattcataacaattgtgtcatttccattatttgtggtgatcaacttatatactgtctttgtaggttgaaaaaatatttggacctggaaatcagtatgtcacggctgcaaaaatgattcttcaggttctattctgatcattctgtaaaatcctgaacaatatctgccctggtgacaatatttttcttgtttgatggcagaacagtgaagccatggtttctatagacatgcctgctggcccttcagaagtattagtgatagcggataaatatgcaaacccagttcatgttgctgctgatttgttatctcaggtatcttctattcttaataccctgcttcatactggtgaaatgtgtacttgttattgaacttcctttactctttgaaatgccatatttgagaatctgaggcataggaattacatgatgtcgtgaagctttgttaagtatcatattatattatataacagttgttcgttcaaaattttaggcggaacatggcccagacagtcaggttgttctagttgttgcgggagacggtgttgatttgggtgctattgaggcagaagttagcaagcagtgctctgctcttcctaggggagaatttgcttcgaaagctcttggccacagtttcactgtttttgcgaaagacatggttgaggtaattcttcattcctgcccactctcgaattatttataatttgtaaggcacgtactatacatcactggagtttgaggtcgtagaattttgcagcatgcatgaaggtaaatgaaaattatctgatctattgccgttcccagggattgttgacaagccccctctttcttccttatgtaggcaatttcattctccaatatgtatgcccctgagcatttgatcatcaatgtaaaggatgctgaacagtgggaggatcttgtcgagaatgcaggtataggcatacctgtcagcgtcttaatcttgacctgaacattttcatacttcaatggtaatctcaggcgatcgttttttcatcacagggtcggtcttcttgggacaatggaccccggagagcgtgggcgactatgcaagcggcacaaaccatgtccttccaacctatggttacgcaaggatgtatagcggcgtgtcactgaactcattcctcaagtacatcactgtccagtccttgtcagaggaagggttgagaagtctgggtccgcatgtggcaaagatggctgaagtcgaaggactagaggctcacagaagagctgttaccctcagacttcaggacatcgaagccactgtaaccgtgtagatttgttaccatgattgttctaggggccaacttggatgcagagaacaagaatctgtgaacaccctaatgagaagggatggtccagctgtttctcgaaataaggctcatccattttgatacatctttgaatataaagtttgtttgattgtgttacactttcaagtattcaagaggacgaaatctgtgaagactgtaaggaaaagggatatgatccagctattactcgaaataaggcccatccattttgaatctttggtccgtctattgaatgcaaagtttgttgactatgttactactactactcaagtattcaagaggggtaaacctatgtgcaaatggtatacaatttcagtataaaaatattgacagcagggtttcacttgcattatgtttctcggtagataccgtgatgatttgcacttgataatgccaatctaggtataacatatgtgattttacatcagcacaagacatcaaaaattgcaagattatacaatgtccatgttctaacatccccagtgcttatctatacacataagtgaagcggcatacgcagtctgcagtctataataatctcatcatctttgtaaggttagcgatcttaaatcaccgaaacagctgccattggcaggcatagcggtctagtttttaactccggaatcccactcagcttcacgatagagcagtttcgacggtttgatgaaggaaaccgggaggcgacattggtggcatcgcttcttcctgggcatcaaccatttctaggatctttcttactgtggcttgcaaatgatcaccttgggttatatttggatgaatagactccttgtttttgagatccgtatttgatgacttaaattttgcatgcgcttttgctgaagttaccgcggtggtgaatacgccggattccttgagaccacgaatgatagcctgcaaagatgaatcattcaagagatgagttgctgccttcattgttgagataaaggtactcctaatagaagttcgagattgtgacttgccattggggcatatatgcgtgtcaacacacccttcctcaaaagcttcaaattggtatctttgtcgttccataaaacatgttcccggaacctgaagaggaagtccgacaaatacaatctttagttaagggagagaagtagggagggtgcaggctacaggagagaaggggtgtttaccagttcctcatttcctcctcggtagctgttgatgcaattataaaggcctggcatgtaagagtggatccaaatttattagtgttatcaaactagctgcttacactgttacacaattagctatgctatgcaatgtcacaaacaagttatcccattgcaggctacaacagttgctcttggcaaagctatgatagagagaatgcaaagagcatcaacttctcattcttaagagactgttattggtatcatacaacaagaagtcgaccaacgttacaaatgaaacgaagggaaagaacacaaataaactcaccaatctgtcaaattccaagataaaacatcgcttcacatcttcctttgtgggcttgcagccacacctatccctccttgaagttaagtctgagaactttgtgtaagtgtaatgcagaatagcagcttcctccaacttgatttcactacatgaatatataactgatgactaaaatgaccagaagaaacactaaaatttgtcctctgaacaactttagttttataaaaaatatatgtcaatgttttcagatgtctgtcatcttactttggggttttcatgtaattatgccatctatgagcaccatttggacgcagatgctcctgaacccttgctgctgatttcccattaccgtaagtgagaaaatagtttggattaccacgcgttgcttctttgtataggccaaaatatgtatcctttggaagatgatcataatttttcttaaacatggaaacctgcggataagaaaaactgataagaatttacagagaatatgatggatgatagttgagctatgaaatctgtagacaacagattttggccagaaaattaaacaacagcttgaagcacatggacgcacattattgatcatgcacaacttacaataaacaatcaacaaaatatgtaatgaagctatagaagtcgcaacatagatagggttggtgtggaaacagcaatatggactattgcatattaactagtctccatcaagcaacaaaactttatcctcatgaagcttttcttcttttgacaggataaacaaaggggaattagttttaccttccaaagtttcaccagtttaaggtttcgatttcttagcgcaatgcaaagtgaaaggtaacactgtgactaaagcaggcaattctgaatacatactttaattcttctaaattttaagcatgcacctggcccagtaacaagggctcttgctaatagctgccaaaattggtgagcttctctccgatttgcttcaaattatgaagttctaacaacacaacaaattacaggcgaaatcttgtctactacaaatcccgaaatgctacagcctcacaaagtgttttcaaaattctagtgatcaatttttttctgtggagaaatattttttgcagtggttttcattaaatcatgccttctattgtggtatatgggcaatattttcctttacttttcttacttttatttgaattagtaatagcttacacacctctgtgaaaggatctttgatgtcatctcgctcaatgctgctctcctggggaaaataaataaaaattagatgtgaaacaggctacatcctcaacagaaaatttattctgcaactcacatagttggggaagataaccatgtcaacattatcaggaacatctaaaagcaatcgcctcagagagtactcccgggcaccagctggatgaattagctcatcggtatcaagatgaatgatccagtccatgccagcatcctacgataatcaaacagggagaagctcaaataaagctaatcaccaaaaacagggtttctggagaactaaacaaacaacatcatgcaaaatgccttcgtgagtaagcatattattataatcttgtgtgccaactgccaacaacggttgatgtaaaccacatcattcatatggcattggcacggtagtataacatgttacaattattgggatttcttaactttttgctgctagcagtagcaattgggctaacatttatagcggaccgtgaaaaaggatatgtgaattattgattatgatgattaactggtgtgtgtatttgtttttttttgtcaactttacatgcattagttgtaccatcccattactcaccctacacgtgagtgagaagaaaacaatataatgacaaaaaggttgattagttaattataccagagatattccccttttgttactgtagtattgttacacaaatcacctcatatcttacatgtttgtgctgtattatgctacacagttcaacagcgaggctgaacatgatatggtgataattatggttccccttagaaattgaggggaaatagcatggaggtagctgaaaaatgggtaaaacaaaaaggctatggtgcttttgaatcaaaattgtgataattatcatttcacaagagcatgattgtgaatattgaatcaaaagcgcatgaacatgcaaaacgaacagttcatacccttgccataatgatagccatttccatgttcagcgactgtttgacaaatagttcataattgcacggtttgtaaaagaaacctgccagccaagtctcattccaaatgcgactgaaaatgttttaacagtagaaattcagaccacgaaaaatatcaagaaaaatacaggtaaacttgttagcaacatacacatatttcactagcaaaagggaaacaaacatacaggacccaaacaacatgaatacttcagaaataagaaattgcaaatcttgtaaaatgggttcgatcaacaaaaatgttatagaagcaagaaggtttggttccatctttactactagaactcaaccacatcatttgaagcaaacagtataagacttaatcactgcttttctaatctatatcttgttaaagcagtgtcctagaagaattaaattttagattgtcagtggaccaatctccaacaaaacctcatcttttacaaaaaaaaactctaaacagcttctcagtacatcacaataccttctgtcctgtttctctttcaattctttagttctgtaaatgatttttacaccctaaattagaaacaaaaagaagtcagaactagatcctgcaaaagtcatacaagtacagaacgaaatggtgcagagttgtttacccgaatggattcaagaactgaggtaacagctggtttcgcagcctctccttcaacaaaaaggaaaaagtgtgaaacaccgatgaccttgtggtagtacaaccatggaagaatttggtgtaaccctgcagatgtgcttcccgtgatacagatctgcagaatcatgaagatatattcaggggcataatcagttaacataagctcatcccatgataaacgagactcgcataccacattctcacaaataagacaggattaattttgatgttcagattacaaaaaagcgaacaattgtacaaccatagtagggtgcatgaatcatagttgcaccatccatttcaatgcaaaatacaagatgttcaaataccgaaattttaatggctcacacaaggaacatgcaagactgcgaatcaaccaacacccacaaaccctgtcaaccaaagttcttggaagaatgcaccaccccgacattgctctgtgtcaaacacgtttcctatctctgggctacagaattcggttgaaaaagacaatctctaagtgaccactaacctctaaaatctaaatcacatcaaataggactcaatttgatgcagtagcgaaggagcaagtcaggaacacaacaatctacaatctacgacaaataaatcagcattgaagcatcaaaatactctagaagataggaccttgcccgcagaacaggcctacacagaaagcaagagtacttaaaccctagaataaccatttgatgccatcgccgtattgcccaaactgcaaaatattgctacattccacgaagatgactatctcatcctcgcaggacagaaatgcgatctcaccaaaacatttcaggctacttttggatctcttaatatcgcggctttcaaattggattcacgtctaaagcaaagcgcaattcagcggcacgaggttcacatcgaggccgctctggagacgagatctccacgcgcagatcagatcggggagcggaaacctcaccttgggggttagtcccgcgtcggagtcgaagccccacccgcggtagagcgagatgccgccgtgcgaggaggacgccgcgctccggccgaggatctcggcgcagtctgcggccgcggaggaggactgcgacgaggtgacggcgaagtaggacccgcctcccccgcccccgcccgaggaggaggaggaggatccgagcgggctgttctccatgccggggaacctctgcgtctccgcgggccacgccgcgcccgccgggtcgcgcatcccgccgcgccactgcagcgcgaaggcgaacgcggccagcgccatcggcagcagcgtgaggagcagcagcacccgcgtcgcgaacgccgacgccgacgacgcccccccgccgccgccgcccgaggcggaacccccgccgcggtatcccgccatggcggtggttggttggtggactggacagagacgccttcgccgcttttagttcggttgtactctctcccagcgtcgcacacgcgaagacgacgagaggagtgagaggtgagaacgagatgttgggccgagattaatgggccggatgggggtaagcagatgggataagtttactttgggtcactcatcgtggtgccgagttctttgaaccgcgatactcagatataatgcatttctcaacttgtaataccgaaagtagctaaggtcccagcctcccggggcaatattatgtctggtttttggctgacgttacgagttgattgtggttaacccggttggagtcaacatgacagggacagagacaggagtagggcaggttggccatactcctgatcctaaataaatattcattgaaattccattttaaaacttcaaaaactagaagataaagtcaaaattatatacattcaaccaattgagccctaggtttggaaaaattctggctctgccactagaacatgggatctacgtgttagagtatcctcaacagctcctctatctagtcatccatccggtgtttggcgcatggaggagaaaaacagtgctccagcagagtctccattgcacacgccatttttagaggtcctccaaaccgagcccttcccaagccaaatatggcggttctctctcctcacaccatcctcaactgcttacctcacaatcgaactcgcgccaccatctagactacataacgcgagagagtagcagtaaagaggaagtgcataccggagtagaggcggagaggtggtggatctggaggtggagagaaccggagtagaggcggagaggcggcgaatctggcagcgaagaggtgtcttcccactgctcttgcgaccgcgcctcccctccgaccggccgttcctcggatcgacgccacccggccatccccgccgctccgagtcaacgcccgcgccgccactcctctgaccgcgtcaccccgccgctcctccgactgtgccgctccctctgaccggccgctccttcgactcatgccaccccgccgccctcaccgctcaggtcttcgcccgcgccgctccccccgatcggcccacgtcctctcggctgtagaagagagagtggtgaggaagattttttttaagtggtgaaaagtgagaggaattgagtaaaaatatgtggtggttgaaaaatattaataaaatataggatgttaatatatggagaatgtaatatggatgatctgttgaagtgaaaagtaatatagagtgagaatctttttggatagccatctaattagaaatatggaagttgaaatttagatgagctgccggagatgctctaaatagaaatatgggataagcaaatctgcaagcacagtacatttgtctacaaccactttgctatcatcaccaggcaaaaaaatgaaaaagggaaaacttgtgaatccaatacacgatcatggcgatagtgcagtgccatgttacatgtctccaacaccatgacctaccaacagcctactctgctactcaccccacatgcactactctgctcacctgtattgatttacggcaaatccgaaatcagcaacgcacaacagccagggtcccagggaattctaaaaagaaaaaaaattactgcactgccccatgcagattttacaagcactgcgtatctctaccttatcaacatggttttttttcccgagaaatattcggtttcctagatgccacagagaactatgaattcctatgtctttctatcatttctgtgaagggatagatcaggtatctgaagaacaccaagaccaaaacgttcacttcggatgtgttcagttcacgctaaaattggaagtttgattgaaatgggaacgatgcgacggaaaagttgaaagtttgtatgtgtaagaaaattttgatgggatagaaaagttggaacctaaaccagcccttcgtcagaaaataatcaagatagaaagtttgttcctgctcctgctcctgcagtcctactaatcaaaagtaacaagatgcagccatggaccaattcagatatgtacattttcagatggcacatacacacacacgtacagtggtaaatatataaatatacagatcatatgatatgagaccatataactatatgttggttagttttcagaattattagctgcatttgcacatgttgtgtcgcctcgccctgatgagtggctgtgattggcgccgcgatgttcggaggcccgggatgcacgttgtctttgcatctggcaatgatcctgtccgtccaaaatagcaattgttttcaacttaattaactacgtgtgataattggttctgctgattattgtgccgcataaatgttagtatattagggcactgtcatgcaattgtggcaaatatattcagacatttgagctacttcttcatgcagaaataggagtacatgttttacatgtcacttttggatgaatttttttttaaaggtctagattacttctaatatcaatagataaacattgtaaaagttttatttcattcacaaaacaattcatgtaatcaataacaacataatactagttagttatagttaatcaataacagcataatacttctagtaattatcactaggattcaactttttgttttcggtgtttgtatcgggcagcgccgatatggtgaaatttccgaaatttggaaccaaaattagtcaaatttgaacaaatattaccaaaattcacgaaaaaaattttaaaataaaatttttggccaaaataatatcgtatccgggggggggggggggagtccgaaatgactgaaatatccaaaatttcggtccgaaatgtcaaactctagctatcaccaccatggcataataacgacctaaccaacgggagtatttagcaacctacagctagaagaggcactgctgatgtttccttagtgatcagagcttgtggttcaattttcatattatcataatcatagcactgtcatgtaaattgggtagatggcatacatgcatcacttgctacatcaacagtgacacttgctactatatcatgacacaatttcttgtacacactacaagcaaggacattcagggataacaagttttcttgccagctatatcaatccaatccatacggtgtgggtgtcacttgggctaaaccttaataaagttcaactcacccactaattacatgctactacctggattgtttataaatatcagatatagtaacatttgactaattaatttgagccgttgtgttaattttcaaatgtcttgattttctcggctttacgaatatatcgataagcatgttgggctgattgcgttgtgtatcaaacactctgctttcttctaatataattgacgtgcaattattttgtgcgttcgaaaaaaatgaatatatcgataacatatttccatgacaggggagcatgggttttctaagtttttttttaataaaaaggagatatggacaatcagtgagatttgaaattcataattgtaatgataactagtaaattcaaatattcaatttatcatcatgaggtaattaggcctgggaaccatcaatctctattcttgagccatacttatggtggtcctggtctcctagccctgtgccccccctggacttcctggcttggctaaaccaccagaccaaccaccaacacatcacaatcattcaagacaactctatgtaacttgtccaactaaactccaaaaagaaatgataacatgagatcagttttatcttaaaagaattgtttgcac

SEQ ID NO: 66251 - DNA, 1201 bp, Oryza sativa
tgacgctggtggcgaaagtggcgtgggatggtcgggagatggagctgcacgttgtctcgtggggaggaagaggcagctcgtcgtcttgccagaagcccctcgcggattttctttttcttgtttttttggtttactaaaggatgtggaaggacctcgttgtaaaagaagctttaggaaggatctagaagatatttcgccattttgagcgatccgacggcttccatcatttgaacgaagaatcggacggctgatgttttcttaacgatgtggcgcagtcatatctaaaaaaaatctaactgtataggggtaaatatggaaaaggcagcaccggtgcccgaaataaaaatcggagaaaaactcacgcccccattccctcccctctcccctctccgccctagagctcgacggcggcggcaacaagggctgggggatgaagatatccgtgaagacactcaagggatccaccttccagatcgaggtggactccgcgcagaaggtatgctctggtctccgcgctctcgatctgtcggtcgcgagcgccgatttcgtttctttctttttctttttcttttgtggggggcgatctaggaggtggtgaccggattggggttaggtttgtttctacggctacgcaaggctatagctgtggatccaatctgattgtgtgattcgtgttactatatgtgattgatttctttgatggttggataactggattggttattataggtagtagtagtagtagtagaacagattaagttaaccagattgagtcatagttgtttcattctacgtgctatttataactgatctaatttcttaaagcaggttgctgatgtgaaaaggataatcgagactactcaaggacagcacatttacccagctgagcaacagatgctcattcatcaggggaaggtgctcaaggatgacaccacattggatgaaaacaaagttcttgaaaacagcttccttgttataatgcttagacaggtgggtacagcacctgtttgatgttatatggctattacctggcgcaaaatcatgaatatcatacttatcgtacaataatccatggaatgtcaaggtattcaactgcatgatcactatgcattttaagcatttgttcagggtatctgcagctctcagaatgtagtgagctatgttatgtattggaattgctttaaaagatgtagggcttcat

SEQ ID NO: 66252 - DNA, 12735 bp, Oryza sativa
tagcgagtaacgtggcatattcaccatagatgtcctcgacatttacttctcctttgctctatgtcacgcccggaaattcactagtaatttccgaacttatttgtgcataaaatcctcgtccaggaatcagccgaggtacacaaactgacaatttaatatacaaatccatcataataactaaaccgatatatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggattccaaaggatggcataatataggctcatttgcaaaagcagcatttagcaaagatttaagataagtaaaacagtagagtaattaatcatcaatcttaatcaacactgaacagcacacccatgctgctcaggcccaaccatcctgaacaaccattcccggctgtacagatctaactccaaaccaggagctaagcaaatcattaccagttataaccatcaataattattgtgagaggtgtgagactaatcatgaaaaacattgctcaactcgcccataaccgcgggcacggctattcgaatagattaaactctggccagaggtgtaccactgtacccacaagacacaaccccacatcatgtcaccatgtgcctcagtaccaccacggtacctcggaaaggagttgtgacaataccccttgcacaacataacccattacagcgcacctttcctggatcataatcactcccttataaaacaaggcatggactccccagcgacccccgtggacttctcgccagttctcagtctggcgcactataatgaatcacgctatacaaaagataaagccgttgcccatgctggcttgtggttggcacggtaaatgtttcacaacagtagctcgcgaaccggtccttaattgccatgagcacgaccttcaaaaccatatgctcacaacccaccattaatcatattttaattaccaattaattatcataacacgattaaccatcgtgagctaccattaaatataaccatgaataataatgtagtatatatgattcatcccattagtgagctaatgtttctaagcattgctaagcaattatatatataacatttagctgaaccaaaccaatacataaggttcaagctaatcaatttattacccaaggtatcaaggaatagggcattcaatgcaaattggccttaacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcgcgaaccttcgcaacgacggaaacaacaagctaacacgcaaaacgaagtaaaagactaataaaaaccaaataaacaatacatataaagtaaacaaacacgtagatcataattttagatgaattatgagacttgaacagcctcattctgacttcaaatgaatttattatgagttttacaagattaaatctaattaaagcccatttaaaaagaattaaataaatttaattcaatttatggacaattttaatatgtatatctttattttatacaacttttgcaacttgaaccacattaaactgagttacgatgatttagttatgattttcagaagatttaatctattaggaaaaaaaaaaagaaaggatgatgacgtcagcatgacgtcacccaaggcagccacaggtcggccgactcggacggcgacctcgccggagctagggaccttggccgggtgattggaggacacctacgcgtagaggacgacgaggcgaacccaacggtactcaccacaacgtctaccgatgaccgacgacggccggcgacgaagaggacggtggcggcggttcgggttgacggcgacggcggagctccggtggtcggcggcgaagagggacaggcggccgaggttctcctcaccacggtgcacctaacggcggcggcggcaagcggcggcgacggcgcaaacggcggcgcgacgcggctgaagacggccggcggcggcggcgggctaaaaggcggcggcgcggcggctaggaggcacgggagaccacgggagagggggcaaacgaaagagggcgacgaggtggtcctatatatagcattggattgaagagatcggactccaaacgagagaaatcgatccaagaaaatcaaaactcggttttggagataaactcgaaaacgagtttgattcggataggatactcaacggattgctccgtttcttgaggggaaagatagaggagaacgagaggatcaaaacccctcaatcaatcggacacgaggagaccggattggggtggatttggaggcggaaggcggctcggtcgggctcggcatggcagccggccggaggttgaagagaggtccgacatgtgggccccacatgtcggcggctggaggaggagagggcgggcggctcggctgggccggcttgggccgcgcgggagagagagagagttgggccgaattcggcccaacggcttaggaaggggttttttgaactttcttcaattaaaataatttgtgaaatgttgtttcatttattaaaaatacttcccttgctcaaataattcccagaaaattctagaaaatagaggaacaagcaaagtatttaataaaattttatctagctcaattttatattgagatttagcaaattaaaattagatcttctcttttaagcttttaaaattatttctaataattccttttaaacaacaatttataatttaaggattttaaacaagaaaaactcttaacaattataattagatcattattgatcaaataattactgaaatgttctttgtatcatttaggaattgagctccgaaaaatccgagaaaattccagagagtataattaatcatggagaatttaataaaaattaaatccatccatgctttaaatttaggaaattttatttcccacaattaacttcacttgcaaattattgaacatttcatataaattctattaataatttattaaataatttataaatcctaagacgaaaatcagggtgtgacactctatacgctctaaggctgcctttttggcatccggagaaaaaaatccctcgttcgccgcgcgcacgcttctcgaactgctaaacggtgtgtttttcgcaagacaattcgatacaaaagttggttaaaaaatcctactaatccatttttaaggtataaaataattaacactcaactaatcatacgctgatgactcacccttttttgcgtatattctcttttcccctcctcacaaacacaccgtaagtaacattggcgaagtttgatgcctaggaacctgaatgatatgtttatagcttcacatgctattggaactttagtgaccgttgcgtagactcgtataagaatcgctgatgaccttgtcgaatttgttgccaaagtggttcttacctttgtttttctttgacaacacccctcgacacgtcgttcatgctcattcgcgtacctattgccaaccggacaatgtgttataagccattaacatcttgcgtacatataaatttcatatcggggttgtggaagtccagatttggatcctgcaggctcagtcaggacaagagatagcatgcactgcggaccgaacacttggcacacatgcatgcaaccaatcaattttggaccatgaagctctcttggcctttggttatcatggtacatgtttccctatttaaagccccgatgatccctacaaactcacacagcaaatccgcacgctgtagcaacatcttccaacattgaaagatccctgtccagttcattagcaatggccaaagccgtcgccctactccttgcagccatcgcggcatcggccgtgttagtgcaagtggaatgcgacgcccccgtcgagaagagcttcaacaaggccctcctcgcccctgtcgataagcgcttggatgaggcagctcaggccatcaacgaggccgccgactccgttgtggctgctgccccaccagcaaaaaaggatgaagttgaagctgccacgtggaagcggagaatcttcgccataactgctctcgggatggcccaaggagatgagaagaaagttgctgcaacttcacttgcctacaagaaagcagctaaagctgtcctcgatgccgccccagctgacaagtttaagttgatggatgaatccttcaaagtggctgttatgcaggtaatcgcatcatgagccacacgccaaccatcaataaaggtctactactacatcgccgacattggtagacgaccggacacgtaccgagtatcaacggttatttatgtaataaatgtcgtgcaatcactcattccattctctccatttgtaagagcacaaggtggaaaaaaaataatccggtgccatctaacatttctagttcaaaatgtcgatccttggcacttggcggaactttttttttccatgaaatcctttgaatgattctttaaataaaagtatggagtaaaaatatcttttgtaagaaataacataaaccggaccagcttgcgtgcatcaacgcttcgatatatgcacacatataagactgttgttgggcgactgttatttgccgagattccatgtaaaataaccataggacttgtgacgagatctttcggtttgcccaaaacctccatgttaaatatcccgcttcctaggcatcttgcatttagataggttgcaaagcgccttgaatcaatagcacaactgcgctagcctccttgtttcagccgctggacctattcaaagagttagccaaaaaaatatttatgtacgtagctccctattcggcgtgcccttcagtaaaacgggcatgaatttttcatccgaattctttttaggacttacgacaacccgccatgtctttttttccgccataagtaccatatgagcggctaaaactagaacaagagcatcatacccggcgccgtccaattgcaaagcacttcctatctccaatacgactgcttcatcgtaacccttagcgagtaacgtggcatattcaccatagatgtccacgacatttacttctcgtttgctctatacgctctaaggctgcctttttggcatccggagaaaaaaatccctcgttcgctgtcacgtcctgataaattcatcccaaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttgaaaaggtttataaaaagaaaaaccctaaaagaagtcttctttcccccccttcctctcttgggccggctcggcccaactctccctccctctctctcctctcctccgcggcccatcggcctcccccgcgcgcgcgcgccgctgacaggcgggcccgcccgccactctcgctgacgggtgggacccacctgtcatcgccttcctcccgccgcgcccgccgccgcgcccgtgccctagcgccgccgccgccgcggattccgccgcatcccgccttccccgcgcgccttaatgagaggggaatcattccccgcgattccctctcccgatcccccctcttttccctctctctctccctcggattcgttcgaaatcgcgcccgcaatcgtcgccggcgtcttcaatggagccgagatccccgcggccgtttcctccctctccggccgcgttctccccctctcggtgctatataattgctccccgagctccgctcttccgtttccgccgctcgccgctcgctctcgccgtcggattcgtgctcgcgccgtgctcctctctctccttcgtcgccgccgagctccgattccgccgccgccgtcgctccgcacttcctccttactcggcgtcaccaccatcggcttcgccgcgttgtcgccgaccccgtccgccccttcgcttcgcccgccgaccgccggagcaccgtcgccctcgccgtcccgaaccgcgccgccgcgtttctccactccggccgtcgtttccgccgtcctcgttgtcccggggtgagccgtggaccgtcccttccgttccccctcctctccgctctctcgggcgctgctccgccgcgccgatggtcgccggcggtgaccatcggggcgcgggcgcgccgctcccgtcggccgtgccggcgaggccgccttcgggcgcgccctcgcggctgccaggtggggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctctcccggctgacgcaataaatgagttttttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatatggagtttattagagtgaaagccttttcttttccgttggtcgtgtagacgctgcagcttcggaagatccgctcttcgtggaagttgaagccgacgtttgggaaatcgagcaaggcaagtcacatcatctttgaacatattgaatcccagtttgtaaaattatgttgatttaaattattgcattatcgctttatttaaattcccgcgttatcactgttttatttagccatgcctatttacccttgttatgaccttattattattgttattgttattattaccttgttcaccctagaataaacaaaacctcaactagtggacactctactcatggcaccactagtttaattttaggtagatgcttcgcaatttaattaggtaacattaggtggtttttcaactttagactttgggaaatattcatatcacctggatactttggaatggtctggttattgtggaaatgggattcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggccggtgtcctgctgctgggggctcagtcctgcctgcctgtcccgggggttccggccgtaggtgggattgggtcggtactcttgtctatggctaggatggattggaaactatgtcacgtcttccgtctgtataccgtggtggtatgtggcacgtggctacacgtgaggaagatgtgtcttgtgggtaaagatgtacacctctgatcagagtataatctattcgaatagccgcgccctcggttatgggcaagccgagcaatgtacccaagttagtgttttaattctttaaacctgcttatcaactaaaatgtggaatggttggcctgggttggcttgggacgagctgggacccagggtcgggttgccagttcggtctgaatcatcataggccttgggttaaggcaggttcgtgtgggttcacggccttgattaataacattgtatagttctagaatcgtctttacaaaatagctttgagcaactaaatatctttaaatgctgtttactgcaaccctaaccctttatagtataactccttgtactcccttgcatttattctgcacttgtgggtgtgtcttgttgagtacggtggttgtactcagtcttgctcaatttttcccaaccccagaagaggagttccttgaagatgaaggcttcggtgtctagctcgtgcctgccgtcaagcgcctgtggtcgtcgccctagtcttccgctgtttctcgtttgtctctgtgtgtgctgggccttcgttgcccatgtaataagttaactatatacgcttccgcttgttaaactctgaattgtatcaacttttggtgtaccttgcctcctgggacaaggattaatgcacgcacgtcaggaacgcccgttgggttatttccggtcatgacaagttggtatcagagccacccttgaccctaggacgagccgtagatcccaagccttagctatattttcaaaaataaaaatcctttgttatttgtgaaaactgtctagtctctccctgtcttgctgcttcatttatcgccaaaatctgacctttaaaatgttgtttttctttttgtttttgtttgtagatggccggcagcgtcacccgtcgtggtttggacatgactggcttcgtcttggagctgcggggcatgtgcgtggtcttggggtatccacatggagtggactaccaggcccggccgcttccggagcaggagggtgacgatgcagagccccacgctggttgggaggtcactgcagtgatcctctctggctctcccgagcggacttcgctggcagtcaccgcgggtggagattctttccccgccgcttgccagaacgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcatacgacgcggctcgtatcgacttccatcagatggtgcgccgtgggatggtcgagaacaacttgaagatcctggagctgcgtcaggagaacctgcagctcaagaaggacctagacgcggtggaggcgcagctgcatcagctcaagatcgcccagggagaggactgccgccccaagcgtcgctgcgtctgccgcagccagaagatcaccgcccgcaagagcacctccaggcccgagcttgttcgtcagtccctggcgtggacctgcttcgtggagacccctcgtgccgagcccgcgcccgtggttccccaggagggggaagcctccggcgttggtagcacggaggatgcgctgttgctcaccttccgccctggcccgtcgcagcggtagacgagcagttagtaggcttgcgcgtgtgttctttctcgtttgtcttcttgttggagtcgtgtggggcatggttatgccggtttgtggtataactatgtcggagcctgtctttattttgtttgcctaagcaacttgaactttaatgaaccaatttaatcgcagtaataaattcaagaattatggtagtcgtgggtggttagctttaattgttagctctctctgtttgctggttctgtgtggggttttcagatggtgacgaccaggagaaatgctaataccggtgatggcaaccaacctgaaggcagcaaccacaaccaccaaggcaacccacctccacctcctcctccgcctccacctccaccaccagataccaacgccattctcacccaaatcctcgcccagcaagccaacatgatgactgctttcctccaccacctccaaaatccgccacaacataatgctcccccaccacctccccaacactctaaactcgccgagttcctccgcatccgtccacccaccttctctagctccaacaaccctgtggatgcgttggattggttgcatgccgtggggaagaagctagacacggtgcggtgcagtgatgaggagaaagtcgtcttcgccgcccaccagctgcagggacccgcatctctatggtgggaccacttccaggctacgcagcccgaggggcaaccgattacttgggcccgcttcaccgccgctttccggagaacccatgtgcccgctggagtcgtggctcttaagaaaagagaattccgagagttgaagcaaggcaaccgctccgtgatggagtatttgcacgagttcaacaacttggcccgttatgctccggaggatgtgcgggaagatgaggagaagcaagagaagttcttggcaggaatggaccccgaactgtctgttcgtctagtctctggggactatcctgatttccaacgtctggtggacaagagcatccgcttggaggccaagcacaaggagctggagtcgcacaagcgccgcttggcgaacttccgcaatcagcagggtgctaaccagagggtccgctacaccaatccctacccagggggaacctcctcgcagcagcagcagcagcagcaacctcgcccagcgccccgacctcaattcgtggtgcgcgtcccacagccgcagcagcagcagaatcagcaagggactcgtgcgccccgtcctcctacgccaactgtgcagcccgttcaaggccgcagggacgctcaaggtccgcagcggctgtgcttcaactgcttcgagcccggacactttgcggataaatgtccaaagccaaggcgtcagcaaggccaagcgcctccccgctccaacaacggcgggaaggatgtcattcggggtcgtgtgaatcacgtgacggccgaggacgtgctgacaactccagacgtcatcgttggtacgttcctcgttcattccatccccgctacaattttgttcgactctggagcttcccactcgtttatatctgtgccattcgtggggagaaatcagttgggggtagaaaggcttagaaaccctctgctcatcaccacccctggaggggttatgacagcaaagtattatagccctgccgtccctatagaaattcaggggattccttttccctcggatctgattctgctagacaccaagaacttggatgtgattcttgggatgaattggttggctcaattccaaggagtagtggattgcgcgcggcgcactgtcactctgtaccgagggccagaacaaccggttgttttctttgcacctccaacctctgtcagaagttcagaactgcatcagataggtctgtcagaaatccccatagtcagagagttcggagacgtgtttccggaagaactacccggaatgccgcccaagcgagagattgagttccggatagatcttgctccaggaaccactcctctgtacaagcgaccctaccgtatggcagcaaatgaactggccgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtatcctcttccccggatcgatgacctgttcgatcagcttaaaggtgccactgtattctccaagatcgatcttcgttccggatatcaccaattacgtattcgtgaagaagatattccgaagaccgcattcaccacgcgatacggactgtatgaattcacggtgatgtcgttcggtttaaccaatgcacctgccttcttcatgaacttaatgaacaaagtgttcatggaatacttggacaagtttgttgtggttttcattgatgacattctgatatactcacaatcagaggaagaccatcagcaccatctctgtcacatcctgatttttgtttcaggatttataaattatttaataaattaataatagaatttatattaagtgttctttaatttacaagtgaagtaaaatgtgggaaataaaatttcctaaatataaagcatggatggatttaatttttattaaattctccacgattaagtcaactctctgaaatattctcggatttttcagagctcaattcttaaatgatacaaagaacagttcagtaattatttgatcattaataatctaattatttttgttaagagcttttcttgtttaaaaatccttaaattataaattgttgtttaaaagtaattattagaaatgattttaaaagtctagaagagaagatctaattttaatttgttaaatctcaacataaaattgggctagataaaattttgttaaatactttgcttaattctataattcctagatttttctgggatttatttgagctaaggaagtatttttaataaatggaattgcatttaagaaataatttaaattgaaaaaggttttaaaagttctcttctggctttgggccgaaagtcggcccaaaacctctcttctctctcttcccggcccaagtcagcccagtccgccgcgcgcgcgcgccttcgctcgctgacaggtggggcccgtctgtcagacccgtcgtcctcctcgcgccgccgccgccgcccaaaccctagcgcaagccgccgccgtctccttccaaatccggccgcgcctttccttctccggccaaatcgattgag

SEQ ID NO: 66253 - DNA, 3865 bp, Oryza sativa
  unsure (1)..(3865): unsure at all n locations
attgtgctattggctatgagcatggctactaagttggtcaaagtgttacctttttatttcttcctcgtgagaagatcagagaaataactctaacgcctcctttggattgaaggattcatgaaaattttgaaggtttcaaatccttggaaattttttcatatgaggtcatctggaacaaaggaataggatgttaaagttcctattggccttctatgcctccagttctataggagaattattcctacgaggaagcaccaatgttgtggtggtagagttgtgggtgtatgactctatccaccagggttcacaagaaatcctagtgctcacaagaaatattacacacatgtggatgagctttcaaaaaggatttttctgagatgagagatgtgtcgctggtttttatctactaaagcatgtgttaggtttcgtagaggatttttttgagatcagagatgggtcgctggtttttatctattaaagcatgtgttaggtttcgtaggggtgtgggtgtgatattacatgtgtagtgatgtatgtatgcatctgccgtgtaattgaaaaaaacaatcctatgcctaggtttcaaagagccctaaagaggttcatcctctaattgtttgagcatatgaagtcatttctataaaagaaaaaacatttttagatttgggtacccgttctctccaaccttacaacaaacaaagatcttatcatcttaagctaaagatgatgacaatactacaagacatacctcatggttaggcaatttctcggatcgtggatctgaaagaaagccactaacgactcgttctttcaagccctaatcctgccgatggaagccagacacgtggatattctccctcaccaaatcattctgtggctcttgattgctccagcctctttcttctccgatccctacctccttttttcttccccttcgtcgccgatcgaccattctcgcagcggccagaacacgcgtgctgtcatctcatcttgcccccaaacaggagctccatgaccaattttgcaaaagccactttctgcagcgacacaacgttcgcaactgcactgatgtttgctttattgttattgtattccttttctctggattagattgcaccgaactgtttggttgcccaaacggaagaggctgtaaacagtgagccactgttgctgatcgctttgtttgcttggtcacaaaaaatggctgcacatgctaattgccaggccgttactatccaacccgttggcaagtgtacagtgttgtttctggaagagaaaagagaatcgtttgcctgcaatttttttttcgctccacacaaagaaaagggaaatgggtcatgaatgaatagtaagtaaaccagacgagcaaatcagatgtgtgctggcgccatcgctcataaataaatggccttgttggatcaaatcatgaaaccgaattgcctttaacatcgcaatcgtatctaatagtagtagtagccagtagagtaaaatacacaaatacacagagtactagtagtacgtactcactcggtactcgtaaaggaagtcatttagaacaatgtttaagtcaaaacttaagaatataaatcataaataactcttaagttattgagtttgaaaatgtaaaaattatatgaatagatttgtattgaaaaatactttcatagaagtaaacatatatcacttttcaataaatatttttatagaaataaaaagtcaaagttgtattttgtagaccgtgtcgctgtgctaaaggacttcctttacgagtatggagggagtactagcactacttttatattgccacacatgacacatctctgactatgtgtaatcattccgttacaatttatacttatcaatttagaggtttgttctaaattaaacttatcttggccattaatttttaaaaaatcgtgtagtaagaattatatgctatagaagtatttataatggtgattggtagatcttatgatgtttgttaaactgtgtgaatttttaaaaagtagtcgttaaaaatataaatatttaaattaggataaatttagaacgatagctgatttaaaatagaggaaatacttcagctttgtttgcctcgcaaatcctaggatctgactggctgaagaaatatggttttttagctcgatcacggcgacgagatctaacactcctcggcgagctcaccggtggcacgcaggttgccgcgtagttcacgcccattggccactggtatactcacaaccatgtgacagctagatccgtgtgatttaccaggtcaaaaccacttctcgaccaatcagcatccgccaggtgtccaccgttttaccggcacctgcctggagagccattgtcctagtgcggagaaggatcggcaggtggcggtaacaaatcagcgtggacacctggcgtcacgccattggctagcacccactttcccgccgctccgcgtgcttataaaagagcccggccatggctgctcttgctcatctaccatttgcctcttcagcaacagcttagaattcagctcagtaaatctgttgattgctcgtttcaaatcatcatcggtgtttcgtttcttgatttcttgatccatccaggcgacgacagtggattggtgtggccgtggcagcaatcttcctgctgcgatgtatgacatggtggtggatagcaaggagctaatgggcgcgcttgctccgtccatggtgtccttctcctacccgtgttccgagcagagcgcgagctcgcttcttgctggcgccaactacctgactcccgcgcaggtgctccatgtccaggcgcagctacagcgcctgcgccgcccgggccggcgagcggctgcctcgccgggcgccgccgctccgatgaagcggcatggcgcggtggcggtggcggcggcggcggcggcgcgggcgccggtcaagctgtaccgcggcgtcaggcagcggcattggggcaagtgggtggcggagatccgcctgccgcgcaaccgcacccgcctctggctgggcaccttcgacaccgncgaggaggccgcgctggcgtacgacagcgccgcgttccgcctccgcggcgagtccgcgaggctcaacttccccgagctccgccgcggcggcgcccacctcggcccgccgctccacgccggggtcgacgccaagctccacgccatctgccacgggatggacctgccccaaccccaaccccaaacccagagcaatgcgacgacgacgacgatgtccacgaccgcgacgaacaccccaagccccttcttctcctcggagagcccggtggtcaagagcgagcccgtctgctccgcctccgagagctcttcctcggccgacggcgacgtgtcatcgacgggctcctccgacgtcgtcccggagatgcagctgctcgacttctcggaggcgccatgggacgagtccgagagcttcctgctgcacaagtacccgtcgctggagatcgactgggacgcgatcctttcctgatgcagtggctgaatcttcttcctctccctgttcttgatccagctcttggtgtcctgaacattttcacaactcagagagtgatgctctccttgattagctacatgttaatctaggttttgggtttgatcatgccatcgattctgtagcatcaacccctggtctgcttggttttttcaatggcattgccaggaaggaggtctcagtgctttggtttctgcgagttgtgcaaccctgcatgcaaactcttcattgtatataccaaatatttgaactctacattgtagtagttcatatatccaataaagaaccattttagcacattcaaacgtctaatggatcatattctgtcatatatatgttgcagttcaaacgagagatgg

SEQ ID NO: 66254 - DNA, 5827 bp, Oryza sativa
tttcggctgcaataagctgatagtaaaggcttcatatggagagaaatttggcccaaccgtcagcggaaatgctaatgggcgatcgatctcctggagatgggggcagcgatcgatcccctccccctccctcccttcacctgttttccctttttggcaccgcattactttcctattttagtaaatttatgcacctaaaatttatacacatcaagtttacacatctaaagtttagagacccaatatctaaagtttagagacccaaagtttataagtcaaaagtttatatatccgattcaagtttgaatttgaattcaaatattttttatatatagtatttctatacacctaaagtttatagacccaaagtttataagtcaaaagtttacatagccgtttcaaatttgaatttgaattatatctaattcaaatttgaatttgaattcaaatattttctatatatagtatttttatgcatctaaagtttatacacctaaagtttatagacccaaagtttataagttaaaagtttacattcccgtttcaaatttgaatttgaattatatctgatttaaatttgaatttgaattcaaatattttccatatatagtatttatatacatctaaagtttatatatctaaagtttatagactcaaagtttataagtcaaaagtttacatacccgattcaaatttgaatttaaattcaaactttttatatatatagtatttctatacataaatttttctaacttttgttttttttaaaaaaatttttgtggtgtagtgtagtaggaaaagaagaagggggagaaaaaagggggagaagtgagaggaagtattacctatagggggagggggggccggatctaatcgcttgggtgatcgatcgcccattaggacccttcgaaccgtcagctcttcggttaggtacacgagacaacgcagcagaaagaaattaagggatggatatagaaacgtccacgtggccgcaggagattgggcgtcttatccaagctctgggctaccaggatcacacaataatacgtacatctctgagtcttctcttttttcattatacaaagtacctacaaagtatgatccgtattaatttcataccaagtaactttaatatctggcgcttctgctcccttagcttctttgtgtggatagatatatgaccgttttagcgattttaatgggattaattttgacctcgatcggcatatatacatccattcatacacgaacagttaattcagtacgaaacacatggagtagacacaagagtagaactaggatatatagcttattaattaactgttctttcaaatacatggagtacgtatttgacagtagtatatatgacacagtaatgcatgcatatatgacaccaaaatgtgatatggatatgattaagcaggtgcagcaaaacgtacattaattaaacaacaacaattaaccctcgggcacgcctgtgttttgttatctcgctcaacatatacgtacgtaatactttgcttgcatagcatagggacgacgacattatattcttaattgataaactcaagaacgcatggagatggatcgagagatttataaatatggagcttgcttgattgattagatgaggtcgtcctccttgtgggtctcgatgacgacgtcggacttggggtaggcgtggcaggtgaggacccagccggcggcaacctggtcgtcgtcgaggaagctctggtcggactggtcgatctcgccggagaccaccttgccggcgcaggaggagcaggagcccgcgcggcaggagtaaggcaggtcgatcccttcctcctccgcctggtccaggatgtacacgtcgtccggcacctgcagctccacctcgccgtccggtgtgatcagcttcacgttgtacgtcgcctgcatccgcagcctgtctcccagcttgttgctcgccggcagcaccgacacgcgcgccggcgccggcgccgtcgccacccgcagggacatcggcaaccggacctggctgctcagtgccgtcgccgccatggctgctatagctaattaagctagctagctgctgctgctaggtaaggtagacgaggaggagaggagtgagctagcaagaatgtgagcgtgaggttgaaggaggctgaggcaataagaaggaagtggaagggtgccacgtggcgagcggcgactggttggcttatctgcgggggagtggatggggcaacgaccaccacacgatgcacatcgccgatgctgtccggccgtcttgggggtggtcgccttgcttttcttttttggtttcttcttcaccccttaactttttttgagcttttttttttaaaaaaaataatttgtgagccaatcacatgtaccttcaggattcagatctggtatctctttttcccatggccgtccattgattttgtttttcacgagaaaaataattgaacaagatgtatgtgtggtcacacacattttctttaatttcttttgctatgtatatatgttgtccacacatacgttgaatcacaattgttagattgggatttgatggtcacgagtcttgcacaagatagagtgcgatgtgcagcctctaataattttgaactgctgcatgtgccttcttccttcctgttcctggctaggaactttctccaaactaacctaacctctctgtttttcttctctcttttttgagggccaggccaaaacttttgctttgtacgatcacatgcacgcttatatgatattccatgtaaatgggccggcccaatccgcatagccgtacccgattccaagatacggcccatagaacactggatgcgatgaccagcccatcttgtctcttattgggcttgtttgttgacaggaacatccatctcatctacttctaggacacgatggaacctgcagcaggcagcaggtacatacaggagtgattgagtataaaaatatgagtggatgtataacaagagagtagttcatgtgctgatcgaattcgatcgatccaactctatatgcatgcaggaatatatacgcatgatcgatgattgtacatgatattttcaactctttaagttctactctatatatatatattgctactggccggccggccacgtgttggttacgtggtccttttgatcctcacacgacactatcagtgaacaaacacgttgtacacacacatatatacgtgtatgtgtaagcggaacaataattgattgatcaattagtagatcgagataactggagtagtatcaactgctgcacatatatgcatgtcaagcatccatcacatgttcacatatatataccccgatatgaatattgatcatccgcatgcaatcgaatcgcccttcatgtggtaggactaaaagacaattttacctcattcaattttatattacattctatttaagtcaaacaacaaaccaatttaaatattttgaatcatttatactgatagtatatgtgtgtgtaactagtacattgtatcgtaacaaaagaaaaactctccacagctagctgactcacatgcatgccttggccctagcttgttgggacgtaatacatatccgtgcattattagcaaattaatagcaattgattaagaaaatgactagctacacagattccctagggaggaaaaaaacacacatatctaacaattaatagacagattgatatatggagtgagagaaaaaaaaagatttacaaccgaaaagaaagaaaacatcgggaaagcaccactggtattgacgtatagtaatgtgatgataaagtcgtggatgcatatctttagcaaatatgtccatgaatacttagcaaatatgcaagtgaagcttgtaccatgatttgagtgagatcagatcgagatgtgctattggtttctgtctttttagtacatgttaggggatgcattctcgggtgtacgagtgtggtgttgcatgtatggtggtgtatgtacgtttattgcacaattgaaaaaaaaaagaaaaatcaaacatggattatatttcattagtgaaattaaattgtagctgggtgtgtttagttcacgctaaaattataagtttaattgaaattgtaatgatgtgactgaaaagttgaaagtttatgtatgtagaaaagttttgatgtgataaaaaagttaaaattttgaagaaaaaattaggaactaaaccaggcctaggtacggtcgcgtgaagattgctcggatccgatcgacatccaaacgtaccgacacggtcaaaccagggatgcgcgaatgtttcctatctatagtttgaccagcatgcatgttctaatgttttctattcttccggtagccactactgttctattttcctatttcattaatcaatatactaataatgactaagcatatgcttcccacccggccctatccaaattccaatctcaaccaataattaagcaattaaccaatgagctatatatgagatttttttattgtactagccaaactgattaattttaattgttgcttttaatcatttcactttgcttgtaagcaattcatcgatcagttcgtgctttgcctgcggcctaccctttttgttgcccggcactactcccaggatatatacggagtatatgccaacacgtaccatgcacgtttcttcgttttgtattctctctcttcgcgtgtgtgatccagttgccttcttttatccgacaagattaatcttcatcacttttaaagaagaaaccacgtttaaaattgctgattttttttgttgaaaattctctctgtgtctctagtatttcaagtgctgatctcgtggtttttttactcccctttgtcacaaaacatgcatgtactctgaatgccgcatctatattgtttgaaaatataacattgactactactacctccgaggacaaagggagtaatttgtacctaattaaaagcaaaacattttaaaaccaacaatattataatactatcaaagtatttttcatgacatatttaccacatgcaactttctaatattggaaaaataaacatgtttagagtttttagagtttaacttgagacatcaattatgataaatttatattacacggggtatatataagactacccacctacaacatatgcgaaatatgtaacttttttttaataatggatatataaagttggtcattgtttcaactgaagctacaaccacctattacaaagttttagttcgaaggccaagcacggtacaataaaaccatgatagatgaaaagactggtacaacaacaccaaccaaagaaaataagccacttatttaaagtttaagtttattccttaatctccatttaaaggtaatgaagatatgtatgatgattgatcctaaatttcgaccgcagcaatgcgaaatagctagcttgttttgacagggatttgtatatatgctatgcatcttctggattcctagttgccatcgtttgtcatgacaatgatatattgcgctagcttgaagaaatggtagttggacaaataattatctcattttatatggtataagggtgaaactaggtattcgatcattggcatatactagctaattgctcatgtgttacaacaagatttcacaaagagtcctcatgataatttcgatcttagaccatttcctattatctatatctatatctatacctaattaaaaaatacgtaaggcttcgccctccccttcgtccatccgccccaccccttcctcccgcgccgcctcctctttccctccctcccggcgcccccatctctccccctcccctgcagcccctcttctctctagcgccccttctctcccacct

SEQ ID NO: 66255 - DNA, 605 bp, Oryza sativa
gtcagtactcgactattggtttatcagttattactttatcaaacaggcaaaacatagccataagtgataactagcaaaatatctaggatttcagcctgaacatctggctctcctaatatagctgcaaatgatgagcacttctatcaatctatagttaacacagatttgttcttagtcaactatggctgagcttgaagggtagcttttacaagttcagagctactagatttaactccatgtatctttgtcatctgttattgtcttgtagaatcattacttcctcttgagttaatctgaatgaggaagagctctatatgctgtatcattttaccaccatgtgaaatgctatccttttgttttcttgagtgtttattttatagtgtttcctcatggtatgtttctctactgagattatagatatctaaccatttattatttgccaggctccccctactcaaacagtgcctgcagctcctgcatctcaagcaccagttgcaccagcaactacgtgagttaactcagatttttatttttgcttcctttttaactctttaacatagcagatgcaattattatttgaagatgtattgctttatcaggttagt

SEQ ID NO: 66256 - DNA, 4744 bp, Oryza sativa
gcccgcccgaccgagtacgtacgtggtgggtgggttcggagcttgggatttgttcgctaaattcgttttcggcccagcccaatagaaccaagcccggcccagcaaagcttgtgggctgtaaatccagggatgagcccaactttgtgaaatctggtaaaagttggttgggctgagtctgcctgagtgcctggcctgagtcctgttatcagcatacagtggaaaaaaccggaccggaccggcggttcgaccggaaaaaatcggaaccagaggtgaccacggttcggtttcctttaaagaccgaacatgcaatcgaaccgctctgaaccagatgaaccggccggttttcggtgaaccggacactaaaccggcactggttggaccggctagccatactaatgggccacagtcggctgtttaaaggcccatttggtgcagctggtggtctttttttttttttggcaaaaatagcaagaaatggtgcgctacgtgggattcaaacctgggtccaaaggttacaagagcaaagagctagccatcaggccatccaacaacatgtgtatataagtgaatatgtaatatacatgtactttgtgaaccgcggttcgaccgcccgagtcactggttggaccggtggaccgttgaaccgagaggttggccggatcacttaccggtccggctttttttactatggttatcagggtttactccaggtatgtctcgttttagggacaaattaaacctttccaaaagttaatgtagctaaattttagtaaggattcataccatgagttttggtaaagttaagactgtaggagtcatatgtgggtatgtgtggtttgttgttgttttttttttgtgtgtgtaggtgatagatagatgttgaatcctggtaaggtattggttattcctcacgaaaattgataaattgataggttggaaatgtagtaaaccaccctagtcatatatccaaccgcgcctcctaattttccaccagtagatttagcatcacctatacgcatggtacggtccagtgaattggattgttgttccattatttttaaaagctacctgtatatataagaaaagttatatataaaaggagtactgtgtttgattgccagaaaatgaggctcttctcgcggagattttctggaccatgataatccactaattttaaggagcgctaaataatcattggataatctgtacttaggcggaaaatccttctataaaatactcagggcagggttaagaactcatgatatatgctatatgagcctttgagaggacaattcgatgtctccatactaactttagcctttgaatcataagaatggaaaaaccgagaaatagaaaaaatatatgattctaacataaatataaatataaaacagagaattgtaaaacacagaaatgacattttgattggatcacaggaaaaacatatgaatcagatgagatgatagatttaaaggaattattttaagaggattgcccatttcataggaattttgaaggatatgatataattcaatcctttgtttctaaggttttcatagggtttcttttcatatgaatgaaatcttttaaattttctatattttttctataaattaaaggtcccttaaattatttaggtccaatagaactcataatatttatattagacaatttagtatgaggcaagataccccttggtacggaagggcaagggcccacatatcgtgtgttatgcatcagcttaattacgagtggtcgtaattatcccgccaaaaactacacacatagtctttacgtgataccaaatactataatattgatatataggtaatcattgatgtatttttttttcgatgtatgataaagttttggtttataatatatttcttactatagaatttagcacaaaactcagcacgcggctattcacatactatcgccaaaagcctctccttcatgttaggcttctcatcagtaaatatatttttcaaacaaaaatcgtgaatcacgttttagatgccaagcatatgttagctgaatcttgtaaaacagtaataatcttcaggtctgatgcctcctacaaactcgaaaattccgatagaaagatctcagatattttgttctcatcacctcaaccgtatgtgtacgtgcaacgccgtataataacggattgtatcgttatacgcgtatatcggccgcggagcggaggcaaccccaggcatctcgggggggttggggggctatataaacccccccgccgctagtgcggcacggcgcatctccccttttgcatgcctcaccggcctctccacctccccctcctcctccgcctcccaatgctctagctgcttgctcccgattgatttgatttccccccttctccgagtctacgcgatctgcggattggccgtctccccactcttgattcagtccagggagttttgatctgaccggattttgcggtggggttttcttttttgggttgggttgatcttttgggtggtttgatctgtggtggcgatgatgtgtgcgaaggtggtggcggcggcggcggcggaggagagggagatggagttgctgctcagcgagatccctcaggtcaccgcgccgcatgggcagcgcggtggccgtggcggcggcggcggtggtggtggtggtgctgcccagtgctacggcttgcatggacctacgcgttaccatgcgcacgcgggggcgcccgcgcgctacggcggggatccgtgcttccccctggtcttgaaccgtcgcgacgatggtggtggccagcagggcggcgctcgcggcgccatccacgtgccgctatcggggggcttcgcgtcgtcgccggcgtcgagcacgtccgccggtagcgcgccgtcgccggggtcggaccggttcgtcggccgctcgccgtcgccgatggtgcaggcgacgaccgacgaggacacggagaggctggcgagccagctcgacggcttgcttgtcggggacgcgcccgccgcggacgcgctcgccgcagcgctcatgccgccgcagggctcgccggcgtccgccgccaagaacgtgtacctgccagatgtctccgcggtgcacggtgcgtataacaatggctacaactttggggagccgggttactcgcttcaccatgagcccggcgtattagctgatcaggccatggcgtccggttatgtcgccccatctcagtgctttccagtggacgtcggcttggatggctacggcggcttccctccaagcttgggtaccagtgttggcagcttcatgtacactaggactaggaacagctccggcattggttgggaacaagggctagtgcaccctgatcatgctcgaccggtcttgcttcctggacagtctggtgcagaacacaactgggggtacgctggtacgggtcagatttccctggactcccgtggcagaagtttgccaaaatcgccctacgaatacagtgttgcagcagcgagagacattgggtacatgaaaggtggtttcaatcaaatggagccattttgtgatgggaggaagaatgtgccttttctgaaccgtgcaaaggagaggagatttcagcagcatgtcaacaataggtcagttgagctggggagtcctggtatgctgatgtatgagaacatagttgagctggagagtcctaggatgctgaggtatgagaacatggttggagccaagggctatatctacttcatggccaaggaccagaatgggtgccggttcttgcaacaaaagtttgaggaagggaaagatcaagccgatctgatatttgaaggtatcatcgaccacattcctgaacttatggccaactcgtttgcaaattatcttgtacagaaactactagatgtgtgtgatgaggagcagaggctgagaattattgctgtactgactgaggaccctgtgaagctgctgagagtctctctaaactcgcacgggtaatgatcttttgttaaaaactgatatgtacttcaatatgatctgccattattaacttactaaaagaaagcgccgattgttgattggagaatgttgtaactttaggcaggaccaagtgtactttgatgctaacattgtaatagctactggacacaatgaatggtgatgatttcttttcatttatttcaggacaaggtcgatacagaaattgattgagactgttaaaaccaggaagcagatcatgctcattatttcggctctacaaccaggctttattcatcttgtcaatgatcctaatggtaatcatgttatacaaaaatgcctgaaaaattttgatgcagaagagaacaaggtactttggcaaatatctagtttgcaaactgatttttgttaactcttcttgactactacttgttatgccattgatttgagaattatctgttgtagttttgacagttgcacaccataagttagagcaacattctaaacacatggaatttattggctgtgtcctatcccatacaattttctcagtctgcatacaattttctcaatctggagcaaaacatttctgaaactgtagctatacctagcatcatgttctgaaacttgcatcgatactctatcagattgaagtaaagtaatttggtgttgtagatgtcactatatctttctataaacttggtcaacttaaagaagttgacttagaaaaattataggaacaaacatattcatactgtttacatagaaacttgctcatggagcaaatacaatctcttaccaattg

SEQ ID NO: 66257 - DNA, 3105 bp, Oryza sativa
tcttctctcatcttttgtttcttgtgttggctagggaagacgacgaatagtattagtcgttttttcctatgtgtttaaggaaaaaagaatcctctcgtccgggaacgtgttttgacacgcctgcatccagtcgtgttcaccactaaagctcgtcgttgtcgtttctctttctatcgggaccacatacacgtcctaccactttcctcaccatcgtttggtcactggagcactggcgcccatcttccctcctcttttatttctcgccttgagttagggaagacaatgaacaatgtctgttgggcattattccttcttagtctagcccaaccatgctactgaaccactcacataatattaagaccatatgagaatgaatagaacatgaaaaattctaatttatatcaattaaacaagcgaaaggaacaccatagaagatccaatattgaagacaatatcgatgcacgttatttgttaataaggttcagccgaagcctacatccccagagcagtggtcctccccaatcaagcatattacaacgtatccgaattacaattaatgattctcggccagacgccgccgacagccgatacctctcacctatgctaagtcatcattgtcgtcatcatgtttggatctcatatgacgtttctttcgcgtttggtttccgatgtattatcggggtcggttttataacaaaatcatttctcattatttattaaaaaacatcacacttgcatcagttatatttttcagtggttagcttgacatatatacagtccatcaatcctattgtttggggtccacgtggcagtggtagtgggtgtctggtggaaccgtgactagcagaaccaccacatcactaccatactagtgtttgggaaagagggacttcagtccctctcataaaagtacaagtccctactagtatgtatggtgttgtttgggaatgagggacaccaccaaagtaatatagatattagtgcgatttctgataaatatttcatgttttcaaatatgctagctcaacgtaaattatgacattatattacagaatatggaatcatgcatgtagctataataccaacgagcttaattatctagacaggataaggttgacgaaaaggatattgttattatttattttgttctctatatatgaactggatattaagtccagcatgtgtggttcagttaagtcatcgatcatgttaggacttaggagttaggaacaacaatacacactccgtaaagtcttgtcgattggttgcttgaaataagcgttcttcagacatacgttaattataacgattaatggatcgatggcaactacagatagaagtcttttttatctttatctttataagttggtattttgagtagttttattgttttttaattaaaccttgtttttagttcatagttgtttctatagtaccattttgtagcaaagaccgaaatattttttatcatcttaaaaagaaataatcgatgacgaataaatgctgtgcgtaggaatgagatcatctgacacgaaccatactaaagtgtgatccatatgtcacttttttttcgcgaacgcgtaaaaagattgcacgtcaatatgatccatatgtcagtgactgaactacgtgtctttacctattataaaagtttaaggtgtttttgccagaattttggtacgtcatctgtctttgaaacggttttagttttatgtttcggttttaatctatatgtctactacaataaattcttcttaaaaaaaagtaaaagaagtccgactaaaaaaaggtaaataaaggaagaaaaaaagtccgacttaacgagtgattaaaaaaaaagttccgtcgtcacttaaagagcgattaaaaaaaaagcttccgtcgtcgtcagtaaaaaaaaaaaaatctcttgtccgactatgtagaaaaaggaaaaaaatcttccagtaaaaaaaagtccgtttggttttttttggcaccgatatttttttcccttttttctttgcacgcaaaagagttttttatgcgcacacgctaaagcttttggttttttcttttttttaatccgatctattcaccgcgcacctctcgggtgcttttagttttttcgtcaatgttttttgtcacctgtttttttctcccgtatgctttttgtttttctcttccggttttataatcccatctgtttaccgcacgcctcccgaggtgaaccctagcgccgcgccgctgccataccgatttgtgtattttctcctccaatttaattgcaaaaatggattccccactcctcttatcattttctccatgattttcccttcgattcggctttaattgccagttttaatctctgttctatagttgccgatgatgacggcgatcttcctcggttatttttatcccgagttttatgctctgattttggggaaaacggaaagagtagatcgagtggattaaaaaccctcgaccaattttggtttaccaagaaagattcggccggatttgatggggagatttgctctagcaaacgtatgggcacgggattatcttcgggaggttgaagatgtagtcatattcgggaagttgaagatggtagggtcgaagagaagcagaccaaatggagggaggtagcggactagcctagggctgaaaaggaaggaaggctttcggtcaaaacccagaaaatattttcattaactttttttaattataatctatagcgattccaatattaagatttttattaactttttcaattataatgtatagtgatcccaatattttaatttattacttagctctcaatatattactgaaaaatgtttacccgttgtaacgtacggacatcttttctagtatataattaggtgagaggatctacttccgcacgcatacaacgaagggagattaatttttcatattcggcaatacgtacatgctcttttaaaattaattatgtgcttattaattaattttttttgccgcggggtttctttcatatacatgatgtgagcctatacatcatgcttattaattactaataacattgtttaagtagttaattgttctttagaagaagttgaaggtgcgtggctcgtgacataatca

SEQ ID NO: 66258 - DNA, 2614 bp, Oryza sativa
aagtatctattcctgtcttccacaaattaagctcagtcttatacagtcctttgtcttacaaatacctcactatgtcacacatgtttttctgaagctatatgtaccagtatttccatgctcttccagaaactaattgcaactctgaaagttaataccgtggtagtggctggttgcagcaaactagaaccttaacttgctttaaaagattttcttttttccttttaggagagtattggagtacttccttgtcatgatcaactgatgcaaagtatgttgttatctaacaatgtatgcactgtagtcttgtcatgctctgattgcctggaggacctcctcatatttgaatatgccattgaagtgtgcatattttccaagtttagtatgttatgccccatatttctcttttttgtcatgctgcatagatagaatatcgcacacccatcttatgtggaaataatggacttattggtggcataaacttcatttgatcaatttttcttactttatgtaattgttttcaactttagagggcgtaaggatgcgaaagggagacgacccggaaaccccaactatgatcctagaactctttccttgccttcccagttcttgaatagcttgacaggcggacaggtattagttccttgttaattatacatctcacttctactctggacttgcatctcttgctaactcttagaatggatttaatagaggcaatggtgggaatttaaatcacagcacatggataaagttctgttcttcaaggtacaactatattttgtaacagttgtggaatactaaagttaaggctaccttgtttagtaaatattctatgaatttgaaatagatgggcaaattctatgaattatttgaaatggatgcacatgttggggcaaaggagcttgatcttcagtatatgaaggtagtaaattctcttctgcttattcagtatactgctgtcactgcacaatccagcttttgttttaattcttatggcataacggttagtatttactcattttggatcatatcatgttagggtgacaagcctcactgtggattcccggagaagaattttgaattgaatttggagaaattagctaagaaggtcagatcatgtttgatatgattttattcttccatggaaaataattacatttttaataagctaacagagttggttgcatcacagggttatcgagttctggttatcgagcagactgaaacaccggagcagcttgacctccgccgtaaagaaactggtgtaaaagacaaggtttattttaagtctcatggtctcaccagtgctacctctttttgttccaatatgcaaatacattgtcattacagaactatgacatcgatttaaatctggaactttttagttatattcagtttacatatgattattcttttcgggaaacatgagtaatgttgttcttgtggttggtgtgctttactttgaaggttgtgaggcgtgaaatatgtgcaatggtcacaaaaggaacattgacagaaggggagtctctgctggcaaatccagatccatcatatctattttctgtggctgaaagttatcagtgtggttcagagaaggatcaagatggtcatacaattggtgtttgcatagttgatgtttcaacaagcaaatttattgtagtacaggttagtgactctaggagactagggttcattttcatttgcattaagtggataaatttcttgaaatcgatgctattgattgggtacccttgtgtcaatgtacacttgttgctttcagttccaagatgatgctgaacgccatgggctatgttctattttatctgagattaggcctgcagaaatcataaaaccagctaaaatgttgagtccagaaactgagaaagcactgaagagcaatacgagagaccctttaataaacaatttgcttccatccatggagttctgggatgcagagaaaactattcatgaaataaagcaatactattgctcattggacacacctggtgccggtgcacaaatcagttctgcctatctgcctgagctattgagtgagctaattgaagcgggagacaaaacatatgcactttctgctcttggtggttctttgttttatttaaggcaatcccttctggatgagaaattgcttccatgtgctgagtttgagcgccttacatgctcagggctcaccaaccctatccgcaagcatatgatacttgatgcggcagcattggaaaatctggaaattttagaaaatgcaagaaatggtggtctctcagggtatttcctgctttgctctgttagttttctctagaaactatattcttatctcattatctcaagatactcttgctttcttgcaggacattgtatgcgcagttaaatcattgtgttactggatttggaaaaaggttgcttaaaaggtggattgcaaggccattgtatgaacgccaggcaatactacagcgtcaaagtgccatcgctactttcaaggtttctgtttgtggaaagaaatttcctacaaataaaattttcttttgttatttggaaaggagtctttaaaatgccttttgcaaaattgcacaaataaatcaaaaatcagacctgtacatga

SEQ ID NO: 66259 - DNA, 9085 bp, Oryza sativa
aattcctgcagccctatttaattttgggagcagctggtacttttatgtaaacttaatgaactgctgatttaagaactaaataccgacagatactaacctcttgtcaacaaggtctgttttatttccaacaaggacgatgatcacatctccgcctcgttgtgtatttacctcttcaatccacttcgatatactcaaaaaggactgcctgtctgaaaacaaggacgatatgagaccacaaaacaaatatacagtggattatattatattttctgataaatttgtattccaagggtatcggcaattcgccaatccctgattcagtgacatgttcagaataggtgccaaccttgttagagcaaaagcactgtagtttacaagagcactggagggcaaaggatcacaaattctttctagttacaacagcagagagaaaagggtgtagatgaagttaacttgccagtcacatcgtaaacaatcactgccacagaagaatccctgatgtaacttgggatcaagctccggaacctctcctgcccagctgtatccctgcacattatcatcaccataaaactctcccggtttttactagctgaaaacctcccagttttcactagctgaattgtcttgtgcgcgtgatttcagttcaccaggaaaggataaaaaaagggcaacaattgagcattaatattgcctccatcagcaaaacgaaatcaacgtaattgagggtggaactgagactaaaaatcaagacttcgaaactagtaggcactaggattatatggtaataaagcaggttgtgcagagtaaaatcggtgatcggacaagtaacagcagctaagctgcaccaactgaattctcgtaagcaggacaagcttgataagcagagtatgatgataggggaaaaacaaagagagagagttttcagaatctcagataccaaagctgcagccgtacggttcggtcttcgaggtacatcgtcttggagaggaaatcgatcccgatcgtcgcctgcacgccgccgccgccgccgcaacaacatgaacaccgtcaaattcatcgaacaaaccttgcccaaaaaagaaaaaaaactggaactctctccagcgcgtaagatcgatcgatcggggacgcgcgcgacatcaacgaacctggtaggtggcgtcgaacttgtcgtacatgaagcgggtgatgatggccgtcttccccaccgcctggtcgccgaggaacaccagcttgtacttggccagcgccgacaccaccggcgccatcacagcacgccgacgcctagcctaccctgcgctgcgctgatcgattccgcgtgtgggaggagagaattggggcttcgaaaatttcgaaatcgagtttgagctttcttgtttcggagtttggacgaacgcgtgcagatgatggaaaagaggaaggtgtaaaggaggaggaacgaggtgggcttgctttgaacggagaaggaaagaggcgacttttgcgtttcgaagcttttgtttttgttttttttataataaaaaaaagagttggtaggtcgatgtaatagagtgagaatacgttcaaccttggggagtccgggcgttgactctatctatgaaccatacgaaacgttacatgttcatgtttgaattctcatgaatttctttcaaaaacagttggttttcagctgtaaccgccgtaagacgacagtttcttcgtttccagagatgctgcttgcgtgtactacaatcgcagcagcctactcgaccaagttgatcttttcttccgatggctgaccccagcacatatttttcagccagcaagatatatataccatgaaaaagaaaataaactcaaaaccctcgtgccaaaacggaccacaactcgtgcgggccaaacgggccagcccaaaactctaagccgggcccgtccaaacgcaccgtcctagctgggccggaaaatgagcccgtgtagaatgccagtggatgtcaaacaggccgagcgaaagtacgagacggtcagcgactcgaatttttttcatttttaaatttttatttttttaatatttacagaaatattgtaccggtgaaaatatttacagaagtagaccctgcagccctcggggagggcggcagggtgacgtgagggacgcataagatgaaaaaaaaactagaaaaatacatttttagcatagcgaaattacatttgcccccttgcaacccttgtagagggcggcaagggatctcagtgcaacatgcgcacaccttgacgccctccacttgagcggcaggggccatttctgtaaatattttggatggtacaatatttctgtaaatattaaaaagtaaaaatttaaaaatgaaaaaaattccagcgactcggcgtgtacagaacagaactaccgaggcgcgccctgcctaactcagaagtcttaactgatttggcaacttaaaagtcttaactgattgagatccactccggtgccttctacttgtagtagaaaataatctgaaccgttgatctcatttgatcatagggttcagatctatttctactaccatcacacttaatgatagtagaattgtagagggatatttttgtccataaaaaattatttgcatagggatattttcgtctttcccgggctccagctgccgccgccccgcgtgctgctcctcctgctggccatccatgtcaccaccgccacccgctcgccaccgcgacgactcgcaaggggaagcttcatgaactggatcgctggaatgggtttcacgcagaattccagcgagatggccctattcacgttacattagctcgggtaaagaggaagcaaaccacaaatttaatggaccaggctcacggaagtttagctacttcttttcatagcaaattcaggttcttgattctggtatagcaatagagcatactgtccatgtccaaattaaattcttattcagattcagaatcagattcttgattctggtgaagtcatccacgaaaattaacattaccgtgcctgctgatgctgaggctacagaaactcctactctcccgcaccagcctcctcaacagccggctccacgcacgcctgtagctgtcgtcgcagttgccgccgccgccggcggcgtcgcgcgagaggaggtagaaccatgcggggctcctctgcaccaccgcccctgtgcgcacgccggaagtcgtcagggcggcgccagaagctcctgcggcggggaagcggacgccggcagagaagggaacagaacaagagggggcgccggagagtattgccgccggcggaagggaacgtgatgcacaagcgccggcagcggaaggagtcgctctctccacctccgctcgaatgcgatggatgaggaagcggtggcagcgctgcttttcctgaaacatccgagcgatccacgacgagaaataaattaagtgccaaatttatcccaaatctatctcagaactttactaatctacccttaaaaatagacggttcagattagttctactcgtagtataatactaccagtagaaagcaccggagcattgctctaactgatttggtagggtctcaataaaaactgatttagcaggggaactgtattaagctagcgttacagctgacagatacacttgacagtaaataaactgtgcagcataaaaacggacacggacacgggtggattaattggcacgccaaagtagatgcacatatacgtctatatactttaactagctagtcgggcctgataacagtgacacaaacagtgcgttagcgtaacaacataggggcaaaacggcatctcaaccatcgatcaacagtaacagtagtactcagcagagtaactagtatagacgtagtctactagacaaatactagtactatgagcctcactccggtgctttctacttgtagtagaaaataatctgagccgttgatcgtatataatcgtcaggttgagatctagttctactaccaccacgcttagtggtagtagaaacatggaggggtatatttgttcatagataataattcacgtaagggtattattgtaaattattattcagtaactctacaccttcgcccttctcaagcgcctgaccccatccatcgtcgacttcgtcgcctgtgcatctccctctccgcctccatcatctccagcgcgatcgacatctcctccctctctagcgaccaagggtggcccttctcctcttcgccgagccgctgaaggtccttgcccacggcggacgactagtcctgccatgtagctttgaccaagacagaggagatagccgggcaattggacagcggacgacgttcgacgggttccggcgaacggctgcgaggtaggaggaatgggcaactgtgaatgaacgagtgtagtatggggatgtggtggacggctcggattgtctaagaaatgagctacggcagccggcgatgtgcggtggcggagctcgagtgaggcggtggcatttggtcgccgccggcgaccgtacgagcggctaagggacttgggaatgaggcgtttggatgctacatgaatagggactgtgcatgacttcactagctgccgcggagctaatgcaaatgcttttgcataaacacgacagtagaccagggagtttgcagcaaagagtgaatcaagatgttctaagcccccattagtagacattgtcctatgacttgaaaaaaaaattcaatctagtggcaattgagcgcttagctacccccatatgagcaaaagaaaggaatcatgtagcgatgattcagagcaccagaatatgacaaaatgcaattagatgtttcaatggtatgaaatataaaacaaatcctgaattacagctctgactgaaatgcaatttacatatgggcaaaactctgatagtgaaaaatctcatttaagcagtttatcagattttttcagtctcactttttcaggagcaaaacaacttgtttactgatccaggagcaggatggcatatttcagttcaaattgcctggactcttctcaccccatcacagttgcacacaaaaaaatgcacaacacactgacatggtcaacacattgacattactagtagtccctcactattcaccttttcttttttacttgaaccattactgaacaatgaatatattgggacagtcacaagatccaataaacaacaatatctcaaacctcgtcaattagtcaatgaagtattcgacacataacaccatacaactgaatattacaagcagaatgaactgggcaggccttcttgttgtcactgaaccactttgcagtgttgcaatcctcgtggaagtcatgcccgcaggagagcgtgcggacatcatcgccggccaccatcctgagctagcagatcgggtatgccgcatgcatcgttcagcgcccgatccagtgtcctgacgccgccgagagcacggatgtgctgaaacctctgagcattgcggtctatcaggttcgccggcgacgccttccacggcagcacgcagcgagcgacactgttgcatattctgaatctcatgccttgctcgcggtcgaggaggtgctcgccatgcaagccacaagactcgggcacgcacggaggggaaccggggagccggaatgtatcgcagttgcctcccaagtggccgcagcccacacaatcggggcaacacggaatggagatcactacccgccggcggaatggattgaatcctccaaagtgggcactgccaagaatctcaggtcttgcgcaggggctccggtggaatcggacgcgcgcggaaggccactcgcagcggacagaaggccacgacggcgaaccaggatgccggcgtggaatacaggagaggagggggaacggatagacaggtgagaggtgggaggaggggacgcctgagggtttcgccgcgccgcgccgcgccgccgcgtgctgggaggagtagtgattagcaacgtgcgtcgggcgagatgttgtgcttgcgtcggacctgacgcgatcaagccaagaccgaccgagacagagaaaattgatccggccaaaattactcctaatatatattaggagattactaatctaccctttaaaatgaacggtcgggattaattttacttgtagtataatactacaagtagaaagcaccggagcattgctcctagtactatacattatacactgtgctccacattatacgcccacgcatgttgacacgccaggatgtacaatcgatatagatataggcgagccagagagagtgggtgtgagggtgatcgatcgatgcatgcgtgtattccatgcattatccgctgctgcaactgcaagcactcgattgatcgattcacagtcactagtcgcgtccgtatcaacagtgcggcgcaggcacacattgcaggtccgtaggaggtgccggcgaagaaggagatcatctaaaatttaattacttctccttaattttgagttactgataaaatagaggatttacatgccagtgacctcgtcagaaaatcttaatatccggtgctagtcggccggctccgttcgccgacgaagttacggcgggcggcgggggtcagtgtacgcgcgccgtcgacgagcgcggccggccggtgcacgtacgcgtacggggcgccgtagttatcgcagccttaaatacggcaacccaacttaagcctctgaccggccggccacacccggtagctatagagctagcttgcgctgtacgctgtgcatgcagtgtgtgcagcaacggcgacaagtaactagccactcctccgaatttattgtctctcgagtataattgagctctcctactcctgcactgcacacaccagtcgtcgttcgtacagtactatcatcaagttattagcagcagcagtagtaattgatcgcgagtaaatagtattgtacgtacgtggggaattattgtatttggagaggaactgatcggagtgtacgtcggtatcatgtctcctgtttgtgcgatacatattcagagattcagtcgtcgatcgtgttcgatttcatggcatctacttactcatctgcatgcgtcggcaggtcattggcagtccaaacctaattaattaatggactgttaagttcggcaggttcatgctcgatcgcgtacatgcatgcatatatccctagatgcagtagaaatgctggctagatcgacttgctaacagaacatcattggcgtgtgcatatgcatgcatgcattccagcgtacacagtggctagctaatagcaaagctatcattgatagagagtactagcgcgcatgagtagtacttgcgtttgcgacatatttccgtacgcagaaatttcctatggattgatttctactgtgtgcatataaaaaaaacagggcttaattagtttttgtcgctaggtcgtgcagcagttaatatgaatgtttcagatcaacgtcggtacctacacaagcgccggtcatccaaaaactacgtacagtaaaagcatagtactacctctattctaaaatataagtataattaaaaatgtttacattttaagacgaagttagtggtatctataacctcgaaggctcgcgatcgaaccctccatcgtaatggcattgagagtagtattatattgcaacaatggatgagtggaagaaaatatgtaattttttattatccatcacaagaacaggaaactgagagtgcaatcaacgccatcatctactccagttcgacacatgcgtgaacaggagtcatcaggagagagatcgatcagatcagatcagatcatcagagcagcagctagcaaatctagctagcgcacgtgcgatcgtggcacggacatgcatgggcgcgctccacgacgatgatctattgatctgagacggccgcgacgcatcggacggtcaggattatattacgtggtttctgcctctctctggttagcgagatcaacgtcgtcgatcgtctcgtcgccatgccatgttgcgttgcgtgctggcaggttgaatggggcgccgacgttgcgtgcgcggacgcgcattgaagcgagaattgaaggggaagttaatgggagccggtggactcggagcagcagcatgacgccatgacctatatacttccagcatttaaatgttgcgcgagagaggggggtcgagttcttaatttcccccctcttgacgggccgagtttagatcgaaactttttctttaaacttctaacttttccatcacattaaaactttcctacacacacaaactttcaatttttccatcacatcgttccaatttcaaccaaattctaattttaacgtgaactaaacacttttgttttctcgtaaggatgcaaggttcaaaaatatccccacttgtacccaaatctaggctgttctcatatgcatatatatggtcccggtatacctgatcacctctcctcctatcttcttcctcatcgatgaatttcatgccaacttcctacacatggcattttcggtcgattttgctatgctatattattattagcatgttttagatatatagttcacggctacgaatttttttccccgtctataacaattctaatattttcctttttccaaattttatactactataaaggaaattaactattaatcatgactttttattccatagtataactgtctatttgtatccctattcactaccgtgcttatggacttatccctaaggcttgctatcgccctaccttattgcactaggagggatcacatctcttcctatattaagtttttttttatggagagagtaggctttaagcctttaaagattgtttcttcctcccatccccacctactctaatcccttgtaaggttgtcaaaaatcttgattactttacgacttctattacgatcttaattaaggtggctgattttaagattttatatttgtcatctatacgatttcacaatttttgatatacaattatatgattacaatcataactaaaaatttcatttctaattaatttaggatagtaattttaacaaccttgctcctttttaagtatatcgagttgcagtcatacagatatatagttacagagagtacaacttttatggtctagaattttttaaaaacaaatatttgagaaat

SEQ ID NO: 66260 - DNA, 1514 bp, Oryza sativa
caacactggtactataaatgatgacgacgacgatgaattcgtatcggagagagaagaagattgcaggagtaattaatttgttgatcaggtctgtatgtgttgtcaaaaataaaagcaggtctgtatgtactgtcaacttaaatgtgagacataaacagtgcaaaattgcacctattttaggattgagggagtactaacacaaaatagaaatagtaatagacctcctcgtgtcgtgggacttggaattggactccctcttcttctttctttcctcttctacttttcttcttttacataatagtattagtattacaatataggagtaatactaatactctttgttccttttgttggcattgcatgtttgtattggtaaggttgttcaaatcaatcaagtctagtgtagtagctaattaagccgccgccgcgagtcgacctcgcaaccatccatggccccgcgcctcctcctcgccctcgccctcgtcctgctcgcctccggcgcaagcgcggcgagcgtgggggacacgtgctcgtcggagggagactgcggcgcggggctgcactgcagcgactgcggcggcggcggcggcggcgacaagacgtgcacgcgcgccaagcccatcgacccgctcacgcacgtacgtcttcttcttcttcttcttcttgttgctcctggacctggatggattcatggatctgatgatggatagtggttgaacggagcagggcacggatctccccttcaacaactactcatggctgacgacgcacaactcgtacgccctcgccggctcctcctccgccaccggctccgccctcatcacccaaaccaaccaggaggacaccatcaccgcccagctcaaggtatcgccgccgcatttcttctccgcttccggcgcccgcggcggttggtgaccgtcacatggctgtggcccacctgtccgccacttccttttcctgccgtgtgggccccaccgctcgcttctttctctcttcttcatgagatgtgctagtaataaaaattggtactattagtattagtattgcagtccgactaggtaaacacgattttccttcctttccctccgtaaaacatgaagaatcgtaattttcctttggctgtgtgccatatgccatacagttttagccaacaatattaacacttgacgataatcgctatgctattgagttactcaacaatattaagtttctacgcaaagataactttttttttcactgtaatccaagttttactttaccaaagcctgaccctttcaatctccacaatagagatttcgatcacatcctccccttttaccaccaataataataataataatggacaacgcacctccatctttctttgcattattgctctacctgcttccttatccatctaacaaattattctgatggttgttgagtaggtctcgccatcttcgatctaaaaccaaaggtcatgcttacacacacagggtttcaccaccctacctgcccactccttttgtctttct

SEQ ID NO: 66261 - DNA, 8783 bp, Oryza sativa
ctaaaaccaaaggtcatgcttacacacacagggtttcaccaccctacctgcccactccttttgtctttcttaggaatatattaactccatacccacaaagcaagtctgcacgcaccatttctccattaccttatacacaaaaaaagactgtccttttgcaattaacacatgttcatgttatatcgccatgcttttcttccaactctggtgcctgcagacaaaatcaaactggctcctttttcaactcttctttttttcccttttagatatctggatcccttttcacttcatgttagatgtcttccctttgcctccgggcttgtgctaccaaatcacaccttattggatattaaggtcaatatccaagacaaacacacaatacagattttaaatttaaagtttacatgtatggagcttcttgcaatgacattttccatacaaagactatgaataattcgaggttaattaaagaagggagtaaacaaagaagaattaacaactagctacagcttatgcatccattttctgtgtcttagttgcctgtggttggcccatttaccagctttggcacaattctggctttcaataaatactgctgaaagatacaacagattaatggttgtttgacttaaattttcctcacatgctgcaacttatgacacggttttctattttttctttgttttctttttttgcggtgttcaccatgggaatgacttgatgcaacttaagcatgttttcacattcttatattgtttattgcctcttcaaaataactaaatcttcaaaccgtggtgatgctcaatgtgtttaaaagcgaaagagattcttgaaggtagcgattgacaagtagactttgttgtaatcatatctggttctggtactaagctgtgaagatatcgattgctttggtcttaagaaaacaaaggggccatactcactcagtttatcataccatatcatcttacttttttctttttaattggcgttctaaagtaggaagttcttataccaaagtttataaatacagttgttgtatttaaaagtgtaaacttgatgcagctcctttttctcatcacacttcagaattaagccactcctcaacagtgacggctgaggattttctactcgtatgtctttgagggtggaaaatccacaaacatgttccagactctgtgtgcactcttatggtttctttaaaaaagctggtcgcaagccttttctcaaaaaaaaaaaaaaatccaccaaacccacctaaaaatactgtggcctattttgcagctactgaataaattcatttttttaccacaaagatacaaacctgtatcttgtggttgtccattcacactctgaattttgacttgttatttgttattaaaaaaatttaaccattggaaacttacttgataacatgcagaatggtgttaggggcttgatgcttgacacttacgacttcaataatgatgtctggctgtgccactcatttcaagggaaatgctttaacttcacagcctttgtaagatgatcaactgggcatttctctctttctcctatctctcctctctctcacaccgagagtatgttgatcttgtaactctaacattgagttggttttgtggtcagcaacctgccatcaatgtgttgaaagaaatccggacgttccttgacggtaacccttcagaagtaatcacaattttcttggaagattatactgcttctgggtctctgccaaaagtattcaatgcttctggactcatgaagtattggttcccagtggctaaaatgcccaagagcggtggcgactggcctctactcaaggacatgatcagccagaacgagcgcctgctagtcttcacatcaaagaaatcaaaagaagcaagcgaggggatcgcttacgagtggagttacgtcgtggaaaaccaatgtaggatttcaaaacaaaattggtgatgtcagaacgtgaaacatttatgttcttatttgacctgttatcttttgtctgtgcagatggaaatgaagggatggtagagggtaaatgcccgaatcgtgcagagtctccagccatggattccaaaagccagtctcttgtcctgatgaacttcttcacaacagacccaagtcaaacaggggtttgcgcaaacaactcagcgccacttgttagcatgctgaaaacctgccatgatctctcgggcaatcggtggcccaattacatcgctgttgatttctacatggtacatcaacttgggaattgtttcactctttaatccatatgaaatatgtttggacatcttttgttattataaatctccactctgaatcatgcagaggagcgatggtggaggagctcccttagctactgacatcgcaaatggtcatctagtatgtgggtgtgacaacatcgcatactgcaaggtaaggacatacaacatttctcttggccacaagttctacttgtaaaaaacaacatgttacattttgataaaaataaatgttgcataccatggaaagctgaatcagaataatggtgtagctatttattctacatatttatgtgatattttgcaatggaaaaggcaagttaggttgcatctcatcagcaagtggatattgtgtcaagtctactcttagatgttaggcagaacaataggtgatgggattatgaatgatatgtcttaatgatgaaaacggggccatctatctagtagttaatgttgcaaccacacctggctgtttacttggatcagaacttccattgcatttcttgtattgtatctgcatgatgatgatgttgttgtgacctctgagctggaggcgaatttgacattcggaacatgtgtgatacctccactttcaccgccgccgtcgcctcggaaggcacccagcggcggcaagggcacaagtgcaggcggcagctccagttccagcggcgcaatggctcgggttgtactaccaaagctgaccttcttcttcggagtggcacttctgatcctggtcatactctcttattaagagcagacccattcacttgagcttgtgctgtctttgtgctctgctggtacaagcacatactgtactgccattctgaggcaaaattttctgctctttttttagccacctgttccattggtttgtaacttctttttcttttttgttaatgagagctgtagatgccagattagctggagaaattgttcatgtgccgagctgtagatcattccttttatttgaggcaatatttttctgcatatcaagtgatcttattgctcataaaataactgcaatcgcattgtaaaaaaatgttgtggtaagaccttttacaggtgcaaaatatgcctattatgcatagacagcaaatggaacagattctgcatatgtcatcaggattattcttgatcttatgcactttatgttccaagaaattccaggttgtgctactagctggatgcctgattttttcaacttagtcggtggataacagcatcaaactaagcatatattcccaccaagattgttctttacacgttctctaatcagataacaatctgtttgaacaactttgtcggcatggtgtatgtgtgtaacccaagtagtaactagaaaaatgtcgttgatcctttccagggataaggaataactggttagtcagttagctaaagcataatctttgtacacggacacacgacaattgtctaaatgcatatgggaactactgactaatctttggacaaatatggtccaatgggggtgttttaataaattcattcatctgccttgaacatgtgagtgacaattaagggagacattgatctcttataatcaagggatctgatgctttgctatgccagattccactgcaacagtgatggtccattgtctttcctgtacaacatgtcaccagcataaatggtccctggttacctgtactcccacaatttatgaacatgcaacttttttttatagtagtatcacaacgcaatcaattgtcccttatttccagtgacattccttaaaaagaataacatgtgaaattattacatttcctaaataaccttcacatgaaaaatccgatgggctcatggtatgtaatataattagaagatacactcatatgtgtgtgtacacgtatttatatcccgtgtgatcgaacaaaaaacaaatttgcacgatcactcaagtaatactttatcatatattatattagagagtgccattaattttatttggacagtttgtgattaatttttatttgtattgaatatcacaactggatgatcaactgcagacattaagaccccacattaatgataataccatcatcaattgatagttcttgtttctctagtagtaaggagtatataggggataaataaaaagaaagaaaaaagaaagaaagagtagaggatgagaggagagagatgctttggtagtccggggcgggctaacaagaaggtaggattggatggatataggagcctgccttgccttcctcataggtttcgtttagctccccctacacccagatcacacacacagacgcagacgcaggagggagaagaagacgacccaagtgatgctgatggcatctcgtctcctgtcctgaacccttttccttctccctttcaagaggaaatcaaatcataaaggattctacaacaaggaagagtggccaaagtgttgtggagtggctttctcctcttcttcttcttccttcgtgcggcctgcggccatggccatggccaagcagcagcgggtttaccaagtctggaaaggcaacaacgtgagtgagattggattactcctcctcctcctccacgatccctctcttctttctttcttgcgcccccgtcccccttcttgtccccataatccgcgcttttcttgggttcggatcgactgttgattttgcccgcttccatttctgtctgtcccgttggcgcctaacatttcgcgatgtgatttgttctaacctgctctgacgaatacttttggggattagataaaggaaactgcttccggcccatatctttgtgtgtggttagctaggctagtttattagttaattggtttgtgcgcctggtttgtactatattttactacactgttgatgagttagatgaataaactatcgttaatcagtttggagctttggggccattctggatgataaccctcttttgtttccaataacataatccaattgggacaggagtcccaaggtcctgtctttctgcagctaattcaacctggcttcaggctgcataaaaaataatgtgctacacttgcaaacattacgttgcttaaatcttctttttactcttctctttagaattattgctttcagcaacttgtcttattcagagttcaggctagtgtaaaaacaatggccttgataggagttctgatggagttggacaactgcagattttacacaatatcatatcaaaccttttaggatttcggaattttcacctttgcttgcagtttataccaccagttaatataaacatttttaatgtgtcatcaacgtgtttctctttgttcagataatcttgtgcggtggaaggtttatctttggaccagatgccaaggccactctgctatctttctctctaattgcaatcccggttgccgtcttctgctactttgtggcgaggcatctcatacacatgtttcctgcatataatgcagggtatgcaattcttgctgttaccatagtcctctcaatttatgtaagtaggctttctgtgcctttgtacttcagaattatgctaaggttcctgtgtaggatttgtcctgtcaccaacaatcatgagaaagcaactttattttagacccttcaacagaaaacctgatgtgattgaaatgaaagatctgttgaaagctgctaactatccatatggaacaaataatataatcatgaatccagcagtattttggaaatttaatattttaacaaattgttgcatcttatctggtaatcagaaatgcagaggtcaatatgttagtaaagctgtagtccttttcatgaggtgaattggtaattcactggggttcgtcatcttcattgccttaaaatgttgtgttgttaatacagttgacaaaagcgctacgagcatagtttcactaatggaaagggatcttataggttccttttagtttatcaagtgatggatcatccgagttgtgattataatgacataccctgtttcaaccttcgatatatctcattaattgatgaaccaaactttttttgtgtgtttaccgagttatcatcttcgatgccctttttagaagatgttcactggattgattgatactttggtcttcatttttctcagtgcaattggtcctcttttcctcttacatatactcagttgtatatattatcatgatcatttatcttactggtctccaaaatttataaaaaatattctatctctagagtgtgtagattgttttatcgtattttatttcacagtactttttacagacaccgccaaaatcataggatccttctctgcaaaacctgattgttaggtactgttactgctcttcttgacctcatctcaagatccaggtattgtaccacggaactcacatccacctgtggaagagttttctcatgatgcttcagctccacacactcttcagtttccacgggtcaaggagattttggtcaatggtgtacccgtgaaagtaaaatactgtgacacttgcatgatatatcgacctccgcgctgctctcactgttccaaatgtgataactgtgtcgagcgctttgatcaccactgtccttgggttgggcagtgcattggacaggtctgttatgtttaatttcttttcaaaataaaataatccagctatgggtggctttagtttctacaccctgacagctgttcatatgaaaccatctcagttaatatgcttttatttcccctttgcagcgcaattatcgctacttcttctgttttgtatcttcagcagccatcctgtgcatctacatattttcaatgtgcgctttgcacatcaagcttctcatgaatagggatcatcattcagtgataaaggcaattaaagaatctccagcatcagtggcaattatggcatattgtttcatctgtttctggttcgttggtggtctcacagggttccattcttacctcattgcaacaaataaggttagtactccaattatacagagtgaatggtaaagtataaaatgtgtagcctttctgctgacaaaggtatataggtcacctttaaatatcatgcagaaggtttgtatgtagttatgtacataaccacaggtccgaaatgcctacctgctattttgaatttagtgcactagtgatcaagtcaaatctcactggatgaatttttattgagaatagaaatggaattaagtattgcaatgatgcatcatgtacactaattctttcttgcatttatgaaaaattgaaaactatgatctgaattgaatttccacttccttttttgaagacaacatatgagaacctcaagtacaaatacaacaaccaacccaacgtgtttgaccgtggttgcatgaacaactgttctgaattcttctgcaccaaaagagcgccttcaaggatcaacctgagagcaattgttcaagaggaccatggggtagcaccaccacgaatcagccgttccaatgtagcagaagaggagacaccccaccgtccacgagccaaagtcgaggatgatcttgagatgggcctcgacatccttaagacctcacaacgtcggtcagatgaactgggtgacgaagagttgggagttgaaagcaatggcgtgaaatatcgcagagctgactgctcacctggtttagacaatgagatcccaattacaagaactaagattgagagttctagtgaggttagagatctggagatcttgccaactggcaatgctgcactcccttcatctcctgagaagaaacaacatcctgatgtactttgttgacaaatacatgaatgtggctgtgaaaagtgaagttgttttcatggattgctgacaaccaacaacttgttattcatcaggtgtacaaatggaatccggatgtcatttgacgtatgttgagtgttgccatctcttcctgggattttgagtgggctgttgattagtcagtcatatcatagggttcttcctgtaacgatctcccgttaagcagtttatgaaggtttcttttttttttcatctaggatttgtttccaagattgcaggaatggtgcttcattactgttaagtgttaattgtacataatctgcatgcctatgaatcgatcaactgatattgcctcctttccaagtggctccttcaagcacatatgcaggctgtagcagtgtagcttctctcatatagcagctatgatcctaaaggataccaagatatatagaccgagtagataaatcacattcgcaagtaagatgcataccctctcgagaaactagaggagcctggggttgttccacttccaacctccaaatacttacatgatataaatgtagtagcagcaaacaactgcacttgagatgtgttgccattctttgttcacatctgccacacaagaagaacagacaactaaatcaacagcaacaacaaactgcacctgcatctgcacacaacgagactgactgatgtttatactatccacacacactgacacgctatacaaacacacttatagtactgatgtatgttattcacaaaccagcttggtgtccaaactgggccaacagatggcgaaagccttgaatgct

SEQ ID NO: 66262 - DNA, 24547 bp, Oryza sativa
gaactgcatatcaagatcttggagtgttgaatatgcatttagaaatctctcaagtggtcttggtccaataacaagtaagggcttgtgaggtaccccttttaacaatttagacctcaaagcaagaactctagctacacctgtgtggtgatcagcatgaatatgggaaatccaaatacacttcaaacttttcacagcatcatcagcaccacttacaccaaacctataaagagaaagtgtcatgacgacaaatatgaaataacatgcatttctcaattacctaaagaagtatgtaagaactaaccttcttttcaattgccctaaggttccttcaccgcaatcaagaagtatacctccttgtgtaaacaggttaatatatatggaacttacgttccgatattttgaaggttgggatgaacccgtacccaaaaaggtaatttccatatcttctcttgttgcattctccacacagcaagggatatcaggagtgtcctttgggtgctttctccagccacttgctctcaatggagtgccatcttgtaacttacctgaattactattttcgtctacaaaattacaaacagaggaattctcagtaatccatggctcttcaaccatgagcatatgcttgccaactgaattactttgccagaacttgctaatctgttcaggaacttctttaatctctgggatctccgacaagagctcatctacaatatctccataagtagtaaggcttggtatagacgatctgtccagccccagttgagcatatggacgcagatgaaactgaaaaggagaacccactaatgtaataaacggcattgcactgaactaaagaaagtttaaccagcaactggtcacatagatgatgcaaaattcttatgatttatttatctctccttcctcctgtcagcttcatttttatgtagtatctttcatgagaagaatttctccttctcagcttctagattgtaattgtgtgccatagcatggcgtggaaaataattgcaaggtgcatatattcaagcccatgctcagagaatataagcaagaccagaactaacgtagggcaaaaagtaactgtctgtgcaaagatcatcaataaataatgaccaagacattcgtcacagcaggttattttacaattgcattgcatagaagggaaaatcctagtcatgctgctttaaaaagattggtatagtgtggtaggttgacacgttaagtttcgagacataaactattagttgaattttcacatccatatttgaaaccattttcatcacaaagtccagacatacaaataccagatagattaacagaaacgctcgtgtgataagtgctaacagggaaatacagtatggttatagagttagccatacctttagaagattagccgctgacacactttcacaggcttgcaatgaagaaacctaaaagtggtaagaaaatttcatgtatataagcagaatgcatttttatattatctggtattatgtatcttactggaagctaccttattcttctctgaatcaacatcatttataggttccacaggccaaaatccagaggatgggaagagatgagggcatacaaaatgaagacgtgatgatatccttgcactacccttcaggataggaatttccatgtttttactgcacataggaggaaaaagtcccatcacatgaccaaatattagaactggatcattacaaacaagatggcagtatttgtagtggtttctgccgcgcagatcctactatatgcagatgcaccacacttgtgttcactcatccatgtgtcagcaatccatgtgcccagttggtagcaacaactgtacatgagaacgctaaaacagcataaaagtgagcacacgtggcaaaaacaccacaaatatcatcacatggattggatttaagccagatttaaaaagttagacaatgttaagtgaatgatttaagcatttaggttgaaaaattaacctatggtgataactgagggttccaaaatcctaaaacagatattatacaataataaaattaataaaatggtgttttaccgaggtggaatattatcaagaagtaccttacaagttacaatgttccgtagcaaaatcaagcaaaacttcactaattatcaattaggaactgacgaagataatacagtgacaaagtaaaacttcacaatatgcaatcacgacgtataaattcattcctggaagttacagataaattccaccaagttaaacatttctacaatatggaacttctcacttcttttgtaaaaaaaagctaacttcagatttactaacaacaatagttttaacctaagttcaaactagaaaagccaataattggggctgcatgaaaagcatacataaaacagtgaacagaactgaatcttacatttcatgccctgccatgatatgctgtgtggcaccaaattttctcatccagttctgataatcgagagcttcagtcacagaagatgggcccaagtggattacacaatttactttcttgggactccctgcttgctcagaagaatcttcataaaagcgtataagagattgcagggaaaatagttcgtgcatatgatattttgtagggcaatccaccaaaagtacagtaggtccaggaatcgacgggccaagaacatcacttggatgaacctagaaattggcaaactaaatgagctgtacacaagaaattttcatccagttatcttgtgcgtgcaatttatatctgaagtaatatcaaaagcttaaattacagaaaaaaaaattaaattatgttatcaaggaaaggacagaagatagtcaagcggcactgcttaatttagtatttaacaactttaaagactaataaaatttaatttagtatttaacatctttaaagactaataaaatattacatcagcaatctattcatgaaaatatatagtgccaccccatccacagatgaatcactgaacagcggactcaacagcctccaaaagaaaaagttaggttcccaacgggcagcactgatctacctggtggcataggctcaagcttgaatcaatgaaaaaaaacattgtaaacaaatacatgaaagaatattatttataatcctacaaatagattacagtttaaatatctcagtattcagtactaaccattttatcgaatgcatcagactgcacagagttcccgagctgaagttcacgatattttggtccaggcttgagaccaagggcagcagccttagcagggtcaaactttcctttaagttctggcagttcacatgcataaatgatagcagtattgccaggcttcaagttggagtcattcaagcaactggcttctttattgtatcttggtttgacaaacattgcggatattcgaactacttcgtcatcaacaatgacagtagcatctttagattgggaagaagatacattttgttccacaccaaagctatgtgtgtgaagcattgctctatttgggataaaggatctcattgcactagctaaaaaatctaggtcagaagggccccatatattcacctatgttgcagataaaagggaacaatacaatcagtatgcagaaaaggtataacaggatgagttggcaattaggtactgaaaagaagggaatgatgaaatcatgtgatctcaccgacatgccctcttctcctatgcctgccagagtcagaaccagtcctgcaaaaatgaaaagaaggaacagaaacaattatgtcatagatataatcacagttcagcaaataatgacagtagttcagtacatagagtgatcaaatttacctggaaggccccctgcagtttctgagcatacacgagtcaaaaatatgtggtcaatctgggaggtggagaatcaacatttaagcaagttgctggtttacaaacacaatcaaacaaggataaaagaaatatgatcaatgcattggcgagaaggacctcatacctttgataactttatcttgtgttcagtacagaaacgttgaagaccctatcagacagcaaggttgttatttagcacattaagttcaccaaaataagacatgacaaactggttaaggatgataaaattagataaataaaatacagagcaatacacacaaaaaagcaggacaaacggaactcaatagacctgagctacaaatttgcccctaaggcaactagagtttaggaacaacttgtgcacttaagaagcacattaattaaaaacataagtatgttttagagagagagagagtgatcaaataaatacaagtgctgcagatacctcgccagcattaaatataaacctctgtttgtcaaagaagagtaaaatggaaggtgaagtatcttgtgtgtccattcctgtaccaagtatctgcacagcaagaagccaagaacgaaggggtaagatcactggcaaaggcatttgtccctgttcccatgagttgatctaagtgagggggttgattaactgaacaactatctctgaggggggtgacacaaaaagtcaaaaacagctggaatgattgcattctaggcctctaggggtgcttatacctagttttctcactcttactaaactagctcgatttgatcgcttgctttgccagccagcaactgcagcatccacaagaccctgacaacatagtatttttggtcttcaacaggtaaaggaaacccagaatatacaccctacaagtgattatcaacatcgttatcatcagagcattgatgttctgaatcatttctaccaatttggtagcgggtggcattaatatgtatatcctccgatgaactttggcatcgtgacaaaatttattattttataattttcttagcacgcaggtaataagcgaacgatggtttaaagtttggttcagatgctataccccctttaaacctaagtaagacatctatcgcaatcaatttgggataacattttagcctatgcccacagttaggtcagcagaaaggcgacacatgcacattcttacaaagcaaagaaaattataaccggcatgctgaaacccaaggcaaaagatatcgcgccatactccaatggggcatgttttgtatcccaagtaagcccaggaattaaatgtgcttgctaagtcatgaagtaaaccaacatgcacaatcgccatcaaaggattgtagcaggtactaaccttgtgctaaaaggcatatatatataatcatattatcattttgttgctcgacatcgttcgcgtcttaggaaacaaaatgtatgtagcataaaaaaagcaggcaatccccgctttaatcgagctgaactgaaagctaggcgcaaagcagagcggcttaataacgagaccatcgggaatgtggcgtggtgtggggggagaaatcggcaaaatccctcacctgtacgtagcagatggtgttgatggggttgagcttgcggctcttgagctccatgctcctgcccttcctcccgtccttcccctccgcgcgcgtcttgttgaacgccacctccgcctcccctccccctccccctccccctcctccgccgcccatcttctccttgctcctcttcccgagcgtgctgttcccgcgtcggaggaggttgttgtggtggccgcggcgacctcctcctcctgcctggccgccgcggtaggcgagggcgcggaggcacccggcgcgagggaaggggaagggggagggggagaaggaggagaagaaaagccggggggaaaggtgaaggagcggggccggggtggcggcggctagggtttggaagagcggaagaagccggcgaagaggggagggcagttgcggcatggcttcctcctcctctcttctcaggggtttaagggcggaggcctcatgccgaagcgagggacggagctcccggatggattacgggggggagcagcagggcaacgggggtgaggggcattttcgtcatttgctccagatctaactcatctccatgtacatgtaggcccggtttggcacggctatgccgctacagattctcccagaatcagaagttccctaaacaaatttagtttttgtccagattctttgaagatgtagttatagaatccagaaaatgaactagaagccagaagctgagaaacccagttttactagattcttagaagtttattatctactagctgcttttcagaattttaagcttcttaaacaggccataaatatcatatccattcataatcgatttgaaatttatatgttaaattataatggttcaaaattttaagttttatccaaaatgagaacaaaatgatatattcaaaatctatcaacgtaattatggatataaatccgtggatttgtggagttaggaatattttagctcaaaaaaatcttgaatccggaactatgcctaatcatccttctggttgcccttgcaaattttccataagtatttttttcatagtaacaagttacaaaaatgcaggcgctcacaacacacacgtatatcatactcttataggcacattcgaaaagctgaaccggcatatcatgatattgatgaaattaccatgggcgccttgctgttgacggatacttcgcctatcactaaaagactaattaggtgtaaatacgaacactcgtgtcaagtttttttttcttaattacacataagacgcacgtaaactctattatataagtatttttacatttatctattataattatgttcatgtttagagagcttctagcaactccactttctcctaaatctctaggtcctccaaacaatttaaaattgtatctagattctaaccgtaagttgctaccgaatttaaaaaatagacttcaagtcaacagctaggaaatttatgtttgtcatattcttgtaggttgtttcttaaaatctcgagctatcataaacagggcctatattaccatctctttggcagccaatgagtcataacaaaataatttgatcaatctacgggaactatttcttcgatgtcttttttcacgataataaagtaaatttcagatattcacacaggtcattccacattactagctttttctttatgttacttcatccttcacaccgtcgttttgttatttttaaatctttgaaatctagattggaacatttgaggttagattatttgaaccttttggttggttagtagggtcttgggcctaacgggcctgttagtgggcttactatgcagtaatatctatgctttgttgctagtgctgcattgctggcctctgctgccgatctatccatgcatgttctgcaataattgatggaaatcggaaattagccctgacaagtgtaacgatagataacgtacgagtatttgagaattttatggttatcccttattgtttgtttaccagtgagtttaggcatgtgcttaaaattattgacaatgtatccctaatgatcgatcgcgggcatatttggttagaaaatgcttgtggatgggcgttcaaaacgagcccagatattggacgccttctactcctttgtctcctccctccttcatgttcccatctctttctctctcacactctcaccgtgcccgcccacagacctaccattacaccggctttcatcctgacatggcccaaccaagagaagttgggctgcccatgctgtcacagtcgcccagtggtgtatctagaattttagaatttttatgtggctagtccaacctatatatttttctaaagtaccctaaatataacaaagtttggagtatataataaattgattagatgtgcattataatatattaacaaggaagtttttttacttttccaaaaaaaatcatatatgtatatatatacattgggttagagcaaaaaaaattttcccaaaagttatattttttactttttttccctagatctgcctgtgttgtcgccaccatatcaaacatatcttcctccgcgcatgccggccctatccacaaggcccttaaggagaagagcaaagccaacatcgatgcatgcagaaccgtcaccgagaagaacaatcccaagtacaagctcaaacaggtgtggcgacgcgtagcaggtcggcgacggcgtcgtagaactagacgtctaagatccacgctcaaggaggttgtagagaaataaggtggatctggtcacattggagtagagaaaaaagtcactataggctcttgttagagtttaacgatttattgcatttttctcataagtattaatttgagtggtgttctctgttccgctatatgtatactagcagatgatgcgcacagttgcattaaaggcgtgtaccacaccctcagttgtcctggagttgctcattgacaatttttttttattcttgatgttgcagctagttttttttttatgctttacctattggtttattgatgttgcaggtcagtatttttaaatattgtattagctggttgcaacatttttttagcgagtgataaaacatctaattgatataattaattcttggccaagtgatgaaaatttgtataacattttgaaacaccatctaaaatagttgtccagttaggttgtgggactacctatatatttgtcgacaactcttcttaaaaaaaattgacagatataagtatagtataatcatgatataattatattgtaatttacatgtaacttaaaaaatccctcattaacatgctattcctttaaaatggtggtcatggaaccaaatcccctcacatatgcgccgccgtagtgattttttccttcctcgcttgtatgaaagttaaagcaaatcgaacgattcaaaattatatgaaagttacacacaagttacagtgtaattacacaacaattgtactacatttgcatatgtcaatttttgagagaaaatttatcaacaaatatatagcaaaattattaggttgttgccttggaaagaagcctagtctaaccgcttggttgctggttgaaaactatatatacatgtcacagctgagatgagccttatgataattattgtagatcttttcatgctgtagtattttaaatatgtcattttataactcgttagagatgaagttatttgagacatgtcgtgctcgatacgtcacaacaaaatgagaggagttatcgatgactccctccgtcctaaaataaacgcagccatgaatttctatgtctgatttttatcgcgcgtcttatttaaaaaatttttatgattagtatttttattattattagattataaaacatgaatagtactttatgtgtgatttatgttttttctttagaaaagaaataaataaaacgaacgattaaagttgtaaacgaaaactcatggctgcgtttattttggaacggagagataattaaagatccacctgcctgtgagcctgtcccaacaacgtagtacgcgtcttgagcaatatgacgaggccgtacgttacgttggtgcaagccgagcgagcgagcggccccccgatcgacgacggggccggccggccggccaccaacacgagaacgttaacgacggctaaccgccgccgctcccaacgtcgcgggccggcgtacatatatgcgtcacctacctagatgtctcagcacgcgtaattaatcgagccatattactcctatgtaattataagagattttaacttttttttctctcacactgtttgatcactcgtcttatttaaaagcctgtgtaaatataaaaaagaaaaattatgcttaaagtaacttggataataaagtaagtaacaaataaaataaataataattctaatttttttaataagatgagtggttaaacagtaagaaaaaagtcaaaatcccttatattatattatgggacggagggagtattaagcatgaatgcagctggttggcacaattaactagctagtcacatatcaatgattgatatatcctgtagctaattgattatatacaatagtgtttgaatcttccaagacgaagataaagataaaaactaagtgtttatacaaaataagatggtaataatatgtgattaattgagttttaattattataaacttgaaaaatggattaatcttatattttagaataactttcatatagaaagttttcgcacgaaacacaccgtttagcagtttaaaaaacatgccacttttatctaaaagtttatccagtttttgtttgagaaaagaacagagccgcttgatatactccatccgtctcattttaagcgtagtcatgagtttccatgttcaactttgatcgtccgttttatttgaaattttttagattgatatttttattgttattacatgataaaacataaattttactttatacgtgacttatgtttttatttttttaaaaaagaaattaaataagccgaacgattaaaattagaaaaaaaaacttaattataacaacacttaaaatggaactaatggagtatatatcatcaatagtagccgtggcagcagcagtggcaccccgctgcagtgatggccacccattttcctcaccaaatcctgcaaacctggagtagtcatgaagccactaataatgcgttgaatgcctgcataattaagtgcatacacatgcatggagtgtatatgagtaaatagtaatataggagtagtagtctgctttgcttgcttgcttgcaaccaccctaccacaccaacaagctttgatttgacagatcgatcgatgtcccgctgtgaatattcctgccgctggatatatattcattactagtatttgatgatcatgggcctgcttaattattactactaacatgcatatataattgttgggggctgctttgaacgcatgaaaactagtcactcgaatggaacatatatagggaagaaaatgtgtagggataatgcatgcagttgtaaaacaaactatatattggaaaaagaaaacatactgatccctctgtttgtataagctactagagatattcaaagtttttctggcataataagtatttatccatctattgtcttatttcaaccaatcaaagctatatttatcatttaatctcttcacttaattgcttaatttctcatctcaattgatcctaaccattttctatcttaaccttaatttttcctaaagctggctaagctattatagggacgattagagcatgcgataatggtaaataagcaattatttcatatttatattttttaacggaaggagtaaaacaaaatatagatatacaacacaagaattctaagaaccttaataacatgaaatcctatgcccatctctttttatggactacttccttcattttttaatacatgatagatattgacttgtgtacgtatgtttgaccactcatctcattttcaaaattattgtgtaaatacatggaaaagtatgtcatgctttaagtacctttaatgataaacaaataaataataaataattattgtatatttttaataatattaatatttaaacgtatgcttaaaagttaatggcgccatcggttaaaaactgaaggggtatcttaaccttatttgttatctaccttgtcctcttatccacttctgcatctctctccctccctctcctctcatggtcaaagctctatttttgacttaaggatggagggaaggggaaactttcctttgtttttcatttgctccaattccttcaatattccaattggctctttagtttttattttccttttgggattgaatgcttctaaattcctatgaaaatgcttcaatataaacatgcccttaattaagttgtgatttctaataaagaaacataattttaggatagaactttatactatatagacatactccagatttagagtgaaaatccaattaattagtgttaaaaatcaaaattagctacgccaaacaagctgccctccctatatttggccactacacacatacatctatctatttgcatctaggcttgtcttgtagccctccaaatataaaattaatggatctggagttatggagaaaggaaaagatagcttctttattattcacatgtgtactagtacttgactcttgaaaaattggaaatctagcctccgtttgatataactccagatcatatatatccacgactctacgctggtattttagttgtttagtacaacttcagatcatatatctacgcttggtatggggtttataagttaaattgtagtatttaagattttatattttatttaaaataaaaacaaaataattcttccaaatattatcagctccaccgaacaagctaggatcggctcaatagcccctagctatatctcaccgtacgtactgcatgcattatctggatcatcatatgcgcaggctcgcgagaaaagctaggacaggcaggcccctcgaaaaaaattgggaataattgtcacctaattaaaaaaatgtagctcaacctgttaggttctttgtggtgggatcaaccacccgagtttaagactttaagttctagatttgacacggatacttatattcatggctaattatttttttagtgataggttttcaaaggtacgtattcatagaaataaggtgtgtgcatgtgtattcacagaggtaactgtgcacgtgttttgagcacttcggattataccgtgtttaaaaaatttgtaactattccatgtatataactatatatatagacagagatacagggattataaacggccggggcctaggtgtttaattcctgacacaatcaatattaatgccgttttatttactgccatgaggatggtctgatacgatgagactgatcaagtgatcgatttgatcggagagccggttcacactcctgttcatcagttttacgagttgcattcatgatttgttatgttttttttttcgaaatatacagctagctgtgctactcatgtatactccgtacgtctcaaaatataagcatgtttagttgtaaatttagacgaccgctagtccgatccagatcactactacaaaacccctcataggcaccgactcatcggcaccctattgatcttttcccacctttgcggaatgaaaaaaaaaatatagaaccgacacctttgaacaattaccggtgccagttctaattaaggaaaaaccgatatcaatatccggtttataaaaaagaaccggcacctatagatgatctaggtgtcggtttttattaaattagcacctattgtataatataggtgccggttcttttaaaaaagtgacaccaacaaaactgagccgaaccacccaacgaaagtgagccgagctgatctggtacttttattttagtccaccgacacacccaacaccttatccactcggtttctctatattagtctccgcctttctcgcgtgcttctctccgccaccccctatccttccatcctcccatgcttgcgcctctctctcgtatgccgccgcctccgcccccaccgcttacgcttgcgccttctctacccctctccccttctcatcctcttgaccccttccacggtcatggtgtgcttggcggccaagttgaggggggcatggttaattttaatttaacctgcacctatgaatcaatatctatgatatattttgtaatagtgtatgcgcgaagttaattgcacatggttctcgatctctcttatatgggctggggtacgtcaatatatagaaaaaaatattagcaaagacgtagcgtgattgtgctgggtagctgggctgacagtgtcccacacggctaagcctcatcaaattatttagcagagatcaaccaacataataatacactttggaaatataggaatttgctcatgttattttttgacatgaacagtggctcatgcgatactattttctagatccgacattaattactcactaaaaccatcacccatgtgtgttttcaattagtacattactgatgatacattttgatatccttgcgaaggggtagtacatatgtacaaggccaacacatttaacacaaggagacacagcaaggacacaaattaacagcgcacatttgctagctagctaccatgcacagaaacggaacgaggacataatccaaaactttagggttgcttctctgctccgccatgacgccaatgcataatataattgtgtcggctacctgcacagtgcgcatgtttaatctgtttcttcctttcttcttcttcttcctattaagactcgcttaggtggtgtttggatccggggactttactttagtctctatatttagacactaatttagagtattaaatatagactacttaaaaaataattacataaataaaagctaatttgtgagacaatttttaagcctaattaatccataattagagaatgtttactgtagtatcacataggctaatcatagattaattaggctcaatagattcgtctcgcgaattagtccaagattatggatatgttttattaatagtctacgtttaatatttataattagtgtccaaacatccgatgtgataggaacttaaaagttttagtctcatctaaacagggtcttactgaagacatgtatacatagtgttctgatcagtgtacagtgtactgtaccatggccccaacttaacggtactgtgcacataatttcgcaagggaacatgcatgacaatggcatgcccagctcaattcgattgtaggccctccacgccacaaaattggtcctaacaggatcgttcaattgccacttttgatattctacctcatagcatattttgtagtaaaaaccggtgatcacccaatacatgtgagtatagctcgttatttgaatgatttcttccgatcgacgtgaattcgcagtggaccatataccaatcaagctgggttcgtgcgtctagcactagcgtgactatgaagtgataagtccgactcgagctagttctcaggctaattcagagcagaaagacgacggtgaacactgagaaggcctgagcatagttaatttttacaacaaaataaatcatagggtaaaacttaaaactaaagtgataattaataattgagatagttaatttacgcaatttttaccttggccgaaagctatgctgacaagtgaacaacacgcttgccgttgccgacatctcttgtacgtacataagctagcgacgatcacggtggttcaataaattaatcaagagacgagacgacagcgtatatagatcgaaaaattaatcacgaaacgacagggtatagatgaaatataaattaaacccacgcttataattaagtcggccaccgaagcagaagctagatagagctaaagaccaatgcaacaacagatcatagatcgcttttacacttgtgtgtgtaccaccattaactgtacgcgcttcgatctgtactacgaatagtagagtctctggtcctcgattcatcgtcctatatatatatatatgaacacacttaattaaacgcatatgatatgcatctgcagctagctagctgctactccctccgtttcaatttctgagacaataattccaatatataatgtgagcacttttataattgtttgatcagtgcttaaaaagggaatccaagaaactcaaaattgaaccaattagacgactttgcatctagctttatcttattcttaaactttactgaataaacctattaatacttatctataaattaatcctatataagtattcctattaattgtggttaggtgtatccacgtacgtcaccctactatatcagcaattagatgagagagtatgtgcgatatatgaatatcatatcgttctattaaatctaagcatcactggatacttatattgtcgaaacaagatttcggcaatactaaaaggaggtggctatcaagctagaaaagtggatggatttagagacaatgaattttatacaggttcaggccttcttaataagaaataatatcctactcctgtccggggattgatccgccgagtgtattattgatcgtatgatctgggagaaaatcgtgccccaagaggcacccggacccctccttatataggggaaggggtccgtagtacagcccatatccctaacggaataggaataggtagttacagataagatacaattgtaaccgactaggatcccgggtatttccttgacatacgtttagaatttaacccgagtccctgtaaagatattattttatctatacatggcaccccatacccagtcggatatacatgccgtatgggtatggggtatccataatctccacatatatcattgcagcatagctttacttttttatataggatactcttgtttgaagtgggatgccataaatcactgaccttcttcttattctctctatttaatccaggaaccaatagacacccatgccgtaaattctaagccacccttaccatttcattcaggaaaaatatgtggtggaaaccacaaatgtagtgtaaacttggaaactattgttggatcaaaaaatggacgtccgaaattcgtccacgtaatcacgagttaaaactcatgagtacatccatgagtaaaatttttactcgagatgacgtagaggaatctcagacattcatttttcgattcaacggtagtttccaagtttccactaaatatgtggtttccactaaatattatcccattcatttatcttcattttcagtttcacatgcatgagcttgatgaagaatcaagaacatatatattcctctctagaagcccatatgttttgccactgatataatcagccaagaataggtgccagtcaagaaatagattgtacgtgctctgttcatgtttcatgcatcattttgtatttttagtgtgattttcttacacatgcatcttcctcataattgcagtataatttttcctattttctacatgtatcgcatctctaatcccttctctatgcagcatgcgagatccaagaaatgctctattcatgcatatatgaagctctactataaaaacgattttttaccaacgttggctttttatttttacaggcgtacaaaaaaaacccttttataaccgtttgcaaaaatagtcaaagaacctctagatttagacccgcctataaaaataatgtattttcgcacaccttcaagttcaggagtggatggccatctgaaaaaatcgttttggtccgtttgtaaaaatgatttttctcatagtgaagcttaatacggctgggatccgccggccagggccccgccgtcgatcgatatcaatcggcgccggaaaaaaaggcgccgacgtacagggccggacctagggggtgtgccgggttggcaccggcatacccaatttttttggaaaaaaatactaggatgtagtatgaaatcaaatgacataaaaatggaatcctctcagaaaatagaatataacaatgatcacggtttagaaatcaaatcaggggaagaggaaaggaatagatgaagagaaacagtgggggggggggcagctagatatatagattaggacatgggattgattgttctgaattttattgatttttcatgaattatgggccatatttgaatagaattttgaaaaagccgaccaaaatctgtcgaaatttttccatcaaaattaggtgttttctttttaaaaaaatatatggtggagtgatcgctagaatgaacacacccggtacaatttttctgggtccgccactatcgacgtatgacacgcgacagcaggagcacgaattttaagttatatatataagcctattaagtggcacgtacggacgtaggtaacagctgccaattatatttatgcgcattgttacatgcgattatgttagtcaaaacgataattttcaggcgatctacaacgggcttaattaattactcttttcattctagtacatccatttcaaaatatattgcatattttattttattttttttagatgaggttttgactaatagttgctttcttaatatgttatttatgtgacacaatagtataatcatacggaagtaattttgaatatgaaactaataacatcagttttgcttcacaaaaaaattattacaaaagtaaatgttggttagagtcttattctcacaaaacaaaatgcactctatattttgaaattgggggagtacaacaagtcattttagacttgtcttaactcaaacttctacgaagtctaatcaaatttatagaagatgtaaatacaccaccaaatcaattagttcattaaattcactaaatctaccattatttttattcggtatatttgttttgcgttgaaactattacttctcctgcggtttttaattaatagatatcgccattaatttgtgtgtgtatttgaccatttgtttcatttaatatactttaagcaatacttagatactacaactatcctataatataagttattttcaactatttaggagtacaagactaaacagttcttgcattgttttttcaattcccgtctaaactgatcatcaaccgagtaccgacatgttgtaatgcagccgtatgaacaaatcgcttcgactgatcagtcgtgcgtacggcctccgatagttatatatattgtgtactgaatggatatacctcgtctgcagcagcaggactacttgaattacctcattgcctgtactctcctgctgtaccccttaggtagatcgagcaaacagtggccagccggctgatataattgcatgcacgtatacgttaaatgatcagtaattgtgcaataaaatatgggagttaatttgctactcaactctgtcccaaattataagggctatattttttttacacggttttcaataacatactttgacaagtattttatttcattctatgattccaacaaatatgaaattagcatcacatgaaagtacttcaaaataattagtatagatataattagtatgattattagtcaaaagctaccgagattgattttccttaaaaatgaggcgccctataatttggaatggagggagtacttctcttcgtcttaaaaaatatttttataagggattagcaatacaaattaacgcagagctaaaatttcttattttaagatatggagataaaatataatacttgtcgttgttttgcaaggcggtgtgacaatcatggttaattaggggtccttcagaacgtgctgatttcaaacaattttattgaatttctatgtgggaattatattcaattcaatcaccgtatgattttgatatgatgaaccgtgtttccaaaggaggcattagttttgtggggtgggaggaggttgggatcaagggttggagggaagaggaggtacggatgcataatgccaccaaagccataggggaaatggtatagtggtgtgtgtttttatttggcaaatgggtttggtgtgggtagtgttgagaggctacgagttaaggatgtcagagatgtaggacacaaatagttgaaaataactcttaacggagcaaatggagaaacaacaatagtaacactaggctagcttgttagtggaaaaagatagggagagtgatagagttatatgtgggtcaaggaaaaaaggcttaatagctagatagcttttgcataagataaaagataaaattacatacatcacctcttattgctacaacttcgctttgactacatggccggtccaccattactcagccaatcaatatatcgattataattaaaaagtgattttgaattctagaactcgatttttggattaatctttgggctctttttaaaaaaaatttcccaactcttttataatctaaactcgatcgctttgtaaactgagtttcgatttacaattttgtgaaatattgcacatcaatattctctacattaccattttttatagaattgtttgtaactatccatatatattgtactcatatttgataagtaaaatggtactctactagagaacatcctcaaaatctatttattatgcaagggtatgaataatgcaagcccctctgatgtgcgattttaaagtgagatagcatgccacataagcatggggctaatttcaacatagtttctccacaatgcaagctattgttgatgggatccatagtaatatactattttaccaccttcttatttgagctttagtccttcaattagttctttttatttttttggtccaaaattatgcatatagtacccccaatagaaaagagaaattgtataaacacacataagccctttccctaccatcgcgggcatcaagtcccactataggcctatcccctcttcccgcctcgacaatgagcaccactgccgccagcgtcttacctcttccaaacctcggcaatgagcgttgtcactgctgacctctgtgtgtgtgtgtatgtgtgttcaccgtgacgagctccctctctagcagactctcccctcacctagagtcgcatctcccctcctactagataggcgttgccgccattatcccctcctcctcaccaagccgcgggtggtgtagatcaagccagcgggggcgacgaagatcagggcaaccggcaccaacgacaaccttgacaatggtaagacatgcggatggtgtaactgtgtaaaggatctcagcgcgacagatagtgcgaggtgtcgagggtgaagcatgccgggacgatcgaggagggccatcgccaatcccccatggtgtcatgcgcctgggcatcttccaaagcagggcactcgtgtctcatagaaggcatgagcaccccgcgcgaagacacggccctctctcctccacgggctacgtggatcctacgaaggtactcgccagcgtggcgcattgtccatggccgaaacaaagcaacaatcccaccagagatgacaccaccaaaattcaccactagccgcttcttacggcagtacacactgcagtaactaaaccatgcagttccttgccgggacgacgtcgacgtttgtagctatagctaagcctaggcctagcttgccgttgcctgcacgcgcgccgtacgtacgtacatccacacactgacagccatcaatctcgcgatcgagatcttgcaagatcctctcatcaaccgtccgatcgacgtcgtcctcgctcgccgccggccagccatggccgccgtggccgtggccatatttacctccggcgagtacacgcatgtgcacgcgatatacatcgagatctttaccctctctttgcccatatcttcccacctcgtaccgtacgcgccatttactccgccccccttaactccggcgagtaatggcgctcccgccgtggtaccccaccaccaccaccgcgcgccgctgcatatcctcgccgtccacgtagacgactagctcgcccatccaccactccttcgtttcatcgacctcgatttatacctcgatttaacgtggcgttggtgggcagtatagctagctactagcatggatgcgatcaattcgtcgtcgtcgtcgtcgtcgtcgccattgttgtcgtcatcgtggtggtaggtggtagagtactgagctggaggtttagtggtgcagggagaggatcagggaggtagagctagtcatggagtttgggaggaggaagagctttagcttctttgaggaggactggaaggcgcggccaacggcggcggcgcggacgccggtgcaccaccactacgcgcggtcgccggcgagggaggcggcgccgcacacgccgccgaggctgagcctctcgtcggtgcatggggtggagctgccggggttggtcggagttgggggaggtggtggtggtggtggtggtgtcggggggatgtgctcgccgtgggtgcagtcgccgctgcacgggagggttcggttcccgccgtcgccggcggcgatctaccactgcctctccgcgctgcaccggctcgacggcgacgtgcacgcgctcgccgtggcgaggggggtgctgttcacggcgtccgacagcggccgcgtccgggcgtgggcggcgcccgggtgcttcaaccgcgggtacctcgacgtcgggcgcggccgcgtcccggcgatcgccgcgtgcggcggcacgctggtcacctcccacagccgcgaccaccacgtccgcgtgtggacggtgtgcgcctccgccgtgtgcgaccacatccgcgccaagaaggccgccacgctcccggcgaagggcggcatcctctccttcaccaagcggcggccgccgcaccaccgcgacaccgtgtcgtgcctggtgctccacgccgtcgcgggcctcctctacacggcgtcgcacgaccacaccgtgaaggcgtggaagctctccgacggcagctgcgccgactcgttcgtcgcccacgacggcgccatcaacgccatgctcatcaacgaggccgacggctgcatcttcaccggctccgccgacggcaccgtcaagatgtggcggcgcgtgtacggcggcaccacgcacgccctcatcatcgccctccgctccgagctgtcgccggtgaacgcgctgacgctctgccacgccgccgccgccacgggcgccacccgccggtgcttcctctacgccggctcctccgacgggtacgtcaacgtgtgggagaaggaggcgagcgcggggcggccggcgcacgccggcttcctcaagggccaccgcctcgccgtcttctgcctcgcctccggctgcggcggccgggtggtggtgagcgggtcggaggacgccaccatgcgggtgtggcggcgcgacggcaagggcgggagcacgtcgcacacctgcctcgccgtgatcgagggccaccgcgggccggtccggtgcctggcggtgggcggcggcgaggccggcgatgtggaggggagcatggtggtgtacagcgccggtctggacaagagcgtcaaggtgtggaggatacgcgtcgtcgggaaggaggaggaggaagacgacgacgaggatgacctggacgacgacgacgtcgacgtcgtcgtcggcgaggaggacgcggcggagacgatgtcgacagctgcagggaaggtcgacacggaggcgagggacgaggcggcggcggcggcggcggtggtcgccgaggaagaggcggaggtggtggtcgggctcggcgcgacgccggtgctgtcgccggtgtgggtggagaagcggcggacgagccgagggtgacaccgtacatctcgacgacgacgacgaggaggcggccatgacggccatgcatggtaaattaattaaccagctcggtcttgatcgtggttaattagcaagtcctgttcctccagctgatgattaattttttttgttcaatttctacagtgttgaattgcttggtaaatagtagtggtagtaacataagtacgtttcaccactatatggcctgtttggatagcttctgcctgccgaagattcttttagaagccactactgttagacagtccagattttcactcgaattctaagaatccgtagttgtagaatccaaaaaataaactagaaatcacaagctatgttttccagcttctccaggttctcaccagctagcttctcaccggttgtttctcagaattttaagctcccaaaacaggacatagggtcgtttggaagagacgagtgagatcgtgtgggggcaagggccaattggtctccctctgtgccgtacggcccacgcgcacatggttggtggaccagagcatataaggacgcacctgtgggctgggctggacggtccaggtctctggagccaggctagatttagaaggtacgcgtacagccttgtcatgttgtcccatcgcacacacttgcacaagaaattactccaaaagggcagaggcaatgtacggcttggcccatggcaaagggcggcccagcaagtcattagacgaatatacggagccgggggacctctcctcgatctgcacaggcgcgggggtgtaattaaatcgacttctccggctaaatgtcaacgcaaagcatgattacgtatttatgttcctcttcttcccatattatggagctacgaaatactccctccgtttcgaaatgtttgacgccgttgactttttagcacatgtttgaccgttcgtcttattcaaaaacttttgtgaaatatgtaaaattatatgcctacataaaaatatatttaacaatgaatcaaatgatatgaaaagaataaataattacttaaattttttgaataagacgaatggggaaacacgtatttaaaaaagtcaacggtgtcaaacattttgaaacggaggaagtatataggtggcctgctatatatacgggctatagctagggtttggtagattaatcatcaacccaagtttcttatcttgtaagtttatatacatcgagtatatattatttgaccacatgtatgtttacatcctgcgcatatgttgtactagtgaataaaccgaaactaagcacgtgctaattaatttaagtagagaggtggagttgtgcgtgtataacttcatctacggctaggctaggagttaaaattttagtgtccatatatttaagcacatgagaatgctttataataatagcggggattttgtttagttcagcctttatcatggagtctccatgcatgtcgtgggtggtgtgtgttgaaaaagaaaaaaactaccccaatatgctaaatg

SEQ ID NO: 66263 - DNA, 40217 bp, Oryza sativa
atttcaaaatcaagcagaatgtgagacaacagaatttgttccagatacatttatatggaactcaaacagacaaggccaatgaacaagagcatctccaagaacggtaaatgcaggtccgacaaatgcatatatacggatcatcagatcatatgcgttcaccttttttttaattcttttttttctttttacatttccccatgtctcctatagcatactgtccatcatgatagtttttcaatatcgagccaaacagggcatactatgtgtttagaatataatacaacatgcaggtatatataatataggtcgtgcaaatgtcttgaacgcatcacaaaatatacttttgaagctttataattgaaaaaaaaagaatcagctagaacaacaaaaggcacatctatacttgatccgttttgagtttctttgaacaaaacaacatgtgtgccatttcctaccaaaggtcaaaccagcacgtcgacatgatcacgatgcccaaaattgtaaattctaactaaacagatacaaacgaacatattaaatactccttccgttttttaatagatgacgtcgttgactttttctcacatgtttgaccattcgtcttattcaaaaaatttacgtaattataatttattttgttatgagttgttttatcactcatggtactttaagtgtgatttatatcttatacatttacataaaatttttgaaaaagacgaatggtcaaacatgtgagaaaaagtcaacggcgtaatctattaaaaaactgaggtaatataaaccaatcaaactgaagaactgaacctaaccgatcgatacccaattccctacctccccaatgcatgggagagaagaaaaaaaaagagaattcatcatccgcagaagaatctcccaccaatcacaacaaattcgagcaaagaatggtcacacaagcaaagaacgaaatttacggacctagcagtgaccgaaccaacggcggccttcaagctccacggcgagacatcgcggtgacagaagagaggccaaggcgcgcaagctccatggacgcaccgcggtcgcggcggccggcaagggatcgatgagccctcatccagccgcggcgggacggcctggatgtgggtgcggaggaggaggaggaggaggaggagagggtggggcgagaataggtggatggagaggaggagaggagaggaggcatcggctaaatttaagaggacgcgcgcgcgcgtggggcggcggcggcggggggaggagaagagtggagaagagaagaggagaggcggtggtggaagcggtcgtgtcgtcggcaggggagatggccaagcggcggcggtgttcccgagaggctccggtctccggcgtacggccggcggcggcgctgggagtgtggttaggtgggcttgcttcgacggcccaaggcccaggttacgttgctatacgtcatggttccatacgattttttgatccagattgtatttcttcgtgatgaggaggagaaaaatatcatcattactccaggtaaagtgatttatttatttattgtgaaaaaaattgatttatatagcaatgacgtagcattatatgaagagaaattctacattttgctattggtaggcgatcgatcatatgaattgtcatcgacaaacatggaatatgttggtcgggaataagttcacttttactcccttagaagtgacacaaatctaatccatcaccaatttgactccctaggcggttttggaggacggttttgctgaagtgacgcctacgtggcggtattgaccgggtcttctttacacgtggtgttgacgttgcgcttaagtggcattagaattaaaaaatatgtgtgggacccattagtcattcacacaaaaagaaacgtgggcccactgacatgtggagcccacatgctagtcctccctgactcctacctttttcctcctccgtctctccccttcgtcttccccttcggcctgtggtgcgtggtggcagaggaagcgacaaaggacagcaacaggcgggagcaggccgacaacggcaagggagttgggtggcaagcgggggaggagatggggggcgcagctcaccgcgaggagcaggacgatgtggtcgcagcgccggcagagtgatgtggtcgcggcggcggggttcccggcgagccgcgcagacgagggggagcagcgagccacgcagacgagggggagaaggcggtggcgcaacggcgtgagggcggaggcggagcacacgaccggcctgcacgccatggtggcggtggaggacgttgtcgaggagatcccccacctcaccctatccatggcagccaccgccaaatgccgccgccgtcttcactccccgccacgcccgcgtctcctccgctcgccgccggctccacttgcccaccgtcgtgcgccacagccgcctttccaccgtctcccaaccgccggatgccaccgccgtcactgccgctccagtggtgaagagaaaggctgggggagagaatgaaagaagggagagagagagggaggaggaagaagggtaggagagaggatgacatgtgggatccacatgtcatcctttgtgtgaatgataaatgaattattatttttaattctaatgccacttaagcgccacgtcaacgccaagtgtaaagaagagccggtcaataccgccacgtaggcgccacatcagcaaaaaaactgccctccaaaaccgccaagggagtcaaattgcaccggtttcaatagttcgggggtcgagatatttagttttatgggttagagtcatggattagatttgggtcactttttaagggagtcaaagtgaacttattccatgttggttgcctacactaacccaagtgagcctagtgggtgcaagcactccaatagcccaacaatccgcctcctcctctctctacattacctttttctcgatcattcgatccccatggctccacgccttcacccaccatgcacgtgaagacatgagagcgagcgagtgagcacgtccttcctccgatgagctcactgcacctctcttcggtgagcccccttctaccctagtgagcttccactaacgaagaagaggagatgcaaacgagctacctctctcaggtgacgaagggctcacttcttttctccaccagcaccccccaccgtgtcgccgccgacctcgcccgacgccaaagggcatcaccatgccaatgaggcccgcctagccgggctccttcccttcccattcgcctcactttgctccacaccaacaccagcccaccacccgctgccggcctctcagatgccttgccacccgtccttgtccaccacccaccgcctgtctattgcctcctaggccatccctctaaacccgatcctccactttcccctcccaagtgccaacctccccctcccaccctacccatgaaatcctaaccctaacccggcatttgtcgttatgctattggaaagcattcgcgagatgcccatgttgagagcgttcgcgcattaggctttccgcactaaccttgtgcaaagagtccatttttccttacaagtgaaatatcagccaatacttcacatatagacatgacctcatgccaataaggacaagtatctcactgccacgctagcagggcctagctttctcaaactttgttaggtcattcacagtgcggtatcatgtcgcgtggattcgttgcgccatgtaggacaagtgttgtggtggaagagagggaagatgggggaccatggttttgtgaggttgctcggatcctagtaaagaaccaagtccatcaactgaaaagcctgcaaaggaggaggaggaggaggaggaggagagagagagagaggaggtctagaccacccataccaagccccgggaggcggcggcgaaggaagctcgatgatggtggcgacggtagctcgatgatggcggcgatcaccacgcgccaccgagctcaccagatccagcatggggctcgccggatctggcctcgggaggtggcgacggcagtggctcgacgacggcaacgacaacgacagtgggacctccgtttacccacttccactacctcgttggatttggctaaagctcgataactgtggcgaggaagctcgacggtggcaacggttgaagatcaggaggggaccggctcattgggaccacctgacaatttctgacgaggttcgcgcatccaaatgaggcttcgcgttcttctttcaggcacgacccacgccaagctagctcagaatctccgagctggtgaggcgagtccaaacgccaagtcaccgcactgtgaatggccttactagcgccggtgttgctagcacactagtgccaattgcaatacaggggtgcgacgtacagggacaaaccacacaggacctgaaggaggaggaataaactaatttctgttagtagttttgtatgggatccacccttttgttctagggagttgattttacccaatctaatggaaagagaaccattttcacaccttaaattttgtttaggattcccataaacagatattgggggtaagatttagccattctcttaggctgcgttcgggaggaggggttagaaaccccttctccctggcacacaaaacaaagcacgcgttgttgcataattaattaaagtaccgtattagctatttttttaaaaaaagattaatttgatttttttaagcaactttcatatagaaacattttgtaaaaaaatacaccgtttagcagtttgaaaagcgtgcgcgcgaaaaacgagagagaggggttgggaacttggagataagaacacaaccttatagcaagtttaatagtatagccaactactaactccaattcatctatagccaatctaatagctcacttatacaatagttacatactacactattagagcacccgcaatggtaaagtaaggtgttatctataaaacatgtacacctcaacaatagactagattaatagtaaaccacttcaatggtatgtctacatgagtatctatagctctctaatccattgcctcgtttttctctatagactatctccatgttagtagatagctttgctctctctctgcatttaatctcttccaagtaggaaaatatgctgacatggatctcttgtagagagcttatagataaccattgtgggtgcccttaacacctggttacacctgtcatacacacagcgtcttggagtccgtgttacagctggctacaaatctgtagcccactactcttctctctccttatttatctccttaaaatatgtttataactgacttatagtctgctattgtacctgctcttagtgatgctctaaggctgtgtttgagggagaggggattgggaagatacgcaaaacgaggtgagccattagcgcatgattaattgagtattaactattttaaacttcaaaaatggattaatataattttttaaagcaacttttctatagaaaatttttgcaaaaaacacaccgtttagtagtttgggaagcgtgcgcacggaaaacgagatgcttttctctctcaatcccccaaatcgcccaggaacgaacgaagcctaagaacaatagtgtttcgttctcaccaaattccaaggttgtactccaaggatcttcaatacacaaagcacttgcatttcttttcatggaaaaaaaatagtactaccgttctattcctacgaacaattcaattctccccgaaaaggcattaccctaaatcaagagaatagaatcacacacgtatcctttttagcatttagtctcatttacaacataggatttgccttctatttttagagaagctatcaaatcatttcctacaaaatccaaagataaaaaaaagatgtgcaagtgcaaacacaaacatactatgcgatttttccacaccccgttcaccagttcactacgcacgcatgaacaaacggtcactgaacaaacggcatcgcggccacggcggcaggcaggtgggccccccacgttgtctgtctgcctcgccctcaacgttctttttgaactttttgaaatttgaacgaatgcacaccccgagatcccaaatcacactctcctagtcctcccccaatcagttcaaaaaaaaaaagaagattcaaatccagacgaagccccttccgctcacctccccggtaatcctctcacccttctgccctctcacccagacgaggtggggcccagcacgctcctccacgcgagggcgtttccccgccgtcgctgagcggatggacggctgggatggatcgacgattcaaacgtgcccgtttccctccactagatgtggcgataaacaaatggggatttgtttttttcttcttctttttttttgaataaagaaagggagcgcaccgttgaaggttgaacagaacactccatccacgcagccttttgctgttgctttgctctctttccatgcagtaagtacattgatgagtgatgacctctttcttggtcctccctaaattgcactgtgacaaaggagtcctccaccaccatctcaccctggggattcagatttcaaaattcaaaaacagaagcaggagtatcaactggccacaagggacaaaagtcaaatcttaatcttagtgctttgacagctgatgatttgagagtcaatgaacaggaatttggaataaccaaagcaaaaaaatgaaacattgtccatgtgaaactgtggccgcaaagttttctataggtgcaggattaggtaaatggtgtttatatggggtattttcattggcaatattgtgccattatggtgtaattaaatttttccatagtagcctttcacacagttaagaaaggtttaatcttacgttttgacccgtctattaattattaattataaatatatataaaacatgtctattaggacatattttaaactttccgaccgttggacgttattttaaacttctcaaccgttagttataaatatatggtattatatcatggtactccctcaaatattaaaaacatgtcgtttttgacacattttgaactttcagactgttgtacacattttaaactcctcgaccgttagttataaatatccggcatgtatggagtaacagagtaacgccttcaatctttaaaacacgtcgttttgcacaaagttccagaccttcctgtccgtttgtaataaatctccggtatgatactcatagcgctccatccactatcgaaaaacaaagttattttggacacactccaagctaaaaacatgaatatctaagcatcaatatcatgttaaatatccgttaccgtccacgaacaaaagaagtaacacattgcaatcaattcagctctacatccacaatatccataaaaaaacggtcggaaacataataacccacccacgaggtgaccgaataactaaaaaccgtttacggataaaataaccgcaacccaacccgatgattattagggcctgtttggtttccagggactttttccaagtccatgtcacatcggatgtttggatactaatttggagtattaaacatacactaattacaaaacacattccatatccttggactaattcacgagacgaatcttttgagtctaattatgtcatgattttgacaatgtgatgctacagtaaactttttataattatagattaattaggcttaaaaaattcgtctcgcggattagctctcatttatgaaattagtttttttattagtctatgtttaatactccaaattagcgtccaaacatccgatatgacatgggctaaaaagttttaaccccatctaaacacccccttagtagcaaggttgaagcacatgccactgcttgaaatttgaacaactgaactgcttaccagtacaaccctagaagaaaatgtgagtagaatggtaggcccaaaactgcaaagaatcgaaagtacaggggtgtattcttaaagtagcactcctcccccttttctttcatcccctaccctcccctctcctcccaatccccctggcctctgtcgggaagagcacccaaaccctcgcttccgccctcgcaaaccctagcgcccggaggaggaggaggtgggttgcggtggtagtttgccgtccgccgatgtcgagcaacctagcagcctcccgccgctcgtcgtcgtcgtcctcggtggcggcggcggcggcggcgaagcgacccgcggtgggggagggaggaggaggaggaggagggaaggcggcagcgggcgccgccgcggcaaagaagcgcgtggcgcttagcaacatcagcaacgtcgccgctggtggtggcgccccagggaaggccggcaatgcggtgcgtgatggatcgcttgtgggggggttggggagtttcttttttcttttctcgaaggctttgttctttgcgcggtttgggttcgagatctttcggtccgtgatgtggttggaatggtttttggcttggccttcttagtttcttttgcttttggtggttcctcctgggttcttgggacggatcgagttcgcttttctgcagttcttggattgggggatttcttgattcggaaattgccgaagcgatctgtatatgattttgcttctttttttttccatctttgtggtgggcatatgccttgatctgttggtttcaagcgaaaaatagtgtttcttgaatccgtcttcttgagttcttccagagtacaagattttcgtttcttcaatttctcgttgtttaacctacaaacggttcttctcttccaatccccaagattttattgccttttggttttctaattgctgttcccattcaaatttggacctctgccaaatttttccttgctgattttgaggattctcctctttcaatccacaagatttttccttgctgattttgaggcttcttttcatggttatttgattgattgatttcttggggagcatccatggtcaacaggcataaagtttattggcaccttcaaaagttcaaaaatcaagctttcttggtatttgtgaagtgttttgtacgtttgcttgctttggaatcttctattggtaatatgatacttgcgtgctgctaatgtttctaaatttttattccttttcatgcttgtggtctgtggaatcccaaatgaacagattgaaataaattataaattgatttctcttgtcccatcctcctgcagaagttgaatttagctgcctcagctgcaccagtgaagaagggatctttggccagtggccgcaatgtgggcacgaatcgggcctcggcggtgaaatcggcttccgccaagccggctccggccatatcccgccatgagagcgccacacagaaggagtctgttcttcctcctaaagtgcctagcattgtgccgactgctgcactggcacctgtcactgtaccctgcagcagcttcgtctcccctatgcattcaggagattcagtttcggttgacgagacgatgtcgacgtgtgactcaatgaaaagcccagaatttgagtacattgataatggggattcctcctcagttctaggttccttgcagcgaagagcaaacgaaaacctgcgtatctcagaggatagagatgtcgaaggtgtgttttggttgctgaaatgcacagttatagctagaaaaatttgtgctatatggtgcattctattggaatggttgattgatcttatcccttgtttgtttcgcagaaactaagtggaagaaggatgctccttccccaatggaaatcgaccaaatttgtgatgttgacaataactacgaggatccgcagttgtgtgctactcttgcttctgatatctacatgcacttgcgcgaggctgaggtaatacattcttgtctacaccttatttctctgaaaacatttcccttgagcaccttattgtagtatgttttcataggaaggctttgttttgcttcctcatgatttgagacttgattgcatccatatgaaacacaagtaaaaaaagtttactttgatgagaccataaattaagaagagaataagtgcacatcactgatataaggcagtattccaatgtaatttatcaggatatttttcacatttcaccacaatccgttcttttctgcttttcgctttgttggtgcaccttatcatctaataccagacatgctttgtgaccatcaattttcagtagttttgttctgcatattgtgtaaacaccttacataaaacattctagaatactttttttttctgaatagtgggttccatttaatggccatcatattgaaattccttatagaaccagtagaagcacagtataatatggagaaattttaatggagttatctgcttaaagcattgactgaaccgatgaattgatacatttcaattgttgtaatcaatgctcttgaagtatttttcaattgctcattgtttttgctgtgacatggactgcactactgcagtcagtttgaccaaatgacaattaatctgacctgagcacagtggtttcaaatctaggttgaatttcatatttacattgtgattttctatttgacttgaagcagaccaggaaacgtccatcaactgattttatggaaacaatccaaaaggatgtaaacccaagcatgagagcgatcctgatagactggcttgtggaagtaagcttttataccaaacatttttttagttgattggagcctaaagaccacactcgttacttaccactgtatttgtgcttttcctttgtgcaggtcgctgaagaatatcgtcttgttcctgatacattatacctgacagttaactacattgatcgttatctttctggcaatgagatcaatcgtcaaagactgcaattacttggagttgcttgtatgcttattgctgcgtaagatctgactagcaatttttttaaatgtgtttctcagtttgcatctgagttttgtgtactgattttggcttgttcctatatcagaaaatacgaggagatatgtgcacctcaagtagaagaattctgctatataactgacaacacatacttcagagatgaggtttgttttgcatatctgttaacattgctgtgtttatgtccatgactaacacatagattatcaggttttggaaatggaagcttctgtcctgaattacctgaagtttgaagtgactgcacctacagcaaaatgctttttgaggttctattccctttcatctcatcgatgtctatagtgctggaatgaatcgaactctaataactctcttattgcctacaacaggagatttgtccgtgttgcacaagtatcggatgaggtgctgctctcttaatcatctcctgcttgctgcaattccataatagttatatggtgcattgcattaacagcttttcatcgtgcaggatccagcattgcatcttgagttcctagccaattatgttgctgagctatcactgctggagtacaatctactttcttaccctccttcactagtagcggcatcggctattttcttggccaaattcatactgcagccaacaaagcacccttgggtaagtggtggcatcatcgtattgaactttccatacatcttttatatcagcattcaaataaaaaaattacaagagctaacatatgcttctcattgtaaatttgaagcagaattccacccttgctcactacacacaatacaagtcgtcagagttaagcgactgtgtaaaggcattgcaccgcctttttagcgttggtcccgggagtaaccttcctgcaatcagggagaagtatacccaacataaggtataaacggcatatcctccccatttcttcagttatctgtactgtttctaatgctgaccttctgtacctttgtttctgcagtacaaatttgtggcgaagaagccctgcccaccctcaataccgaccgaattctttcgcgacgcaacatgctgaactagaaaaataaaccaaggattagttacagttgctgactgaattcttcctccagaggcacctatgccaggttgtgccgtagaccgttcagataaccttgatgcaaggcatgctgcttgcccccccccccccccccccccctggttctttcaggcggtttggctgagtgtagatagatcgatgcttctgctgtgtgtggtaacttttatggtactgatgtgctttcttctatcttcttttccctgtacctagatgatccatggttttcagtactttgtacatcggagtcctgcagcaaagctttaaacatcttgtttgatattagctgccaacctgggcgtctcctaggttgatgtatgatagagtctctgttcgtgttgcttttgtgaaattctcaataagagcaccacattttcaacagtgctcattctgaataagtgctactagtgttcttgatgtttctagtaaaaaaatatcagcttcagctttttttttttcaacctgttctgttcttctgttgacagatatatgcagctgatgtgatcgacttaaacatgatgattcagcgagattcttagataaaagcttctgacatcttttccaagaaagatgttttcatggacaaatgcatttaagattttgaaaatgaaaaatactacctccatcccaaaataagtgcagtcgtggaaaccagtgtccaatgcttgaccgtccgtcttatttgaaaaatttatgaattattttttaaaaatagtcacacataaagtactatttatgttttatcatctaataacaataaaaatagtaatcataaattttttttcaaataagacgaacaatcaaaaattaaagataaatagtgcaaaactgcacttattttgggacggagggagtatttgtcaatgcaacctgttgaagaagtgatgctcaagctatttccatacttgaagctaagcacagctgtttagacatgcatgcctgcgtgttgcaccatcatattgtacttagactaatcacctatactaatataaaaagcattacttgtagtctttgctagctacactaaaaaaagtgtacacaaattaacctcaggcaccctgcaatctaatggttgagattacaagttccagcttgtcttgcaatgcaacaggtgaactcacagattcaactccaccttggcccttgcaaacgtggcggtgtgccggtgtgctagcaactacacgtcccaaaatataaaaacctataatcagatgagacatttttttctagtactaagaattggccaatccagattctcgtctcgctggagtctcatcctcgtctcactggagtctggaatctatagcaacgttgtttacagtagagttaacagaaattatcaccgtctaattaacctgctactgctttacaaaacgggagacaatcagacaacgccgaggtgggttgaaaaggaagaaaatgcaagcacaggcaaatgccgatgataagatactagatgagcaaggctactccctggggaaaaggctttgcttgccatggattgcaacacaagattaaaaaaaattacaatacagaaagaatgactcgaagcatgagtctagcaaggttaaatcatcactgagctaggcctacaacatgtcgagttagaagtcctcttcatcgtccagatctggatcatttgatggccgtattctcttgccgtctctccctccagggcgacctcctttctttggttttcctctgtccaaacacacgaggggtcagaactaggcaattcaactaaaagggttgttcctagaaacactggtatttttaatataaagaagtgttagacaaacactgcccctggcaagaatgtatgtaaagttgagaacgatagcacattttttgccgcaaaagtaatctgagcacttactgcccgtttgcaggagtggttgcgcctttcgaacgacctgatccatattctcttccatctgccaggatgcagctggtattgagcccagagtctcaattgttcctggtttcagcttaatgaaaacaagaaagagaacttaccatctcgtccagccatatgttcatcgacctggaatgaataaaaaataatggtatgtattagcaacctcacaaatatcggtatagcacagggggaataacaatcatcgatcaaagcaaaccaacagattaaaaaaacgggcactggcttttcagtggcattaggatttaggatcattagtcataccgctggagatgtaaccgatgacagggagaacagcctctcatcagcctggaacttcctggagcgcttgagactgaaattaataagacagaaactgtcataactaattctatgtgacctattagcagaacaggcatgataaaacatttgcttgtgcagaataatgaacacggaagattatgccaatggttatcataaatccaaccctcccttggtgatgctagatagtgcatatagagcacccctgcaattggccacaactgatataacactatcatagcatattttgggttatgaatctgttgtataatacctgccactgccactagagtgatcagaggatcttttgttcatctgatcattagtaaataaattataagtgatcagaggattttttgttcaatatctataactataaattattcatctgaatattagctaaattatatgtgatcagaggctggtagaaagttcaagggcaggacagtaggtcattcaatcaacagtcagaagtaagcaaagaatgtggcatgaattctgaaggtttcgaactggtaagtatacagtgggatgtcaaaagaaaatgaatgaagacctccaaatagtaaagggcatagcagtctaagaaaaggtttcttacttggaagtgttctttgacgatgataagaatgattcaaaaccctttagcacacttccgaattgattagactcttgtaggtaggttgtctccatttcataaacctgcaacatatggacataaacatcatttgcaggttgtataagaacaattctgttaaaagcatgaatagatattttgttaaattatgagtgtttaatatcatatacaaaacttccccttaaagtcaagcaaagatggttgacattatagatcatgtgttgttcctggtattaaagagcgactgttttgttctttctaaaaaaaaacacatatctgtgccattaaaatacttgatatgagagcaatacccatttcctccctttttaggattatggtttctactaaaccaaatgctcctcttatttaatgattttggatgacacaccaagattcaccatcacaaacatagattggaagttggagcacatagtgtaactttgaaatactttgaatagaagtagctcatttgatacttgttgcaaataatttctgactaagacacagtagaaactccacatcttatcttgataataagaacagatggaatttacaggttgtagctaactgattttcatttttaccctagagcaacaaagtgttctcaggcacaaagaacaacatacaagaaatagaatggtcatattcgacaagaatatcaaattgatactttcttcccttcctcctaattctatccaaattgttcgtcacaattgatcctctctgtgaaatgacaatcagtggtcactggtccagcatattggttccaaataggttcatatttctatcattcccaaggcattaagaaagattgcacaataaattggggactgtgtgtaagacctaacctggcgctctatggagcggagctcctcctggagcttggcgcgcttgctcatcagggcggagagcatcgctgtggggttcgcggccgccgcccccgagggcgcagagcctgacgctgccttgtgcgatgcccctcctccgcctcccgagtccatggttagggtttctagggttcgagttcgtggtttgcctgtttgggcgttcgttctgttttggctcggacacagttcactgttgtggagacgactagcccctcctctccaataatccgatcggtcctcttagccaaggtaatcaatatcgagatactaggtaggatcctttctcttcttgatttgatccttctcgatcggtttgatcccttctaatggagaaagattcttgtttgctgcaagtcacacctaagctgtcaaatgcacatgtgaaaatgtttagcaatcaatgcatacatacgcatgagtataacacagaaaaggttaatagagtatttagcagaaatttgtgtttcaatttttttttctgttgatggataaatttcactccaaataacattattggaatacatttctgcctataatctaagatgcacatgttttatgagcgatttgatcatgaccacaaacatgagataatgtccataccctagttaggtgcccatgtgttgcaatgggaaaagaacatttggctatgtacaatatgaataccctaatactccttcccgtcaggattatttgatccaaagtactgaggtatcccgcgccaaataatgactcgaggggcaacaaatgaaacatgcataacagttcaggaccttgagctgttgagcatatagaagaaacaaatgatacaacctatgtcacttattatctacaacacgttgacctctgtaataacagaatgacattatcaccatagatggtgaaacttccttgaaaaacacacaaaaacgaaatccagaacaaatgtggatcccctggcagtgatatcacacaaaacacataaaaaggaatgaaacctctctccctggcacagcaatcagcacaatcctttctttttcttgatttgcaaaccctttgcaggcaattttaaacattacgaattctgagtgcataacaaaaataaaaactacattattccactgtatgtaaacaaattagtgaaatgaatgaaataacaggggcggatccaacttgggacatgggggttcagttgaaccccccaaacttttgggggaacaacaaacaaactcaaactgttacttgtattaaggttaaggctctggaattaaaagaagagcttcttccagatctacaagagaagctagggtttacgcaagcaaattccagacagaagcactcccggtgggagggagagattaatcatcagaaagaggatgtggatgctcaccaggatcccttgctcgccggatggagatcggcgcccctcccctcccctgttcagccgcgaagggcgcaagaagcggaggagacgacgagacgggagattttttttttctcttttacgcgaagggaagggggaagagatactcgagtactccacctttagctcagatttactatgttacccattatgtgtagcaggccaaatgggcggcccggcccatcacggcaaggggcccgctgatggcacggcaactgtaatgggccgtacggtgccagatcttgggcagaacggcccaaggaggtgttgggccgtgtcgggccggcacggctactgttgcatggaccggtggcccacccactagcacgataacgttattcgtgagaaactacagtcgcaagttttctatagtaggtaacacaattaggcaaaattgtgttttttttagatattggaatagaatccagcctttggtcaatgagctacaaccaattattacaccaattcatacaaataaaatcgcatggcaaaaaagttataaaaacacggtcctaaaaggtcaggaacacacaccaagtactaaaaaccaacgcaagaaaagatcacaaaattattgaattctatttgtgaatcttcatccaaagttggcaaaaagccgcataaccgttgactcaagattacgacatgtagcttttattaacttgatatcttcttcacacttttgcagttgtgctcaggaccgaagctagtgtgttgccctgaaaagaacctgcatataagatatagatggtgatttgtcaaaaaccatatcatttctattcaaccatagagcccaacatatagcggaagctcctaccaggataagtttactggttttttttttatcaatcccaacaagccaagcaaaattgtgtttataagggtatttttcattggcaatattgtgccattatagccgtgttaaaaattcgcataatttcctttggcacaactaagaaaggtttaaccttacgtcccgacccaagcattcgttgtagatatcctgaaacactaggttcggacctgttttacacttttcgaccgttggacacattttaaatttatcggccattagttataaatatatggtcttatatcatgttactccctcaaatattgaaaatatgttgatttggatacattttaaacttctcgacctttggacacattttgaacttctcgacctttagttataaatatctggtatgtacgagagcaatggttttaatttttaaaacacaccgttttgcacaagttccaaactcccaaacctcctatcaaagtgctccatccggtcttaaaaacaaaggtccggtttcccacacaaaaatgttacaccctttcacatcaaacgtttgaagtattaaatataagctaaaaataactaattgtacagattacgaataatttgtgagacgaatcttttaaacctaattgctccatgatttgacaatgtggtgctacagtaaacatttgctaatgatggattaattaagtttaataaattagtctcgcggtttactgacggatactgcaattagttttattattagtgcccgaacaccccatgcgacaccctatataatacccgatataacacgcaataattttacactcttggatctaaacacccccaaagttattttggatactacattccaagttcaaatataaaactctaatggcaggtacaataatagactataagtcagctacaagcttatgtggtgaagataagagaggagatagaatagaagcgggctacagatttgtaaccagctgcagcacggactcctaaacgctacggtggtgtttgaatctcctgaagataaagataaagatgaagattaagtgtttcacgtaaaacgaggtggtaataacgtgtgactaattgagttttaattattacaaacttgaaaagtggattaatatgttattttagaacaactttcatatagaaagttttcgcacgaaacgcaccgtttagcagtttaaaaagcgtgccactttaatccaaaatttaattcacccctttcatgagtttctaacgggctctacgtgtgtatgacaagtgggaccagtaattaatgatgtagtgtatatctgtagttaactattgtataatttactattagattagctataaatgatttggagctagtagttagctatatactattaaaattcctctaagtagcaaaggccgtgttcgattattagtgttagaaactaaccctccagcacgtaaaacaaaacggttcattaatacataattaattaagtattagttatttcataaaaagtgagttaacatgatttttcaaataactttcatacatatatttttttttaaaaaaaaacacaccgtttaaccatttgacaaaagcacacatgtgaaaaacgagagagataagtaggaaaatacgatgaggaatatttcctccgtatcaaaatataagtatttttagacttcgacacggttctaaagatgcttatttgacaaacgatatttataaaagtaaaatattttaaataaaaagagttacatactgtgatagtttatttaatgataaatctagtaacatcaatttcttttatgattgatcttttttattttttttcttattaataattaaagttacaaatatttgacttgacactatgcttaaaaaatacttagggcccctttgaatcttagggtagaaaaaaacagaggaataggaaaaacacaggattctgacaggaattgaagggtaaaacagaggattgcaaaacacaggaaaaacacaggaatggtcgtttgattggagcgcaggagaaacgcaggaatcagacgagagagatagactcaaaggaatttttccaagagattggagctcttgctaaatttcctcaaaaatccatatgcaatgtgtgccatttcatagaaatttcataggatttggaaaacttcaatcctttgaatcaaagggccaaatataaaaatttcctataggatttgaatcctatgaaattcccacataaatcctttgatccaaaggtgctcttacattttaggaatataaggacggagggaatacaaagttaaaatccgtcatcttctacggcagaagtagtaacgcacgaaattaatttagctctacatccgttctgtttatgaataacggtcgaaaacgtaataacccaaccacgacgacatgaaaaaaagaaagacagacaaaacggtcgaataactaaaacaacttgctactactatttgaaatttgaacaactgtaacggcccaaaaactggaaataatcgaaagagtcgtcgccattttctttctcttctcctcctccgctcctctgagtcctctcctctccggctctcccctcctctgtcgggaagggaaggatccaagccctcgccctcctccgcctctgatccccgccggccgccgccgccctcgcaaccctcgcagcagcagcaggaggaggagggttcgggtggtggttgccgtccgtcgtccgatttcgagcagcctagcctcccgccgctcgtcgtcgtcgtcggcggcgatggcggcgaagcggcccgcggcgggggagggaggagggaaggcggcagcgggcgccgcggcggccaagaagcgcgtcgcgcttgtcaacatcaccaacgttgccgccgcggccaacaatgcggtacgtgaaggatcgcttgctgcttcttcttctttttttgtgctttttttttctctctccaagatttgttctttgctttgcgctgtttgggtggagatcttttggtatgtgaggtggttggaatggtttgggggtggctttttttttttttttttgcttcttggttgctcttggggcataagtgagttgctgttgcttgattcttggttcctcttggggcacaagtgagttgctgttgcttgatgcggaaatggctgaagcgatctgtgtatgatttttttttggtttttttccatcttgtttgtggaggacatacgcctcgatctgttggtttcaagcaaaaataaatagtgtttcttgaattcgtcttcttgagttctttctttcagccaacaacaagattttcatttcttcaatttctccttgtttagcctgcaagcgattctcctcttccaatccccaagatattcttgccttttggtttttcagtgctcttcacattcaaatttggacctctgccacattcttccttgctgattttgaggatactcctattccaatccacaagatttatcttgctgattttctggtttcttttcatggttaattgattgattgatttcttggggagcattcaggtcaacaggctaaattcacttgagggtttattggcaccttcaaaagttcaaaataaaagctttcttggtattcgtgaagtgtcttgtatgtttgcttgctttggaatcttctattggtaatatgatacttgcgtgctgctaatgtttctaaatttttattccttttcatgcttgtggtctggaatcccaaatgaacagattgaaatttaagttctaaattgatttattttcttcaatcctcctgcagaaatttaattcagctacctgggctgcacctgtgaagaagggatctttggccagtggccgcaatgtgtgcacgaatcgggtctcagcggtgaaatcggcttccgccaagccagctccggccatatcccgccatgagagcgccccacagaaggagtcagttattcctcctaaagtgcttagcattgttccgactgctgcacccgcacctgtcactgtaccctgcagcagcttcgtctcccctatgcattcaggagattcagtttcggttgacgagacgatgtcgatgtgtgactcaatgaaaagcccagactttgagtacattgataatggggattcctcctcagttctaggttccttgcagcgaagagcaaacgagaacctgcgtatctcagaggatagagatgttgaaggtgtgttttggttgctgaaatgcgcagttatggtgcattctgttagaatggttgattgatcttatcccttgtttctttcgcagaaactaagtggaataaggatgctccttccccaatggaaatcgaccaaatttgtgatgttgacaataactacgaggatccgcagttgtgtgctactcttgcttctgatatctacatgcacttgcgcgaggccgaggtaatacattcttgtctacaccttatttctctgaaaacatttcccttgagcactgtaaagaattgtttttcattgtagtatgttttcagacttgagacttgattgcatccatatgaaacacaagtaaaaaaagtttactttgatgagaccataaattaagaagagaataagtgcacattcctgttccagtggttataacggatataaggcattatttcaatgtaatttatgaggatatttttcacatttcaccacaatccgttcttttctgcatttcactatgttggtgcaccttatcatcaaataccagacatgctttgcgaccttcaattttccgtagtgttgatctgcatattatgtaaacaccttacataaaacattcttgaatacttttttttccctgaatagtgggttccatttaatgaccttcatattgaaattccttatagaaccagtagaagcacatcatatgttatgagcaccggtgagcgaacaaattaggtatgagtgggacacaggaggtcgaggattcggtagcctcttcgacgccctacccgtggtggccattcaggagaaacgggggatgagatagaaaagtggagatgagaagtatagattgaatcttgcttgcctttaaccataaattcgtggttctaaatagccttacatccaaactaactctgttaataaaaagggataacactcgaactaatcgctagcaatttgcgtggtactgttcctcatccggcacgacatcagtcggtcgcttcctcactttctttgtcgtgtcgcttcctcgaatacgtgatgccgaccatgacatgtctcccctccttcgcaaacagctcgtcctcaagctggaacgtaggataggtgcgacaaaactcatcttcgtcttcccacgttgcatcgacagccggtttgccggcccattggatgagcacatggcatactccggcgcgtcaattgaccatgaacagccgtagctggaagcgggagcactctttcgttcgagagcgccgacaacgcaggcagctggtctagcggtgtgtccttgaacaccttgaggagttcaacgtggaatacatcatgtatcttggcaccggccggcaacttgaggcgacatgccacatcgcccacgcgagtgacgacttggtagggaccgtagtagcatggtgccaacttgttgcgacaaaagcatagtaggaaaaaccggaccggtgggtgacccggtcgacctttgggttcgccggtccaaccgtgaaccggacggtcaaaccgcgatttaatacatatatgtgtaacgtatgtaattgctaaatcacaactgcttggatggctcggtggtctacgccgcttgcttctatcctaaagaccagaggtcgaacccccacaggtgcatatttcctctgatttttgccaaccaaaacgctctttgcaggctaaatgggcctttgatttttgccaaccaaaacgctctttgcaggctaaatgggccttgagagtctgcccggtgatggtttaatggccggttcatagaaaaaccgtccgattcagccggttcaaagcgggtcacatgcatgtcctgacttttttttaaccgaaccagaaagacctctggtaacggtttttcctggttgaaccaccggcccggtctggttttttccactatggacagaagccgggaagggatgctgcttggtgatggagtagacgcacctagacccagtcacagacctagaaggtgacatcacaatgcttctcttcgtagtagagcttccaataatcctgtgcttggaggaggtgttcccggatttcctcaaggaattcgtcccgctcgacgagggcttgattgacagcgcgcacacgtgctgtgccgtgatcatacacacagacctggaatggcgtcgtgcgcagcgagctctggaacaccgtgttgaagcagtattctgcccacggaagccatcacagccagtgacgaggatggtctccggtcaggcacctgaggtacatgctaatgactcggttggctgccttggactggccgtcgcactgtggatgaaaagctgaactcaggttgagcttgatgtcggccaggtgtaatagttcggttcagaacgtgctggtgaacagggtcccgatcggcaatcgctgacaatggagcttgggatgcatggagcatagttattaggaccggactggaccgacggtccgaccgggaaaaaccggaactagggcctcggccggtctggtccccttaaaagatcggatgtgtaattgaaccggagaaaaccgtttgaaccggtcaatttttatgtaaaccgggctttaaaccggagtggtcagaccgggctgtcttttggtgatgggctgacgtgaggcccgctgagcaaactcagccaaaaatcggtggaaaaggacgttggtgtggggagatttgaccttgggtcatgtggttgagcgctgcacgcgctagccaccacaccatctgttcacttttgttggtctaagacatttgcatcctataatacatcgaatcgtggttggatcggcctaaccagtggttgaaccgctagaccagtgaaccgagagcttgaccggttcattctccggtccggttttaataactatggcgtggaggcggaccaccttgttgaagaacacacgcgccactatcgtcaccgtgtaggggtggccgagcagaatgaagtgggcgtacttggagaggcggtcaaccacagtgaagatggttgtcttgccgtgcacgcggggaagtcctttgatgaagtccatggcgatgtcctcccagacttgcgtgggcaccgacagcgactgaagcaggcccgccggatgaaggtgttcggtcttgttgcgttggtaggttgaacatgtgctcatgaattcttggacgacttgcttggcatggggcgtgaagaagtccgtgcacagcctgtgaagtgtgcgctcgacgccttcgtggccggtgtgggcgtggtcgagcagcgcgggcagtgtcggggaagacgtcggcacggacacggtcattgcgaaggataaggccgccacggaaagcccatggctagcccaaccaacccagcgtgccactggaaatgtcagcggcgatcttggctaggtcctcgttcgtggtcacctcacgcctagggatggcaacggggcggggccgagttgggctgaaacggcctcgcccccgacccctgactacatcccccgcccctggccccgactggagatgtgggccaaatcaggccccgtccccgacccctctagggccccgcaacccgactagggccccgcattaggtagtcgagaggccgcaggggagagggagagggcgaccgggacgacgagaccaaaggagtgcgtggtgccgattcgtgggacttgggaggctggaagagagaggaggggaggggagagggagcggacggcgaggggtgcatggtgccggtgcgcagtgcgccgcccctgctgccctgtgctccgctgcctccgcctatgtgatgtgggtgcgcgtacgggagaggagaggtcacccgcgggtgaaatatgtcccccgttccctcccctcccaaattgccatccctactcgctccggaggttgtcaaatgccatgaacgtcagctcggagattgccaaggcgatgagctcggcgtccttcgtgcggtgggtcagggcgtccgccacgacgttcgtgcgacccggtcgatattctatagtaaagtcaaaaccaatgagcttgcttaccaccaccgatgttgcgagattgtggaaaggcgttgatccaagagaaacttcaggctgtagtggtcggggcggacgaggaacgcccgttcccagaggtatgcgcgccaatggcggatggcttggacaaggctgatcaactcctgctcgtaggcggcgagcccggcatggcgtggtgctactgcccggctgaagaaggctagtgggcccgtcccttggtgtagaacgactctaatgttggaccccgacgcatcgtctttgacgacaaacgacatgatgaagtcgggtagttgcagcacgggacccatccacagggcatgcttgagctcggtgaaggcttgtgctgcgtctggcgtccaatggaattaggggtgaaaacggtaacggtaattaccggccgaccgacgttcattttcgactttctaccggccgagccatatggaaatggtaatcgaccgaaacaaaaatggaaatggcaaaaaatatggaaatgaaaacggaaatggttttgctgttataccgatcgtttccgtatttatcgtattctcgtggaaattaccgtttcttataatgtggtaattaccgtattctaaatatatcgatatttatagggcatgtctatacttatgtatacatataacatacttatgtaaagttaaatatatatttttatagtttaatatttccgtatttgttaccgacttccgatctgtaccgatatgtttccgtccgtattgttccgtttccggtttttcgatatttccgatatcgtttccgagaaaaatatggttacagaaatggttgaggctattttccgatcgtttccgactgttttcatccctaagtggaatgcttcgcgcttaaggatagccgtcaatggtgctgcgatcgcaccgtagttgcgaatgaacttacggtagtatccagccaggctgaggaagctgcggacggctcccacggagagggttgcgaccagtatgccattgcgcacaccttctgcacatccatggccaccctgtttgcgaacaccacatggccgaggtagttgatctgctgttcgccgaagtggcacttggagcgcttcaggatgagatgattggcgcgaacgacgctgagcactgcccgaatgtgctgaaggtgttggcccatgtcccgctgtagatcagtatgtcgttgaagaacaccaggacgaaccggcgtaagaatggggcgagtaccatgttcatcagcgcctggaatgtcgccggcgcgttcgtcaagccgaatggcatgaacaagaacttgaaatggccttggtgtgtgcggaatgccgtcttgttgacatcgtccgggtgcatgcgaacctgatggtacccgaaatggagatccagcttggagaagaagtgggcgtcgcaaagttcatcaagcaattcgtcgagaaccaaaatgggaaacatgtccttggcagtcaccgtgttgagggctcggtagtccacgtagaagcgccatggcttgtggaccaacagaaccgacgacgagaatggcgacgtgttggggcagatggagagcttgtcagcgcattatttctccaattcgtcgttttgaagctgtgggtagcgatacggtcgaaccactaccgggggcttgccgggcttgaggtggatgtgatgattgatggatcgggtcggtgggaggccggttggagcgcgaagaggtcgtcaaattccgccagcaaggacggaaggagatcgtcggcgtgcagtgcagcgcaggtggatgtgaatcggttgtcgaggataccatagagtgtgacccggcaaccgcaccagatcgccatgcgcatgttgacgaagtcccacaggattggtcccaatattcgtagccactgagtgcccaagatgatgtcgacgcagctgaggtcgagggcgaagcagtcgacgtcgaacacctcggtggccacctacaggcgaagcccgtgcacgacacccgcgccgcggatgcgatcgttgtcagccaccaccacgcggagaccttggcgtaccggttggagaggtaggccgatgcgctgggccagcttggtggtgatgaaattgtgtgttgaagccggagtcaacaagggccatcacctgctcggccgcgatacgcgccacgaggcacatcgtgctagtgccattgacaccgaaaatcgcgttgagcgagatgtgtggttcatcggtgtcgtctgtgtcgtcccattcgctgaaattagccgtggtgtcgtcgtactcaaggtagatcaggcgagtgcacttgtgacctaatgaacttctcgtcacatttataacagaggccttgtttacagcgctctggtaactctgctggcgagagacaacgaaattggtgtcctggtgtgtcagccgccgtggttggtgatgaggttgcgccagtcatcggagttgacgccggggcaggagcgcgcgacgcgttttgctggcccttccgttcgtaggcacgagccaaggccatggcctcctggaaatcctcgggctgttggagctcgacatcgatgcagatgtcgtcggtgagccccgctgtgaagagctgaacttgttggcggtcggtgaggaggtcggacgtgcggctacccaacgccaaaaggcgctgctggtacgtcgtcaccgtgccaacctgagtgagatgcttgagttcacccagggaattgttgcggatcggcggtccatactgaccgtaacagagctgcttgaacgtatcccaatccggaggacccatgtgctgctcataatggaagtaccattcctgtgcagctcaagtgagatggtatgtggccatccagacacgatccgtgtccggcgtatgttgccttcaaaagaactgctcacaatgattaatccaattgagcggatcatcggtgcgatcaaacttgggaaactccaatttgtgaaaaggaggaacggcgccaccggaattggtgtcgtgcaccgagccggttccagtcgacggcggaggtggtggtggtggcggcaggcaagatgccgctgccgcccaggcgaggcgcggacaaggtggtggaggactgctcgagggccgtgatgtgcgaagtggccacgcgacggaacgactgaggtcggcgaggtcgcttttggaagccaatagcgaaatgctgctcaacacatccgccatggactcctagagcttggccagtgcatcagcactaggggatggctgcttggaggaagaagtttcctcaagaaccatggtctatgataccaagttgttacgagcaccagcaagcgaacgaagtgggtatgaatgggacacaggaggtcgaggcttcggtagcctcttcgacgccctgccagtggtggcaatttaggagaaacaggggatgagatagagaagtggagatgagaagtatagattcaatcttgcttgcctttaactatagattcgtggctctaaatagccttacatccaaactgactttttaacaaactcgaactaattgctagcaatttgcgtggtactgttcctcatccggcacgacatcagctggtcgcttcctcgcttgctttgcctcgtcctttgccgcgtcgcttcctcaaataggtgatcctgaccttgacagtataatatggagaaattgtaatggagtaatccacttaaagcattgactgaaccgacgaattgatacatgacttcaattgtcacaattaatgctcttgaagtattttcagttactcattattttttctgtgacatggactgcactactgcagtcagtttgaccaaatgataattaatctggcctgagcacagtggtttcaaatctaggttgaatttcatatttacattgtgattttctatttgacttgaagcagaccaggaaacgtccatcaactgattttatggaaacaatccaaaaggatgtaaacccaagcatgagagcgatcctgatagactggcttgtggaagtaagcttttataccaaacatttttttagttgattggagcctaaagaccacactcgttacttaccactgtatttgtgcttttcctttgtgcaggtcgctgaagaatatcgtcttgttcctgatacattatacctgacagttaactacattgatcgttatctttctggcaatgagatcaatcgtcaaagactgcaattacttggagttgcttgtatgcttattgctgcgtaagatctgactagcaatttttttaaatgtgtttctcagtttgcatctgagttttgtgtactgattttggcttgttcctatatcagaaaatacgaggagatatgtgcacctcaagtagaagaattctgctatataactgacaacacatacttcagagatgaggtttgttttgcatatctgttaacattgctgtgtttatgtccatgactaacacatagattatcaggttttggaaatggaagcttctgtcctgaattacctgaagtttgaagtgactgcacctacagcaaaatgctttttgaggttctattctctttcatctcatcgatgtctatagtgctggaatgaatcgaactctaataactctcttattgcctacaacaggagatttgtccgtgttgcacaagtatcggatgaggtgctgctctcttaatcatctcctgcttgctgcaattccataatagttatatggtgcattgcattaacagcttttcatcgtgcaggatccagcattgcatcttgagttcctagccaattatgttgctgagctatcactgctggagtacaatctactttcttaccctccttcactagtagcggcatcggctattttcttggccaaattcatactgcagccaacaaagcacccttgggtaagtggtggcatcatcgtattgaactttccatacatcttttatatcagcattcaaataaaaaaattacaagagctaacatatgcttctcattgtaaatttgaagcagaattccacccttgctcactacacacaatacaagtcgtcagagttaagcgactgtgtaaaggcattgcaccgcctttttagcgttggtcccgggagtaaccttcctgcaatcagggagaagtatacccaacataaggtataaacggcatatcctccccatttcttcagttatctgtactgttgctaatgctgatctcctatacctttgttacctttgtttctgcagtacaaatttgtggcgaagaagcactgcccgccctcagttccatccgaattctttcgcgatgcgacgtgctgaattagaaaaaaaaacaggattagttacagttgctgactgaattcttcctccagaggcatgctgattgcccccctgttctttcaggtggtttggccgagtgtagattctaagatcgatgctgcagctgtgtgtggtaacttttatggtactgatgttctttcttctttctcctcctgttcttttacctgtacctagtagatctatggttttcagtacattgtacatcttgtttgtaatggcatgattcttggaaatattagctgccaatctgacctgggcgtctcccaggttgatgtatgagggagtctctgttcgtgttgctcttgtgaaattcccaataagagcaccacattttttaatagtgctcattctgaataagttattgatcatgtccttgctatcaagtgctagcgttcttgatgtttttagtcaaaaggaatatttggacgaattgcttctcatcttctacacatatcggctttactttttcttttttcaacttgttctgttcttctgttgacagatactgcatgcagctgatgtgatcgacttgaacatggtgattcagcgagaagcttagtagatcattgtatctggacatatctttgccaagaaaaaaatatgtttttataggcaaatgcatttaagaatgtgaaaatattatgtcaatgtccctgtcaatgcaaccttcttgaagaagtcatgctcaagctatttccatactggaagctaagcacagctgtttagacgtgcatacctacgtgtagcacaatcatattgtacttagaactaattaatcatagggaaaaaaaatgtaatctacagagatcgtgccaactgtgcctttagcaaagcacggttagcaacgacaggtatatatcgcctctcttccagttgttattatggcagctaactaattggcctggagggttcgagaagattgcgttgcatgttcaccacagcaatattttgaacttgcatgattgatttgaattaatttgagccttgatgggttcataagcatgattggttcatgtatttattagttcctgtatttttcatgatctgtggttaagggtcattgtgtatatatgcgtgtacttcactgcttacctaagagaatatttgcatgtattttgtatattcgttggaaaacaatagctagcctactaaacttttgtgttttagcagaagtagttggacatagatgctcagggggtgtcactgtttataagaattttattagtgtaaaagcaactaacactattctttatgttgtgaaatatttgtaagaaattgtgattgcatgattcctagatcactgtgatcacttcatacgtacaaaggaaatatgattacaaatgtatcttcaatcattgtaagatggtgctcctaaatcgggtggcttgaataattaatatcaagtgttccagaataaatagttgtacaattaggaatacatgtacaatgcattttttttgtgggggcagatgattacatatgattgatattctattgccaagaattttagggtgtgaataagtgttttcttggcaaatgccatttgcatgtcccattgccatggcaaatgcgctggcacaaagaggaaggaccttaatatttctcctcacgaaaaatccctgcaatttctcttttaattatgaggaaattgcaatttctgtcctcaagaaagcaacaaaaaaacttactatttggatggatggttggttatcctgaataataacctgatttgattgtagtgacacaaacagcatttgcaaggaaagttttattcagttggtattaaacaaactaaatcttagctcatcagttgagtgttcagttatcacaagtaacttgacctggaaaatttgattcctggggctccctggttatctttttcaggaagccatttctgacctaattaatttgtgtgcaggaaacagagtagaagtacaccaccattgttgcttgtgtgctgcacacactcaagcatagcttgctgactagaactaaaaaatgcttaaaaaaataattttcgagctaagaattggtgtgttgattgaggtatatgcatcagttagctggtctcgttacctggctcataaacaggtgacagcaaatgagggctgtcatgtgacaagtggatacgaattttaaaattatttaggacaatagagaatggcctacgtttttgttttgttttctttcatttcttttcatggtagttatcagtattattagactaactcggcagtttgtcattcaaaatacaacaaacattggttttaaaaattttgagtcttgtgaattctgtataaaacattttattcgtgcttataaaattcataaaagaaattcttacatccccaaaagatcactctagacacgcatgcttcttctacttcttcttcttcttcttattgacgagtgtggaagttctcaccatttaccataatttgcgagaatcacttaagaaatactttgctataatttgcaacacattgctatagtttgcaagaatcacttaggagtacaagagaacacaacaagacttctcccttaatgtagacatacatggcgtacattcgatgtggcaatgcatacggtcacttgggaaggagaggagctgtcatgctggtagatgtaccattcatgccagcacattggagtacaacaccctatttgtgtattctccctcctctcctctcctctccttaaaactctagcaataaaaatcttggagaagatcacaagagtattctactatagcaaataataatataatgatgcaagttaactaaacaataataccagcatggctgctggattttgtccaacctgagaccattaggtggcactatggcaggttagctggggcattgttccattaaacttctgattaatccaatttctttttgtgattgcgagtactctcttggcttcttggccaggatgaggcgctgtgattggcttgggtgtggttgcttcttcgaggtgctcacgctacttctctctcggaaggtgtgggccccaccgtcgagcaggtgtggggccacacgcaggaatgccagtgtcatggacagtgttaggattatctatctggctgtccctgatcttctgtgggggcaagggtgtgtgttaatgtgtaggtagttatagccgatgacaaaggtgaaattttaaatggcgtgttaacatattgtactcgtgatgtgatcgcacgtattttttctcgatctatataaagaaatctagaacaattcggatagtgatatattagttaatgctatttagcaaaaaaaatcaattgatatttagttgaattaatttgctatatagacaaggtggtagtgttacaatgaagtttgaccaccaactgtcattgagtaaacactattctttaaaaaaggtgaaagttatctaggagagggatattgtcctttttatatcattctaacttcttccaggaaagttaccagtttgatgtgaactcgttatcaacgaatgtcaaaattaaagctaacactatcccagaatagttattctagtgctaaaaaggaaaaaatatattagacaactatgtgatcttctaggaaaacaaggaacaataaataactcattaaattgcataaccatatcacatatagtttattaatatctaaattggacttttcgattttataaaataacagttaagcataatctatgaactcgcttggttgtgctagctatgggcaataccaatagctaagccaagccaaatttcttctagcaataatagggcggctgcactagccggctagccctatatttttgctaatttttccttatgtctttttttttgcaaataaattacttaaattaaaggggtgttcgataatgttagatgtgattaatttacaacctacagctacagtaaaaacaagaggatctatggtggcagctgcagctacggctgtacaattgcaatgtagcatagccgaacatcctctttgtaattttattggcatccattcagttgataaagaccacagagtcatagtaacacagaggatcctagcaaaaatactcttcctctttctctcccctccagcgcagcttgcaagcctccacgacccaccatcatgtcatccgtggcttaatgacaccccttccataatcttctccattttgacacttatgcccctgccacctcactgcaaccatggtgtcatctgcaggggtagacatgtaaatctctcccaagttcagggtggctttctggccagcccattatatatcactctcatggcaaggtggctcctgtactactctgcccattgataggctgctggtgatcacaagctacacaacacatcacacaagcaataggcatctctctcttctttctctttctcctccttgcttcatgtaagcttcttcttctctagcttactttgatcatttccatggtttcatgcatgcatgtttagtttcatgatatatatgaaatatcctatggatttttgttctgtactttttttaagaaggggtttttgttatggattttttattgctgttggacagttggagtactagagattaatttcttgaaggagagaaatgacaagtgtctggaagaccaaggttctcactggactcaacaagctctttgacaaggatggaaagaaggctgctgctgctgagttcttgaaatcattcaacaaggtagctacgaattcatacacagagacacttgaaagttgtaagtatagtttgtgtttatttcacaattttttttattgattgggtgtcatatgtatttgtgtaggaggagattggcaaggagattgatgacaagaagacagagctagagcccaaggttgtggaggttgttgagtcatctcctcctgagattaaggtaataatttttcaggtgtttcataggttgcttgaggacatccttgctcaagaaataataatttgcatgcttatctgtaaaaatattgcaggctttgttgaaggacaaaaaaacagccagcaaaatcaagaagaacggtcctgcagtcactaagttccttgaggaattggctaagattggtaagaattggctaagttctaattggcttgtatttgattgcatggggtattgactagaataatcacaatatgtaacttgtcccctttttttatattttcgttcaaaaatgcatttttaatgaaaataaagaacctttatcacttatttccaaaatgaatcgtaacataaaaaatgagttatttttttaaaaaataatttaggtgtcatttatgaatcacctttttttcccttaaaaaatagtagaatccgtagtttcttttagcaatcatgtttattcattttcttatgtttttattcgatagagacctatactatttgccctctgagcaacaatctagactttattccctcttgctagaaaattgaacttcagaggaatcttctcgtctaccatgtttccttgaacagaatctcacatgcaaactccgtttctttagctgacgcagacaagaggccaaaccagtcgaacaaaaaacaaacgaaactaacacagtttttttttattaaacttcagccacttatttttccaatcatatataaaaaccaatccttttatagtggattaattttatagtcttaagaggtattgggaggcatcaatatttttaatacaagttttggtacctcctaatactggaggtatagaaaggtattaaattttacattaagaaatatcggtaaaatcaattttttatatatctgaaaatatttgaacatgtctgttcctgaatagacatatttgctcgttaggtagtcctaaaaattatataatttttatgcaaacaataaaagatattttaaatttccattaatatttttacaatgaaactaatgcaatcctctttttttttttcagatttccccggagccaagccggtgagcgacgcggtggccaagtccggcacgacgccgctctccccggcgatcgccttcatcctggagaaggtcgcgcctttcgttcccaaggaggagcccaagcccgagccggaggcggaggcggcggcggagaccacctcccgggaagtcgccgtggaggaggagaagaaggaggaggaggcggcccccgccgagcccgccgccgccgccgcggaggcggcggcgccgtcgacggaggtggtggaggagaagaaggaggaggagaagccagcggaggcggcggcgccggcggctgagccggagaagcagtagtgatcactccagaagcaagcaaagctaagctagcttagctaagcttagctgatggtaattaaaatcaagattaaggttaatgtgatcacactactctctctcagtctctgcacaaaaagtaagtaaaaatcaagatacacacacttggcatgcaagaacatttgttattgaattctttcaccctttgatcctttcatctctctcctatatatatatatggtcgcctcatcggttgtaaattaatttatgtggggtttcttgttttttgggggtgattaaacatgtgtaattatattcatatgtttgttggtcatgatcataaggagcttgtgtatattatccatatctttttttttcttttgtttacaaattttcggcttgaggtgtgatgaagatagacatatatatgcaccctctccaattgtaatacaaattaatggctgtggatatatgttcatatggtacagtttgttgttgttgatccattggttaccttggggggagaaaatctttgcttacatgtcgtgatcaacttaatttgattgcgtatacatactacgtaaacaaaaatatggataggtgggaaggacatgtctggcctttgcaattaattgttccatgagtgataccatgtatgatatgcatcttctcgtacatactagtacgtacttcatctgacgtttggagcaatattcaatcaaatttgtagaattttgaccatcaaatctaatgatattatgatgccaaggcaaatctaactcaaacatttggaaaattattgatagtcaaagctttaaaagtgtaactaaatcttatcctaaatgtttaattcggatctatagaatcttatcctaaattcggggtaaaggcattatctagaaaattgccacacatatagattgttgttctgccggccaataaattaatttgaccatggtatatgtataaaatctagtaacaaaagtgtatttctcaaatatcaatattacacatatatatcccatatttatgtatcaaacgtttatacataaataaagtccaccaatattcttttaggaaaacatcaacgcgtcatatagaaaaaaaaatcaaagcttgaacattggacttcaaagctactggacctaagtaatgacatcaccttgatatatatatatatatatatatatatatatatatatatatatatatatatatatatatatatatatatatatatatatatatatccaaacttttcctcacaagataagcacgaggaataatataaattcagtgacaaataagctgggcactactactactgctgcatgtgtaccaaatcatggcacggaagcttaattatttagagataattacttaggaacctgaagcaagcaagcaagcaagcaaactgagccagatatcaatcagtgccaggcgaaaacgacgtgagcttgatcctaatcacgctctgcttcttcaatcgatcgtcactgcacgcatatctttaaaggggaaaaagagagagagagagagagagagagagagagagagagagagagagagagagagagagagagagagagagagagattgagaggggagttctaaaaagaaaagagttcttaaaaaaagattgaaagggagaattaattaattaattcaacaaaaagagaggacagagagtgagggctcaaaaagaaattaagaaaaggaggagtaaagatgttgattgatatttaagttttgccttgatattttcttttgttgtttaggacaggggcaaagtagtcatttcagctctttaattttttttcccttctaataccttgggcgctttgtcgctgttttagttcatcactcaagcttgcatcacaaggtccacacacatggagtacttcaatgacaatataccctgtcgccaggaatgtcaccgtgaaaaataggctcatagtatgattaaatctagctagattattcatctattggcttaattaattgggatttattcactttttacctatgaaataacttcttgttgattcgcttcgtctggttctatttactgagagttaggctgtgtttggaagtattgtttaggtgggctaattctcttttttcaccgttaacatgctttccaaactacttaaaaagtgtatttcgtaaaaagctttctatatagtttttttaatcaaataaattaatttttttcaagtctgtagtagttgataattgatcacgtgtttttcctagtagttacatataccaagttcgtttagctagaacggattagctgcaaccgagcttgaacataaacagataaatacaattgcttacagctgaatgaattgcacaagaatgatgtggctatttttaagtttatgcactcggtagaaaaaatgggaaagattcataggaatctaaaccatagggaaagctggttgtcaaaggcacaatacataataaaccatgggagctagattccttccattggtcgttttcggaaaggataggtttttgataaagacaaacaggggatggaatattctttttagtggtatttacctttctttgactcgctttagtttgtctttatataatttgtatgatcatattatctattatctagggagtaaataccataaaaatatatttcctaagaaagtgtattatagaaaaaaaaactaactcg

SEQ ID NO: 66264 - DNA, 2002 bp, Oryza sativa
tctgtgaatatctacatggacgggaacttcacgaaatatcttcatctggttattttattttaatgaaatgcttctataatatggaagtaataaagcactgcttctgtcaaaataaaataaagcattatattttgcttgtgttccttcaatgtgatcacaatgacttctttttctttcttttgtgcgattaaattgtttccacaattttggattttgtcaagcatgatattatctgatatctttcagtatgttatattagtttgaattttactcttggcatttacttgttatggtcaaggcatcaagtgctattttacacatacctccatgtacttggcagtggttctttatcttattgcttaggaaacgtcacatgatgatgctaagtaacttgaatgaaacactcccatcacaacgtgaatcttattttttagccttggggacaatcactgtttaatgacctttgtgaagtacaatgtgtctattcacagttggataatatcaattaaactgtaaaatcattcatgttgaaaacagaatttatgaaattactcgctgtatatacaaagtatcagtcttctgtacataacgtttattttgtgtaccccatgtttatcatgcaactgctcgtttttatttatagggatctgggcatgaatgtgctatccaattccgtaaggatctgtctcggcttccagacatggagcgcctacttgcacgccttttttctagctggtaatttagtattatatgatatgcttaataattagttgaaatatctcaatgtaataagctggatttatgtgccttttggtttgatcattcattgcaatcttactttttctactctctctctcggtgtcttactttttctactctccgtgtcattctagcaattttcaaacaaaatatgtagctatggttaattaccaagctacccctattaattacagcagtactaatactcctttgagttgaaggtgtggattacaatgagtggtgtagatgcattgatgaggggtagagagggaagatttagccaaaaaatgctttggaatgtgagattgacagtattttgacataaagaaaaaaactagaaagacaagtaatttgaaacagagggagcacttaaactctgcaatctgctagctcattgtttaatctgaatgcttaaggctacaacttatttgcagtgataagaatggaagaagttcaaagtcagttgttctttatgaagatgcatcaaagagactgcttcatcagtttactgctgctcttcgtggttgccagcagatgttccaagcatgctcttctattagtatgttgacaagcacagatggatcttctctattaaatgatttgttatcactaggtatgagctgagtaactgaattctctcactagtttctcagtgcacccatatgtgactcttttgatcttcaatatcatttccgttggtctggttgcttattacattgtttcaattacatttattgtgtaatgtgaggttgcatgtgttaactgtttacaggcaaagggctaccacatgtttcttctattctggaccacttcagagatgcatttgattggtcagaagcagacaggaatggtcggatcatacctcatgaaggttgtgatcctcaatatgatgctgcttgcattgcaattgaggagattgaatccagtcttcaaaaatacctgaaggaacaaagaaagctattgagtgattcatcggtagtgcatgtcatgcttttcaaagtttccatagtttaatactcattggcaatttttaataactagtgagcaacggtgcaggtaaaatatgtagatgttggaaaggatacgtacctccttgaagtgtctgagaacctgcgaggttctgttccccataactatgagttgcagtctacaaaaaaggtaatgaaaaggtgttttcctgtacttgtgcctagcctttcagcctgtccattttttttggttatttattttctttagttggatg

SEQ ID NO: 66265 - DNA, 1042 bp, Oryza sativa
tttggccaaattttgttctctaacacctatgtactgagttagtcctacagtatgtatgtagcttcttgaaatgttcctacttcctcaacacttgtatatgaattagaacttcaaaatgtagattatccatataccatgtcagtgctttatttctttttaatgctgtagctcatttctcacattaaaaagctattttttctgtttgacaattatgtataacaattcaaaacttctgaacatcccaaaccactctgatagcagcttagccattcacacgtgttgttgaaaaattactcataactcatgtatatatgcatgttaaattctcagtgcttgacgtaatctgttgcatctcacaaacagatcatttatgacggtgctgacactcactacaagaattctctgaatgttttaacgtgtactctttgctgacttgagttgaaaacatctgcaaccaaatctatcttgtagtcattagtcaaggactccacataaaggatttttatttatgttcgtactttgagattagtttattgatatttttatgatgttcgctgacatgtaaatccacaaactaaaattctttcctgtttccccttattacaggaattatgtgatccaatatgtcctggatctgaaaattccttttgcaaatgcacagctggcatctctgtttcaaggaaattatgtgtatctttcgaagcaaaaggtgggcagcaatgtggtggagaaatgcttgaaggttttcccagatgatgacaaagctgccataatatgggaattaatctcagcctcccattttgagcaactgctgcaagacccttacgcaaactatgtcattcatacggctcttgtgcagaccagggtaagtactagttcttttgaatttgacagcgcattatgttcaacatcttctaatcttactgttcttgatagggccatctccgcagcgctcttgttaacgcaatcctcccccatgaggaagctattcggaccaatccctgttgtaagagaatctctaaagtcctctctaggaggtaag

SEQ ID NO: 66266 - DNA, 1196 bp, Oryza sativa
cagagctaagcctatgaacagatatctgacatgatcgcatgaacatgccaatcaattacgccgtgcaaatcgatcgatcgatcgaatgaaatcaggcgtatccgcccttccacgcggcaccgcgataggcgccgcggttgtccctccggttgttcctgaacgcgcagcagccgagggagtagacgatgacgatgaagacgaggaagacgatgcagacgacggcgacgcgcttccagtcccgcttcagggtcgccaccgcgccggccttgcacgactggcagttgtagcacagctgcgtgccgtcgtcgacccacgtgttgcagtccgggtccgacgagttggtgggcaccttcgtccagttcgtgccgctgacgtagaggaagttgcagctgctgggtggcttgcagcatccggactgcacgcagatgagaaggaaagagatgtgaggtttgatcagttcagaattgtatcaacacacaccaaaatttaccagaattatgtgcaaattctactttgtatgattacttcaaagttttcagttatatttctcatggaacatggttttcataatattgcagttatataattctttcttaacctactcatacagatcaaatggtttaaagtggatattagaaaacgtgtgctactatttcaggactgaaaatttcagacatcttccgatagaatactctgttccgatagttatcaaatggaaattttcgtgaggcagttgagttttgcgacctaaaagtttggtgaaagggcaccggaccgttgaattttgaagatggcgccaataaatttttccccttgatggtcagaactttgggaagtgttcagagaaaaggcatgctttgagttgaagaaactccaccacaagatagtctaatcctcccgttgacaatatcaccacgagtcatgaagcagtataaaatgcctagtgattcctaatctaagcattccaaatatgtttttttttcaaaaaattattctgattattcgactatgcgacaattgaatctgtatttcttgagaatgattcatattttaggctattgttttcaggtactcttataaacagtacgtgagcagtatgacagataaaaagaaacgatgtttgcgtagctaataatgcacccaaatcaccttatcagaattaatttccattagaaaaatactacccgggctgcagg

SEQ ID NO: 66267 - DNA, 3287 bp, Oryza sativa
catgtgttgttcacaagaactttggtaagactttacattcttagcatatatctaggtgcttgattgatctcatgtaatcatttacagttttacacaaaggtaccatacatataattgaacatgattttacctgttttagagacacaggaaaagtgagctttccacagatttccgggctttgcactatatccttacatatctctctccatgttcggcagactgctgcacaggcaacaacatctttgcgggacggccaattgctctctccttcctccagtcttttcatcacatcacggagtaattcaggaggaagaccaacccatctgctttgatctactactacaggtctgtcacgcagctcgctcaaagatccaagggacttccctctgtgatggccagaaagaccagggaggcctgaaattctcacctcgaaactccgtcttgataagctcccgaagctgtccctaacatcacggactatgctgcggaaagacatcccttgtgaaaaatgcacagcgaccaaactttcacctgatgccgcgtgaccaagatcttccacttccaattgagcttagcagcactgcatatgcacaagataaaacatcagcaactgctgagctcctgcaatcagaaagtacgtggagaacaaaatcacagtagtacaccatggtaataccttaagtaatcttgttctgatttgcaaatcgaaacatcacccccaaaaaagtaacctgagaaggacaaaagtgattactcggtgatgtcagagcaatgaagaccacaaagcagttagtgccatggaataaaactaaagcatccaccatggaagatgattagtagcattcaacaaggaatccaggacaaataatccaatcatgtagattaagtcaagcctactctagagcataccattcccatttgaatagtctaaagtggtgggctaccgcggttagtgagtacaagttattgtcacaaacttaatacaagatctcaacgtaggcgaccaactccgtgatggtgaaaggccaacaaaaggccgcgttaattacaaataatctaattacatcatacaccagcgttgtaaaattttgaccccttatctgctgagactagagaggataaaaggttggctcttgttatcccaactttgtgatgtgcaatagattgcatatgtcctatgttggtgaggagaaattctaagatctgcaagaactttgcacaaggggtagggtagagaagcgaagcgctgtttgagtagctagagaaatgaattggataaatataaatgtttctgtatttttctatgcgaagtgcaaaaccaaattggacacaagaagagaagaggaaccaaaacagaatttctcctgaaagacggaggaggagatggtagggatggaatcaattaatcaggcggaagaaggaaaaggaacatccgtatcttaccctctccaaatcaagctccccaacttattcagaaacctcaaatgaaatcagccagtcccccttgcaaagatccaacttttgcagcagaaaacgtggcaaaggaaatgaatctgcagaaagcggccaactttgcagacagacagaaacctgggaagagcacaggttcaattcctgtgtgtgtcggctgaaattaaccttggatctgaaaagaagaagaagaaaaggaaagcaagcttccgaccggaagagaaggcaacctcctcgatggtactggtatatggttgtggtggtggttgcaggtgcagagagggaagagagcaacagtgtgaagcagttgagagagaaacagcaaggggatggatcatggatgaactctttatattatcattatgacttatgaggtcgattgagatttggcaagatacgtactagtagcactagtgtatatatatatatatatatatgaaaacattattccagtaaacacgaatatgaaacgatttggaagataccgagcaagtctatccaactaacctcaaccaataaataaaatgtcacccaaccaaccaaagttaattagtagtattgtttactttttgttgataaagagagcgagtcgattagctcaagctaactatccggtgatgattaactggtgggccgaattcctgaaaaaggaagatagaggaaggcctaattttaacgggctgcatgggcctcacctccttcaggctggccatgcccggttgcttgttgcgtctctccgtcgtcgtctttttttttttctaaaggcatgctcgatgtacatgacctaccttaatattatcgtagggcctataaaaatatatcgtcatacacataatgtatatgataagagaagggtattaagatggatcccaccaacctaagagcagacattgagagagtgagagagagtagcactaccgtaaaagatagaagagttttttcccttgtgggtagtctttatgtacatatagctagctcaacgaaatacatcccataaagactactctcacaaatatataaggtctattttagaggcttaagacaccggctattcttcctacaatatcattcctctccttctcaaactccttcatgttccaacgctctcaggtccttggactcggtgccctaaccttggggctatagcggtggttgggtgatggcctagaagcagtggcggatctagaaaatcgattcgttggtgttataatgtgtctatcggtgtcatagtatgctgataatacttagatcatagtgttataatatatagataagtagttttgctatagattttgccgaaagtcgtcggtgttggctctagtactgtagatccgtccctgcctggaaggtatcgatgggtggctagaaccgaacaggcagatggatttgagtgtttggggataaaagttttatgtctttttgtataaaaagtggggttggattggaaggttttgggaatttgggtataatccctttggtaattatgagatgaaagtttcatggaagagttttgtgatttgagataaagttttatatttgaaactaaaaatttatgattttcgaaatgaaagttttaacgcacggttaaaagtttttgaagcagagtccgacttgtgtgaagcggcaagcgtagtcatgtgtgcgtgatttctgttcgtggcgcatatgcatgcgcgtgccagcatctcctagaagatagccatatgcactagacgccatgcatgtaattaagataaatactcctagattggaaagatcgatatatatgtatcaccttaattagtacattgtaattgatattttttttctgaacgaat

SEQ ID NO: 66268 - DNA, 647 bp, Oryza sativa
agaataaacttcaataaaaaaaacttaaaatcaactttaaattgaaggttgaaaattaaaattttggctgataagtacttcctccgtttcacgatgtaagtcattcttacattttccatatgtctatctagatttattaacataaatataaatgtgaaaaatattagaatgacttacattatgaaacggagggtgtataagtataagcgataagacgtggctgaacgaagctgaggtgggtccaattcttcaaaaagttttttttttcagggcctgttcttcaaataagttttcaagaggggtcaaaatgtcaaaatttcagcttcctcgacggctcgacgccatggcgcgccgccgcggcccgcggcccaagccgccattatccgctcgacgaacgtcgccgcgtcgcgctcttcccgggggctctctcttttgccggtctctgtagggctccactaatggcgaaaacgcggcgcggcacgtcagtcgccaagggttcgggagataagaggccatccacttatccaccctagcctcctctgtagggaagacccccgccgaacgctgcgccggtcgtcgccggagtccgggctcagcagatcgaccccccgtagaggtttgcctctagttcccagacttcaatttgt

SEQ ID NO: 66269 - DNA, 2171 bp, Oryza sativa
gtcccgcatttctattaaatattgcattgttttacaatatcatgtgggatgagtcctactactcagccatatattgtttaccttatgccattgctaactcgggtattaaaatgactagatgttggtttaggaaatgcttagccatgcttagttctactagtacacaaaaagggaatcacattaaagcatagactttgattattggcatagctttggtttagtgccaccgtaatggtgttggttaattaaaatacactacatggtgggctgtgggtgcatggttttgttagtcatgcccatagcgattaaggaccggttcgcgggataccctggaagaacttaccgtacttaccacaagccagcgtgggcaacggctgggcttgtagtgtagctttcctctagccgacgtacccagacgagggtgggcgtgatggagttggttcagccggggtgtccggttgatcggcttccggattcaccacggcatgaaaggggggctgcccgttgcctgctggggacgggggcgaaccctaaggtgtggtgcgatcggttagagggggttatgcgaagggtcctgtcacggcctctttccggtatgtcgtggtggcatgtcggtgcatgggaatgtgtcgtggggctgtgtcttgtgggtacagttgtacacctctgatcagagtaaaactattcgaatagccgtgcccgcagttatgggcggtcgaccagattcaccgtgattagtctcacatctagttagctaatggaactggttagttcaggtggtggtttgggcctgttgcaacgtggtgtagcgttggacagtgattggttaatattgataaatcactacagctgttttactgctttcaactactgcttttaaatgctagctttatgcaaatgagcctttagcctcctttggatatatcctgcatcatacctcctcttccggtataacttgctgagtacagtgggtagtactcagtcttgctctctttcccccacaccagagctgaagatcttcctagtgggagttgttttgtcgaagttggtttcgtcgctgccgtcaaggattgcctgtggagtggagtcgccccgctgcagaagtcaagtttccaagtctagcttgttttatcttttccgctgcatttgtaatcttttatatttttgtaagacgtggatctgtatgtcaacaattgtcgtttgtgtaccctggctggtcctggataggggtttaatacacattcagcttagaaattctggttcgtgaatttctgggcgtgacatatgaggagagggataagccagaagccaacacacaccgctagatccatcagagattagcctagacatcccccatccggtgcctatggaggccagcaagagggatctagcaccatctctgatctcgatgagttcatattcgaggaggaagactaccccgtcatcgactacgagttggttatccatgctgccaagtcgacgacagctagataggttattccaaatattgtacttgtgtgatctagatgaataaagagcaacaccggctttggccaacaagatttagggctattatttgacaggtaaggagcccgaatctgtataaaaatccttgtccccatctcttttacctcaatctcgcatataacctggtaccgaggatccccatacatacaaataccgtagtcgcgacctcaaacgtcgacaagttgtgtgtctatataacacctaaatcggcagcaggttgacaaatctttaagtgacatagcaatcataaacaaattgaaacttaaaaaatatataaatattcaagttaacttgtcataaacattttcaaacacaaaaataaaaatatatcagctccatcatttacccgttggcttatcagccacaggtcacatgcaaaatttaattttctggaagttaattttagaaatgattttaggattttctttgttgtagtttagttttcaacatgggcttttcaattgctaagaatacatctatgaaagttttatctataagttatatttggttgcttcattcatttttccatggtttatcaaccgttgagcaaacaatgagaggctatatatttcatatcgaatttccttccaaaaaggctcctatgtaaatatattacacaattaattttttttatgtctttgttg

SEQ ID NO: 66270 - DNA, 3384 bp, Oryza sativa
attcctgcagcccctctttgccacatgaatcaaatgctgaaaatattagtatgcgaatttcatatagcagtagaacataaaagaaatatgacaaaatacattgaaaactaaaaaaattaactgtgctgagggaggcaaaactaaatgtcatttaatgtaaaccatcgttagggttgtactatacacagctttagtttcaggaggtaactgtttttactgtggcaaagggctctatagctatatgcagaacatatgtaaactttagcaaggactctgggtcaatgcatgtgactttaatcttcactggtccacgtagtagttcataacagaattaagaaaatcgatatttttttagtacaccacagtttttttcccctcatatctctgcctcatactaatccacaagttaaataaaacctggttatgctatgcctgaaggcttcccccccatagtcaagactcaaaaccacaaaccttatttactggtggattgtagaaggccaaagattatgtagaactaacatctaaacatttcttaatctgtttaacctgaactataaagaagacatcatgcaaagttgcatattcattgcatataaagccagaaatgggtggacatatttagaaaaaaggcaataacatacctactgttctgcggccttttcaccaaccacagaagaagatggtctccattttctatcaaaaggcccatagcttctctccacaatagtttgccgctcggttagtttcttatctattagctccagtaactcttgcaatcctgtccctgtcactgcagaagttttcacatgacaagtggacattggttgtgttgaactgcagctatctgtactaatagtttctggaccacaaagctctccaaaacaatcttttgatgatgatgatactgagttcattgctctcatctcactaggctcaagtgaggatgatatttcaccattgttgccttccaaattttcctctgataaatattcggagtctgttccatcatccaaggactcaaatgatgattcttctgcaggcacatcgttttcagaaaataattcttcctccttatcctcctcaccttcggtcaggaaaatctcatcttcaatatcatcagttacatcattatcattgttgtccacaatatcaatctgaagaaacaccataaaaaagtcaagttacatgaaaacccatgctaccaacaattcaccatgcaagtgtgacagtcacagccaaattaaatttcactactaaccttattccaaacttcgatcatactgttgattttatcctgtgaaacaccaatctgttgcaatacttgcagaacagtagaacgatgttcctcgatattaggagcactagaatctaatacatgctgcaccaatgcaaataaagagacatacaatcaactctatttctcttttttttattaagtaatttatcttaaaacaatttctgaaaagaaaatgtacatggctgaagaactatttgttattaaactagcaatggaaagattttagaagctgtcggagatatgggccgggggtatgcaaagtgaggggaagttaccttcccatccagccacgtggctctacagtctggccctaccccgcacctcgcgagtcgcagaagcggccggggcgcctcggggcgccacgtcatgcccctcgggctctcgcgttgccttgccccgaggccctcccccggctgccatgtggcgggggagcgagaggggaggaaacccaggctgaacagccatcaatgcgcggcgccccaactgtccctcactgcgtttaatgtggtaaggacggacgtgcggtgccgcaccactgacccacgtcaatcgggtctgaccagtctgtgatcggcctgtcgccggtcacgttcgactgaatgggcggccgtgcccccacgtcgcctctgtatccggcggagtggaggtaggtatgtcccgtcccatcgaaaagtcattcggagttccctccgtgagaggaggaccgccacaagtcttcactcatttatgagggaatgacagggctgtcccccgtgtcaggctggggggggacgttgggtcccgctcaaggacggactgctgcttagcttccgggcgaaggtacgggtcgcagtccggtcaaggtagtgggtccccctcccgtagaagagtaggcagaggcggtgcatgcggtatccccttaaactatacaaggatgaccttgcccaccgagaaaagggacgactctcagtaagcctgaactctaggagaagagaagtgggagcgctctccggagtttaggaacccttgtaacactccataatctcacacacaggagtagggtattacgctccatagcggcccgaacctatataatcttagtgcccacacgcgttttagtagcattgagggcggattcacgatctccccacgcgagccttttcccccggccgaactcactaaagggggatctcacgatctcccgctagagaggatcactcctcgacagctggcgcgccaggtagaaggaattcgcgcgcttcaaagggaagtcgtttccttccgccccaagttctcctctaccttcgacgatcatggtcgaggtcttggaggaagaggtggtggtgcacacccccattccctccgggagtgaggatgctagcgggagtcgcggcccccgtcaccgtcgccgcaactggcgaactccgccccgtcgcgaccccccgcggagggaggatcccacccggtcgggtggctcggccctctccccgcctcccggcggggggaggccacggcgcgtcggagcacgtcgccgcctgacatacggcgacggtgactcgccccgaggcgcgcttcaggcggcgggagcccttctacggcatcctccggtgaacgcggagcatcctcaggttggtgacgtcgccaacctggtcaccactgcccagcgacagctgaccgcgggtggccgttccaccgccactggtacgtcacgtacccccaccaccctctcctcatcagcaaggaggagggcccgtcggtcggccacggccttgaggcgatccacggccccaacgtcgtcgggggcctcgggaagtcggaggcatcacgatgacctctacgaggagcaggacgctcgaatcaacatcgagcaacaccgggacgagcgccgcgctgcccgcatgggagaaggcgcctcctcgtctggagtgccgcgttcctcctcgcgaggcggcccgccccccacgttcacccctggagggactgcttgtagggccttcgttgtgagtctccggaatgtccggtgacccccgaagttttgccccaacctcacggagaagtatgatggcagcatcaatccctccgagttcctccagatctataccacg

SEQ ID NO: 66271 - DNA, 9164 bp, Oryza sativa
aatctatcaaacttgagccaaaattattacaaatatgttaaaatatttgaatatatacacggtatgacatataatagggtcaaacaagtaagatataacagggtcaaataagcaagggcaaaattgactatttacccctaaattaacaccgttaactcacccaaacggaataggtgcttcgtttttgaaaaggagggtcaaataagtaaacttcaaaaagtaatgttaaattggtagttacatgtcaaaacagggtcaaataagcaattgaccttatgaatataccaacttgtcactcctcttttctttttacatggcaccgttgatcaggatgttttttccctcaaactttgatcagcatttatttaattacttagttataagtaaagtaaaagaatatcacgagatctatcatcaaaagtactttttaagtgagccttatatgcctatctattcatatacatatttccagaaaacacgaatagtacgtcctacgaattataaaagtcaatgcatcatatatattaaaaaaacagagatagtaactgtaaattatggtggatttagtgtgcatacagattgtaaagttctagggagatcgacatgggagttcatacataggagtataagataaacatggcttttattaattcctgcagccttagctttaaatcttgagtttcaacggtatctttgtgttgcgtgagatgaattaattaagcggccggcagcacctcaattggtctaataattaatctgaatatcacaatatgcacgacaaattgactttgcttagtgggcatccatatataatagcacgaggtagaactgcaattgggtacctatgcttggtaattgaacttattgcattggtttttccgacaggagtgcttgatccagtgctcctccacctccactagttgttaccagataatttttaactataagtctatggtaatagtagtatttgtttaggtttatacataaaagttgatgtattttggattggaggttgtatgtcacagaataaaaattaagatatgtcatgacattatatatacggagaatgataattagaccccaaatccaaccactgcgatacttcacaaaaaaatacgttaagtatacatgtgtgtgtatatatataaacattggacatgtttgggagcttctgatggctgtattttctcctaaaatccgaacctcccacaacaatacaaacaactctaaagctatagaccggcatgtatttatttactattctttgtctagatttattatcttagaagaggtcatatattcccttaattaaattaagttctgtaacgcattgtaaatgcagtcatcaaattaataatggttcctagttttctccgtacgttgaaatctctgtcccaaccatactagtagctgctaggtcgctaattaattaactaaactgtctcaagtttatcgagttgttaaattgttaagtgaacttggggttttcaccactgcgtgctcttcggtctaggaatctactgtaagcaagttactaataattaatactccatcgttctttacatcgtacgtgtttgataaagctcctaacttagcttcgtaaattcatacatctatgggcctgttcactttaatgtcaaaaaaaactttatatagttaccaaaattttgacaggatttcttatatagttatcaaaatttgacagcaaactaaatatagccacttttttttacaactttaacaagattgaaaatgacatcaaaatgaacaggccctataatccagagctccaagatctaaatatgtaattatgttgataatatttaaatacatcatttttttattttcaataaaacataaaatattaattactatttcctccgtaaaaaaatcaatctaggagagggtaacaaactacgagagccagtatatatgagagaaactacgagaggcagtatatatatatatgagagaaaataaactcttaggttacatttttatcatatatttttaatacaaagtatagtgataagaagcgtacgtcacgagtgagtcaccttgtttgtggagttttttttttgtctttataattatttttaatatagaagaggaagaaactgcggtcagagtcacgcctttctgtgggccccacccccaaccaaaccctcaaagtcgcagcttgcgtcatccaggtcccaacccggtgggccccaccgcatccgcatccacccgcggtgtgggggaaaatcccagccgtccgcagttaccatccgcaccgtccatccctctacgcagatccgatccctttccgctccggataagagatgccacgcgtcgtgtccccattggctggaccgctacgtgtccccattgttcacacggccacggcagatcggaatattctgaaaaggaaatactactagtagaaacaaaacccacagaaaattgaattcaaaaaggaaatttaaatccgttagtatttcaagcccagtggtcgtcgtcgtcttctccaaactccaatcggtggtcgccggccggagcctgcaccaccgccacgcacggcggctataaatacgaggcccccgcgggcgcgagcacgcaggggcgcagagggggagatggaaatggaggcggaggattggggggagagctcgtcgccgccacggccacacccagaggcagacatggtgaataaagagaaggaccccgaggagatgaagaggaagctgaaggagcgaatcctggagctggagaaggaggaggtccccctccccgacgacgcctccgccttcgtccaccacctgtcgcgcctccccaaaaggtatctcttcgacctcggcgttgacagggtggacgacgtcctcctccactggaggatcctcacccactgcgcccacccacagaatcgccccgtcttccacgcccgcttccaaaagtccattcctctcccggattccgatttcgatccatgccagaggctcatggaagacctcagcttggagagaagaagaagaaacgacacaggagacaacaccggctccatgtccatctcctctaggttggtacttcctttatttcctcatctttccatttgccttttcactttattattatgtctttatttgtttcaatacactagatgaaccctcgcgttgctgcggaaaactaaggaaacatcatgcatgccataagcacaaaacaaaacccacaatcacatacctttaaataacatagtatttgatagcttgcagaatcatagaataggccaaatatatgttgagcgacctgcaaacaactcaagaataatatgaaataaggtagatatttagctgaacaaacactgaatcagtacattagaggataataaagcatacaaatttctctctaaaacatcacaggatcgtgcaatgtttaaggatatatttgtgttgagaatgagaaaaaatgtatacctgctagctatgcatccattttttcagagctaaaatctatgaataccttttaatatcattttaattaaagacaaatctagttagtggtaaagaaatattgctcgctgagtacctgcagccaagcaagcaaatcatcagatcagattataaagtatatatgagatatatacatcaattagccaatcaaaggtaaaaggattaaagaacaactgttagtaaaaaaaaatgatttccataaagtgaacacaatattattgaataaaggggtgcatagtgataaggatcagtacaccacattctttggtcaagctcacacaaagcaagcactgcaagatctggttaatggtgtccaaacaaaatgatgaaaccaagcagtgcagagaaaagccgtgcaaactgctgataatactgtaaaacacatcaaaaggtctgggcaaagagtttgggttcctgaatgttacagaagaaacaatttgtcaaatcgcagtcaaaagggtgcaaagtgtacatatgcagtacccagtctaacctgattataagcacaatctaataaattggttgtgaaatacttacattaaaaaaggttgtgagatacttgtgcacagatggcactgatcctgttcaaatgttgtcttgcataaatctgaagcaaatcaaacaaaaataccagtacgatatcaatctcgttcatagaaattggtgtggcaaaaattctgcagtagaaacagaggcaacccaaatacataaggcttagtgtagctgcaattttgcatatacatatataagaattaagaaatcttgtcttatatattttgtcgactcctagccttaatagattccatacgatattgtatggataattaagaactgattcgatttttacaaattgtcatgtaactggaagtgaagaaacagcaatcctgtactgtcgaaagtaaagcatccccatttttccattatcttaatcatggtgatgatgcatatggttgggttggccggtcgcacggggatgatggattaagagtcttagaagctgacgatggtatattttgaggacttaaaaaaggcttaagaagatactcccgactgcttgttgctggcgatggtttcagaaagaggaatcatcccgtgggtagctagtggtaggctggtagtccatcagacaatctggagaagaggaacagacgacgccagcgaggtcaccgaaggggattggtgtgcgcgacgggggtggctgatgtgaaggagcggaacgtacaggcgtgaggagcagcagtgcgagaggaggggaagcggcggcagtgttggccgatgcgccgcacttgtgaagggatgagagcgggcggtggttgcgagtttggggatgagagcgagcagatagggaggccgtcgggatgggctcaattcagttgggctttctcgtgtgcattgtgcaagcaataaccatcaaaccgttgagttttggtccaacggctggcattcattttgatgacgtggatcaaccacaatgcaggaaattgtgtaataactacactaagtggggatcacttatatagatttataggataggataccatatatatcatactcataccttatacaccccaactagtatatagtacttactgcctactgaattcccttcctacaggtaccccaaaactaagcttattcatgagattatcttctcttccctggacaagcccaagcttcttagcagggtaataattcattttccatctcctacttctgctttcctttccatattataattgccaacttacttaccaccaatagttacttaatcttttcaacagctcactctactcttgtctgaggttggactgaatattcgtgaagcccatgtttactccacaactgatggcttctgtttggacgtttttgttgttgatggctgggacacagaggtcactctataaccatgcctgtttctacatccatctataaactctctgtgattaccagctcacatttcacgcacacagataatatcgtttactctttcattatgtgctcttgtatatgcaagtgttgcttgctcattttgcaacttcacatgcaggagacagatgatttgatcatcaagattaaggaggcattgtcgcacaaaaatgtatgatgccctttacactcaacctactttaattcctttccgtttcggtcatcataagtcatccgcatggtttttcgtctcgcttgtttcatgtaaatgcagtaccacgtgcaaagctctagtttcactcacaaggaaattaccgacatttcctaacagacttagattaattattccatgtaatatgtaggcatcaccatctaattcaacaaattcttcagcctcgacaaatcagcagaaaatagctgagctacaacagcaggttggagattctgaaattgactggaacttgctaacaacaggggaaaagattgctactggatcttctgctgacttgtaagaattatttggcacttacagtttgctaacagtctagtatgatcaccatttactatgggaataataatttacaagtttcaattatttgcacttcactgctgatacggtggtgtgccgctctatcctctacagaccataatagtttgctggcttccactgacaaggaaatgttgatgtattaccatgatgccaattgacaaattaccatggatattattaacctagttttggctctgatacacaaaaaccatataacagtattttccagtcgagtctcatctttactctgtttcacaggtatcgaggaacttacaatggtcttgatgttgctgtaaagattctcagagattctcatttcaacaatccgtcagaagttgagttcttacaggaaatacttattctaaggcaagttcttttataaactgctgaaattagcgtgtttcattttattctgacttactcaagatattttcctccaggagtgttaatcatgaaaatgttcttcaattttatggggcatgcacaaggcctcaaaagtattgcattgtaacaggtagcatttatatcttttttttccttaatatttgattggaatcacctccataaccactggtgctgaattgcataaacaatgctgttgttgccacgtgtgcatgtgcgcacataggcttaaagcagaagctagtatttaggtattgacacaaacatacatccattttatagccatctatctgatgttgttcttcaggtagactatttaattttgaagttcccatactatcaagaaaattgtgtaatatatagcaaagaatttttaattatgcatcaaataggtcttagacttgcatagttggagtcagtattcgaatgaatcatgcttcatgtcctgtctggcttactgttactgaactcacatttttgtcttgtggttggttctctttctttcagaatacatgcctggagggaatttatatgactttcttcacaagcaaaataatgttttggacctccttacgattttaaggattgctatcagtatttcaaaggggatgaattatctgcatcagaataacatcattcatagagatctgaagactgcaaacctgctcatgggctatcatcaagtatgcgtactgaatattcttctcagttcccattttcttcttctttctgatatgtggtagtgatatccaaaaattagaaaaatatatcaaggtgaccggtactattacagcaaatcatttgttatccacttttcaatcatatgacactgctttgggatgggatatttttttcttcgaattatgtaaagattttcagtccacatcttgcagatgggcaacggcatttcaaagaggattttttacaacattttatagctcaaaggggagatttcatttataaaaaatcgagttgcttaagaactttggcttcaaatagtccttgtaatttgtcagtattaattttgtttttcagttttgaactgtgaaatttcatgcctcatgtgaaaaaccacattatggtcctgaagatgtaattctgttcctttaattgaaatggactaatctcccagatttgtattgactatatctgctactggtaataggttgtgaagatcgcagactttggtgtggctcgacaaggaaatcaagagggacaaatgactgctgaaactggaacctatagatggatggcacccgaggtacagttgaccatttaatttgtgcccattgagattcatacttcttttttgttgaaagaaataacttttaggaagcttctgtgtccactataccatcctcagttttcctagtttccattgttatctgatgtgtgaaactatcggtaaaccttttgcttttgcgtggtcctttgtttgctcttgtgagttgtgaagcgtaggctccttgcatcacatttttttctggaatgggtcatgcctcctcttcactaaactctgcctttcttttaagaattgcttggtgttgaaatttttctttcagatttttgtataaccaatttgtgagttctgagtaacctaagttttgaaaatctgctgctttgtatgagatacctttttagataaatccaattcaaagtcaagatttgaaactagaaacaccaatcatatactactagataatgtggagtggataatgctgcacaaactgaaatagggcatcacttctccaacttactgttgagcgatgaaccacccatcattaagccatccatgtgagaggtgtaagttggacttcttaagttcccccatgcaggcatcactgcaacagtgttgcattatcaactttgaaagattttgggtcaatcagtgtccttggaatctaagatgcctttggaactttacctgttatgtgaaattgattgtattgatgatttgatagtgacaaataagatccagttgtaggaaaaggttggatacattgtttaccactctggaattatctttgcgtgagatgagaagttctgaccagagttttcattgcaacagtttttccattcttttggatgagaatctcataggtgctgcttgtctcaacagatcattaaccataagccttatgataacaaagcagatgtgttcagctttgctattgttctgtgggagctggtaactttgaaggtttggccctggtgtacattctgcttgagcttaattctgagttgtttgaacataccatattgtgattattaacggtaacactgtaatttttaattctgctataggtcccatacgataacatgacgcccttgcaggctgcactaggagtaaggcaggtatgtatctgattctggtcatctcgagaaaatattgctttcgttgtggtgctacctccatgtcatccactgtaaaagattccagaaaatcccaaattttttggagttgtaagggatgctccttatccatgtaaatcacaagatcaaacagaaccaaagtaccacacttcaaggatattagaagatgacagaaatgaacatgaataatgacaaactagcaaattattttgtctctgtgtttctttaaacagaaatccacattgactcattttcccacacaccctgcttagggatttcgcttggagattccctcaagtgtgaacccgagattgtcaaaactgattcagcggtgttgggacgaagatcctgatgtccggcctgtttttgcagagattgtcatcgaacttgaagacatcttacagcatgcccaggtaagaatgatt

SEQ ID NO: 66272 - DNA, 726 bp, Oryza sativa
ccttcgctgctcctgtacatgtattttactgcattctttagttattcacttcagaatctttcagtttgcctgatagagtataataatcaactttgttttggtctctggtaaaacaaaaaaaaaggccagaagtaaagaaaattataacagcctctagctacattgacctttgacatgtctacaaatcaaaagatcagtcagtggtgtaagctgtctccttaatgctttgtagcagtgacttaacctcatcctttgttaaatcaaagccgccatggatcttctccagtccatcatcagccaagtgtgacattttgtatttttgtttgtcttccaattgtcttatggttgcagcagatgagtcggcaatttcatatagactcttcatcacctcttctgaacgtccatactaaaattgctttctgaacatcctcttcttcattttcctcttctccttagaattaccctccgccgcctgattactgttcaacttccactttgagctattcatatccttattactagagccttccattgaatcagtgaccctacagatcatacaaagaagagaataatcaaattaatgtcgctaatataatccgatgggcaacaatcttgaatcaagtgaaacgaaattaagatatactactattcagacaatatataccgtacctctctgatgtgttgtttgaagcagcagcaacatcagcagctttgcaagcaaattcc

SEQ ID NO: 66273 - DNA, 664 bp, Oryza sativa
ttccattgttatctgatgtgtgaaactatcggtaaaccttttgcttttgcgtggtcctttgtttgctcttgtgagttgtgaagcgtaggctccttgcatcacatttttttctggaatgggtcatgcctcctcttcactaaactctgcctttcttttaagaattgcttggtgttgaaatttttctttcagatttttgtataaccaatttgtgagttctgagtaacctaagttttgaaaatctgctgctttgtatgagatacctttttagataaatccaattcaaagtcaagatttgaaactagaaacaccaatcatatactactagataatgtggagtggataatgctgcacaaactgaaatagggcatcacttctccaacttactgttgagcgatgaaccacccatcattaagccatccatgtgagaggtgtaagttggacttcttaagttcccccatgcaggcatcactgcaacagtgttgcattatcaactttgaaagattttgggtcaatcagtgtccttggaatctaagatgcctttggaactttacctgttatgtgaaaatgattgtattgatgatttgatagtgacaaataaaaaccagttgtaggaaaaagttggataccattgttaccacctttgaattatctttgcgtgagatga

SEQ ID NO: 66274 - DNA, 929 bp, Oryza sativa
tgcaaaaatactcttattagccaaagtactccgctctcaagtttatgcgccaaagcacaattcactatcttgaaatatccattctatgttcatctatggctatatatttcaaatgtctacattatctccaccatctttcatagctcagacgatagtaattcatattttgtacttagtacacaagttctaaaatccaaaggccttttatctagctaggatttatttccttgcacctattgtctgaaagttttcttactttactgtaaccttcaatttacttcctcctgcagagagaagatcaagcttatcagcaccagttcatattgcacgctgcattagatgttgttcaggaccttgcatgggctacaaacacaatgtgagtagccgttgatctgtcactattctgtttgctgcaaccaaagatatcgtcttgtttctcctgtaactcttgtttctcctggcttcacacaacacgttcatgatattctgcattccttttcaggtttctgaagtcagtagacagatttgatgatcttgtggtgtctgtttatgtaactgctggtcatatccttttaaaattaagatatggacatagtgaatcaatactgggaatagaagaatatagaaatctgagaacttggataatgataattctaccagcactattttaataagaatcctgccaggaaatgattaaatgtgtgccgcaacagggatttttttgtttctcacgcctgtttttattccctatgatgatcataaccattagccatgctatctttctagccattcctccatcatctaagtattgttttttttttggtggggaagtattgttatttcttaacttccagtctgatacatactagatttatgttacttcatgactcaaggagcgaggatggaataaaaagtttcttccaggaggt

SEQ ID NO: 66275 - DNA, 1085 bp, Oryza sativa
atgtatcacataaccctgggttggtattatgggctataaagtttcacgaaactaaactatttatcattttaactttgatcggagaaacacctaggggtttttcggctagctccacaaggtggtgggctaaacgacctgggttcgaagctttaccccttctaattatttgatattaggccctttcctaatatttattttaactttgatctactacacgtttgaggtctacaatcaacaatcacatatcaaatttatgagtttttttatctgttgtatataaatgttacatccatataagtaaagcttcttaaaattgtgatataaaagtatgtcaaatttgttaatgatgtggttgtgtcaaaatttatatagttttgtgagactacaatagattgggttttataaaatctattctctctctctctctctctctcttaaaaaaagttcttttctatgaccattatgctgtggcacacaacaatatatcgtgagaggatttttttttaatggaatcgtgagaggaattgcaagttcaattttccaaacggccccggcccgagccaaaccgcttgagatctaaacaatcaatcaacatagggaaaacttgcagatcgatcgtgacgagctagctgtagacgatgatcaatggaggcgcaaacatggcatgagaattgagatcgaagacgtaccgccgttcagggcatgggaccccgcctcccctgcagcgacgaatgtcgcagccgcagcggcgcagccgttccaccgcctcgtcgatcaaacgctgccgccgtactagctccccgcgcgacaggttgaatagaaagggcagcctcgtcgtcgtcgtcggcggcggcggcggatcagcgtcctcctctctcgcttgttgggatcccatgtcgctgtgatccagccaagatctaatgttttacaagaaattctcaaaaaaaaaaaaagagaaaagctttacaagggaggctaaagtaaattcggcccatttaagtgttcaggcccatttaagacttttaggtgctgacgtgggctgcgcgtcgtgacccaatggaacgggctggcttgcaactccgtct

SEQ ID NO: 66276 - DNA, 10257 bp, Oryza sativa
  unsure (1)..(10257): unsure at all n locations
gccccatcgtcatctacttttctgagatttgtatcaaagttgcgactgtatcatcgccatctacttttgtgcgacctggggataaaaaggagagaaggaagaaatacatattgtacctcaacaggagagagaacatacttacgtacgtacatcagccagagttggaactgctaccacctgttgctatccaaaacagagaatcgttgctccaaatgcaaatgatttcatttttatgatgtcagtaatactaacaattaacagaggaacagactacagagcccacggccggcgccacagggcacatctgaacaagcgtggagcccatgtgctggacgatgcacacagccatttatttttgttcctgaaaaccatatgcacagccattaactgtaaagcacatataaatacccaaggaaacaaacaatgttgttacagatgtcattgtatagcatggacgtgttccactgttggatgaaaaagaagcagcgtaacatattactcggccgcaaaattggagcggcgcgagaagccctttcggcagcagcatgcacgagcacgacaccgagcatcggccaggccggccccagcaagagcaaagttaagctcgcccagccggcaagcaacacggaacgcacgatcccctgctcacgggtcgaattcgaagcagcagcagcagcagcagaaggagaagcttcttaattcgttcgcgtttaacaaccccatccccgtagacgacgacgaggaggagaacgatggcatggcatggcatccctgtcggcgtgcagtaacacctcactctgctgctgtcccgacgttaacctctcccctcactgacgctaagcacactggcagtcgcgtactacacgcggttagagcgagcttccattagcccccgagaaattaacaaaaagcaaaagcagaaggaaaaaaaagaaaaacgtcactcgcatcacatcacagcactagccgctctctctctctctctctctctctctctctctctctctcctcaccagattctatataagcagctcgtccaaccttgggaggcacccagcagcagccagctagctagctactcctactcagcagcagcagcagctcaggtctctccagtgttcttcgagctatacactagctctcacagatttttgctccgactcatcaagcggattgattcgatcggctgttagagagagaaaaaaggagagttggagatggtgagccaagtggtcgccgaggagaagccgcagctgctgtccaagaaggccgggtgcaacagccacggccaggactcgtcctacttcctggggtggcaggagtacgagaaaaacccgttcgaccccgtctccaacccttccggcatcatccagatgggcctcgccgagaaccaggtacgcacacgcgcgtgccacacctgcatgtacacacttgtacatgtgtgtacactgtctctgacgacatggttgctctgccttggctgttgcagctgtcgttcgacctgcttgaggagtggctggagaagaacccccacgcgctcggcctccggcgagagggcggcggcgcctccgtcttccgcgagctcgcgctgttccaggactaccacggcctcccggctttcaaaaatgtaattaattaaatcaactgtactctggttcgcgtacacggtcgtcaaaagttacagttggctaaccccccgagcatatgcgcacgtggattgcacaggcattggcgcggttcatgtcggagcagagagggtacaaggtggtgttcgaccccagcaacatcgtgctcaccgccggcgccacctcggctaacgaggcgctcatgttctgcctcgccgaccacggcgacgccttcctcatccccaccccatactacccagggtacgcactggcactgccgctgctgctacacctttttaccatacgcgacaacgtgcatggtggcgcatggctaacggtggatggatgggtggatgcaggttcgaccgcgacctcaagtggcgcaccggcgcggagatcgtacccgtgcactgcgcgagcgcgaacgggttccgggtgacgcgccccgcgctggacgacgcgtaccgccgcgcgcagaagcgccggctgcgcgtcaagggggtgctgatcaccaacccgtccaacccgctcggcaccgcgtcgccgcgcgccgacctcgagacgatcgtcgacttcgtcgccgccaagggcatccacctcatcagcgacgagatctacgccggcacggcgttcgccgagccgcccgcgggcttcgtcagcgcgctcgaggtcgtggccgggcgcgacggcggcggcgctgacgtgtccgaccgcgtgcacgtcgtgtacagcctgtccaaggacctcggcctcccggggttccgcgtcggcgccatctactccgccaacgccgccgtcgtgtccgcggcgaccaagatgtccagcttcggcctcgtgtcgtcccagacgcagtacctcctcgcggcgctgctcggcgacagggacttcacccggagctacgtcgcggagaacaagcggcggatcaaggagcggcacgaccagctcgtggacgggctcagggagatcggcattgggtgcctgcccagcaacgccggcctcttctgctgggtggacatgagccacctgatgcggagccggtcgttcgccggcgagatggagctctggaagaaggtggtgttcgaggtcggcctcaacatctcccccgggtcgtcgtgccactgccgcgagcccggctggttccgcgtctgcttcgccaacatgtcggccaagaccctcgacgtcgccatgcagcgcctcaggtcgttcgtcgactccgccaccggcggcggcgacaacgccgccctccgccgcgccgccgtccccgtcaggagcgtcagctgcccgctcgccatcaagtgggcgctccgcctcaccccgtccatcgccgaccggaaggccgagagataatcgccaagaacaaaaccacaccatgtccattactattaccagtagtagcacatactagtacattactacgtcacagtacactatactagtagcagcagtagcagattcctttcgtttcttgtaatcttttggcgccatttttttttcctcggatcgaggcgtgcatgcccgatggtctcggatgatcacatatcgatccattccatcagccggcatcggatcgatcccgtatttttcactgggaattttcagttttcccccgacactgaatttctcccagttgttgtaacctatggaaagtattattgctcgtcaataaaagctagtgcccaccacttgtagttcacgactaccactcccacatttgggctcggtcgcatccatccatcgcgtgttttcgccgccgctgtcatataaaagtcaaaaccgttgcagcgaaaccacttgggccaatggcgttttttaacccccatctgctccgtattgcatgcgaccgaggggattgagagaggaggagtatatagcacataaatactcgtagtaataacgcggaggtctccgggcttgacgtaacgtggtagttaatgctaagttgttaatgatgctgttgtgtttgccgtccgcggcgggcggcggcgtgcccacatgatggggatggatggcgagcgaattgacggcagtgatgaccactagtcgttgatcaaggaaatcgccgcggcgagtgtaggcgaattgactttggagttgggaggccgggacggccagttgcgccctgcacggtctggttgggagctcgatgactcgtcggctcgcggcgggatcacgtgccgggcgatctttagctcgttgatttagggcatttttatattgtagccaaaataaactttatcaattttagtattgctaaactttttacaagatgataatattgctaaaattttgacatgatttattatatatttactaaatttggcaacaaactaaacgtagatattttttagataattttaccaaaaaatgctatggtcgaaaatagcatcaaagtgaacaggtcattggatttcggctgttttctctttcatctaggctgtgtttagtttctgcaaaaagttagaagtttagagaaaagttggtagtttggaaaaaaaattagaagtttatttgtgtagtaaagttttgatgtgatggaaagttgtaagttaagggtagttagaggttaactaaacatggccctagggtggctggaattttggagtagtccccattggttaggagatataaaatctagcctttaatgctccgagaaatgcttccgaatgatagcggcacacacagttgattttgtaaggctactgcaatgtcaaacggagactttttggttaatgtgctcggtagtgatactccgtagtacattatttggttaataagtgtatgtgatgatgatattgaaagctgatctgcgtgagctgatgtagaacgcagcggagcacttgaagcaagtggcagagagtnnttttttttttttttttttttttagcaaagggtttcctaaactgtgatcgcggttaccgcggggtacgataaaagaaaaacctcagtaatctccttaaatttaaataaatttaaaaaatattttaaaattttatatggtttcgtacgatttattacggttactacgcgataaccacgcttaccgccaggacatgaaaaccccgggcctggtgatttgggaagccatgcagtggtactgctgctacttaccagctctggaagcctgtaacttgggactgtacattgtcattcggggttagcttactttgtgttcacactatcttggtaaaagaaaaaaaaagctgttcgtttggtatcagtgttcaggtgtgctggagattattaatcggactgtttagtgtcatggtttgttttatcgctatgttcttttgtggcatcaatatatgatgccagggcttatatatcaattgttaatttgtcccatagaactgtactaccagagtgtgtttagttcacgctaaaactgaaagtttggttgaaatcggaacgatgtgacgaaaaagttggaagtttgtgtgtgtaaaaagagcaattttacggtctttgaggaggtaccatgaggtaccattttttctattgtaaatttggtacctcttggtacctatgtgctatgaggtaccaaattttacactaaaattttggtacctcatggtacttcctcaaggaccgtagaattgctcgtgtaaaaaagttttgatgtgatggaaaagttggaaatttgaagaaaaagtttggaactaaactcgaccctagtcatcttgatgtattcatcacaatcttagccaggggctgattcgacgtggatcccccctacacccacaagattcatggatacccccgtgagcacctctttgattttttttcaccataaataataaactaaaggtccctaaatgattggaggttgaagaaactctataattgagcctctctaattttttttcctagatccacccctaatcttagcatatatgtgtacgtttcatttcaatacctagttcgcgaaatctttcgaaaatgttgactaataggacgaggataaagagaaaatcacccgacatacccatgtcaaccaccgatatgactcattcacttgataaggtgtacacgactcttccatcttattcaacgttttccattcgctcaaagtctagacagtaaggaagaattccacttatccaatgtttgacgcagtagctgaaaatttttcaaagcaaagctactcgtttctactttgggatacgacaactagtcaaaaatgtttgacatgaataaccacctgatagattgcgcgtttgcgcactacaactggaaagtaggaaaaccgttcttctttcaatttagcccttatttcatagatcttgtttagacaaaaatgagactgacaatctccttcgacatgagaaaaaaacgaagttaaattactcctaacccttccttagaatttagagcatgtactatggtgtccaataacggactctctttgttgtcatgcaagtaaattttatgacctggaagaataagagggaagaaaagagaaacatcgttgctacgcatgacaacagctcagaatcgattcttagtatttattaacggaaagtttgttgcatgaggttggagaaaaggaaagaagtataataaaaaaatatttagtgcaataatgatttagaaattttattgtttctaccattgtaaaaggatagtctctagtgatattaattaatatagatagctcatattagattctacctttatatatgtccttaggtatcaatccaaacaagatccatacatagatctaaaagcattctcatctccgacggaaaagacgaaacatgaacataaacgtggaaacactcgtaataattaagcaaactagattatcatccagagaccaactatcacattcccctcatttctttcaggggaacagaggtaaaaaaaaataaaaaaggagcaagacaccctgttgctacagtatttttttcaggtggtacaggaaaatcccttgggtagtgtacgtagatgaagccaagggggtttgccaccaacagccgcgacacatgaggggcagatggacaaacaaggagagactggaacgggacaattcgccgttttcgggagatgggagacgcagcagctaaccgcaccggcatgcaaacgaggagagacctggagatcagagtctcggagaggcaggtccgagcacggcacatgggggctcacccccggccgtaggccggcggggacgagatcgacgaccgaacgaatccacaccatttggatggaaaccggcctgcccccgggcatggcgtggacgcgggtgtctggacccagaagggaaattccttgactcgcccgggacacctctgcactgtccatgcatgtgatcgatcgagcaagctgcgattttattggttggttttgctggataaccccgatctcctgtcctcaacattttggtagtttgactgagcatgatcacactttgaccgttattacgttatnccaaancgaatagctatacttttcggttcaaaaaaagacactcacctcngncacaatatcacctctactaggacaataaatatgtactacctttttccagattcgttgctttaggagggatcacatccacttctagattgagttttttttgatggagtgagtagatattacgctttagcgaagtaattgctattgaattctaatgatataactattacattgcatgtttagagttctaaaattgttgttatgtagaaatatactcatctcgcttatgaagaaagaatgtgctagtgtaacaacggcataggtctgtctagccaattgcgttgtgtaataaaaactatttttcttctaatatattaatgtgtaaattttttgcgtgttcgaaaaaaaaaagtgtaactgtggatcgatgatcgatcactcccattactcatcttatcttctagaaccatatcatgtgtctccactgtgtcaattattttcatgtttcctccacgtacctcgatgtgttgtactaacatttcacggggtcctctgatcgctaccaggagtctagctattttgagttatgaaggtgagctaggtggctgaccaatgaaaacagagggagtatttgcctttacttgtagtggaaatattagggtataaatgattggagtgaatgaatatggctttgcacaaagagggacatctagataaggtgatatatacctttccttgtacgtgtagggttgccaatatgctggatgctgcccatataatgtctgcatgtttgtatgtgttgtgatatgattcgacaatgttactgtagtcagtaccatatatcttgccttggcactatgggggtaaaagtgattaagctgacacgcaacatcggtattcacggttgaagtgtgatctttatcatctgtttattagattatcaggtacaactaaaatttaaatttaaaacttaatttctagggttttatcgtggaatgtttttctgccttattttctaaaccacaaattaacatgcataaaacttttaccagtaaaatgttaaggtcacattgtttaccctttagcttacaagccgcagctaaaatttagattttaaaaccatattttagatttgattttagcctttttttttcctttacgtggtttatttttcagcatttgttctcaaattgataagagcgtgcatgtaagttttatttgtaaattatttctttgttgttaataagctattgtggtatgtaaccagtataaacaaaatgatgattgtgccatatcgcttcattcaatatatctacgggttattagtcatagccgactcataggttaaccaatcagagaatattgatcagcagcatgagtacttctacaccctccgaaaaaaataattcttaattctagatatgaatctggatatatatgtgtctagatttatagataggattggtttttttacatgaccaatagacttcgtgccaaaaatactttacatatttctgtattttctatgccgtgccgctgcctagtgcctatggcctaccatcacacaatatgcactaacctaaccaattgttaagtaataagaggcgtggctagtctaattaccatccaagcatgtcggctatattattgatactgacgatatatagggtgtacggtcgtcctctgtttgcaccttttcgcacattgttttttttcgaccgattttgcccttttcgatgtactatatcggcactgatgatatagtgatatgggcggccactaaccacgcaaactttccaagtgcagccatttttttcgaagcttcccaggcccagcttaattaattatctacgactagatgctaatatctacttaaaaaagttttgacaagacttgcaacgaggagcacggatggtcttccacgtagtctacgcgcttttctctggaaatgctacatccatattttaatatataacgttgttgacttttttacaacgtttgatcatttattttattaaaaaattatataattatcatttattttattgtgacttgatttatcatcaaatgttctttaagtttgatatgaatatttttatatttacacacaaaatttaaataaaacgaacgattaaacgttagtaaaaaagataacaatatcatatattaaaatataaagggagttctatataggaccacccactttataaacctaaacctgagtgatacgtagatacttgtaacttgctcctgctgtttgttttctattccgctagatgcctagatcccatttccttgtaaccggcaacgattgcggtttggtatcttacgttgtgaacaaaactcaatttcttctactacctccgttctaaaataaatataactataaatatctatattatatctaacgtttgaccgtccgttttatttaaaaaatttattaaaaagatttaaaaaattagtcacacataaagtactatttatgttttatcatttaataacaataaaaatattaatcataaaaacattaaataaaatgaacggttatacgttagacataaacaatgcaaactacacttactttgggatagatggagtaatataatatactgatgtgcaatcattttgcaagttcgtgaaaaaaaatcgatacttgctcctctcaaattgatagtacttcgcattttaaataaaattgttaacaaaatttagaaaatgtgatgataaataatctttaaaatatctatcttaaaaatatgaagaccatgcatatctacattttaatcttaaaatatacttcaataaattcatttgttgattgatatttatatatattataatagaatatagcgatcacaatttttttttaaagtgaagtattatctacttagagagagcatgtactccctccgtcccataatataagggaatttgagtttttgtttgcaatgtttgaccactcgtcttattcaaaaaattttgaaattattatttattttatttgtgacttactttattatctacagtactttaagcacaactttttgttttttatatttgcaaaaaaagtttgaataagacgagtggtcaaacgttgcaagcaaaaactcaaaatcctttgtatcgtggggcggagagagtagttagtaacttactatattttaatgcttcaatcattttgcgattggtgtggctctagctagacttctagtcatca

SEQ ID NO: 66277 - DNA, 1073 bp, Oryza sativa
  unsure (1)..(1073): unsure at all n locations
ttatagtgtcaacttctccttttgacttgccttgactaacgacaattgtcaaattttgccgttaacagtttcttacaatgatctagctcgagctacatcaggcttcttcgagtaaaacctaataggaagagaaatctatggttcatagttactgacttagttctaagcacgacttagtagatcaaacttaactgatgcatcactaagtatgaaaagaaacataatatctagacnacaagcctttgattgattttcagggtggtggataccttagttaatctaatctagcaagataatttaaccgataccagtataaaccctaaaatgaatctcagccgatatgatcaaattaagatgctaatctagattaactaagatatatgataaataggtaggtaaatatatcaaccgatccagagtgatccaagagggcgaagtgatgtaaccttgaacaacatcaatgtagctgatacaatctctagggccggcgaaatgtaggacttgccccttcaccggagatcgaactgaaccgatgcagccttgcatcaggtgacaagtttcgccggttgataagtaaaaaccttgaaaaagagggtggcgatgcgccgagagtagttgtattgatctgtgagatagtttacaatgactccatgtgtacatatttatatccatgggtagatactagtccttattggataataaagaaacttttctaagataaaaaggaaaacataaagtccttatcggacactaaacacactctcctaaagataacaagaaactaatggactcttcctaattaatagataaactctgcatcctccttttgaactcggtctcttatggataaatttcctttaattcaattaatttccttaaccgaacccatcaagaatcagactactggcgactgttagtgcccatcggccgatttgtcacaccccaatccggcaccgccatacaacggcacctgacaagagcgtgtcgtaggaaaaacggcgcgaaccgcttcatacgaaaccacgatcttagtaccagtcccaggacatagcgctggtaccccggtgacaaat

SEQ ID NO: 66278 - DNA, 711 bp, Oryza sativa
gacttgggttgttgttttgaacattctgtcttaatcgagtatgttttttgagcaggcaaacagcaggggagccagtcggcgttctagagctaagatacagaagaaatcacctcgatagagtatcataccaaaggttatcttgctctttggttttcattctttttggtaaaacaggctaacttgtagctgctttcttagcaactccacagaatgtgtaatttctttaggtctccttcaaatgaaggtatatatgcgtatatatatgtacttgccgatttgacggcagtaacagaatgactgcgaattcactgttggtgtcatctgtggactgattagaagatgaccattgtttgcttcccatcctcgatggcaaagccgaccttagaacacttgtacagctgtagttgttgcacctaagtactagtacttcgtattatagtggccttcgctgctcctgtacatgtattttactgcattctttagttattcacttcagaatctttcagtttgcctgatagagtataataatcaactttgttttggtctctggtaaaacaaaaaaaaaggccagaagtaaagaaaattataacagcctctagctacattgacctttgacatgtctacaaatcaaaagatcagtcagtggtgtaagctgtctccttaatgctttgtagcagtgacttaacctcatcctttgttaaatcaaagccg

SEQ ID NO: 66279 - DNA, 1806 bp, Oryza sativa
aagatgaacaagcgaggcctctgtactgttggcaaggttcaggaagtttggtcggtggatttaaaaagggggcgagggctggagtttaatggaggaggagatgaggatagctgggtaggcgtcgaggatgcagcgggagtggccctttcgcgggaaaggggaggaagaagaagatgaagaaggcaaccaagggaagtttggtggttccagcattctgtcaaactcaactggagcggttgggctgttgagttctgtgtccgaaccgaaacacacacaagcccccactggaagtggtttttcttcctgctccacttccagctcaagaatgatgtcccactctcttgacattctaccgggatgcaggattacatgggtttgcagctaattttaaaaaccttacattagttgtgttttgtcatttgaattctgaattcggtctgtctgcaatatgtttgctcatgatgcagaaactgtttcaaccaagatgagtatgactggtgcatatgggttcgtaaaatgtcacaatgcgtgtaattttgctttcagaaaatcttgtgcagttattcttaggcctgagaagagcaatctgaactacctagccatataggggattgatgtgccaccttatgcgtggtgttaagctaatgaacacaattcggtaaaatgattctgtcagcttttgaggttttagaccaaatcactgcaccataaatcacatgacgtcagtttatcacgctgctagggaagtgaagcaagtcatacactatcgtcctctagcatgacagaaatgtgcatcacaatacattcttaccagttttctatagattaggtacgcacatatagaatacggtttcaatgaaaagggtcatcacgttggtccagaaaaccatctataccatatagtacagttcgagcaccggatgaactagttactagatactgtatggaattagacagtgacgtaggatgcacaacctgcttgaaaaagggcaaagctatcctgcatttatcatcagttggaagattgcatcggtgggaagctaagatgtaacatctgggaatggagcgaaagcccaatatgcagtaggtgcagacatacctcacccaatggtgggtcatgtgaagtaaactcagcaccaaaccccttcttgagccttggtgtagtagtagtagtagactgtgagcaagtagtatttttcgcacacaggacattggctgatgagcgatcaaatcgacactgcaaaaccctactaagataaggattggtggtgatttgcaaatgaaaggtacgtaatgggaagaattagaccaacgcatgtttatgctctatgcttacattacatccgaaataaatgttgtgttccatacttccatgcttagcgattaaataaagtatagcagtcattagttattccataatcacaatcattcaggaacaccaattgtgtagcatttctccatttagaaaaaaaagaagaaaagatttgtcgtgttcagaacttcaggctcaacaatcttgcgggcgttttcttttgttttcggaaatggtgacactcgtttcagatggtgtcctgtgtcacacaagttatgtgtgttgcacagccattcctctagcagatttctctcgacgtggttgcgtggtctttgcaatgtcaagaatggtgggggttagccggttaggctgtctgtcatggatcaatcaccgtcagttttgcaccctaattgagcttctgcctaattaatatcgtccactaaataacagtgcttttcatcaaactgttgtccggtggatggaccagtcgccaa

SEQ ID NO: 66280 - DNA, 1735 bp, Oryza sativa
cctgcagcccatagttttgcaggaaaatctataggaagctggaaacaacagtgcaagcttggctttctgtcgattgttgctctacgtggtaagcaacgttcatggtgtaatttatgaatgattagtactttctctgctacatattttgtcaaaatatatgtcattagattggtgtctggtgaatctattaggttgtgtgatcagtgtagataaatttgaagtgtcgactcttttctgaagtgaacagtccatgttgcagccttcagtgatccaaacttctgaatctgtgagtttcagctctcttttacttctgagcatgatgaagggtagtttggatgcttaacaagtgattgtcttgtaccaaatcatgtaatttttatgtctttggttttcaaccacctctccaacatcttaaaaaatgttggttagaaatcagatgatcttcaaaatcaacctttctaaagtaacttgggagtttagaaaaagagtaaagtgcacaggcggtccttaaacttgtagaggtgtgtcatctaagtccctaaactctcaaaatgtagatccaactcccagaacttgtcaaagtgtgccatataggtcccaaatcgcaacaactcctccaaaatcctacgtggcgctgatgtggcgtgccacacgaacgtgacgtggcatttaaaaattttccttttccttttttttcttttcttcttctctttttttttcttttattctcttctcttttctctgtgacctgagcaacccgtgtagcggtggcctatatctgcagtgagagcaagaaaaggagaagaaaggaaaaaaaagagaataaaaaagggaaatgaaaattttttaagtgggtctcatttgtcattcaatattatgccatgtcatgtctgtgtgtcattgccacatcagtgccatgtaagatcctggaggagctgtgacgatttgggacctacatgacacactttgacaagttctaggacctggatttgtattttgaggacctagataacacatccctacaagtttaaggaccggccgtgtattttactcttttaaaaacaattgaatcaatgttcctatctttggaggctagaaaaggagaaaacatgattattgaccctgtaaactatggtctcccactactgttgtatgtggttgattttatttttcaaagaatccttacgctttgattgctcaagtgaaactgatcatgcaatgggttttaaatcaatatactttgagcaacaagtataattagttgtttgattctcaacatgattctatttttctgtctatcaccattgttttatgaaatatcaccgtagcgttagcacgttcatattactagtatagtaagtcaattagtaattagtaggcatatactctctgtttcatattataagttgttttgactaatcaaactttatttaatcaagttagcatagcattttaaatacaaaacaaatatgttatcaaaaaacttggttaagtttggctacggaaaaagtcaaaacgaattaacaaaatatacccagatcattcctaaccgttggatcctctcatctaacgacctacattgtgagttggattagcagatggattagtagtaggattagtgaaaccaatggacaacctccttgctttgagcaccccacgcctccacttcgtcgccgccttgaaccacccctcttccttcccatgtggctcatcgccactgccatccctcatccaa

SEQ ID NO: 66281 - DNA, 1528 bp, Oryza sativa
gagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctctaagttgcacatcctggggaaaaacctccctaatccatcagcaaaccgatcaaccacccacgacaagtcgacgccaccgttttttttttctccctcctaagtcctaaccccacaaaaatcccgcgaactttcgtctcaccacgcgccgcgtgccccctacaaataccaaacaacacccaccacgttcactcacaaaccacgcaggaaacctcagaaaatcaccgtacgcgacgcgggcccaagaaaaccccgacagaaaccgcgcagcagcaacaccaccaccggcg

SEQ ID NO: 66282 - DNA, 4444 bp, Oryza sativa
ggtcgaaagaaccctcccctccccccatgctgactccgccactgcgtagacacagcaagatcacaacatcgtgatttccccgacacgttttcaagttaaagtgcgcatcctgacccatcaaccatgggtcacctaggtcacagtcacattagatctgttccaccacaggtccaaccggagttataactttagattctaggcctatacaacccaaaagactagtctgatggatgagcatcattcctatcttttaagtcgtgtttctctatcgtcaattatcgatgtgggattacacccaacaccgtcgacggcgaaggccacgtcgtcgcggaagcgagacggcagaccgcccggcgggtggccgcgcctgcagcagcatatgcagcgttcggggatgcctggatggctgggtttgagttgggctagtcacctagtttcaccgtgggcccaattcggttgggatcccatcccacggcggaagcccaagtcgagccgagccgcatgggcggcgccgctgcccaccaccgcaccaggccaccaccacaacacctcggtggctcggtgcgcacgcactcgcgcttgcggccacgcgcgatgcgacgcgacccgactttttcccccctgcgcgtacgcgtgatggcgcgtgaggacggagaagatgagacgggaggaggaggaggaagagaaggggcccatccattccatcgcccgacgcggcccgctgcggagaagaggaggtatcgaagccatagctctctcccgtctcctctcctctcctctcctcccctcctccgccgatggggaggattccttccattccatccgcgcatccgctgcctccgcggaatccgagttccgcgtactgcgctgatctccggcatcggatttcggagagggtggggtgttctctccgctcggggttgttccactcggttctgaactgggagtgtgagtgtgcagggcaaggttgttgggatttcacgtcgggtagagactaccgcgactgtcctagttatgtcagtgccgttgtatttttatacaaagcggtagatctggtggaaggatatgaactgttgcagataattgttgattctgatttgtactggtgtgacatgtgcccccatgtgttcaacttgtgtagtacatgttttctgatgcttggattgtttattcagtctggaattctacttatgtttttctgatttgtacttgctgagtatctgtgcttctagaattacctcccatacaaaaattaaatttggagctctggtttattttggtactagtagcttgttgatggacctcttatttatatctaaactaattgaccgcatcttgtattgaactagtagtttctgatgcttcagatcggattgtactctacatgataagaaagtatggcaccagcaaacaaagcagagagaaaagcagtgctggatgctggagcatggatgttcaacgttgtgacatcagttggtatcatcatggtcaacaaggcattaatggccacacatggttttagttttggtaagacatgctataattcctcactcgtggttgaattgtcaagaatgccttgtccgcacgtcttatggatagttggactaaaccgaactatcgttgtgcagcaaaccagtcagattttttgtgctaatgatgtgttccattgtgtgtttgtgcagctacaacattgactggattgcattttgcaaccacaaccttgatgacattagtaatgaaatggttgggacatattcagccatcctatttaccattgccagaactcgttaaattcgtcttttttgcaaacttatcaattgttgggatgaatgttagtttgatgtggaactctgttggattctatcaggtgggaagagtaattttaaatccttctatattcaatgttagaatggagggcacatactaattttcgtttcatgcctcttcagattgccaagttgtgtattattccagtcttgtgcattctggaaatcctgtttgacaaagtccgttactcaaggaatacaaaactcagtatagtgcttgttttagtaggagttgctgtatgtactgtgactgatgttagtgtgaattcaaaagggctgctagcagctgtaattgcagtttggagcacagcactacagcagcatgtgagtatttgattgtgcacattttgacgtattccatgccctagtgataactgctctgtttggctcctttttaaataccttggcttctgaatgagcagtttcagttcaaattacgtcgcatatggtacattacatttacatattttccaaactgttcgtgtgaattcagtctgatttatctcattctgtaatctggatttctgtcgatatttgcttgcttctaactgctgtactgattactcatgttcaaaggaaatgttcaatagtaacttgtatctaaaagagttgcaaatatttagtcttactcatttatctgctaacagaaattttgtccctcgctgctgttttcacttttaatggtgaggttttggataattagcacttgttttattccagttatttttctttcatgctgcagtacgttcatcaccttcaaaagaagtactcgcttggctcattcaacctattgggtcatactgctccagctcaggcagcatccctgttaatactggggccttttgtggacttctggctgaccaatagaagagttgatactttcaattacacaacaatagttacggtatgtgattcttgttttgaatcagttctctgcttattctcttgtgaacttgttgcattacagtcccatttggctctatgcagctatttcggcattataaactgtacatagctgtagatgaatccgttttgagttagatactgatgaccatgaagagtttaccatatcctgtaaccaccagatttatctcctggatttggtccatgaattacgatttaggctggaaaggaatattttaagttctgttttgatataagtttacagcagctttaaagatattttttttgaacattgtattatccaagtgttattagatattagagtactggcagtgattcttttcaatcccttttgtgcatgttcattacctctctataatggatcaaccacctaactgctagtagttagtaagctaccttgcacattacagttgaaacttgaaatgtgtttttacagtatggtccctccttcaaatagtacagaagtatatgaatagttctttgttgcacaatagcaattttgcttcttatatatacttcatggagattaagagatacctagttgcctacactgtttcttctatctatgaataaaattttatggaatgagcatgacatgtatggttttttatcatagcagtgcagacctgatgttcccttgacttttacatattccttacatgagcaaactgggactaatgctttcttcttcactcacttaatttccagttcttcattgtattgtcgtgcacaattgctgttgggaccaatctaagccagttcatatgcattggaagattcacagctgtctcatttcaagttctaggccatatgaagacgattcttgtattgaccttgggttttcttttctttggaaaagagggccttaattttcacgtagtccttggcatgatgcttgctgtgattggcatgatttggtacgggaatgcttcgtcaaaaccgggaggcaaagagaggcagatttactcggtgcccagcgagaaaactcagaagtcatcacaatcagagcttgaccagaaggtctgaaacaaagttgtttcactatttttacagctccattgcttagcgagcattgagaagaccacgatctgatttattctttttttttctggtaagtttaaagatgtttctgtacaactgaaattcataccagacaaacagaatatggcaggaactaagcgcgacgataatttaatttgtaatattccattgagtaactgcatatatgatggaaagatattttcagctgtgatgttccgtttactaactgcgtacataaaatcgattggtcttcactttgatattagctattccagcttagcctggcagtatcaatgtatcatgttatggcacgtggagtcggtggagaagtggctgagcaacactggtccttttcatgtataccggctccagtaagcccattccacctcataacctcgtactcatagccttatgctgctatggactgcatccaagtaattgcagacatcaaacctcataccacgttattaacaggtcaatatgtcaacaacacaacacagcaacattgaagaggtttaagagaatttcaagggcgcctccaaggataaaaataaaaaaagaaaattccagggctataaaactgaactcacagtcttcaaaatggtcatcctattcaaaatcaaacaaaacacaacctaaacaatatatcaagt

SEQ ID NO: 66283 - DNA, 791 bp, Oryza sativa
ccaatctaatagctcattcatacaatagtcacatactacacaattaatatctggtcccatctgtcatacacacattacgtcttagagtccgtgctacagctggctacaaatctagagccccgctacccttacctctcctcatttatcttcttaaaatatatttacagctggcttatagcgtgctattgtacatgctctaaggactccttaatcaatcgtcgtcgtattgaagaaagagcaattaatggccccgtaaaaccaagccagcaatttgatcagcaattctacacaaagcaattcagcaaagaagctactactactacagatgagcttacacctgtaccagtaaattacagtgcataataatgttggatttcaggcggtagctgtgctctgtggagtagagtacctcgcagcatgatctggatgatgttattagggcaggagagagagttgtgccgactttagttcatcggatttgttttcttttatatggctcaacatctccaatgcagtcgcagagtccagaggaaaacggcggtatagaagaaaactggagtattctatttagcacacagattactgctctcttcccttgaaaggccacatgctgatttgtttctcatactccttccgttttgaaatgtttgacacaattaactttttagcacatgtttgaccgttcgtcttattcaaaaatttttgtgaaatatgtttgattgagaaaatcccttatatacccctgaaatttttcctaatcccttctatacccctgaattttgcttacttcc

SEQ ID NO: 66284 - DNA, 965 bp, Oryza sativa
ttcctgcagccttgctggagttgctcttacggagatgtctcggtggatatgtggtttgaggtgctttgggttcctgcagttgctcctccaatcagcacaccagttcttttgtgtcgtgagacacatatccactaccctgcacatcatgatggttatgatcaatatgatatgttcactggctcaaataatctccttatactttataatctcatgattaatatgcatagagcatgacgataatcaataaattctactctctcagtttcaaagtacaagtattaatagtttgtttagaaaaaattgagaataaaatgaaatactttcaatgtcttttcctcagatccctccccaatcaatgatggaccaaaataagccgtgcaatgaaagatccctccccaatgatggaccaaaataagctgggcaatgaatggagtagtaaagcactactaacattttttctactttcctcgttatgtagtacgagcaaatatatttttaaacaaacagtggatgatggtacttggctttggaatagtgtcatggaaattatttataaaactgactatattttggaaatggatagagttaattaatgttttgtttatatgggcctcaatgctggccatgcaaatgaggtcttacaactcacttcccctcaaacgccccctaatttgattaagttatatagagtaaaagttatatctatgttcatgtaggtgctcatgtgttacacgtgaggtagggtgaattgcagcttgagcgctaccctgcttggtagacagcatgatctttgcatcagcgtggttgagtgcacacggttcctagttggatctgtgctagcggtgtttgttggagttcttagcgttgtcaaggcactagcacgttatggatcctcggatcctgatttcctcgtgccaagaagtatgatctataaaactatacgcagtattatatatacacatatt

SEQ ID NO: 66285 - DNA, 3290 bp, Oryza sativa
cagggatccaaaaaatgatcaactatctgggtgattagaaaaaacccctaaatccacctcgaattaaacctttaactccatcaaatacccctgaatccaacccccaacatgaacacccctgaagaaaaatcgaaccaaaaatacaaaaaccctcgtggattagaaaaaaaaacatagaacaccatcgaatctggtcgtttgcaaacaatggactagtaacaaaacaccctagactgaactgaatcaaactataactaaaaacttagggaatccaaaacctaaacggattccaaaactaaaacaagtgattctgaatcagatccatacgttgggagcaaaaaaaatcgtcatgtattgacccgaatcttctaaacctagccctattgacattgaaaaaaccaaaacacaagctaatgatgccagcaaatcagggaagaaactcaaaaaacactctctctcgagttgtctcccctagcgagcgcgcgcgctctctctctcccgccggggagctgctcgtgctctctctcgccggcgagctctctctctctctcgacggagaaaacgagaagagaaaagaaagaggagaaagagatgtagagaaagagcgagaataaagaaagagagcgaggaaacaaccaacggttacggacataatagcgcggaatccaaaatttaacatgggttggcccacattgactcccaggccatctgctcacaggccacacggtctcatccacacagggaaatgcacgaatcatggcgcaaatcctacggatagaaaaacgacaaatattgggggtgaaaatctgttgacaaagatctagcaaaatcgatacggatcatattagctcccgaatcagtaaatcacactaaatttatcaaccatgacaattattaagttgctttctacagagatgctaggtttgcctgaggtgctatattaagtttttgataggctgctaccacgatatatatgtttagagatatatagcagttcctgaaactactaatcaaatgtgagcactgaaaccctcggcgatgacgtacggtaccatggaagacgacgtactgcatgtcggtgagggtgcatcgtgcacacggtgtccactgtcgaacaacagcttcggccggtcggggccgcacgttcacgagcgtgtacgtagccgcgctcggcgcgcgcagtctacgacctccacgacggggtggccgtcgttgtcgtggcggagaaggactcgggggcgccggaatcgtcgtgcgttatgtggtggggacggcgtgtggcgtgcgcggcgggatggcggcgcgcgcgtgccgccgccgccgcgctcccgctgcccaggaggtggcacgtacagcagcaggcgaccctggttatcgatcgatgcatgcatggctgcgagcgtgtcgacgtccgtgacgtgcaccagcgccgccgccatgcgcacgtcgtgcgtccatacctctgacgccacgatgtttcacttgagggggctcgcctgtcggaggtgttcgccacgctcatcgacctcaagtgcaacatcgtccttgctgatcagctcgatggccatttgcgtcgcctctgcctccaccccacctccaccctgaccgaccgttccggcacccgaaaactcagcgacccagctcccagcaattcgcctctgctgctacctaggaagagaggtatatgcaacccatatgtaggacccactgcccatgttttgctgcatttcacctacatatgggacccatgcgccgactcagcgaatctaaccacggtctacctgccatgtcagcccaaaccgattctcaaccaaattgatttgagtcggtttttgtagttgggagaggcgttacccgattgagggatgcaattcgatcgagggtaagacaggagggagacaatatagacttattccttaaactcggcctacaattggacgaacgtaaagtggacctttttttttctttggaataagttcaccggaggtccctcaacttaacagcgagattttttaagatcctttaaccacaaaaccagaaataggggtgggcaaaattagaccgaaccaaagaaccgaaccgaaaagaccgagaccgagactgaaaaattcgggtagttgttcggtccctaacatcaaaagaccgaatttatttcgggtatttcagttattgggctcgattaaccgaaatacccaaaataaccgaactggcccaatagactaggaggcccagtaggccagtactaagcccactaaaataaaccctagatcaccaaccctacccccagcctcccacttggctcggttccctcaccctcacagccgcactccccactcctcccgctcgcgccgcccgccttcgcctccaccgcgcctgcgccgcctccgcctccaccgcgccggcggccggcgccgcctccatccgccctcggcccactgcgtcggcgccggcgccgccctcggcccaccgcgtcggcgtcgcctccgcccgccctccgcctccctcgcgccgtctccacctccaccgcgccggcgcgtccttcaccgcctagctcgatttgcttttcagtttgtctttctgaatctgcttgatttcctagttgcatgtgcagatcagcagatgcatcatctatctattgagttgccttttgatttgtcaaccatacatttgttgtttggcttttgtgatttttttgttcagagacttctgctctcgggttagttcggtcatgaccgagaccgaaccgaactaccgaagtgctcggtcttcatttttttttggaccgatcggtcttgagtttttgatgaccgaaattttaaaaagaccgaaagaccgaaccgaatttctcggttagaccgaatgcccacccctgaccagaaagaccagaaatgtgtacccctcaactcacacaaaccgttcaaaggaggtcccataacagtatatgtgggtggtttcgctgacgtggcatcctagtcagcaaaaaaaattaaaaaagtacgtggggcccatatgtcagttgcacattttctttcttttcctttccttctcttctctttatctcagcgatgggcgggcagcgtgcgagcactgaggcacggcagccgagcgacggcgggcggcggcagctgagtgcggcctacaggcgagcggccgagcacggcggcgattagagcggacgagcacgacggcggacgagcgcgagtaacccttacaccacaacagccatggcgacccggccgcagctcgagtaacgtccattaattcttctgtcacatacagataatctggtt

SEQ ID NO: 66286 - DNA, 619 bp, Oryza sativa
cccaccggacctaagggaggcaaaatagacttttcgagaaggattgatattagggatttgaatttgacgatggattggggatttgagatttggaattggcacggagactgacaacaagcaaagaaacaattttcgcaattagggtttttagaatttaaattttcccgctaggcgccacgatggaacgggcgctacatcatggcttcgatcggccgctatcgatagctagttgagcttagcttgtataatcatcagcggataacagtgatcagccctcaagacacagtgatttacgtggaaaaatcccctcggtgtgaggagtaaaaaaccacgggaccaacggtccactccaagcttccactataatccagtacaaatggagtcttctctagaacatctagaggcacatcacaacaacagctacaacatcaagttacgcaattggcatcatccatcaaccatcaaaactaacaagaggcatatcagcaaacaagcaaagaaatgatagatcctgtcatcttcgtttctcagctgagatctcccaagccacatatgcaaattgcacgaaacatggctgaaatgatgatctatgagtcctttccaacctttccaaaaaaca

SEQ ID NO: 66287 - DNA, 735 bp, Oryza sativa
tcctgcggccctttggtgggatgtaatacatcgtaatacgataaatttggactgactatttgtccagattcgtggtactagtatatgtcttatctaaccaaaactctttataggttaggacgaaggaaataaattcttatattttggtacggatgaagtacattttaacaatggcttataattgaatctaactctgatgacacatacaaacgctgttttttttttccagcttgatgggagcagctgctgtgatcaccgggttgtacgtcgtcctgtggggaaaagcggacgacatgaagcggggcagcgagccggcgacggcggcggcggcggcgaagccatgcacggattcgtgtcgcgacgtcgagcgcaccgccgctgaggagcctctcctgctggcagacgccgtctcaagcgagcagctctgattgtttacacattacgacaacactagactattttgtatgattagtaaaaacggatcgacagatctgtgcagttttgctgtttatgactagtttacctgttgtctgttccgacattcgagcggccagcaaatggcctgatttgttaaagatgtggggccgaattgccgatgccatcatgaagtatgattgatactccctccgtctcattttaagtgtaaccataaattttttttatgcccaactttaaccgttcatccattaaaaaaaatataattattgttgtgaatattactttatacgtgactta

SEQ ID NO: 66288 - DNA, 2393 bp, Oryza sativa
agattgactatgaaccgagtagggagatggcattgggcccggttcacctattagggcccagcatcctaattacgatgaattttggtactaagttcacttttgatccctcatttgagatcgagtttcaaacacatccctaaattgcaataccagaaatcttaacatctaacttataaaaccgagttaaagtaggtacttcgacagtatctatggctggtttcgctaacgtggcaagttgacccggtccactcgtgctgaccaagcgcttatttggcaaaaataaaagtgagccccacatgtcatctacaatctactcacctccccccctacctctcctctttctctccatctctccccctcattcctctggagttcgatgcatcaagtgttctggcaaggaacagcgcccagcgggtaggaatgacttggggatggttaggagatgcgatgtggtggtggcggctgccatcgcaaccatggcagcaaggaggtggagtggggttgggggtggctcaggaacgaccggaaacagggcagctgacatcggagacggccgtgaggtcgcataaaaccgcccaactcggtaacggtggagaagagagggacggcggcgaggtcactcccttccctcttcctccagatccgcgcatcattccgccattgccaacggtgtcaacaagcatgatgatgtggtcgatcaagcggcattccgacgagctcatcgctgacatccatgtcatcgaatgggttcagctctcagacccctcctctgtggcccatcgaatcgaccaccaccaccaacacccatccttcctatgcaaccattgtggcgctcgaggaacctagcagacaaggatgcatgatagaggctgagcgatttcggggcacacagcggtggcgacggagtctatgagagagttgtttgacccacatcggcccaccgtgatgtggagggaggagggaagtaaggctgtgaggtggaggcgatgatccatcgagagccagcggagtccaactttcatacatacatcataccaccattcatcaaaaccctctacgggattagtagataggcttatgatagacacatacaccccttttgtacttgtgttctccatatataaataaagcaacctccccaaactgacaggacgtaggattattactctaaggagggcttaaacctgtgtaaaaatcgtaccttgtctgattggcattccctcgataacacacaaacatgacacatgtatacaaagtttctattgtcaggatttttatcgataacaataatatatactataattacaaaccaagctagcccgtgcattgcacatgttattgttattgatattataattatccaaactttaattatacatattattaaaaaatattatcactgttattttagatagcggtatatacattagttacaacctatatattaatccacacacttactaaccaaatcttccaggttaatttttttttacaattcttaagaaaacaactaagctactaaattttatactaaattttagtacctcaaagtaccaagtatttggaggtattgagttttatactagaaaatgtacttctatactttccattacatttctaaggatggctaaattaccattctttttaacacgtgggaggtacgagtattgcccaatttttatagatatagataaatactagtgattgtctaaatggcaattgatctaagaactatatagagcaataatgataagagttaagacaactaaataaagtatgagcgccaagatattatgatggagttattgtcattgcacgagattaattagtgtgtatctcctctgaggattggcatgatccttctgaaactatacccaaaactaacagcaagcaaggatattaacttagaagttacaacacaaactttactagcttatacccttacctgccattacccagcttccggaaggcagcaccttgcgtgtgtgtcactcacacccagtcaagcaaaacctgatcaacgaccaaacgagttgcaacacaaccgtgatcaagattcgtctaacctaaacttgacttgatctagcttaattaatcgatcgatcccctaattagctatactagctcctgttgctcctcttcatcgatcatcccatggcgccattgaaaggcgagctccagttggccgagtagccgttcgccctcgcgatgctcaccgtcgacgccgagccctgcgacagctggtacccgccgccggcggcgccgctcgccatcgccatggcgtcgtacccgatgagcttcccctgctcctcgttgccgtagctgcaggtgtttccatggttggtggccgtgctgctgtgcccctggtcggccacgacggtgctcgccggcat

SEQ ID NO: 66289 - DNA, 562 bp, Oryza sativa
tagggttagggaattgcacgaatcttaaaacgatatattgggctatccaaagttttactaattttttcttgttttcaggcaactaaacaacacacagccccttaagatttgtatttttaaggctacaattttaagatgtaaatgacacacgatcatacatcactcttagataacacgccaaggccaccacctctttactacatctacctcctcctcgatctacttaactgagaacctctaggaatagtgggacgcatgaggacaagttacctacctgcctagcacaagtaacctgatgctagtcttaggttcgatgaggattgcacctttagagcagggttttaattgggatgaaaattttagtgatttgaggggggggtcatggatggaaagttaggaggacacctactgctggcaggtgggagatcatggttgctcatttcaccagagaagagaagaatagaggtagctctagattgaggttagaaaagagtccacacacacaacacgcgtgcgcatgctaaaatatagccaatattagccactagctactatctctctt

SEQ ID NO: 66290 - DNA, 5493 bp, Oryza sativa
tcaagttaatctagagagtttgttgttcagtgtttttgtttactaaaataattagttaccatgactggtatgcttaccgaccttacggatatgtcttgactaagtttataggcaaatatagtaatatttataatactaaattagtttcatcacatcaataattgaatatattttcataataaatttgtcttgggttgaaaatgttactactttcctcatcattgtagtacaacaaatacatttttaaacaacagtggatgagtgtacttggctttggaatagtgtcagaaattatttataaaactaactatatcttggaaatggatagagttaattaatgttttatttatatgggccttaatgcttgccatgtaaatgaggtctttcaactcacttccctctcaaacgccccctaatttgattaacttatatttatgttcatgcaggtactcatgtgctgcacgtgaggtagggctaattgcagccttgggtactgccctacttgctagacaacacgatcgtagcattgtcaaggcactaggcatgctatggatcttcgatgccgatttcctcgtgccgagaagtaggaggatctataaaactacacgtatttttcgtcttgaggattaggatgatatatgtactctacatctgattgtgttagcactatgtacacatctaccgtctcgtgctgaggaatgcatttcatattaagtttgatttccttacgctgcaaatgataatgcattttttatatgggacaatttgaaccatgccacacaaattttgcaaaatttgtgatatgccaccctgacccacatgtcattgactcgtgggtcctacatgtcattgagatgcgggtggcatatctcaaatttagcatggttccaacaaaccctttttatatttattagtgtaagtttattttcaggtgtgatatctgttaattcttattgtggatgattcgtttttgtcatcctgttatctattttctttcaagtgatatatgttagctcaaagtgttgtaattaaccaaaataaatggtaaattgattatctcatcctaaaattttaaatgtttgatcaatttattcaaatattgatgtttatttctataggtttcccctccactttagcttaagctccattggtgacgacgagcaacccacaaccatggagatcaactatttctataaggtaccctttgttttatgagcgtaggggggcatgtggggtattgcctgtcgtggacttcgctcttaggcactgttgcaacgacggtgcgggagagagtgagataaaggaggcgctactagctactgcggatggtcgcgtagtgctcatctaccaagaatcgtgtataggtggtatgcgtttaagttgacttatatatgacaaaatagatattagagaaaataagtatggtggttcaaattggcgatgacgagcaacccaaaaccatggagatcaagagggtgaagattgtagttcacgtggcgagcatcacatcgatgatccttgcctttaggttaatgtttatcatctatgtcccgatgtcttatgtcaagcctctgtcctacaggttaatgtttgttggagagtttgttcccacttttttatggttttattccgagttaatctggagagtttgttcaatgttgttgtttactaaaataattagttaccatgactgatatgcttatcgaacttacgtagatatgtctgggtggatacgtggtctgaggtgttttggggttgctggagttgctcctccaagaagcacactagttcttttatggcgtgggacatatatccactacgctgctcaccatcatgatcataatgatatgttcactggctcaaataatcttcttgaactttgtactctcctcagtgtcccatcgatatattgcaatcttcttgaactttgtactctcctcagtgtcccatcggtatattgcacaaagagacattatcagtagcaaatcgttgaactgagacaaactcagtagcatatagtagattctctcttcttttttacactaggtaggtgttcgtgcgttgccactgggagaaattgatgtgttccagcacacgaaaaacgaaaattggtaaaataaaaaacatccacattaaatatatattatgccaacatcattatttttgttgtggtttagaataattgtagtcatttggatcaaactccctctgtcccaaaaaatgacaaaccctgggtttccgtgtccaacgtttgactgtctgtcttatatgaatttttttataattagtattttcattgttgttagatgataaaacatgattaatactttatgcgtgacttgtctttttaatttttttcatatttttttcaaataagacggacggtcaaatgttggacacggaaacctagagtttgtctttttttttttacggagggagtatatttgaatggacaatatcattcacactttagaaataattatttatcataattatacctaactctagaagataactaaggtatcgaaataagactagaaaaggcttatacggaataatctttttgtacgcataaaggcaatagagaagcttacatttacataggatcattcacgaatgggcctaaagagtgtctaataagaatataacgcacaggacgcttgcaaaaaaaaggaggaacaaacatctatctatagatgggcttgtgctgacatcatctatacgtgctttgctccagtgcaagtcctaaaatatcaggtttgtacgtgtcagtcagtttgatactataactgacaagatagataaattgatgataaaagaaccgatcagccaataagccgatttgatatggtcttgaacaattggctatatgtccgaggtaaattctaacgctcagataaataatgatataaagacaatagaagaacttgaacaatcaatccaatcgaccgatgataatataatagagtagatatccaatgatatgtgccgaagttgtatttatcgagagatattaatacatgggtagatactagtctgtttgaaattcctggctcttgaggcgccgaagtgacctcttccaccgcgccgccgcctccggtaacgacgatggccgagacggtggacttcgcgagcggcgacgcggcggagtggcgagcggcgctggcggcgtacgaccgccggctcgcggccctgggcaagcccgacctcgtcgaggtcgactccttctaccgccgcgacctccccgatctcctgcgccgccgcgacccggagcccttcctcgccaagcccgagctggtgcgcctcctccaatggaagctctcccgcggcaagtggaggtcgtctcatcccgctcttagattttctttcctgttcctctttagagcacttgaacttctggttcccaggggcgtgtgatgttgtagtagtatttctcgctcaaatctccctagaaatcgtgccgaaatgtgtggatcaattggatgatgctagtatcttaagggtgcttggactgatttgatccattgatttagggactcgttttcttggcaaatcaatcattaccctagttggttagttgatgatactcctacactaccctgttattatcaaactcgttgggggaaaaaataatcatattgttgctctgttcttttgtgcaggccgagactgatggatttcgtcaagggcttggaggatgcagtggtagaatcagcatcgtgcaaggcgttcgcagcgctgcctgacctccgcaaggccatcaccgagctcaccgtgctgaagggcgttggccctgccacggcatccgctgttctcgctgcctacgcgcctgatgttgcaccgttcatgtctgatgaggtgagtttgtgaattttgttttggcagttctgcatttccaggtgagatgaatgcatctttgatgttgtaaacatggatggactgtgtttaggctatggtggcagccttaggcaatgcaaaggagtacactctgaagcagtatcttgcttttgctgaaaagttgcaaactaaatcgaaggtattgcttctgcatttgtgatgtgtgataaactgttgttaagatagcatttgtttttcctgattgtgctgatcgaagtgtctgtataataagccttcggtttgctaggcagctgcaagtctgaacctagttaatgctttaggattgttttgcggtgactatcacttgagttcagacaaaggggaaaaaaatacggtgtattcccttgtgtggagatttctagttgatacacttcaaatatgtggttgatttaatgcagataaactgaaagggacttcaaaaggtagctggttgtgtggagtcattttagaagaattgatcttagctgacatttgaaattgaaatagaacataccaccacatattttttgttatagtactgttcaagaactagtgcagaaagataacacctttttcttgtttgctgatgcttctctaaatcataacgtccaataggctcaaggatgccaggctcataaatttacagagtatgcattacaaaaatcgtatgccaaattttcagctgcttgcctttttattccagacagcagctgcaacaatagggtaatatactgataagctgattagtacttgaacgttatgcttttatatttgcaaaatgcaagcatgtaacgtccgcattgctagaataacaccgagtaaactgcaaattccatatcaaaattatagattgttgaacatttggactgttagctgaagtctgaagatgaacacatgcggtgcttgattgacatttatttcatattttttgtttctctggtaggaattgagctcaggagaagaagttttcactacttctgatgttgagagagcgctgtggagctcagcagttgcatccaagtctcttaaggcgccaccaggaaatgaccttgagaacaagtcaaagactcatggcaagagaaaacgatgactcttgctgccaatgttctagttgagctaggagttactgatggtaggtcttagaacttagattgttcattgtatgaagttaagcaatgcttctgcatctgcaaaaagaatgtggactgcgtgctcccgatgagcaggttaaaccctttggaaatgtcttccgctgtgagtctgtacatcagtacatggcactgaatgagctgggggtgatgggtgtgtttttctccacaaaatggcatggataccagatgttgccatgcgtgtgttgttctttgttagataattgcatctgatcctttcttctgtgttgccattcgatttaacagttcatgctgtgcaggtgaaattgcattgtgcgcttcgtatcgctgaaaataaagataagattgagcattcgttcatttttcacctgagattattactgagcgttgcatgtagaggatcgaaggatcccattaaagagtgggttttaacaatatgaggatcactgcaacaaatcaggtacattttccaaggggctgcaggaat

SEQ ID NO: 66291 - DNA, 6508 bp, Oryza sativa
cagctgaacaattatctgttcggttgtgtaatagatcactcatgaaacttcagtcccatagtagcagatcaggaacgtggagtgtcatagcactagcagtatggaaataggcacatcatatggtgacagaggcagcttttacatgtaaatatgttatggatgcaaaagggaaacattacaggcaaagaacaaactgcagatataagtatgttctactccttccgttttataatgtaagtcattctagcatttcccacgttcatattgatgttaatgaatctagatatatatctatctagattcattaacatcaatatgaatgtgggaaatgctagaatgtcttacattatgaaacggagagagtaattgtctatgttaattgctacacctcaatggctagaattgatcagtaaacagttattcaatatgcaagaatgaatagatcacacttgcttcacaattacacattcatttcagatctaaacagtaactgtcaactacatcgtaattgttcccatcatatgttggagactaataatgggtaatggttgcactggagattagccagatatgcactcggcattctggtttttgctgggagaggacataaatcagacttatgaagtgaagataaaatatatgacaagagcacctgatgaagttatttggtatgcaagaactttctcaataaacatgatcctacaaaattgttgcgagaaaactttaacataagcaaatgttgaggcaatccagattgatagtcagcaataaggcattaggcatggcatagtaaatttatgcagatacggccccaataccaactgcattcaagtacagttcctatacatatactgtatctagtaattaaaatgaattatcaattactgggcaatgcagaaaagtcattgctagacctgaaagattgagctattcgaacataatagaacattctgacagcagtaggaaatttcataaagagaactgaacttgctgaagagaagtaacagaaggacaaagatttctcttgagagatgaacataccatgaatcacgctaatcctcaagcgttgaaatgtactcatctatacgccgatgcctctcccgcagggctgaaagcgcctcttcagcagcctcattgatcatcctagggaggtacacattcatcctctgaaaccactccctcagtgtcatggtttccaagctgctgctcccagaactctccccctccacttccacagccgctccctctcctctaccgccgtctttctcctcaaccgcgttgtccgaagcagcatgagcattactacttgcagtagccttcccctttggagctcttcgtgcccgtcctctccgcgccactggcacctcctcctcctctgatgccttgtcattctgttcaacttctccatccatggcttccaccttatcatcttcctcctcaccgtcagtcaccgccattgccctcggttgatcctttatctgctcttctgccacagcagtagccccctcttgctgttccccatcatcgtcatcgtcctcaggaacggccatcctacacttccttgcattagaccttgtagcccttccccgtccctttccggccatctcgctctccctctcatccaggcttgtgtccactgccttgcctctcctagcagcagctctcgtcgaccttgccctcggcggcggtggcgcaacggctgcctccggcgccgccttcctcgacctgccgcggcgcgtcaccaccgggacctcctcctcctccttctcctcttgttcctcatccttccccttctcttgctcctcctcctcatccggtttagggggctctgcggccttcttccgcccacagcggcgcgtcaccaccgccgcgaccacctcctcctcgccctcctcgtgctcctccgctttggggggttgcgcggccttcttccgagcaccgcggcgagtcaccactggagcctcctccggctctggctcttccttctccgcaatgggcggctcaaccgccaccgccgccgctgcagcgttcttccgtccgccacggcgggtgaccgcagggggtttctcctgctcccccaccactgcggcggattggcgcgaggagcgcctagggccagggttgggatccgaatcgggcgcgatggagaccacgagcatgctggactccccgatcttgatgacatcgccgtcggagagcggggaggggacggtgggcacgaggggggagccgttgaggagggtgccgttggaggatcccacgtcggagacggcccaccgcgaggccggcggcgggaggaactcgatggagaggtggcgctgcgacgccccggcgtcgcgcacggcgatgtcgttgccggtggcgacgcggccgacgcggagcacggcgcccgcccgccactgccgggtctccccgccgcggcggcccttcttcacctgcagcgtcagcaccggcggcggagcgtcggccatcgccgcaccgccctgcagccgggagtggggaatcgcggagaggagagggatgcgaaaaggatttcaaatttttcggggggaatgcgaaattgccgaggagtggatatgggcacacttccacctatcgtagcagacccggttcggtcgatcggttggaccaaaaaagatcggaccctactattagaccgggccaatagaccgttgagcgacggggagaggagcccagcagccggtgctcgttagagcaagataataatacatccagctgcttagttatagtctatctatcagctcactcatatagtggttaactattcactataaatatatgatccacatgtctgtcttacagattttcttggttcctatgtctaagccggctgtaaactttgtcgaaacatgaattcggcaataataaaacggggtagcgcacgagacctaaaagtggatggatgcagagacaaaggatttagacaggttcaggccctctcaatgagaggtaataccctactcctgtttggggatttgaatccgccgggtgtagtatagatctgacgatcaagttgtctcatgccccctagagggcctcctgcccaccttatataggatgggggcaggattacaagatagaaaccttaaccaacacggtatcggtttcctaaatctactttacaatcttatcaaaccaggactttaggccgttccataatatacagggaaacgtaatacccaagtcataatctgttacatatttcatatatataagttatcccctataactagtcggataaccatgccgtgtgggtatggggtacccataatctccacagtagcccctgagaccttcacagtcgaaaagataatcttctctcgaactagattactccaaaaccgagtacttcaatcatctttgccatggtctcccgagtatttttaccaaatctgaagactgtggagggctgaaaaataaagtcaggtgcatcgactagatgcaccgagtggtttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaagaagcttgtatgttgtgaataaagaaattttcaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagccagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacacatgtaacatgctcccgggtgatatagaccatgtgatctgagtgattatcccttatgggatactccaaaatagatataacaattgaatcccgactggcgcaagtattcagttgataacccttacggggaataataaatagtccagtctttgagcatataaaatagacccatgatcatgaattcatgttgcatatatccggagcaagtccaaattgaagatataatacttgtatttgagctagtaagcccctgagcacgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcaacagtcaggtcagccatcaatgaagatgaaggcgcccagcgataaagttgtgtagccatggcagcgaaataatcagtcggtgacagacgaggcagatcaaaggcgatgacgaaatccaccaatcatgaagatgaggaaaatagtcggcgacgacaaacgtaaccgacagtaatgatgataagcatcaacagagatgtacgacatgagaagaatgttgcctatcaaaacaagtagagtaagctatgataaagaggtttgacaggatgttgatgaagatgacgatgtcggtgatccagtcaatagcggtgtaatagccgatgataatgacgaagacgctcatcagcgtttgcatagtaggtcaaccgtgaaggcggaatagcaagttggcaaagtcttagtcatccattagcaacggcggaatgtcagagctgatgaagcagatgtgctggtgatgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcatcttgacataaagcttgtcaaattttgagccatgtatttgtgtagcccccgactctttgattagttgggaaacaactgaacatagagtcgagaattatagcttcttgttgtcgagtagtcatcacttgattgaagatatgtgttgaagatgtccaagtagaaatcctgaatattggagagccacttgttgtagtaaaataacatggcattgcatgccgagatgtcgaggttcacaaagacgtcgtgggtggtgaagtagtaaaacttgcgaagtagcaacaatagagtttgccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagcaccagtcggcggcggcataatcagtcggcgacggaagatgatgatgtccatcagtagtggtagctgtataaaccagacgtagaggcgagggcactagtcagcagcagacgagacgaccagcgatgaagatggtaaggccaatcaacactggcagaatcatgcagccatggaagtgaagaaaccagtcggcagccatgacaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaataacggcagcataataggccagccgtgcaggcggaaacaccagtcggcggcggtcgaggcggccggtcggtgaagacgtagacgcccaacaacggcggcataaaggccagccgtgcaggcggaaacaccagtcggcagcggacgaggcggccggtcggtgaagacgtagacgcccaacaacggcagcataaaggccagccgtgcaggcggaaacaccagtcggcagcggacgaggcggccggtcggtgaagacgtagacgcccaacaacggcagcataaaggccagccgtgcaggcggaaacaccagtcggcggcggtcgaggcggccggtcggtgaagacgtagacacccaacaacggcggcataaaggccagccgtgcaggcggaaacaccagtc

SEQ ID NO: 66292 - DNA, 713 bp, Oryza sativa
cccaatcgtttaattgggatacatactcatgataaacgagacgtggccattccaagaagcactttagaacttagccttaaactcttttcaaagctcaatattttgataagcacctagtaaaaatgtggaaaagatggtgttttatagctcctggtttctaatttattttatataatcaagaactactaattcttatatttcatatgagaaataatttttttttcgcgaacgcgcaaaaggattgcacgtcaatatattagacgaaaagagttttagttacaccacacaatcagacagaccagcttatgctaggggaagggagaaaaagcaaaataaagaattgaagctagagaaactacggcggctaagaacaaactccaagcagcgggaagaggcctagccgcgctacactcccaacaagtccccaaaaacggcaacgccagctaaaaccacatatggctctccgaacgaatggactccagaaccactgagacgaaagagagtgcggagtcgaaaaccctagaatttcgttccttccacaactgccaagataccagaagcaccagggagtataagccggcgcggagatgctcaggtaagaaggccctggagaatggctaccaattctggaaccagctgccatgggggagagagggcagcccagctaggaggcgataacacccggaaccagacctgtcgagcgaacatgtagt

SEQ ID NO: 66293 - DNA, 706 bp, Oryza sativa
cgctctcatccccaaactcgcaaccaccgcccgctctcatcccttcacaagtgcggcgcatcggccaacactgccgccgcttcccctcctctcgcactgctgctcctcacgcctgtacgttccgctccttcacatcagccacccccgtcgcgcacaccaatccccttcggtgacctcgctggcgtcgtctgttcctcttctccagattgtctgatggactaccagcctaccactagctacccacgggatgattcctctttctgaaaccatcgccagcaacaagcagtcgggagtatcttcttaagccttttttaagtcctcaaaatataccatcgtcagcttctaagactcttaatccatcatccccgtgcgaccggccaacccaaccatatgcatcatcaccatgattaagataatggaaaaatgccaggtatgctttacttttgacagtacaatattgctgtttcttcacttccagttacatgacaatttgtaaaaatcgaatcagttcttaattatccatacaatatcgtatggaatctattaaggctaggagtcgacaaaatatataagacaagatttcttaattcttatatatgtatatgcaaaattgcagctacactaagccttatgtatttgggttgcctctgtttctactgcagaatttttgcccaccatttctatgaacgagattgatatcgactgg

SEQ ID NO: 66294 - DNA, 743 bp, Oryza sativa
ctgattaccagataagatgcaacaatttgttaaaatattaaatttccaaaatactgctggattcatgattatattatttgttccatatggatagttagcagctttcaacagatctttcatttcaatcacatcaggttttctgttgaagggtctaaaataaagttgctttctcatgattgttggtgacaggacaaatcctacacaggaaccttagcataattctgaagtacaaaggcacagaaagcctacttacataaattgagaggactatggtaacagcaagaattgcataccctgcattatatgcaggaaacatgtgtatgagatgcctcgccacaaagtagcagaagacggcaaccgggattgcaattagagagaaagatagcagagtggccttggcatctggtccaaagataaaccttccaccgcacaagattatctgaacaaagagaaacacgttgatgacacattaaaaatgtttatattaactgctggtataaactgcaagcaaaggtgaaaattccgaaatcctaaaaggtttgatatgatattgtgtaaaatctgcagttgtccaactccatcagaactcctatcaaggccattgtttttacactagcctgaactctgaataagacaagttgctgaaagcaataattctaaagagaagagtaaaaagaagatttaagcaacgtaatgtttgcaagtgtagcacattattttttatgcagcctgaagccaggttg

SEQ ID NO: 66295 - DNA, 4642 bp, Oryza sativa
ttcctgcagcccaattttaatttgaaacgggtatgtaaacttttgactaataaactttgggtctataaagtaatatttgaattcaaattcaaatttgaatcgggtatgcaaacttttgacttataaactttaggtctgtaaactttaggtgtataaactttagatgtatagaaatactatatataaaaaatattttaattcgaattcaaatttgaatcgggtatataaacttttgacttgtaaactttgggtctctaaactttaggtgtataaactttagatgtgtaaattcgaggtgtacaaactttaggtgcataaatttactaaaataagaaagtaatgtggtgttaaaaaaaacccacgtggaggggggatcggccctgatcatcccggacgatcgctcgcccattagcaaaaccgtctccaacccgtctatcctggccgaccaaccgggcgggtgggtttggatcctaaaccacgtcaaaagtcaaaacacacaaggtggagtatacatggacaactaggcctgcaatgcacatgcacggcacgggtccaatgatcgcccatgtccagagacggccgtcaaatactactagcagaacagcaaaaaggctgctgtacgtgcccgtcggtgtctcgcactctcgcggtctcgcgccgctgcagcgcgccgcaacttccaatcccattggctttagagcaaggataataagagcaagtataatagtgggctataagaaaactaaatggtgagtggataggagaagagatgagagagatgaaaagcgggctgtaagtttacagcctgcttaggcacaggaaccaagaaaattgtgagacagacatgtggaccatatatttatagtgaagagttaaccactatataagtgagctgatagataggctataagtaagcagctggctgtattattatccttgctctaatatagctcacttcctactactcccttcatctatttttgatagtcatatttccaaatctgaaaattttatttttgataggcatatttcaatccaacaacctatcatcttaatgattttctcgaatttaatgcatggctctctattcttccacacatgattggctatatgggctttgagaaatgtaaatattaatgaatcgtttgtttacgaggaatgaccagtagcatgcttaaatgaatgataagtagaactacttatccttggtctgtgtgtcaagatgaaatatgactatcaaaagtagatggagggagtattagcctatactaaagtcaacacatgtaatagattagctataaagttagctatgattttcttcttctatctctatctctcacttatatatttaatgtatttgtctttaagcttgtgttaagctagctcttgcatgagagccaacatccttctttttcttttttgtttacccctctcctccacgtaagattatagtaagcttatagctcactattatacttgctcttatacttcagctcgcagtcgccggctgtattaatattgtgcctgattttgcgagagttatgagagcgtacaaaccgcgcgcgctgcgccctataaacatccttccacttcttcacgtacgtacgaatcatttttcgtttcgtcagcaatggcacgcttgccttctcatcgtctcgcggctctcctcctcctcctcctcgtcgtggtctcgccgtgtcacgcggcggcggcggcggcggcggacggtgggcagaggccgactaggccgaaagccgtggcgatgccggtggtcagggacggcgcgacgaggcagtacgtggcgacgttccagcagcgaacgccgcgggtggcggtgaaggccgtggtggacctctcgggcggcgccacgctctgggtggactgcgacgccgccgccgggtacgcgtcgtcctcgtacgccggcgtgccatgcgggtccaagccctgccgcctcgtggagagcccctcctgcagctacatcgccagctgcctgggctcgccgccgtctccggcgtgcctcaaccgcacctgcaccgggcacgccgagaacacggtcacgagctccgtcggcagaggcaacgtcgtcaccgacgtgctgtcgctgcccaccaccttcccctcggccccggtccggcaagggccgctcgccaccgcgccggcgttcctgttcacctgcgggcccacgtccctgacccaaggcctcgccgccggcgccgctggcatggcgtccctcagccgcgcccgcctcgcgctccccgcgcagctggctggcaccttccgcttctcccgcaagttcgcgctctgcctcccttcggtcgacgccggcgtcgtcgtcttcggcgacgcgcgctacgtgttcgacggcatggaccactccaactcgctgctctacacgccgctcatcaccaggacgacggacaggtcgagcgaatacttcatcagcctgaagcgcgtcgtggtggacgaccgcgccgtgccgctgaacgcgacgctgctcgacgtcggcaccaagctgagcacggtctcgccctacaccgtgctggagacctccatccacgaggcggtcacgcgcgcgttcgcggcgtcgatggccacggcggggatcccgcgcgtcccggccgtggcgccgttcgagctgtgctacgacgggagcaaggtggagagcagcgccatcacaggggagccggccgtgccggtggtgttcgagctgcacgtgcagagcgaggtgaggtcgaaggtggcgccgtggatggtgtcgggggcgaacctgatggcgcgcgccgacggcggggcgctctgcctcgccgtggtggacggcggagcggcgccggaggcgccggtggtgatcggcggccacatgatggaggagatcctgctggtgttcgacctggagaagtcgcggttgggcttcagcccaaaccttggggccttcggcttgtcctgcagcaagtttcgcctcgggtagcacgtattggcatcgtaggctcgtagctaatctttctcgggcctcaaactcccaaaatctatacctgcattttgccgtcgcatgttggaataaattgctccctcctgccgtcctgcgtatctacaacccggttataccccacgatggaggtgtacactagtaaggatacactattacacgtttaaccattcatcttattaaaaaaatatataactataatttattttattgtgagttattttatcatttaaattactttaaacatgatttatatcttatacatttgtataaaatttttgaataagatgaattgtcaaatatgtgttcaaaagtcaacgatatcatctattaaaaaatgcagggagtatatattagggaaagtccattttacaccctcgaactcttatgcttgtctaaaatacacctccgaactacaaaaccggatatgatacatccttgaactgttaataccggacacttaacccccccgggctgtttttaccgtggtttttgccacgtcaaccctagccacgtcagcgcaaaacataaaatgggccaagcccatgttcacttcccctctctctctctctccctccctgccctcttcgttctcctctctctcatgaccattagcggcggcggcggtggcgcggagctgtgacggcggcggcggcacggagctgtgaaatcgacggctacggcggcggtgtagagcagcgagcgcggcggcgactgcgtaagatctaggtcggcggctgcggcgtcggcgtggagccgcgagggcggtggcagcggggagatggtgctagggcggcagcactgccccagttgcgtggacggtcgccggcggaagcctctgcgcgcagtcgccggaggtaggtccgggcgtcgtcactgcacgcgcctttggatatggctcagcagggaagaaccagctcgacacgtggtggaagcaacgacgagctagtggactgttgtgccgacggaacaagtagatggaggggcatgagcagctctggaaatggcagcaaatccagtcaaggcagaagcaatctgtcagggttatggataccacatacctaatattagttgactaaatctccgcaggacccaccacataccatgtcttatacggaaacaactttcggatataggaggagttccgcataaggaaggataaataaagttctacataaaaacgaaaatgactactcggattgtatccatattggtttccctagttctacttgtacagggggacatctatgggtataaatacaaggcctcctgggaggagaggggacacggaacaacagatcaaggcacaagatcaacatacaagccaacatgcgccaagacaagatgccagatatcgacttcagagataagtagggctagtcccctacggtgtctacagatattgtcaggagagacatagcgttgtcttttatcttgccggatgtggattcgaggagaaaggctaccctgttgtcgactatgagtcagcacttcagaccgccaagtcgacaacagttagataggctaccctaaatattgtactggtgtgattatggtgaataagagcaacgaccggcttcggccaacaggagtagggttattacctgaattcaggggcccgaacctgtataaaaatcctcgtccccatctcttttatta

SEQ ID NO: 66296 - DNA, 44821 bp, Oryza sativa
gtcatctattaaaaaacggaaggagtatttaatatgttcgtttgtatctgtttagttagaatttacaattttgggcatcgtgatcatgtcgacgtgctggtttgacctttggtaggaaatggcacacatgttgttttgttcaaagaaactcaaaacggatcaagtatagatgtgccttttgttgttctagctgattctttttttttcaattataaagcttcaaaagtatattttgtgatgcgttcaagacatttgcacgacctatattatatatacctgcatgttgtattatattctaaacacatagtatgccctgtttggctcgatattgaaaaactatcatgatggacagtatgctataggagacatggggaaatgtaaaaagaaaaaaaagaattaaaaaaaaggtgaacgcatatgatctgatgatccgtatatatgcatttgtcggacctgcatttaccgttcttggagatgctcttgttcattggccttgtctgtttgagttccatataaatgtatctggaacaaattctgttgtctcacattctgcttgattttgaaatccattgaattctgcttctggctgatacttatgaggtcaggcagtaaatgatcaataaaccattatcatcactgatttgttactatcctaatctgtgcattttgtgcaagtttcagatgaactccatgtcatacaacaagctgtccataacgaatgacagaatggatttcaatacccgtggaaatgcagtccccaatggcaaattagatcggaatcagtcaggtgtttcagccaatcgatcctcagcctccaaaccaacagcacgctccaagaagaaaccggatcaagctgacaaaacaaccccaaatccagcgcagaattcagcatcatcagcaacaagatccgaagcagcgaccgtcacgacgaccacgaaatcgccggcgatcagcgtggacagaagcagcatcgcgagaagcaacagcctggacagcttcagctacggccaggcgaagcggcacaccggcggcgacagccggtgggacgccgtccggtcggccagctccgtggactgccccctcggcctcgtccacttcaggctcctcaagcggctcggctacggcgacatcggcagcgtctacctcgtggagctcagggacaccgacgccttcttcgcgatgaaggtgatggacaaggagtcgctcatcagcaggaacaagctggtcagggcacagaccgagagggagatcctcggcctccttgatcatccgttcctccctacgttgtacacgcacttcgagaccgacaagttctactgcctcgtcatggagtattgctccggcggcaacctccattcgctccggcagaggcagctcaacaagcatttcaacgagcaagctgcaaggttggttttggtcacattttcaagatcactccagcatatatcctctttgcctcaacatactacatacaatgcttgcacattgacatggatatatgtcattgagtaaatttgcactttacaccaggtaaaacgtactactttgttttccctttacaagaggtttagcacatgttttagctttacaccagggattattgaagtattccctccgtttcataatgtaagtcattctagcattaccaacattcatatagatgttaatgaatctagacacacatctatatctaaatttattaacatctatatatatgtgggcaatgctagaatgacttatattatgaaacggaggaagtaagtttcacttaacactaggacacatattatctaaaaacactaggacacatccttaaacctatataaatttgaagaaattttataaaagtctgaatggaattttctgaagcatggtctaaattgaagaagcctcaaaagttccactcatatttcacaaggtttcacaacgatgtacgatgcaacctagtacaaactgcagagtatttcaaaacaccctggtataaagtgaaaatgcatgctaaactcggtgtaaattgcctttaaatcatttgctcaccatgattctgaaaatctctgaatgttttttttcatcaggttctacgcatccgaggtgttgcttgcgctggagtacctgcacatgctaggcattgtgtacagggacctcaagcccgagaacgtccttgtccgggacgacggccacatcatgctctccgacttcgacctgtcgctgcggtgctccgtgtgcccgatgctggtgaagtcgtcgtcggtgcacgcgggcgccaacggcgtcgtgaagggcctcgccgccggtggcggcggcgacggcgagggcgtcggcgtcggctgcatgcagccgtcggcgttcttgccgcggatcctcccaaagaggagccgcaagacgtccaagtcggacctcgggctcctccacggctcgccgctggagttcaacgcggagccgacggacgcgcggtccatgtcgttcgtgggcacgcacgagtacctggcgccggagatcatccgcggcgaggggcacggcagcgccgtcgactggtggacgttcggggtgttcctctacgagctcctccacggcatgacgccattcaaggggagcagcaaccgcgccacgctctgcaacgtcgtcgagcagccgctccggttccccgacggcggcgcgttcccggcgccggcggcggcgagcggcgtcgcgcgggacctcatccggggcctcctggtgaaggaccccggcaagaggatcgcgtcgaggaggggcgccaccgagatcaagcagcatcccttcttcgagggcgtcaactgggcgctcgtgcgcagcgcccacccgccatcggtgcctgaccccgtcgacttcagccagttcggcgtgagggagaagccggcggcggcgccgacgaaggtggccaagccggcggcgagcgattcctcctccggcgacttcgagtatttctagctcccatctgtgagtatttctaggaactgaaaaatacatttagatacagaaaaaaaatatacagtctattgattctttgttactgttgtattgctccttaattacagtacacccatacatgattcttgggatcctggtatacacatgtacaaacaatgtgatagcttgttgctaacaatgattaatgaactgtaaaatattctgttacactactgacagatgcagatgttcatttctttagctgatcaagctttgccttatatgcagctcatttcttggctgatcaaacctgcgtcatgcagatattcatttcttactagcttacctgaacaaaattgcctaatgcagatgttcctctgttgttataggctatagtttagctgatgaaacttgcttcgcgagggacacactattctttgcagaattgcagtctttgaaaaaaaaaatgatctacgcgaaccttcgagtttcagcagttcaaacttgctcctaaagggtttacaaatgcaatggaggctaaaaaaccgcacccctgatcggtaattgtagttaccgaaaaaaaatagtaaaacccagaaaaaaatagcaaaaatttaaattttagtttgattttagcttgatttgttgttcaggaggtctcacaaaccagaccagcatcgatatgtctactgtgaatatttcatttcatatttggaaccctggctaaacctccgcataaaccaaatttgcggtactttacaatttcgagcataaataatgtctggagttgaaagacgtcatcaaaatggacgtcttcaaaaccaaagatagaacacgctctgctctgtctgttaccacgtaaatataggcatatataaactagtgcaacaggttctattaaaaatttaaaatgcagcaggttcaaagcctaggctggcagaattggaccacgtttcgatcatccaattggtgtatcaccagaaacagctactaaacaaaatggctagcactgaactcaacccgaattcttgcataattaatccgaacgatcttgcctccaaacaaaaaacctacacagtatgtgtaacgagtgctatgatctatacaccattttcacttttgagttaggcaggtgaactgcaatggtcaaatgctctgacgattctagctgctggtacactcaacgatctcatctgcggcagccggcgagtctcttgtcagtttcaggaagtgtgtgcggttcgcggccaagtccttcctgagcagttcagagtacttctccagtgacttcttgaaatctgcaaacgatctgttgttgtcgcggggatgcttggtgcccttcgcagaggatgatccaacgactgcgccagatatgtatgcgtcgcacgcatccaggatgacgcgctcacgctcatggaagtggcgtgcaacaagggactcaaaatgctgcagtgaatgaaaggtgtgtgtgagagcgaatcgatctgcaagaggtatatggaactgaattgtgtttataggacttcataggtacatatggtgatgaactgatgatgtttcaaaatcaaatgttcttgcgctgatgcgctcacttattcagctgtttatttgcaataacatactgtcaaaactccaaaacacattatcacaatgcgtgtctttgttagttaaatgtgcccacagataaatttttaagttggcaatttcatgacgcaacacaacacaattctcaagccggaaaatcgctctcctggcaactgaatgcctgctaaagagtttcacggagtgacaagtacggttggtacagcatgactaatgttatagtagttcctaactgtatatcagtatttaaaagcatataggcacagagagcagttcactttatctggatgactgtagaagcactgatataaccctgacagctgaaattcttctattactatcttttccagcacagagacttgtgaaattaccacttttaacttgacgagagatgggggttctgtagttacctttggaggcttccgaagtgaatacatcattgtcctgcaggatagtaggaaggcagtctgattataagccaacgagtacttttctccaggagctgtattagccgaatttttgttgcctggctcattaaagtatggtttatcattcaacacaagaccctggatggaaaccagcacctgcagtatggttgattttgacttgccccacttctcgcatccagtaccccaccaggtgttcagcaggctaaggcaaactttcccactctcatacaagtttggatttagccgaagcccacccgaatggtaatgaactttctgtacatgttggatatgattttaaagagattatattaatgatggtagtaacatgaaaataatggtgcaaagcgtgtgtgaactgtgaagtggttacataccggtggagattgtgggtattcagaaggaaagcgaacatcaaagaagaacagaccatcatgatatggagttccagctggcccaacaatagcagccctcagcagatcaatcctatcctcataagctctaacatagatagattctgcatgattgaaaccatgctgagatgcaagttgctagtactgaagacatcatataatttcaggcacagctcctctaaacgaaagatttaaggcacaaaagtaaattgtatgtaatgatacttgtgatacccttcggtgacatgatttgatatatgtagagattaatttctatttgtcccattccccaaacttaaaaaagattaatttctgaatacatgttatatgctgctatcacaagattacatggaaaagggtgacaaatgcagaccataactaaaagatatgtggcacacaacagaaactaatagatatggcaccaataaagtattttatacatcaaacctagacaatgtcattagctagtttgggactcagcaccagtcatgccaagactacaaaccacacaagcaaattggtatagcccatacagggcatccaactatctttaagtctagaaatatctcaaacgtattctgttggcatgtgatcagatacaattggcataaaacagcaggtctattataagaaaggaccattatatgtattcaccatctaggcactggcggtttgataaaaatgcatacattgatttgccatataaaagcatgtactgaccaggtagatctttctgtagaagcttccattcattttggattgtcttcacccaatctttggaggtctggtcagtggtcacaagtaaagacaggaaattaattcacagttggatctagtgatagaaatagagttcataaagcggcacagcttaccttccctggtgaattctttgcatagtaatgatcagaaaaatcttgcacaacatcaaattggttaaacaaattgtagccatcactttcagatccatattctgtccttgtcattgatgatacaacacttgaacattcaggctcatgtttttgcactaatagcacagtaccattcccacttgaaaagggatccaaaaggctgttgtttgtactgacatttgcagtggggtgtggagcggcaactgaaagtcagtagagtaactaatttcaaaccacgatgttataaaaaaaaagcacatcaatcttaaagacagagatacagaatgggatatggaagctcgcttaactgcaaaaataaagaggtgtacttggcatcagtactaactactggcagaaaaacagagtgatgaacatttagataatgtgtagttctgttaaagtaacaaatatcccccttttggggaacgggaggggaggaccctaaattttcattgattttattctttaaaaaacaggttcagcaacatgaagcatgagaattactaaaacaaataaggaggaacaagttgcatgaaaagatacctttacaaagaggattaatggctttgcctgcatgaaaaatattcttttattagaaaacgccaggcagaagagcaaaacacttgattttatctttctgaaacaaaatgagtagaactccgtgcttcagagggagatgggtatacaggctaatgaaatattaagtttgttttttctttatacagtttaacaaacttcaaaacagtgttgacaaccaagactcatggattcataacaccagactatccactagttcactctccagtggatgtatccaaccacactaatagcactctgaatttgtcaagattaagtttatactttacacatcacattttggtatactttgaagcatctggtatagcaatccagaccaatgtacagcacccacaattatccaacaattttaatccattatgaccacctcatttgatctgcagtatcctttcaccggaaaacacattaatattttcacttttttttaaaaaaaatgcagaattcatggaagaaagagtacacaagacaactaataatatgccatcaaaagaggaaagcatccttggatcaatcaaacaaacagaagcagctgatgtaaacatgatgttaaataggggcagtagtgcagctgtacagcacctttcttcttggaatccttcttcttcacacaaaacagctcgagcaccttgtttagaaccatccttaaaacccgcttcacgcgaaacgcacctgaaaaacatgagacgccatcgtcagaattagatagccagaaaacagaaatataggcgtcgtccaccatctccaaaataaatcatcttctcaccaagcgtaaccgaaaagggaaaaaaaacacaatcttttggagaatcccaactcccccaagcaactagtattttctcccttatatttacttctatttacacaacacttcatgagtgaacttttgggttggaactcttgttcatctgcctcacctgtcggcgtctaactccacactccaattccaatcagtgacatacacgaaggcttgtccaatacgatcgggacaccattacccccaagaacagacaacaacaacaacaacaacaacaacaacaacaacaacaacaacaacaaaaaataaaaaaaaaagaaagaaagagaaaaggagaagagagaaggcattgaaagcaagaagccaagaaacggcaactacagcaacagaacaaatccgaaaaaaaataaaaataaaaaaggaataaacttggaccatcgccatctatgaacaggagtatcaaccatccatccaccacccccaattccacagagaaaaaaacgagagatcgcgcgaaggtggtgataatccccgatcagcagccacaaaaaaaaaagaaaacgaaaaaagaaccctttccccgcaagaacgatggctgctggctgcatcgatcaagaagaagaagaagaagaaaacctcgggtttgtctgaggtggtggtcgcgctctgcagttgagaggggccggaggaggagggttttagttgcagtcggtggagacgagactgcaggaggcaggaggagaagcggagacggacacagggacacttgctgctgctgctgctgctgcgttgcctctaccacttcggcgagagagagaggcgcaatggccgcgaggagggggtggaccgcacccttgcgtgccccgcgaggaaaagaaccaagcaaaagtgtagtactactcctactagtatctctccgccgctgcgtcgcacggacgtcgtctcgtcgtgtacgtgtaccggagtgtggccccagccgtatcggcacgcgacgtctcgttcggcagaaaaggaagtctggcgctttcccccaatcagacgaccgctacggccacgccacggcctcaccggtgtttcccttgcatgaaatcaaaatttatttccgtttttaatttttcatccaagtttatttcttatcattagtttctaaattgctaaaaatatatacataaaaatttatttataaattattaaaataaaactaatttgatattttagatgttgctaaattttaatataaacttgatcagatttaataaaatttgactagaaaaaaattaaagaatttataatatacaatagaggaagtagaccctatctctatggaaatcttagtacggagtactccctccgtttcaaaatatttgacaccattgattttttaatacatgtttgaccattcgtcttattcaaaatatttattcaaaatatttaagtaattatttattcttttcatataatttgattcattgttaaatatactttcatgtacacatatagtttaacatatttcacaaatttttttaataagacgaacagtcaaacatgtgctaagaaattaacggtgtcaaatattttaaaacggagggagtatattagtagccatacggtatattacgggaaaaagataggccctacgtgtccacgtatagggataattctatgggcgatctcgcgacgttctgggcgtgatgcgtagtagtagtaaccaaaacaagccttttgctgctaatgtaatccatccctataaaaaaagattatagagtacggagtacttttttttacatggcgagatgcgacaaagatttaccttctctttttttgggtttgtttttctactgatggaaaccgacagaaatttcagctgggattctggcaaaaggcccagatatgatccggtgaacacaaacggttctggctgggctacctgtccttctggcgcagttgaatttaggcctgtttgaatgagcctcaatccaggcccataagcatgagggtaagtgctatgatagatatgactattgtctccaaatttatctattttattcactcataaagcaagaggcaacccatacaatgtatcacctctagtttacaaataccaatatatctaatactctcacatcctttttgaaatttgtgtggaggttgcctcttaatttaggggtggctcatcatctctctcttcacttttctcctccacctcatcacttaatccaatgtggcacttgtaggagcaacatataaagcattatagtacttgccctgatgtgctggtgtttgagtcacgtggaggaatatgtttcattcggacttggagtactgtgttccaaagcctctgtgattttaattggaaaatccataagtaaattttcgtctctaatggtatctaatcttttagggtatgtttggataatgggaaatgaggagtgggattgggagtgaaaaatgaatgaatggttataattaaatggaagagggagaataaatggttaggatttaaagatgtcttttggtgggtgaaaaatcatttccctaacacattaggcaaacaaggcattaggcttaagttgttagccttttggattatataatttataaacaaaagtcttaataagttcaatggtggagtcgtatctctatctcactaatagtaatagtgggaatctagttcaaatcctacaaaataaaaagatcgagaaaacatgattttttttttcataactccctgtactccctgtctccatcacatccatttcaaaacggtgcttcccaagtttgcagtacagctaacgggtccttttagatcagtaatactttttgaaaagttcctcaaacagaaggcattttataaagaatattttcatgcgtgctaatattaagatatactaacccaaagacatttttttcctgatcacttgaataaatacagtggtattagatattttaagggtcttttgatttgtaggagaaccataggaattttggaggattttatcttatagaaaaagattcatatggagacatttgaaataaatgattaaatcatatcctatcctttgatattcctatggaattaaccatcctataaagatttcggagaaaatttagtaagagtttcaacctattggaaaactttctttgagtctatggctgtgtttagttcacgccaaaattggaagtttagttgaaattggaatgatgtgacggaaaagttggaagtttatgtgagtaggaaagtttgatgtgatggaaaaagttgaaagtttaaagaaaaaattgggatctaaacacggtgtatatctctcatcctattcatgtgctttttcctgcagtccaatcaaatggtaattgcagtgtttttcctattcctctattcttttcattcatacgattcaaaggagccctaagactctgtttaagaagagaggaattgagaaaattgagaagatacacaaaacgagataagctattagtgcgtaactaattaagtattaattttttaaacttgaaaatggattaatataatgatttttaaataaattttttataaaaagtttattcaaataacgtaatgtattacaaactaaagaactcggagcctaagtacaccacgggttctttgtcagaaaccgtcggagattcgtgagatggggcgaagaacagcccacacagcgcattgcgagaggcatagccccgtgcttccagccagcaaccagggaggagggccgccagacgggggaggaggtgagggccgaagaaaggaggaaaaagcctcgctgttcgatgtccactcgccgccgaggccactccaccatgtcgccggccatcgacctcagggtcgatttccccttgtagcatccggccaccggccagatccgcgccatcggagaggagctcgaggtcgtctaccaccagatccataccagcgagctccgcatcaccctaggcttgattggtatagttggctacggctgcaactgtgctgcatctacagtatcaataacatatttttgaattggagctgttgcagtgctgtggctgtgcagcagcagcaaagctgaatcgaaacaaaaaaaattaagaactgaaacaaaaaattttagtggctaaaatattacatatagccacttgcactatcaagaattcagattttggatcatccataaccctagcctacgtgacacccccagacttgtcaaatatgtgtgacgcacgtgaataccttgtcttctttctgcgtgtactccctccgtcctaaaaacacccaacctaccacttagatgtgacataatttagtactccctccatcccttttaagtgtaaccatgaattttcgtgtctaattttgatcgtccgtcttatttgaaaactttttataattagtatttttattgttatgagatgataaaacgtaaatagtactttatgtgtgacttatatttctaaaattttttaaataagacggacgatcaaagttgaacacggaaaatcatggctacgcttaaaataggacggagggaatacaacgaatctggatagagcctgcccagattcgttgtactagattatgtccaggttgagtttttttggacggaggaagtacgtctacccatattcgttgtactagattatgtcccatctaaataattggttgagtttttttttggacggaggaagtacaggggatataaaaacagatttagcgaaaataaaagtaggccccgtttagatcccacctcaaaattttacaccctgtcacatcgaatacttgaacacctgcatgaattattaaatatagggtgtgtttagttttttgggtgtaatgtttttgaagtgtacgaacgcacatttaaagtattaaacgtagactaactagatgataccccgcgcattgctacgggattgcaaaggattcattgagaaaaatataaagataaatcatatttgtacctttaagaactatatcagttagatatcatatatagcatacatcagtatatattgcattcgtgtgatgcataatactgaaaatatggacaaagttaaatgcgacccataaaccatccaatttaactggagaacataatttaaatcatatcgaaaaagagtgaaattgtacagatatagagaattaggaaataaaaatattagttgcgtgagcatcacttgattgaaccttctataagaggacatctattttgagacatgggagcaacaaataaaacattagcagagacaaaagacaaaaaaaataaatcaatagactaacagaaaccacatgcttgttttgttgctatgcaaaacgaatgcaacgtgcaacagttctgctcgtcacggtactattaaaatctaaactatgacgtgctttttagtggtgcacagtatagcatgaaaggcatactgaattaaaaaaaaagtgaatagaattttaggcttacaacacaatttgcgcagtatagcatgaaaggcatactgaattaaataaaaagtaaatacaatctttaggcttacaacacaatcaattaggaatatttgcaagaaactatatgatcaataacaaatattctgtgattgaccgcacctaagttagctgctagaattgttcaagtgtttattcaccagcaagaagcaagttgccatatcaatattttaattattgattcctctttcccttgcatattctagtaaatagtaataggaaaataaaatataacattagataaaatataactctgcatcggagtataacaaattagacagtagcaactacacgaattattgtggtgtgaatacaaaggaaataccaatataaattgccaaatgttggtagtatgtgcagtgcgcaagacaattaactaaaggatttttttataagaattgtattgagtaataaatctgacactcgggtaaaactgaactattaattctttgttaaaaaaaagaaatatactgaaccaaccatccatctgtttcattgtaacgacatttttgttggtgatatatacatatacataaaactgcaaactcaatcaggccaccattgaccgttggtgaccttctataatcaaaggtcatggccacatgagacaaagtgactcaaagatgatagtgtgaaggtataagtaaaatttaactatttcaatacgattaagaaaccaacataaaaatgaacaaatttgaggtgataattaccagctcttacgaattatgaaaaaacaccagtccaccttgaattcgctcttaacatgaaaaagccaccatttgatgacaacaacagggttgaaggatatagaaagatccatccttataatatgatcatcattcagccattccgtttaacatatgacagggacatctgaaaatatttccaaccaacgccattccataaccgtcaattacaggaattaaaaaacggattagcagtaaaatactcaccagggagccacagcctatgggagtgaggagctccctggtgtactgctggccaggtaagggaaccgacgcacggggagggagtgagggagggagggagggagttgagcgggtggaggggaagcagcgcaggggaaggggaaccatgcggcgccgcatctacgtggggaaggggagcgaacagcttggggaaggcaaaaggttgggttgttgggctgtcaaatgggcttttcgtgtgtaatacttgggtgttctcaccaggataacatatgcattgatatcataccattgagatttcatccaacggctgctatctttttggatgacgtggatcaaccacagtgcagagaattggtaataactgcagttagtggggatcacttgtataggtatataggataacaaaacaaattacagattccgcctgtaaactgcgagacgaatttactaagcctaatcaatctgtcattagcaaatgtttactgtagcatcacattgttaaatcatggcgtaattaggtttaaaagattcgtcttgcaatttacatgcaaactgtgcaattggttttgtttcccacatttaatgccttatgcatgttatcagggttatgggtaccacatacctaataatagttgactaagcacgataggacccaccatataccaagtctcatacggaatcatacctcgtatatagaaggagttctggataaggaaagcaaatagagttgtatatggaaacgaaaaggactactcggatcgtatccatgcttatctccctagttctatttggacaagagggcatctatgagtataaatacaagaccccctaggaggagaggggttaagccacaagaccaagatcaacatagatgaatacaagccaacacatgccaagacaaaccgccgaatatcgacatcaaagataagtctagacaaacccaatattgtgtctgcgaaagccaacaagagggatctagcgctatctctgatctcgccgagtgcggatttgaggaggaaggctaccctgtcgtcgactacgagttggttatccatgccgccaagtcgacgacagctagataggttatcctaattattgtattggtgtgattatgatgaataagagcaataccggcttcggccaacaggatgtaaggctattacctgtcagataaggggcccgaacctgtataaaaacccttgtctccgtctcttttacttcaatctcgcatataccctggtaccaacgatccatatactatgcaaaataccgttgtcgcggtctcaaacgtcgacatatgtgtccaaacatttgatgtgacgtttttggccaaaattttttggatctaaacaagacctaggcttaaaaatataactaattatatagattacgtgtaaattgcgagataaatcttttaagcttaattgctccatgatttgataatatggtgctacagtagacatttgctaatgacggattaattatgcttaataaattcatctcatatgctaattagcacacgtttactgtatcatcacataggctaattatagattaatcaggctcaataaattcgtctcgcaaattagtgtagggttatagaataagctttataattagtctatatttaatacttctaattagtgtctaagaccctgtttagttctaatttttttcccaaaaacatcacattgaatttttagactcatacacggagtattaaatatagatcaatttaaaaactaattgtgcagttagggaagaaatcatgagacaaatttttttagcctaattagtccatgattagccgtaagtgtcacagtaatctacatatgctaatgacggattaattagtctcaaaagattcgtctcgcggtttccaggcaagttatgaaattagttttttcattcgtatccaaaaactccttccgacttccggtcgtctgatgtgatacccaaaaatttccttttcgcgaactaaacaggccctaaacatcaaatgtgacatgtaagatcaaatttaatcgttgatccaaacaggcacttggggacggagggtgtagtaaaaatctcctgcgatattgctgacacctagtcaaatcagtcaccacttgcgcggagctgaagagccggctcgttcctctccttcccgttcacatttcaaaacctcaaagcccccacaaacttcggaatcgaggtgagcgggagttcggagagatcaacccgagggccgccggccgatggcgatagatcagcccatcaaagcaagttctttcctctccctctctatctgtatctctcgtttctcgattaaacccagtttttttgggggtcatttgcttcgcttattcactgttcatccggttgattagagaccgagggttctttgatttgttccactctctcttgaatcatcgattaatggcggcggatttgggggctaaaagtttttgtcttttgtgttagatttcatcttcttagctgcttttcttgttttgattcttcgatccgagtgggagactgaagagagtgttctgtgtgtgtgagagagagacgtgttcttgaaaatttccccatgctttttttttcggatgacggagtgatctgatatttcagctatgttatatggttatctgtgatcttcttggagattttgcttcctctttgatcaatttggttgtactgctcgttcttggatacgatttttgttttctgtttaatgactgaaatattggtgtttacttccatgggtaatctgaatctaattcgcttgtcctttggttggttgttcttgagcagaagagagggagaccaccaggttccaagaacacgaagaacaagatggagcagaagatggaactagtccatcaaaggctcgccttacttgacagcagcagtggcagcgacagggatgacgatattgggccgagggtgagattcttgcattatcatttcccattgatgcgatacatacattgttgttgttgcaaggcattcaaatcaggacaggttctaactggaaaaaatgggagaggcatatactacaatacctgggtgtatgcccaatctggattcttaatttgataatattatctacttctacttaaatgctaccctgaataattcatgtatcgcagcacatctgtatgttgatatgtcacttcacaatctggattctatccgctcgttcttgcatgtttatgaagtgacatatcacatattaatctactccctttgtcccaaaatataagcatttttagctatgaatatggacaactgtgtgtctagattcatagccaaaagctgttacattttgggacggaggtagtatcttatcaaatttttttcataactatttggatgacatacaagaaagagggattaaaaagagtttcccgtaggttcacaaattttgtaactctgaacaggtaagtcatgacaaattatcagatgctgtatttgcttaaatggtcactttatgtgttaactgtgaattttatccaggtctataaagtactatagatgttaatatatttctctataaacttgatcgaatgagagaagttttgacttaggacaaaactaaaagaccttgaattatggaaaggagggggtatttctagcttatgtttcttttttctgttaatgctcattaacatctggtagcccctataataatcaagggttaattggatctatgccattataagaatcatgtatttaccatgatatcaagaatatatgttctttttgtacttgcagaattataatcttgcttttgttgttgctccacaggctataataattgattgtgatgaagatgatacggatgacgtgatggaggttgttcctttgaaagtaagggcagtgctgctttagttagcgggtggaattttgtcactcgagaagacatccccttgttttgtgcatgttgttcaaaaagtcataaaaaattgaaaacataagatagatcaatatgtaaaatatctcttcacaaacatgcaagttcaaattcgacctatacaagtagaaaaacaaaaacaataaatttgattacaaatagtgtgttttgttctatcgtgtcacatattgatctataatgtcaaatcttcttaaacttttttatgatgttttgggcgacatgcacaaaacaaggggatgtctcctcaagggacaaatagacttttccctttatatgattatctgtttacaatggtgtaagtttatatgatataaactacatgtgctctatttagagcatccctgtcaatgatgctacatcattgatagcactctatgtagcaacaatattttcaattgcacaaactcacaatatctgtcctccttgttatctcataacttcatttattaattctcatctcaaaaacaacttattgattaagtgttctgatttttcttggatttcttactgtgcaagatgctgatgccaaaggaggtggaaaatgagcaaagaacggttcctggcattcctcaaacatgcaatacccagaacactagcaatggacgcactaacaccactgaagtaagatatgttcaccaactctatctgtattgtatgaatgcagtatgaatgtaattgtaagaggactttcagttttcatctataaagctcataatacccctaaagatttttatatcataagccatagcatttaggatttcgattggctggctgaaatctccggttttccaattcgaaaaaaaaagatcacataatgtaatcctggaacacatctccaatctttattcagtggactttaccatttcctttccaattcctgtataatgtatacgaaaccgttgcacttttgagctccattactcataactgaatgagttgtgacttaacaggtgccagttaagggccaaaataaatgtgcaaggtattccagctctccttgttcttcttatgaaaaaaactacttatgtagctcacaagcttgttcaatcacacgcagttatcttccaaaaaaatctagtgttcaggcgttctgtggatctgctatgaagagagctcaagagattcaaacgaagttaccagcagagcatcctagctttgttaaacatatgttacattcacatgttgtcagcggattttggctggtaagggttgtagattactaacttttcttatgcttgtcaatttatgaagccttagataattgtttcttatgaacaggctgtggagaagcaccttctgcagaaacatacaaattgcatttactattagaagattttatttgtcaaacaaatgctctcactaaaattagaaagtaaaagtttaaagcgtgttatggatcttatttaaaacttcctactaccctattaacatgttctaaacttctaatctttttcattaaattttgttttaggaagagaagtctcacacatacaagttatatccaacttatgtacatttcttgcatgttagctcttactgcttgagttattgtgtttatgaaaatggctgacactagttctgcacaagccacctagaaacttctttttggttttctctgcatctgattattgttctcctctgcagggtctaccagctggcttctgcaacaagtatctcccaaagcatgacactgacattgtgctcgaagatgagaatgggaacaaccataacacaaattacctgggtggtaagcagggactcagtgctggatggagaggttttgcgattaaccatgatatcaaggttggcgatgttgtggtctttgagcttgtgagcacaacaaaattcaaggcaagtgtttctgaaatgcttgataactttcttccaaatctactactactacttgattgttcctttataatcttcattcatacccatttcttgagttcccttgtgggttcagtcttccctaatccaacaatacaattacctcttgtttcttcatgccttacattcaggtgcatataattagagataaaaacatcagcccaactgacagagcacccggtctcaagagtttttacgcctgcaagaaacggaagatatctagtgagtcaaagtttatgttgttagttttgcaccttgaaatgtgttagacatgggaatatacactaactattgaatctcccgaatcatgtgctgtgttctacatgacagaagaagctactgataatgccaccaagcctaaggaggatccagagactactagagtcagtagcaaagtggctcatgatgatacccagaatctagttcatgaagcaatagacggcatcaggttttcagactcagagatgagctttgacgacgtgatgagctacagtaacttcaacatcgtcgtggacggcttggtcattgactgcaagttccccgatcaccagcgcaggacgtactatgagctgtgctgcgcccagaagtcgttcctccacaggcatctgctgaggcagctgagcctcacgctcgtcgtgggggtgatcatggagacgatcaacatcgctgagggcatcagggcctgcggggcgggtacctcctcgcaagaggacttcctgatctggaagaagacgctgcagtcattcgacctgctgggaatgaatgttgcgttcttgctcaagcgcgttgacgatattctcggcctccccgagcaaccgagggatccatcggagtgtagcaagtacaatgagctgaagcttgagcggtctcgtgctggggagaaggtgaaggctctggagtccatgatgttgacagtgaaggatgtgctgaagaagatcgatgccgagatggaggagatggagtcgagcgtgaggaaccatgacattgcgctgcggaagatcgccactgcgccatggtgatcctgcttgacatctggggtacttgtctgaaacattttgggttcgtcattcagggtttcagatgatgatgatgatgatgatgcactgggaaaccttcgtggtgagtgactgagtggtgaatcctgctaaactcaaggactgaccacatttttgtgtacatttcttcagttactaccacgcagctcagtgcctatctagaactgttcagcagcaaacctgtctaggaatcaggatgctgtttttacacggtaaatcgtataacagaagttgtaaattttggggggcgaatgcgctgtaagcagtgcaggaaatgcgaggaagaaatgcagaacactacttaattatttcagactccgtcattcagtgcaccctgttcttggtgcctgtttggttggtcggtaaaggaggcgtgatctgaataccggatgccaccttcagtaattttcagattgttctaatttacatataacaaatttgtcatttcttttagcaagcttgcatttccatatgtttccaattcagatgttccctacgtttcacaatgtaagtcattctagcatttcccacgttaatattatatatctatgtagattcattaacatcaatatatatgtgggaaatgatagaatggcttacattgtgaaacggagaaagtggtatattttatggtggaatgcatgagttccttgctttgccttgtattttattttactggtcaaatacccgtgtattgcaatgatttatatataaggaaaaaaaacgagtctttttgttgagaaaaaaatggttgcttctatttggttgaaatgggattctttatcttaaaaagacaaaaagaaaagggacatagtatagttcttaaagtgagacataaaccctttttcacgtggcaatgaaattctcattactaacaaattgtgcagtgtaattaacttaaatgtacaaatgaaacttaaattttcatggttttttaacttgaatagaggtgagaaagaagcaaagcaatatagcattaaagggttgcaacccgattagaagcacccaatttcctctttccggagaggaagagcaatgactgcaacacacaaagcaagaggactcacatttgtactgctctcatggccccactcgtcagtggtgttggcggcatcatcgccacaagtctttcgaaaggagtatggaaaatgataaaagtacattaagttttcttatgccattcataatacatctgatccccatgcggttgaggagtggaggaagcggggttatgacttccacaggatgatgctctctctctccccacgttacttacccaggattaggctgaagaacgagtgatcaaagttaaatacggggacttcaagtaggtgcgacagaagcgaacgtaacacgaaatatttattgggaaacgctgaggccgaatgccaactcaatgcactgtaaacgcccttagctcatgtccattagtgtttttattcattcataggcaaatcggaatgtatctgttcaaatttttgtttttacagatatgattcttttgggcaacaaatggcatctgaacgtatgtccgccctcaaactaatggtaatgtgaccatattttccacaggttagatactgaccatttcgtacttctctcacatttgacatttttggcttcatgcatgggtttcttcaaaaaaaaaaaaatattcgagaaccgccactatgagaaccccacgaaaccatcattaatttttttcctcctagatccgccaatgaagttcatgcatcatactacttgatccatacatcataataaaattggaaagtatttatcttaaacattccttaaaactaaaatgcattataacgttaataaaactaaaactatatcttgaatcatttcttaaggtatagtttatcagtcaactaaatgtacatattgcggtcaaagagtacacaccttcttcaacatcatgacacgcatcttaaaaaaacatttcttaagatacgttttatcggatgataatatagaaccaattttccctaccaaaatacagttacctcagctttctaattcaaatttgaacttgcgagttttggaggttgcagatcgaccctaccgacaaggaaggtaccaccattgaaatttgttgttcctgatgcaaacatgtatatatacacataatcccacataaatgcacaaactatcttattctgacatgtgtttctgaactaacaacttcagtggctagtctctgaatgaaactccagtcagtggctagtctctggatgaaactccagtctttgcatctagcgggccacggtagccaaacagacgcctgataagaccattgccaaaagctgtaattgcaagagataataagcgttaattaccattagctgtaaagcctaatcaactgcagataatgcagtcagccaaaattagccgactcatcgtcagatgtgcacacacctattttcgagaaacttttaggaagctcaagctttgacccaagccttcctggaggtgtagttagcgtctccttggtctgtgaatcgaaggtagggttgtctatgatcacattgaggaagacccatagatagcgcttcacatcatctacattgaagttacactcctcatagtgctcattcagaaggttcatcagatgggtggtaatcagctccgtgacgtaatcaacatgggttccaccttttagtgtctcaaatccatttacaaagctgacctgcaaaaccataaaaaacaggagtaaaatgcagcaacaaccatggcatttaactaagaagctaccctgatataaacataaccaaaacatttacctgctgaaagtgtccatcatcactcaggctcaaacagacctcacaccaatcatttaacttctcgtaaactctgaaatcgatcaagaaggcaaaggtgaattcagctaattaaaaagacaaaaccattatggatagatttcgatcactcaacaaactaatatgctcgttcgaaacaacacagcacaataaccttgggaaccctgctcctgatctgtcactgacaggggaatcgatatacaggcgcacataatcgttgaagctgtttatacgcagcctcacgccatcccactcaacttgcacggagtctcctagaattcctgccatatcaaccactctcttccacatgagcgtcacgtgatcctcttcgaggtaggtcatgttgaacccagcaagatctggcttgaaggtgattatggtccagttctccccttgattgcagtctgtaatatggggcactgatttcttccccatattctcagagaaaacctggaaattaaagtattcaaggagtaagtaacatcatgatctatattgttttgatagtaaactgacctatccaatgctccatgaaagtagtaactacatctaaaactcagaaaatttgttgataatacagaatttgcatgcctataaacgatgagttttttttagcaagaggccaggcctcccatttccattagtagaaatggagatagacttacacagagttttttgactcattgactactacctggcaactacattcctccaaaagccaaccaagcagctggatcagatctggacatcaaataaatgacagcgagtatatatcaacaacaaagccgataacccctgccaagtaacaaggtcatggaataggcaaagaaaacatatcatgatcccaggaaatactggtcatggtataggcaaatataacatatcatgatcctaggagatactggtcatagtgtgcaggatctaacagttagaagagtcaaaaacagtatcaggtgtaccaaactatgccacatgctctttccggctttccaatttatgacgccgttgactttttaataagatatactactttatggactctgttattaacatcgtcttgtcactgcatgggtccttttaattttttcacggtggaatcaaaatttataagttctttgatgttaaaatttgagtataaacaaccatgcatattattagttgctgtactgtgcgagccaccgaattttcgccatctctacttatgcgtgaccaccttattctccttgtatgttccgtctatcctcctacttgtgatacatatgttttagcaaatgtaattttattttacatatttgaataggtgttaagagaatataattgacaggaaacaataggcggttttccaaaatttaatttattggaatttgatttgtccaatcgttgattagtttttttgagttgcaaattaataatactccctccgtttcacaatgtaggtcattctagcatttctcacattcatattgatgttaatgaatctagacatatatatctatatagattcattaacattaatatgaatgtggaaaatgctagaatgacttacattgtgaaacggaggaagtagttttttttcttttgtgtctcttttagatttaattgaacatgttgcttaaccccacgatcattcggcccactgaactcaaccgatcccatcccatgatcatgcttgctaagcgatagctgaggcggagcgttgtttctttttcttttcctttttttttaatcctctttcttctactactatctctctctttttaccttcaggaaggctcttcatttgaacggatggctacgatttgtcatttctgttttgtcgttttctgtatcggatggtcaccgttttgttcattacatggctcatccaagttgctgttttgttcattacatggttcatccaagttgctttgagagatttactttttcagttaggtagatttgatgatttattttactacaaaatattacgtaattatcgtttattttatggtgacttgatctatcatgaaatgatctttaagcatgacttctttttatatatatttgtacaaaaattttgaatgagacaaatgattaaacgttcataaaaaaaatcaacgacatcaatatattaaaaaacgaaggtagtatcaaatttggcacagtggagttgatttgtgagggtgtgacgctgccgagagagagtagagagtgtgtgctcagaattggctcactcacctgcttgtacttcttcatgcggcacccatcggcggtctcgatgatgaactccgtggagaacaggttggcgagcttgacaccgtagccaccgccgccgtcgttcgtcgccttgttctgatcatcctcttcgtcgtcgtcatggaggtggccgaagaacatctccggcgcgtagacgccgcgctcctcgtcgacgagctcgacggggacgacgccgcggccgttatagaagacggagacgctgcgctcgacgacgtcgacctcgacggagagggtgtccatggaggggtcgcgccgcttgttgctcgcggcgtggacgaggacctcgtcgaagatcctgtggaggcccgggcggtaggtcacctcgcgtggcaccatgtagtagccgtcgttgatccagaacgtctgcgtactgcgcttctccggcgagccgatgtagccgtctggccgccggaggatgcgctcccgcagcgtcgtgtcgccgccgccgccgccgtgcgcggcggcgatgcgggcggacctccgccgcggcggcgcctggcgattcatggcggcgtggccggcggcgctagggttttgggtggtgtgtgtcagtgttgtgtgttcacactcgtggaattaattgagagatccgggggagagaagatgcggttgcctcgttttattcggagtaaatttcatgaatttggagccttcgtatatatcgttttggataagatgagtggtcaaatagtgcaagcaaaatgtcaaaatcccttatattaagagacggagggagtaacaaatttacggaatcgctataattatgtcgacacattttctcctccatcacagtcggtgttttgaagcgttcgatttcctttgtcccgtgccaatgcaatcatgtccgtgcatattgctatggcaggctaacgttacggctgtcaacatgattaattaaaacttaacgtcttcattagttcaaggttttacacgcatgcatactatactttatacaaatttacaccccacttacacatgtaatgtaattactatataattttggaacttacacattgccgttcttttttcccccaaaaccttgataaaacctggagcggcctccaatccttcacaaaccaaacaaattgaagcattggagcccgatccggattggaggtggccgcggccatgttacggaccaccggagcggctgccggaatggcggattaccagtggccggccggtgtcggtgaagcggcggcggccggtgcatgattgcacatgcacgcacgcacacaccgatctggcaacgaacaagctaagcactcgccgagtcgccggcacgagcggatgggagtaatgcgataccacatcaccatttactcctattgccctattggcatcacatccataggttcaggcccctttgattcaaaagaaattcatatgaggctgtgtttagatccaaagtttggatccaaactttagtccttttccatcacatcaatctgtcatacacaacttttcagtcacatcatctccaatttcaaccaaaatccaaactttacgctgaactaaacacagcctgaatttcagagaattttattcctataggattttttcctatatagccctttgaatcaaaggaatggatcctatggaatcctatgaaattcctatggattgtcttttcctatgcaagttttgcaggaaatttaacatgaggtagaacctcatggaaagaatactttgagtctttatctctccttaaattcctgtgtttttcctgcggcccaatcaaacaatcattcatatgtttttcctgtgttttgatttcctctgttttacacttgcattcctgtcagaatcctatgtttttcctatttctccgttttttcattcctgtaattcaatggggcccttatccttttctatttgcttcggttgcacattttttttaattacacattaaagcgcacacatactcattcttatgaacatgcgtacataaaaccctatcgtgtctgatcacaattttgagttttccattgcgaattgtatgagttcccttcgtagtttaaaatcggtgtgtaaatgactaaatgcacaccaaatccagtcgacacacccaaaacttggcaatatgaaaatcaccgaaattacaaaaaaaaaaggtgaattccgaagcaaagagtggccagtgtgaaactaactcagcgaacactctcctcacagctataaattctatgcttcacttgtctcgcttttgctccacttacaccaacagagatttgcgagtagattttgcatggcccatgccacgctcggctcgcctgagccggcggcaaagcctcggctccggtgcgccgacggccgccaccgccgccgccttatcgtcgtcctgtgcatcgtcggcgtggcgctcgccgtcggcgtcgccgtggcggtggcgatcgccgtcttggggaggtcgaggatgacgtcgtcgtccggcggtggccgggcgccacgggggcgcgcgccgaccgaggcgatcgcgcgcacgtgcggggtgacgctgtacccggagctgtgcgtcggcgagctcatggcgttccccggcgccgccggcgccggcgacgccgagctcgtgccgatgtcgctgaacgcgacgcaccgccgcgtggtggacgcgctgtacaacgcgacggcgctcggcggcgccgccgcgctgctcgccggggcgcggtcgggcgccgcgtacggcgactgcgtggagatgctcgacgccgcggaggagctcctcgcgcggtcggtcggcgccatcgcggcgccgccgccgccgccggactcggtcgacgccgacacggcgggacgggacgacgacgacatcatgacgtggctcagcgcggcgctcaccagccacgacacgtgcatggacagcctccaagaagtcggcgccggcggcgacgccggcgacgacgacggcggccgcatcaagccgcagatgctcggctacctcggcaacctcggggaacacctcagcaacagcctcgccatcttcgccgcgaggggaaggcccggcggcgagctctctgatgtccccgtccacaaccaactccacagacggctactgaccatcgacgacgacgacgacgacgacgggagcttcccaaggtgggtgagacacaacgaccggcggctcctccaggcggccgccgccgagatcgaggccgacatggtcgtcgccaaggacggcacggggactcaccggaagatccgcgacgcgatcaaggcggcgccggagcacagccgtcgccgcgtcgtgatatacgtcaaggccggcgtgtacaccgagaacgtcaagatcggcagcaagaagaccaacctcatgctcgtcggcgacggcgccggcaagaccgtcgtcgtcggctaccgcagcgtccacgacaactacaccaccttccacaccgccacgctaggtacgtaacgtactacgtagcactgttaccaatggcggcggagcacgttgctgatcgtgtcgtgtcggtcttcgtcgtcgccgcagcggtggccggggcggggttcatcatgcgggacatgacggtggagaaccgcgccggcgcggcgaggcaccaggcggtggcgctgctgctgagcggcgaccacgcggtggtgtaccggagcgccgtgctggggtaccaggacacgctgtacgcgcacgcgcagcggcagttctaccgcgactgcgacgtcgccggcacggtggacttcgtgttcgggaacgccgccgtggtgctgcagaactgcacgctgtgggcgcggcggccgctgccggggcaggagaacacggtcacggcgcaggggcggcgcgacccgaaccagagcaccggcatctccgtgcacggctgccgcctcctcccttcgccggagctcgagctcgcgccggcggcgcggcgcggccgcgcggcgacgtacctcgggcggccatggaagccgtactcgagggcggtgtacatgatgtcgtacatagcgggccacgtccacgccgccggctggctcgcctgggacgcgtcggggcgcgcgccggacacgctctactacggcgagtaccgcaactccggccccggcgcggcggtcggcgggcgcgtgccatggccgggccaccgcgtcatcaagctgccggaggaggccatggagttcaccgtcgggaggttcatcggcggctactcctggctgccgcccaccggcgtcgccttcgtagccggcctgaccgtgtgaggcgactctcactgactcatggtagcttaagccaataagttgcatttgctaattgggagataggtggtagtaaaagtaggtgtaatttttcaagtatgatgtaatcatctacacatgctaactgattcaggaaaattatgattaatgattagtttgtaggcttgaatttggattgagaaatgagaattctgaattgggcacaaaaacaccatgaatgtgaatgaataaacctgtgaaatattatacaataacgatattttttgcaatgttggtgtaatgagaaaataaattgtttgtccaactacttggtccctgcaagcaatgagagtgcagatgaaaatagtgtactagctagtaccctggaaataaaatatgccaaccaaaaagctccttttggttgtcacttaggctgctcacaatatcacagtgagaatatatgcttttctttgcattggatttccaggaaatagtacctgctagatgggtgtggggcttaccactagaagatcgaaagaaccaaaagctagcataaagagagaatatcagagagtggcttataattgatgggctattgccactaaattcctggcacaaattcttagctaaaatatcgtgtatttgtgctccttatcttgtatgtaggggaataattgtgtatttgtgttcgacaatcttcagctattttttcccggcaaagcagtagcattgtatcgttatcaacaatgacaactgataaaatctaaacataaacaattggatccaaaccttcacataaatacataatcatgtgcaatcatctgtacatagtcccatgctttctcatgcgattcaattctgcttgcttgggcatggaaggcgagcattcatgttgatatatccatggtgttttcgtctgtcatttcctacttagctaaaaggccatcgatcagtgcatgccttttgaaagcaagcagagcctttttatcccaagtattcccaactaccccccccccccccccaaaaaaaaaaaaaaattccaaaggtgcagcttcttttgctgacaaagtagaactagaaggtagctatcacacgtaccagatccaagattgaacttgggcggtgaggcaatgtggagcccttggaagagttgatcttgagcacaatgatgtgagcctgaagagtgacagattctcatgatttacaagcataatgcaactgttagaacacaggcacaaatttaaagcaaaattaaggtaactctaatctggtggacaatgtccatgttaaaatttacataaataaaatgtccatgttaaaattggctcaattgaaaagcaaattaaagaagcccaaatagagagctccatattctacttttctgtaacaagtgatatcagagcattttaaagaagtacggacacaattaaggggaatgctacatgacaattaagaagatgtacatcagttaagtccagctttgcgatggaggacgccagttggatgaatccatgtcgcgcggccgacctagttgccgccgaggccagtggcgttcttgacggcgtcggcggcgccctcctgcgcggcgctcgccgcgccgtgcgccttctccaccgcctcctccctcctcgcctgcgcgtggcccgccgcctcgccggccttgtagctgagctggttggcttggtcggccatggcgatagctcaagctgctgctgctgctccttgaattcgaatataaacgccccccgctctctgtacgtcttgccgttgccgtacgtcttcctggcgcgcggccgccatttgtaggtgtacgtgcgtggtcgccggcgtgctgtcgctacatttgccgttgcagcttggcatgcgcgccccggccgccgcacgaggaggacgaggagaagagagaacggccggccaacaagcccgtaatggatgggccgtgaaggtactgtgatgacgggaaaaaagttcatttgaggtccctcatcttgtcgtcgagtttcaaaatcgtccctgaaggttcagaatcctatctttttataaagttatcccccactaactgtttaaacttaacatgcaaagatgccacatcattattcactaacaagatgccacatcatcatccactaattaacaagatgccacatcatcatccactaacaatgatcacatttaaacatcatgcaaacatgctatatttttatagtttttataatttaagagcttttcaaatacaaacctgttaaattatcatctaacataattcacataatgtttcaatgtattatgtttttttttgatacatgctatatctttatgtattatgttttttttatatcctatatacttatacagttcatccttacttagttagtacttaaatgattaatctatggtccaaattatctttctccttttttttctaattaagtcatatcacattaattgtttttagccttgagatgaataatctacggtacaaactatctccctacttttcttcttctataaagtcataccaccttactttttacgtttgaatcaccattctacatactatttaaatttaaattatcataaaccatattgatttacttaatctgatattatctagctatcttacacattatttttttattgttatcatactaaattttcgcagcaatgtgcggggtttcagctagtatcatatataacgtgtccctagccttccccttcaccgattgactagcagccagctaggcatggaactcttccgacaactgcgccatggagaccgtttcgttcctccgcgcttccattcgttccactgaacaaggcgcgcgcattttaatattcaacgctttaaacatttggccaataattattttattataaattaaattttatttgatgcaattaatattattgggttgacattttaatttaatttcctatgattacgatttttcttataaacattataatatatgagaaatttattttatatatgtgagagatttatggttaaagattagttttggagccatttctaaatttgacagcaccttattcggtgggtagggcattttttttctaaagaaaaaactatatatacagatttcttggaatactttatatgttcaatgttaattcactcatttgtgcccttaaataattgtaacaaaaccagaataatctaccatccgtcctccacagtttaaaacgaatgggggctatttttttttcgaggaacaatgggggctaaatttccatgctgtgaatttcatcgtctttgatttcttgaaaattttgtgattattatattttatttgttgtttcgagcagaagacgtacacttctggggtgtggcaattcgaggcatacgggtacgtgccatcgggcacgacggggtgtccatcctgcaggtgttcggcgcgtcgggtcgtaacacgacgctgatacctttgaaagattagggataagttatatatggtattatagttgagagacgattttgaaactcaacgacaagatgacaagatgagggacctcaatttaaccttttcctactgtgacgagtgtgcgtgcagcccataatgcatcagctggatgtacggcccgacccgtgtttatggtttggatcagatcaggccatggttaatttgtataatgcaggaatagataccagcatccgttgtagtctagctggttaggatactcggctctcacccgagagacccgggttcgagtcccggcaacggaattttttgcttttatttcttctttgtttcacatggccagatgtgcgtcgaagtttcttttctttttttttttttaccgtctaccttactactcctactttgtttttattatttcgaagtgaggtggccagcaatccagcatccttgccaaaaagcaagcgaaagaagacgacgattcggcctctttttcccaagggaaaagaaggcgcaatcaacgcggcatgttgcttacacactaagctccccgcgagcgagagctttgcgtcccaaaagaaacacacaaaaaaaaaagccaaagaaataccattactacaaaaagaataccgaacctcatcagccataatccccaactccgttcctgttaatttcctgtttggtggagtccgcgtcctaacttcttttccctttcgctcgtcgctttgctatgctttgctttgcttagtcaagtcacactcgtaataccaaagctgtggttagtctatgctaaaattaaaaatttggttgaaattgaaacgatgtgatggaaaaattgaaagtttatgtgtgtagtaaaggtttgatgtgatgaaaaaattagaagtttgaaaaaaaagtttagaactaaatgcggtgcaagtttatcccacattgctcgacaaagcccagctaatcagtgaagctgtgctgatcagctgatcagcagttcagcgtagaacaaagtctagctaacacgacagtaacagcttcactgacacgaaagaaaacgaacgtgaagctgaagcatctatcaatacaaccatcgaaccaacggccaggattcgtttgcccttagaacacacgtcgtcacatctcctcctagggtaataacggatcgtatgttagttctgcgttgagtctgtccaaaatgacggtatagtatgggtttataaaaattttagcgaatatggatacggattcaaataatatgatatgaatacgaatatggtatccctaaaattcaatagatgcggactatcctatgaaataatatatgcataatcacactatctactctatatattatgagttgacacattcaatagcccaatttatcagttaccctattatcagcatgagctctcacgatctcttctcacgaccgcatactaccgtcacgcaccgacataacgcaggatgcaatgagccgcgagggaaacccttttcagcacttccccttccacctcctaattaatctctgatgtaggctctggtctcgtgatcttcaaggtacgtagcaacgacaccagcccaccacacacatggttaaaaaaaagtgaatattagagaatgatctaatatcaaataaatagaatgaatgaggcttcgaactttggtcggctaacccaccaccatgtggagctagccaaaagaccctaagcacttctcccaccacacaatggggttcacatcgtctgctgttgaggcttacggcaaacattgccattgcattcatccgtgccacacatccttctatcaacggctgtatgcagtgatcccaccatgattaattagggcctactaatcagcataattactaatttctcttttttaaaaaaaatcagaaaacagaatatgcacttggcggcaaagcgtgtgagaacaaaagtagagtagactgttttttttaagatttgataaattctatttttttaacttatatcagtctatacatttgtagggtgattcaaatggttgtgagttgtattctcaaggattttgttagtagcttcatttcgctgctagtttttggataaaaaatactctgtatggacatagtagtagtgcggcaatgctatttttgtcaaatgaatacttaaatagtattttataagatatgtactattgttcgaggatttggatagctctcagtataatagaagcttgctttgctgcagtattttgctctgctctgcttctatgcttgattgctcgcacgctttgccgccgagtgcgtattctatttgctgatttttttttcaaaagagaaataagtaattctgcttattagtagttcataattaatcacaatagtgggatcacttcatgcagctgttgatagaagaatgtgtggcacggatgaatacaacggcaaaatgtttgccgttagcctcaatggcagatgatgtgaaccccacacaatggttgatggtgtgcacgaacaacttgacattgttttatttacacacagcatctgagaattttaattattttccgaacaaattcgatatcgacccccaccattttcaacgtccgaaattatccctttcatatccgctccaacacataggtcgtagatactccctccatcctaaaatgtttgacaccattgacttttttaaaaatgtttgaccattcgtcttattcaaaaaaaatttaattaattattaattttttttcctatcatatgatttattgttaaatatacttttatatatacatatagttttgcacatttcacaaaagttttaaaataaaacgaacggtcaaacatattaaaaaaaatcaatggctttaaaaaagttaatggctttaaatatttagggaaaggagggagtacgatacaaccactaccaaaattaccgatctcactccaaactagaactcctctctctcctctccccgacagccgacagcagcagctgcggaggctgccgcgagaagcctccacttcgccgcgctctccacttttgcagcacatgccgcccccaaccactccatgccatcattcactcctaaagcggcgcgccacctccggcgcaagccaacaaatgcgctcgccacgcgcacgcccgccagcagcaaccacttcccactcaccacgcatgcagccgccgccaagaacccgcgatccggccatcgccatcgccggcgacggcgcggcgcggcgaggtcccccgccgatgcagccgcccgggccgccgccggtaaggcatggtccgccgccggtgcggcagcagcacggctactactacgaggaggagcagaggccgctgcacctgcacgtgaggacggcgaggtcgtcgtcgtcggcgctggcgtcgtgcctcgtggcggcggcgttcctggcgctggcggtgggcggggcgggggcggcgctgttcgtgctgttccggccgcgcccgcccgacatcgcggtggcggcggtgcggctgccggcgttcgcgtccggcccgaacggcacggtggcgttcacgttcgagcagacggccgccgtgcgcaaccccaaccgcgcgccgctcgcgcacttcgacagctcgctccgcgtcgcctacgccggcggcgagctcggctccgtctacatccccgccggcctcatcgacggtggccgcaccaaggacatgtccgccagcttcgccgtcccggcgttcgccgcggccaccccgccgtcgctgcctcaggagcagatggccgccgccgccgccgcctcggcgcagcagcagcagccggcggcggcggcggcggtgatggaggtcgactcgctgctggtggtcaaggggagggtgaccgtgctgcgtgtgctgacgcaccacgtcgaggcggccaaggtgtgccgcgtcggcgtctcgccggtggacggcaaggtgctcggcttccggtgctgaacaccactatggatttggatttggatgaaatccaaattaagccgaaattttgcgggaaagaatgtaatttaatttaaattctgcagaaaccaagcattcccgttaagtttctgagctccaaactggtggtgtaatggtagatgatgatatactatgtaatatgttccattcttaagacacggtgaaataccagagtatcagtagcattttagctcaaaggtatcatcaaggttgttcatgttctacatcaagataatctcaagttgttgcatgtaaaaaatatcatatttagcatagcatttgagctcaagacaaataggcccttcatacttaacgttgttctatctcaagttgttgcactgcatgccaaaatctctgactacagaagctgataatctggcaatgagaatgacctttctccagcagcataaccggacgtattcgattgcagctaaaacgtctgagtcacaagacattccatgcagctttggatggtatgtgccttgtccatccatcagcctgaaacatcaattcttacatggtgagtttgcaaagaacatataccatttcggaggtcgaaaagccgactctacacaacaattagccagaaatcggtgctgcaagaactcaaggacttcttcatccatcaggataggctgggtcgatgacgagggtttatactacaatgggtttagtttggatgatctttgttgggaggaataggcaaaaaacaaaaaaacaaaaaacaaaaagcacggaagaagagctacactactactcgcttgaatgggcagatgcgggataagccatcaaagcatctgttgagccagaatcgattcggggtgcacggagaactcaagttccagcaccgtaacaggaggcctgactgttactctcagtcaccatatcttgttcttgacccaaaagagcatcagtactattccaatcacaatggcaacaagggcatacttgcgaataagggcctgaaaaccattgaaggaaagccttgtcacagacgtgaaaacaggtgaagtggtaaactggtaatgcagatcaggtgtttgttatgcttaacagtccaccagtgatatgacatagataggacatagtaacgcatgagagattcccatatccctcacgtgcattggtgaacataatttgggggtatggcaggaattcatatgtttaacaaataaaggatgtagacatgttctaagcattactgtgtcaaattgatcgcaaaaggaccaacttagttgttgactacttgagcacaaattcccccccttttctcctcaaagagcaatgaaggtaaggaaatttgaagtggagttgctggaactaagcaatacaattttacggtttttgaaaataaattgcaattgcccatcgatcattctaggaaacaacggactgttgatgtataattttgagaaaagtaaagtgtcacaattctagaaagcaaatgagtagactcccttaagacttccatgaataaacagcagtcacgatttatcacatgtccaatattaattcacaatttattgaaatattaatttcatattagttgcttggagattgagattgccagatggcaaatgcagtaaagggaataagggatcacacctgacgattgagatccttcgccttctccgcataaattctagtatcagagatcaacctattggacatttcactcacctctgcaaacagaaaactttcactgagcaacagctgggaaatgtaaacctctaagcatgaaacgaaatgtgagatgagactgcaacaagtcttgccaaaagtgaagcactcatgcaaaactgtcaaagcgtgggattacaggcaacacaaagaaagaaacagctttggtgtgtactggagcaaacaattcaaaaggaagcatgagtctaagaaatattaataagatgtgaaacaacaaaatggcctattgaaggaaaacacaaaatataacaacaatatagtgcggaatgaaaacacaactcaagtaattttagggcaagatagtctgctgaaaccaaattgattttgcgaatttgactgctcacctattcactgataatctttcaaggaaatacgtaaactcaagttaatctcatatgcacagaaatcattgacaagtccatcgtgctaaaaactatgatgaacgatgcagcataacacagataaggtgcaaaggcaaactcatgatctagtttttcaccaacaccgagaacttcttgaaaattgcgagtcataatctggtgcacctcataaagctcatcattcaacttggccaggttcctttgggttctggtatccaaatacaacttcttcgtcttctgtatgaaagtgtctaaacaggaaatataagccattaactagtagaataaagagaatgagtataaagaaaaatatcatgaatgtaagaaccataccaaacttaataaaagcatatggtcttgcagcagtttcaatttggttgccattgaccctctcaaattcatttttgagatcttctaagtactggaaagcaagtttcttcggataagagcagtcacacattgtcaaatagcacacacggccctcgatgatgtaactgtttggttaaatcaaggtgcaacaagtgtaccacaaatgattttcacaaggcaaacaggatgaaaattcaagaaatgatttagtttcttaacatacggcattagtaacacaactttcctggcatcttggtgccattaacatccaagtatatgacgaaaggcagatgatgcatatagggcatagaatatacaagttcttgctgatgcaaaaattgggagagtggtagaccaagtaaaatgtctaatacaatacttattactcaccaattcactcactcccccataagcagcaagaatatgttgtcaatggaatgagcagttaaatttaaaataaagaggaaaactaaacagagtgtatgtatcaaccaacatatctagttggaatcattgtctttgctgctgcaattcaaatttgagcctaaaaccacaaaaagggtaaccatgagttaatcttttgggaattggcacggaacacctataaaaaaaatcatgagggaataatctttttcaacaggaactctaaatctgcagatagcataagaattaaggatactggaaaaggtatggcccagtctcaattgacatccttgatgcttcatgttgccctttcgataagttcttgaacaacagtttagcttgctgcttgtagaagtcagcatccttcagatcccgaccatcatctaatccctccactaacggaaggtcatcagtaacacgtgctatcattgtcagcttcaccattttggatatgcagcgtgaaatgaactagcataggcaatctgaaagtgccacctgcatggtaaagcagataaagggtagaagatacattagacatgtcccatagtcaaacttagctgcaaagttttaatgttcaatgtgaattctacttattgcaatgggccagatctagttttggagaaattccattttaatcactatgtctaaaccggagtgcaaatagtgctaccatgggattcattatccaactactcaaacagtaacagcgtaacacacattaagcttcctagtttcagagggcaaacgcaatccatacgaaagccaacagggatgcatgatagtgatcaaacaagctgcagcagaacaggtggaagtcgtctgaacttttgcattcttcaatcaatcactatctacacatgctaaaggcctacgacaaccaataccagtaaaactttagattataaaatataagcgcatattcgatattcttaagcttgacaggaacacctagaaattataaactaatcataccccctgcataacactagtgagactagtaacaacaatgttacgatcaacctaggaagtgcagaaacctgaccaaattcagccaaagtagatagctaacagtctgtgcctatagccctacagaccaatttccctgtaacactacataattgaccactcttgcaggtaatgaagcaaatatccgcttaatgtgggggcatggggtttcaactgaatccccaattatttttgcaaacaaactgctagcaaaacaagtcccctcaatgtcagtactgcaccaagcagcgaagaaatccggaatcaaaccaagggctttgttcggttaatccctaggaggaccacacctcactacgcgtggaactattcccttccaaacaaatcccatccaatctccttgggggaagattcaatcaccggatggatccccaatctacgcgccacgccggctcgtgaagcggccacaggagaaggggggagggctaagcgaggcgagaacgaatactaccttcaaaatttcgaatcgggccgcgaggtgggggcgccggtgggatgagccggccgcgtcgccgcccccggcgaacccgctcgccggcgatcgggggaggagaggagcacgtccgccgccgttgcctccggcgggagcagagagagagagagagagagagagagagagagagtaaagtgaaggagagaggtagatgaactgatgagggtgtgcacttagcattttggttgggtgaatgccatttttttttcctcaaaaatttatttgaattcgaaattcctgccactgtcgaaactcattttcgcccaaaggggggagtcaaataaagtgagatcgataactataagttttgttatagtaatatacatgttttctttaggaaaaaaattgcatagcgtgatgtttgcagtggtgtgtgcgcataggtacatatatattttatgtattatcagggaaaaaaaggttttaattttgatttgatctttgtgttacttaatgttttgagagttcatactaatacttatatcagctgaacatgtttaaagtccccataatttcatcctcaagaggaaactttaaaggtatcattcaattactttacacaaaattttgagacaaacccttgtttcaaataaaaaaacactgaacatgcaagatgttggtgagatatacacaatccattaatttacaacattcttcacttatattcatttacaatttacatcgagaaatgtaagaaggaccaatgatccttccttattattcatggaggcgatatcttgacacaaaagagacttacattacttacaaattcacttatcacacacactcgaaaccataattcacagtcatcttgaggagcatttcatttgaagagttcattgagatagcgatccatgatacctgagatggcttccatgaatgccttttcacctatcccaggaagaacaacatgctctgcctcttcaacaatctcttcaatctttgatttggttgtaatgttctccctacacaacatgttaccgatctcatatggagttagacctctcacagcacccttcttcaacatcatggtgcttagacgaaaaacacgaacacacttagatgatggttcacaaccattgagcttgagcaacttgatatcctcttcctcgtcaagtgactttatgtagtccagggtttcaacattgaaaggctggcgtgcttggggccagtaaagccaatcaaatgtgcagtcttcaaactataaattgtttagaagtcaaatcaattactaaaactaaaatagttcaaacattgtttacaacatgagaaaacaatcattgctagtaaccaaattaggacaaaaaatttagcaatggatattatattaaaatgtgtacatagtgtgtggtcgtgaaaattactccctctatcctgaaatataagcctcccgcaattttaggaagccaacatttgcaaacattgactaataattgaactagcggtacatatgtttagcgtcaagcatgtggcatcataagatttgaatttgaaagtacattcacgttatgtcaattttatagttattgatattaatactatacaaggaattaaaggtcaaagttttgcactgaagacagtgtaagaaacttatacagcttatatttttgacatggagtgagcaactctttatggcgattagtgactatgggtgatcatagatttcaattttcagtacaaaaaatgcagttcaaagcaaaacaaaatacttacgctttcaggcagacaatacccatgatcaattggtatcagctcaatctgcccattctcatccttacgaatcagtatgttgccgccatggcgatccgtgttagctagcctcatatccaaaacagcaatcttgtgcacctcttgcacagggaaagccctaggaccaaactcctcacaactcccagaattcttcacaaacatttgcaaggacccaattttcggttctttctccgcgcaatcatacttagtctgatcaacataaccattcaaacatcgaacaagaactgtcggaggaacaccagcaaaccctagttcatcgctcacgcgataaccactaataggatggtcaagaatgtatgctgcaacctccctgaatgcaccttcaccgactcttgttcctctctttaatccttccccatcactggacaaagggtagccattaggattgtcctttgccattggctcttcatttattggcttgaaaacagcaacatactcttggcctgatgaatctagcatgaagtagactcccccagtgccctctgaggacatcacaggtgtgtgctccatttctagcccagcaagtgtagcttcgatcatacccgtaatttttggagtaagggtaacacttgggttgacaagaactggttcaatcaggggatatttctccttggcatcatcaaattgtaaattgtttccaatgtcagaagaaatggataattgctcaaaagattcttctatttcatttccattaaaattttctgacttgtttgcaagaaaatcggtatcagaagtgttggtctcacaaatggtggagattaatgtgctttcatcaagcttttcaccattgaccaaagtcatgctctctccaataccattgggactttcaacatttcttgaaatctcttgcttcatatatctagcatttcgacgttggtccacttggaatttaaacttccttccataaacagtcctcacagcggttcgtcgtggatctgatagtcggatcacgagatgaagcacacttccatacctcaccccatagtcacggatatggctatcattgcgagagagctctctgccttcgaaaaccaacctttggtttctcgccacaaatcctttgctgttttggatccg

SEQ ID NO: 66297 - DNA, 28916 bp, Oryza sativa
ttgggacaaaatcgtttgtacgatggcatttcttggaactcacatttgtcaatggcatttctaggacttagacgcttgtcaatggcatttcatggattatctcttttttaaatacactgttgatcagtttggaaagcggtatatgcaataaatgagggagttttttttccttttaacgtgggcgagatatcaatagaaactgtctacgtaacatagcacaagaaacagatataattgagtaatgctcctattaaatttaactctggaccatgtttttagaaagccattttgcacacttttattgatatgaaaacacagaacgttcagtaaaataaggggctcatcaatacaagaactcttcaaatcaaattagatgtatgtttagatagaacatgtgccaaaaaatttggcttcccggcgaagcgctcaacagagacttgcaaaatcacgtcaaaatattgcattcatataaatttgttgacgaaaagccgcattgtttccaccacttggaagtgtggctgcgttctttcaagggagagatagggaagattgtgactcgttttccacgcgcatgcttttcaaattactccctccgtcccagtatgtaacaagttttaagctcgtggacaagtattaaattttaaactggtaggcggcaaaagcacatacggcaatacaaactagtactctattcttttcttctctttcactgataactatgctgaggggtagaattggtagatttctggtaaaagttgtactaggttgtaacatttgggacaaattttgaatgccaaaacttgttacatattgggacggagggagtactaaacagtgtgttttctgcaaaaaatttctataagaaagttgttttaaaatatcatattgatccatttttaaaatttaaaatagttaatacttaattaatcatatgctaatggctcacctcgttttacgtattttctcaatcttctcttttcctctccttccttgagggcgtaggcttatctccccatcaacaacatggggtaagtacctgaaagaaccaattacaaaatttccttgcgcatctcgtatgctctggctcctctgtactcgaaagaatgtcaaaaacaaagcatctacatttaccttgagagtttcttcctgtaggaggtggtttatgccatccttcatgtggttttgtatctgttttttgcttgccattttataatttagtgcaagagtaataatagatatagctgatctagtagccatttgaatcatttcaacattcaccatttgcctcctttcccaccaaatataccgtattcccctatcgaaacaatttcagcaaatttcaaatcattgaggtgtggttacctcctctcatgattgtcttctagtaaaacgattgtcttctagtaaaacaaaacccgattgatcaatattggcaatattctcaattttgtttcaaattcacatatttatccacacttctatatagctctatcacattgaaaataatatgtttaatatcctcacatatacggtccaatcgtttggtttattcatcatcatgaaataaaccaaacaacatatttgcaaagaaaaaataatttgtaaattttatgatcgttaatagaatattataaaataagttagcgagaatgtgtattatgagagacggagtaacaaattaagttaatatgcaaggacgagccgggggagtatgtaatactagtattatcaccatcagtcatcaaccattcttactctttcgttagatatgataaggttggaaggttcattttgcctctaatatagtctgtattaatgaaactaatcactagattaagtctactaagtgattattagactaaacaacatcttctggtggcttggtgcttacgccacacggaagcttattagtagctactccctccgtcccaatatgtaacaagttttggcattcaaaatttgtcccaaatgttacaacctagtacaacttttaccagaaatctatcgattctacccctcagcatagttatcagtgaaaaagaagaaaagaatagagtactagtttgtattgccgtatgtgcttttgccgcctaccagtttaaaatttaatttgcgtgtgagtgggtttttactgtgtttaaccagctttctggcgccaatgtgtttgaaatgcacgtgtgagtttgatggcagcaaacagaccgccaccactgagttttagtacaggaataatcattgagggtagtatggtctttttgcaccttttcttaatacttgtgaacaagcttaaacccccgcctcgtttctggaagattctctcctcccccgctctctcagaaacaactcaaatcacgattcgctcctgcaacgctgcacgcgcgcggcacgaggagtaggatgccggcggcggcggcggcggaggggaaggcggcgcgcgcccgatcgacggcggcgacagcggacgccgcggccgacgacgtcctgtacgtcttcgctctccttcgtcgacgtcgtcgtcttctctgtctatgagaatctagttctcgcggtttgatcggcatatccacaggatgccgcggggcgcggaggcgaacaagggagcagcgggcgggcgcgcacccccgcccccgccgcggcggcggcgaccgcggggcgggacgacagccagtacgattccccctctccttcaccttctcttcctgagaatattgcgttctcgcgagtaatgacatctagcattgcaggactcgtcgcgtcgatggaagcgcggctggagtttgcgcgcgtcagccggcgaccgcagcgcgggaggtgggcacagcagcagcaggaggcgtggctctctggttagttcgtcgtcgtcttctctgcggccggtttttcggttgagagtttgtgaagcaaggtggtttgtgtgtgggggtggggggtggtatccggatcggtgtgtccttttttttttttgaatcgcaaattcaatttaattgtcgggattgggggtggtaatggcaatctatttctgtggctggttcttagcgtttcgatgtgtgctgtgtgatgagttcttgatgcggtaggctattgcgtcacttcggtctctagaagcgaggaagattctgtagtgtttgctttcaaatgctttggcaagttcgattcggctgtagatttcctgcaccaaacttatgttgggcttgcaagttcaggaatcttcagtttgctgattgcatatatctgaaggctgtttgcacaattttcttgctgataatgtttattcacgttggtaatctgtcttttttgcaagcagacacgcaaaaaaattcttattcgggatggggttttgtttcaccaaatgaatggcattcgtcacaactcttcatcttctctttgttttcccagcctggtgcacattctatcgtctcatctggcattgtctataagggtcaactaattagatgatgtcttgcaattcttttgtttgttcttcagcttgcattgggagtttaggtactaggaaacggttttctgcgtttagattgcttgctagtttcgatgtgtgttgggaaaaagagctcggaagcgagctgcatgctagcggtccatcatattcaggtgtagtttggccatcaccaatgtgcagtaaaagtttcacaatcacccaattaagcatgttgatgaagccactttgacaagcagcgaccaaacattgcgtacctgtgcaccgttcctaatttctgctgtctcttgtgtaaggaactaagccagcttagttggtcgatagctagtgtgggtgtacacctagaccaaaagttttatcaagttgaatttgggtgcctattttcttgttaaactagatgaatatcccgccgcgttgctgcgaaaaattacgttgcataatatgtacaaatgtaatttgattatcaaaatgaaaataatttgatacaattttgagtctaaaaataattaagattgcatgttttaagatagaagaaagaagagacaatttggaccatagctctatcatccaaaggctagaaataattaggggaatatagcttaatgagagaagagataaataatgtattaactacacttaataagaataaactatagtatataagattacaaagtcgatcctaatattttctttatcttcttaaaataaacacaatgaactcgcatgtttttgtcttttctgtttgaatgatgtatcacagaatgccctgcaaatttgctgacctttttaacctgatacgtcactgatcggactttgaatcatcttttattattgttggaaggaaaaagtatatatgaggtcctcatcttgtcatcgaattacaaaatcatcctccaaccgcaaaatagatatatatcatccctaacttacaaaaccggatcactctaggtccttaggtggttttgcccctagttttgtctaatgtggcagttgagtcagcgtgggacccacgtgggccccacatgtcagtatttccacatcaacaccctctctttcccttcttctctcccctcttatctcccttcctcctctcagtctctctctcacttctctgggcaagtcggccgcggggagaggcaggagaggaggagggcgtcggtggccggcgacaggcgatgcagcggcgacgcggaagaaagggagacatcggttgcagaggccgtaggcatggaggagggtgtcggcggccggcgacggcaatacggcggtggcaacaacttgggagaagggtcgacgatgtcgtggtccaagatggctctagcatgggcggtggtgtccccgggacggcaagtcggtggggagccatgagcctctcctccgaccttaccttcttgcctcttccggcggtcatggcggtgtcagcggcagggatagggctgacgggaggggccctgagtcgttgtcgtgcagcagcggcaggggtagggccgggcggcgtgcagagttgtcgtcgcagtggcgcttcgggtcccagtcccctctcctccacgaatcccgccgccgccaccatgaatcgcaccgctgatggcatggagatacccaagttccatcaagccatagtcaccgatcagcgctgctccaccctcgacttgctccacgtgatcctccgcccctcccctatccaaccctcctcgcgaatcgtgactcctcctcccaccacagggactcctcggaagttgactgcgatcaggagtgccgccgcgacgaagactctgcacgaggcgcctgctcccgcgctgccgccgctacgtgactgcgtcgcccgtcgccaaccgccagacctcctcctctcccgcctcgcgccctcgccctgccggccgacttgcctataagacgagaagtgagagagagagaaaggaagaagggagagaagaggggaaagagagagggtgctataatatttataatactaaattagtttcatcaaatcaataattgaatacgtcgacttttgaggtctcgactagacgaatacggtatttgcatggtatggggatcgtcagtaccagggtatatgcgagattgagtcaaaagcgacagagacaaggattttatacatgttcggaccccttcacaggaaggttacaaccctactcctgttggccgaagccggtgttactctatattcatcagaatcatacaagtacaatatttgggataacccatctagatgtcgttgacttggcggcatagataaccaacacatagtcgacgacaggatagttttcctcctcgaatataaactcgccgagatcagagatggcgctagatccctcttgtcgacctccgcaggcaccagatagggtttatttaggcttatctctgatatcgatgtttggcttgtcttggcttgtgcgttgatatgttgtcccttctctcctcctatggggtcttgtacttatacccatagatatctccttgtccaagtagaactagggagaccaatatagataaaatccaaatattccttgtagtttccatatggaactctactcatcctcccttatccggaactccttctatatatgaggtatgatttcgtataggacttggtatatggttggccccgcctagcttagtcaattactattgggtatatggtatccataaccctgacagaatatattttcataataaatttgtcttgggtctaaaatgttactacttttttctacaaatttggtcaaacttaaagtagtttgactttgactaaagtcaaaacgtattacaacctgaaacggagggagtaataatctaaagctagctcttttgctagcttttgattggtccacgtggcacctcttactttgaagaaaaatcataaatttatagtagagaaaaaaaaaaacctaacaatcatatgtgagaaaaatctagagaaaagtatcacatatggatttcagaggctttcagaggcttccgaaactatctttcctttccaatcacacgaacttgtactcctttgccttgtataaatataccacgcctactcgatattactcctataactttagaatatatagtaatcccaaaattattaagaaacaaacaaatctaaaacaactaatttacattcattttcttctttaaatatactacgcctactcggtactactcatataactatagaatatataagtaaactcgacattattatgcaaaaaaaaatcgaaaacaaacaaagaaagaaggcaaccttgtcttcttatgtcatgaaataagatcattaatacctcagccaaaaaaacgattgtgtttttttgttagacaagatattttttaaaaaaactctgaatatactaaatgattgatctttcaaatattcaaatccacaaacaaatatattggaactaattaattttgacaaatctcaaaatttacttgtttagattttattaaaacttatgtataaaatgacagattaaattttgtacttttacttgacatgacatacaagttctatatttttatattttttatgacaaatatatttttcacttctatacataataaatattgtcaaactaaaatagtggttcgcaattttctttttaaaatattttataaaaactctaaaatttcaaataagaaaagaagtatatacatattttaaatagtgagcacaccaattttatcatttagtattttctagtggtaagtatatataggttgagtagcaagcatgccaacggcatgccgatgttttagtgatatgtaaaatatgtgtcaaacgcataaacgactggctgcatcagcgcgaccaaagaaaaaggctagtgtgtactactactaatatattttttcctgtttagttgtatgatgctgatgagtatatgatttcaaattttgccatacttcactaatcctatttggtacatgccaccattccaaaattataatacttatttttacactattttcaatgatatattttgaccattaatttattgtatgttatgtttccaaatgatataaaattagcattacatgatatgattaatatgatcattagttaaaaatttattgagtttgatttttctaaaaaaaattgggttcattataatttgacagagaaagtatttagcaaagtttaaggtttattaaagtttaaaatttagtaagaaataaatcagtgcccctattaaataatgtaggattgtatgtgagagggtgggtagttagtggtatgatgaagaaaattttgaattaaagttaattgatggtaaaaaaatataaagtgacaagtttttgagaataaattttgaatcctaaaaatggagggagaactagcatatgactataggagtactagcggataatatttgcattgatgtaaaattttgccctttcattttttgttgtcagtactgcagtagatgtcaatatagttgagatatcactaacctattaaaaattcgacagtattaaaacttatttaagatttagtactataaaaattttggcacgacattaatccaaacaagcctaactgtaactatttttctccgtcagtactacgtcctgtctttagtatagtagtatactctgtttttctagaattccacctgtgaaggtatgaccggaaagaactgtgaagatgcagaagatatgactggaaaggactgtgaaaaaggtgcaggcaaaaaaagacagcgaaagaattgatgtaagttatgcatgtgtttctcgtaattgcatttttactgtaatcttattgttttgactgattgtaacatgttgatgcacagtctaccatggatagatgggatgggcagctacgtgccactgcacccagctggtgaaaaaaaaggacactgcatagtctgctacgataaagtcagtatcagcacactacactgcatttgcttaaagttcatactaccggcgctgatgccgcgaagtatggaaaaactataaatgttggcttatgtgatactccactaaaatcactatctgagtgctgggacacctgtgcctgcggtacatggtacaacactctactcaagcgagtttgctttgagtttgtgtcactgaatgtttgtttactgatttgattttacaatttgctttagcttttgaagaacaagacatctctttaggggtctcagcctgatagtgacattgacagctaattgagagatgccttctgttttgattgtgagtgtggttttgcacaaacactttacggtcatcacaagtcccactcgtgggtaggaatcatacaataccttggtgtggttttgcacaaacacatggcatgcatgaaccacatttgacttaacccactctcacaaggtttagtctaactcttaatgatgcatatgcatatgacttaatattggccattaaatattccattcataaattgctatacaaagcaaaagagaaaattcaacatatcagtaggtcttatctagccatatggctcgatcaacgccgcttcgagccagtgtgaccaagtcattagcatgactaagactatagggaaaaacccggctattacatgaagtatcgtgatgccactcagtacatctggtggtggttgtggtagcatatgctaattttattgatggatggataagacgaggtgttgcttgctcaagcgataggagaagcggctgctttgaatgtttcatccattactctaaacttgtcagcaggtgcggatgcgtcaatcgcatcagcagcaagcatgaaggcaatggaaactgcggcaacttgtctcttttctcctgaagccatggctgtgtcgagcatagtagcagcaatcccagccatcttggccgtggcctccttagtttccgcctgttttgctggtggggcagcatcaacaacaccatcgagggcttttctgatgtaggagcatgtctcacttatgcacatctcaacattggaggtgcaatcctccgttggcactaacatggccactttgaagatatctatcattgtcgtaaagttgtatggagacattccaataggaaaggcaccaggaatcttggtgcattccacaggtgaggctagcatggttgacactgtaataacgacaaggattagtgtgattaccttggccatcgtggaatatatatcccaatgatttgatgatggatgattcaatgcaacaagaagtagctaacctaggttgatgagctgcttgctattatgaaagtgggatgtgattgctttaaatagtgtaaggcgatggcctaggaccgcaggagctttgtggtcaaaaattagttggttgcatgcatatgtgccaagtctttgggccaccacgcatttctcccaatcacatgtcattagcgagaagccaggtgtcgggtgcatagtcatggtaactggttgcttttttttgacaatggaatcttttattgaactcggtcaattatatcaaggtgatattactacgctaagtaacactcccagcctctgcatcccaaggatccacacaactaaacacatatgaaccaatttaaaagaaattaagtacaagaagcatcaaggaccatcatcctaagactagatcaccacctatgtccctagttaaaacactcattgaccacccgctccaagtgtagacacgtcgcaataaccaaatcccacgagctcggctttttaagaataacctaggtgtgcatccaatggatagttacaaatatgacatgtatgtgtgataaataacttttctatcaaaaactatatagttcttacgtaaccaaagcaactagcatgtggcagtcgcccctaacaggacatatggttacatatctttttgaaaacccgaaagccaactagtgaccacttgtgaaacactatcgggtggagtaattcttgacgccacaaaaatgatggaccaaactaaatgggctaagaggcattcaaagaaaatgtgtttaattgtatccttattattacataaacaacagttttgatcgccttgctaattatgtttagctagattgtcttgggttaacacaactttacgatgaaggtaccaaaggaaaatcttaaccttcaatggcatatttagtttccaagggcgtctatttatattcgagatgtcactataaactagagatgataatgagactccatatggagctgtccattaggggtcatcttccatggaaactcatcttgctcctaaattaaaccaatattagcgatgtgtggtgataaggtgttccatgtgactaacttcgatccaatttgatcccttctccatgaaaattgggatatccattttgaaagacatcttcgatagttgcatgtttgtgcctgacaatgttgtagaggaacgagtactgttctcgcagggttacatttcccaaccatttgtcttcgcagaacctaaggataatacggataatatgccatatggcatattagcaaaataataatacagtaaattgttggtaaaatttttatatatatgttcttagcgacttaaatgccaatgctaaaaaataaactttgatgaagaaacttcaaattcatcttcaaaattaagctttaaaatttaaattttggcattggctgatgatgaatagagaaaaagatgggggcctaatcagggccggtcctaccattttgggggcctagggcgagagggaagtaaatgccctttttatcttggattttttttgaaaaaaagttgtttaatttaattttctgattgcaaagtgattgatatgcaatacatcaatatatacatactttatttaattttttttaaaaaattataaattatacttcattttatataaaatgagctaattatatatgttgatatttatttctattagaagttgagttggttttcgtgttccgagaaaaaaatgtttccgtattcgtgcccgatcatattcgatttttgttcgtatttgagataatccgtattgtttctgtattcgagctatccgtatttgtttttatatcggtaaagaatatgaacacaaatatgatacgagcattatctatctatatcccctccgttttcatcccacatcgcgcaatcgatccccgtgccgatgctgcctccgacggtgcgtccccaacgagtggcggtgagccgtcacaactcacaagacctcactgagatgggctagcaagcttggtgggctgggcccaggatcccaggggcccacaggcccagcctttttccttctccaagaagggcggcccaaatccaacggctcagctctctcctctttccccatctcttcctcgcatcgaccgaccaagcaaaagcattttcttcttcttcttctctctcctctctctctccttccccacgagaaatttcaaaaaccctacctccactcccgatctccacgaaaccctagccgccttctgctagatcgccgcggcggcgggaatggaggtggcgccggagacgctcgacaccctgtcggggtggttcgcgcagtcgctctccccggacgccgccgcgcgccgcgccgccgagcagagcatcgagtcggccaagtgctcgccggggttcgggctcgcgctcctcggcctcgcctcctccccgcgccacgacccgcagtcgcggctcgccgcctccgtccagttcaagaacctcctccgccgccgctggcccaagccctcccccgacggcggcggcgacgacgacgccgaccacctcccgccctccgactgcgccatcatcaaggcgaacctcctccagctcctcctcaccgcgccgcccctcatccaggcgcagctctccgaggccctcgccgccgccgcggcctccgacttccctgccaggtgggagtcgctcctcccttccatcgtctcctccctcggcaccgccctctccgccggggacatcccggcgaccaactccctcctcgccgccgcggcctccctcttctcccgcttccgcaatgccttcgacagcaacaccatccgcctcgacctcaagtactgcctcgagaacttcgccgctgccctactcgaggtcttcctctccacctcccgccgccttcaggctgccgcacccacggtcaccccgcctgaatcccgcccggtgtttgagtgccttcgcctatgctgcgagatcttctattcgctcaactccatcgacctgcccgagttcttcgaggaccacatgcgtgagtggatgacggagttccgtgcgttcctcaccacctcctacccgccagcgatagaggcagacggcgccccggatgcgctccgcgccgccgtgtgtgacaacttgcagctgtacatggagaagtatgaagaggagttcaggggatatctgaaggagttcgttgaggcggtctggggcctcctcatggcaccatctgtctcaccatcccgcgggcagcttgcggtgaccgcaataagatttttgacaacggttgctgagagcgtgcaccacgcgctgtttgggagccctgatgcaatgaagcagatatgcgatagtgttgtaattcctaacctgcggttacgggatgatgatgaggagctgtttgaggggaactgggtggaatatgttaggcgtgatgccgaggggagtgatgcggatacactgaggcgggctgcatgccggttgctgcgggggcttgcggcaaactaccgggagcaggtggctgcacttgtgtcagcacaggtccagcagatgttggctgcatatgcagctgatcggacgaacaactggaaagagaaggatgctgcaatataccttgttatttctcttatgcagaagcctggtgccacaggaggtgggacaccggtggttgatatggagagcttctttacatctgtgatcgtgcctgagctgcaggcccctgattgggaatctgaaccaatgctgaaggcaactgtgctgaggttcttgaaggaattcaaggatcaaatccccaaagccactgcactggcactgcttccaagtgtaataaggttcctgatacacgagtcaaatgttgtccattcatatgctgcgacctttattgagaaccttctgatcatcaaggatatggtaccagtaccaagtgcaaatgtgattaccagggctccacgctatgttgctgctgatatcaacccatatgcccagccgattgttcagaacctgtccaaggcactaagttttcctgaatcatatgagaacccctatctgatgaagtgcctgatgagagtgcttgggattgctaatattgctgggcaaattgttcatgagattactgctcgccttgtgggtattcttatggaagtgtgcaataaccccaagaaccctgattttaaccattacttgtttgaagccctggcagcagtgattggtcgggctggtgagcaggacccagcactacttcctgtgtttgaggcaagcctcttcccggtgcttcagaggatattggttgaggacatctcagagttctggccatatgctttccagatatttgcacaacttgtcaatttgagccgaccacctctctcgcagaactacatgcagctgtttggtgtcctgctcagtaatgctacctgggaccgtccaccgtgtgtccctgccttggttcggttgctgagagcattccttcggaaaattccaaatgagcttaaccaagagggcaggctaccgaatatcttagtgatattccgcagtctcctttcgcggagcagtactgaagattctgccttctacatgcttaacacacttgtggaaaatgtgagttttgacatcatgaatcctcacataaatgagatatggagtgctttgtttactcgactacagacaaggcaggcagtgaagtttgtgaattctcttgtggtcttcatgtccttggtggtggttaaatatggaccaggtgttcttgtcagttctgtcgatgcaattcagccaaatattttcatgacaatccttcagcgcttttggattcccaatcttaaattcatcaaagggactgttgaagttaagctgacatcagttgcatcaacgaagttgatctgtgaatctgcactgctgttggatggtgcagcagcccaaacttggggcaaattgcttgacagtattgttgcattgctgtccagaacggatcaagatggggcacaacaagatcagaatgatggtgctgatgcagatagtcagaggacatcaggttattctgtctcatttgtacgtcttcaatatgctggaaagagtgaagatgatctgttgaaagaggtaaatgatccaaagcagtttctggtcacctccttggctactctttctgcgcaatctccagggagatttggtcctatcattgagcagaacgtggatcctgcaaacaaaggcgctcttattcaactttgtgcagcttacaataccaacattgtctaggtaaacaacctctcagttccttcccatttattgcatcgagtcaatccaatgcattttcatttgttgtcttgaaaacatggaagtttttcatctataaattctaatattagctgtaagtgaactttccattggacacatgcaacaaaatctcagtttgatgatcctataaactgcaatgttgtcctttgtacaacttttttttcttagtttggtgcttcaactgtataatagagatgcctcttgttctgtgtagaaaaggatattattatgcacattgtggctaggcccattaatagcttctgtcttacctattcattcaatagattatgttatcttagtatcccatgatttatgttgcaccaaagtgtttttttttttgagtcacaaagtagaattggtcacatattggattaaatacccagatagtatcagaattcacaataactgacaactatgtaggtgggagttcctgtgagttaaactatgagtttgttatccctggcataccccttccacacaggacacctgggcccacacttaacaattctttttggttagggtgtaaagaactctttatcaagttttctgtatcatcttggagcataactaaagccataaacgttctattattacttcacattttaaactgcactgacattaggccttgcatccaaatttttatgtttagtttagttgcctcaataatcaaaattttgtatgaaaattgagtgctatgtgttcagacatgggttgggaaatatagtactaaattgccattaggatttaattaaatggcagtctgaaacataatgtgaaatattatttagttattatgcttcatgtcacttgcaggcagaagtacatccataatttgttgataggaactttttttcctgagaaatatggtgatgcaaaaataaaacaacccctccaagcctgacatatgtcttagtgatgaacattggaacttattctagtatgttctagtttttgtccattattattgtggtgtcaatcatgagccttaggaaacaccgtccaaatgtgaatcagaatccaaatattgcaaattcaagatcatgttctaaactctcctagcgagaatcttactcatgattgttctgcaagtacatattccatgacttgggatggatgtaacttactgaaaagcatatggacacagttcaatgcaagcaattatctaggatgtaagcgagttgcaataaccaaagtatagaggctactatttaataaaattgagaacatattttccattcgtgattcctttatatgcagattgcagggaaatgcttgtttggtgggtcttgtattagctagaatcatgataagcagttatcttgatcctgaatgctttgctttgttgtagtgcagacatgccaattacttatttgttccttgaatatctccttttggtagtaccttgtctagaatatttgcaaaactgctatattatttgtttatttcagtttctctaaacctcctctgaatgtttcaggagccaatggctttgctgtaaggcatttgcattgtttccatggggttttgtcaaaggatgtctcaggggagtctatcggtcggtcggtctatcgggtcaagctggtcttcggtttcatccttgcaatatttctggcatgtgtaggttggtcttgggagaggaaggatgtcgaaatcatatagtggtggaaaaacatgaacattgtggtggaggatgtctctttgattggaatttggaattttcttttttggtgtggaagaggtttgtttcccccggaaaacatgaacattgtggaggataccccgagaatattgccagcgtaggcatgtgccatcctggtggaactttgctgtaatttttttgcccttgttggctgaatgccttgctctggcgtaggaaatggtatatggcgtgggagtatattgtcatcggtcatcaccctttgttaggtcgggttacaaaaaatattgcgaacctcgattggagctcgcgatcctgctgccatttgctctgttttttgaatgcattgagccgttgcaagctactactatagcatctgcccatttctaccgtttcgtaatttcgtttgctttgcactaagattatagcttcatcaagctgttttggatgggttactgtcaccccaacattatcgtgggaactgcacggttactatgcaaactgtgatctactctcttcgtcttttaccgcacggtgttgcaaatccttatatattttctctatcttaaaataaataaatataatacagagcgtgatatatgctaataatataaatctaaataaatctagatttgtaatattacggtggatcgttgtaatattacggtggatcgtattttcttatagatttatttattttgaacgaaggttacacagtgttgaatggaatcgtgaggttcgtcatttttacgtttctgttacgtattccctctgtcaaaaaaaaaaaactcaacctcttcttctagaacaatgaatatggataaaggcatcctcacgtttccgttacgtactcctttaaaaaaaacttagagaacaaaacgtttccgttacggactccctttctaaaaaaaaactcagagaacaattaatatggacaaagatatcccgttgagttttttttactaagcaccaaaatcgtagacggaacctttttcatcttttgtcgtggcgatgccacctgtgctgcttgcgtggccgaccggcctctgcccaacccacgccggccacatcaccacctcgtggctcgtggcgctgctccgcctccgcctccgccacacggccccgctcccgacgaatcagcgagaaacggtaaccaaaaccttcgcctccagcctcgcctcgctctcgcacaaatcaatcccgcaaaatccctcgaccctcgatccccccccttctccctctctctctctctctctctcccggtgatcgcgacgccaacccgcgctcgcgccgggtaaggatcctcctcgattccccgctcctcccatctcccgccctacctagctcacgatcggtcgccgccaccgccgccgagtggtcggtctgtgtggctcgcccgagctgcgcgttgtgatgatggcgatgcgcgtggttcgagttctcgatgcactgggggctaacgacgaatttgctcctccgagtttcccttttttttttctttcatttcctacttcccttttgagttctttccatctattccatttcatacgtgtctctcattttttatcatgttttctcccttgtttcttcgcttacacgatgtgcaaacaggcaacattgaagaccaaaaagaaagcaagaatcatatggataccgagagcatccaggatggtgatgacatcctgctgtcaggtggagacgacgacaggaatggagggagtatcgcggagattcagacaacggtggacctcggggtcgcatttggctcggagaagctgctgaatttggagatgctgctgatggagatcgcccatcgcgcaactgagatcgagcccctcgtgctggatgcagagtcgatatcggccgagtcggttcagagggtttctgaattcgacctcttgcattgtatcctagattcagaggtcaaggagttggagaaattagttgattccattgaagtggatatcgggaatggtggaaagatgatggcttctgatgaagatccggtgagtgaggtgaacagcaagctccgagatgcagccgtgtctttgaaccagatgcaggaccttatttctgctattagaagacaatcggcaaactttgtgaatgtcatagacccttctcaggacaactctggtatgctcatgttagtctggtgctactagtgctagctgtttgctgtatgttttttttttcctgacaattgcatttgtacaggaactagtgaagatggtggatacgaaaatggtcatggttcatctcgctcagccatgcctgccgaggaacaaagaaatactctgcagctgttaaatcagtcaatagcaagtgaactggatctcggaaagaagttacatgattcggagtccgttgtggaagagctcaagcttaagctgcatcatgtagaacatgaatcgtatttcttggaggaatctgttgaagcgatctctgaaagaatgtttgcagctgaaaatgcatctgaattgtttcttggagcgtcaaaggaacttatcggtaaagttaatacaatacagttccacctaagtgcatcaattcgtcgggaaggtgaccttaaatcaaagttagagcaaagcttgacagaatcgaatggttctaatagcactctagagaagatgaaacaagacagtgaaaaggaagtgatgccgactcaagcccaaccggactctgagttcttgactttgcaggataaaattcagcaactagaggaatggctgagggaatctaagtctggattgccattgacaattgcatcaacaggagaaaatgaagtcggcgaagatgagatgagcacattcgaaaatattgttaatgatattaaagatgctgttttcagagcagaaagtagaacacagaatgctgaagcaaagtgcaaacaactttctcacgctaatatacaactcgatgaggagctaaaatccctcaaaagtcaggggtcagatagggctggcttactggaggagaagcttaaggagtcagaaactcagttactgcatgcaaaagcatcgattgaggctattgtcgaacggcacagtatatttaagtcttcaatgtctgatatggagcaggtgattgatgatctaaaggaaaaatatttgaaagctgaaaccagagctgagaatgctgaatcaaaatgtacattgctgacagacactaacttagagcttagtgaagagttgtcatttctgagaggtcgagtagacactttagagaattcactgtgcaaagccaaccaactgaagatgtccgcagcaaaagatattggcattaaaactaaaactatcactgacttagttgcaaaacttgcattggaaagagagtgccttcatttacaggtataaattttattattcaagaaaaaaatactgtggtcagtattttaactttgtcctgtgtatttatgttctttgtatgttatgtaactgtacttcgtatgatttttaccaaaagtactttgtatgatttttaccaaaaaaaattgatgcttatgattcacattgttcaaataatatctttggggttctggacttccggttcaaacagaagcgccaaaagataaaaagaatgaaggctattcttggagccaggcaatcagttaatcatagatagacatacgcaggatttttttcacggtcatctagtcaatataccaagctcatattttgagattctgaatgctttgagtagaaacactgaacagactgaaaaaatagttcatatttgtatttcattttcataacatctgcattatgtttctttactccttttagttctgaatgttctgctctttctttggcatgttttagcctttttaaggcatcagacttttcaacagactggcgctaaccaaaattagatattttattaataaattcctttggatatcaatcctatgactgcatcctccttttctcagttaacagtgttgcagaaattactagtataaataagaatatatgtactcctggcttcttaaccagcttcccggtatcttctctgtacagattgttacactgacgaagaagaacaggatgttggctcaaaagtgcaaagaaaatattactgaagttacactactaaacaacaaaattgctgccagtgaaggtgaactcaagactactaaagtaatggaggaaatggtctcagattcttcacctacacaaaccaaggtaagttcttgcggtgtcttgttttaaaacatgtagaagcagcaaattcttcgggtctgatcctctttgttgttctcacattgaccacaattgttgcatcattgaagacaatcatcagtgtagaaaacaactctttacattgaaattgcccacccaccatgctctctcttccatgagtaatcacctgatagcgcaaagctctactagcagaactcagattttataagcattcacagctggggttcttgtctcaggaccaaaacttgcaacggttaagggttaacatatttatttcttttaagcaaactttgttcttttggaacttatgtcaagcacaattactatgttcttattggtaattcaccctacgatgtttattaatgtggtaaaaggtgaagagagttgctgacactcttggagaggaggaagatgagattactgctccaccagaggataattccggtgcctgcagcacacctaacacggtgaggtccattgaaccaaaaatcctgaactggaagtggatttttgcggcattcctagtcttgctggttgctgttctcgtctgcctaccgtaccaatgaggtgaccatgtcctatgatctattaacgcagcttgtaggaccagatagaaagcaggtaattttcctgtaatgattcttctaaatcattgtaggaatagtcaattttggtagtggtcgttgttgcaagtgtcagttcttgcatgaactgtctatgtgtcaaataatctctggggtagaagagattgtagatctgaactgagcaagtatgctccatgccttctctgaactagcagatccaagcaaatcaaattggcaacagagaattcatgcagtatctacttgtatatatatttcgagtacttgactaatatcgagtagcatttgttctagacaaagtgatcttcactattttacagaatcacagatacaattagcctgacagatgatggtttagtaggttcagctcatctgtacaaaatccatttgtgtatttgtgagcagttatgttatacaagtacaattttgtttacttactctttagttaaactgtaagctttcttcgttcgtaagttgggaatcagggctgtgacaactgataattgcagtggaaacatcacattagccacacaatgacatgcaagatcagtctgaatcgagcactcgagcttgcaagatgtgagtacatagtggatcattacaattgacatctgctgtgtcatttcatcactgatggattgacacaccacaaacaccccccagctttatcatcagaattcatcaccatgaacacatatatacaaagatgtacatggcttatgtggtactaacacacaataagccttttttttttttggggtgatggtgcacagtaaaaccttcgttttagtatgcctcaacaccagtagacttgcaatcaacatcgaaccatacctcgttgagacggccaatgatgcgaaaggggttgttatactgcgcaattgagtaggcgctcttgctagggtagtttgtggaattagcccatggtgaccggctcaaactcaacgcaagtttctccgcttcctcgacgacattgttgtcccgtgcataacccgagaagctcctcactgcaatgcagtggcttggccacctatccgggtggaggttcagttcggggagaggcacaggaggggaagcctggaacttcgctggtaagtagagccgcacaaagtaggcagacgagtgtagcggccctgcacctgggacgatgctagttaggatgggagttgtcatcctgatcctggaggagttaaggttcgcgcccatcaggtactggaacaatctggcaggaataacatcaagagttagtgcttgtaggatctggtaaaataaattctaccgacagggaaactgaatttcagaaaggtgtaaatgagagtgaattatgaatgaagatcaatgtagtagtgaatctgatgaactcacaggctaccatgttgttaattgttgtcttaggaatcaaaataatcacaaaagtgctaatatattcaattagctctccagcaaatcaacagataatgccttttatctctgtattacatgaagagctctttactgatgcaactaaaagatttggcagtgcagcccctaacttatggctaacaagtaacaaaacaatcctgcatattttctgttatagaaatctctcacaaagacccaattctttctagaaaaaatcagtactactccatccgtattttaatatatgacgccgttgactttttgacaaacgtttaacctttcgtcttatttaaaaaatttatataattataatttattttattgtgacttgatttatcatcaaatattctttaagcatgatataagtgtttttatatttgcataaaaattttgaataagacgtttggttaaacgttggttaaaaaatcaacggcatcatacattaaaatacggatggagtattatttaacatcacaatactgtctcaattcaagaccacattcttcccgattctcaactgaaatgaacaagcatcttgctaaagtcaaccgacaatagccatcgatttcactcatcaatctcttctacaattcaccgatcttttccattcctgcagagcaaccaacacccaaaacgagcaaatcgaagagctgtgctcaccaaaaaaaatcatcatctcctacctactccaccacccaccgcacatgattacagacaggctccaaatcaagcgcggctgatcccccatcccccggaccaaatcgtagcgacgagggtctcggatctgatcggggtggggcgggctttgcttaccggtggaagccgagcttggtggcgacgtggaaggagatgtcgtcggagggggcggacatccagacggtgtcgcggtagcggcgcacctcgaagtcggactcggcgtgcaccgtcgtgtactgcggcgtctcctccgtgccgcgcgcggccggcgggagcagcgcgagggggaggaggagggcgaggacgaggtgcgcgagccccgccatggtcgccgccgcctcagtcttcgctccgagcggctgcttgcttgcttggggaggcgatcggcggtggatcggagtaaaatatacgtacaacagtcggtatatgattggagaattgtgtttcgacaagtttcagttctggacatcactgttttgttttttagaaagagagtaaattatttttgttaataatgaaaaagagtaaattctagtagtacgagtttaaccaaactatcactgaccttgtttagagaattagccaagatttattttgagagctattttttaacacaaggaaatagccatccaataaaatagccctaagttgtttgaattcaaaggttattttgagagttatttggcttttaatgtacatttccatagagggagatagaggaaaaaagacactttttcagtggccccacttgaaatagctccaattaacacttcttgggtgggatagttttttgggtgggttatttccaaataaccctaaaatagcttaacttttagatctttttgagctatttgaggaaaggctaaaaaatatctcttggatctaaacagggccacagtagatttaaaagtgttgtataaaaaaatatagatttaccaataaagtaagataaaatattacaaaactacatatttagtattgaagttatcacaatcctagtttaaatctctatcattacgttatgttagagctataaacatttgtagttttctaattaaattgataccaaacctgtagttttgtgacactcaatctttatttttgacactccatcttaaatatgtattttttgagaaattttgtgttaaatctatatagttttgtgatagaacatcgtaaatatgtagttttgtgataattttatcaaagtatttgcagttttaagatgtgctctttctctatttttttttgacaagtcacatgtctgtgcaagatactttgtttaatttgatatatgaaacaagtttatttttttttacctttttttggttgatttaagctgatttttattttgaagttttttttacatggaatagcagaggttaaggaaggagtagatgtaattagagaaagtgataataaagatgtgtcgttgatgttaataaagagtactaaaaagtagaacatgcatggtgggaaatttaagctcaattggtcctaaggtttgttctccgttcggtatggtggcttgggggttccaaacttagaaaaatttaccatagcttttcagctaaggtggctatggtttgaatggagcacgtcagaaaagccttggattggaactaaaactccttgcgatgaattggataaggatacgtttgatgcatcgatgaaagtccaaattggtgatgggcaaaaggcgagcttctaagaatctaattgatttggtacctaaagtgtaaaatgtcaagtgccgaacctctataggcattcgaagaggaaaaacagcaccatccaggaagctctgcaacaaagaagatggatcaatgacatccgccacaacctcactatccccctccttgatgaattcttatgggaagttctagcccgtgacaccccacaactaacagaggaggtacaagatttgattgtcttgcgatggacaaccgatggggaatatagtgcaaaatctgcatatcaattccaattcaacggaatggtactatcgccatcaacaaagttgtcctgggaggaatgggcttcagcaaattgcaagattttcagctggctagtgcttcaaaaccgggtgtggacagctaaccagttgcagatcaggagatgaccaaataattatttctgtcagttatgcttccggaatcttgaaactgtcaaccattgttcgaatgcccgatctcgaagcaaatctggtttgacgttctcacacagctacgtcaagggcacaacatcctgaaatgtaataacaatagaaacctattgggttggtagacacaagaaacaagcgacccataagtaacaaaactaaaaggactcgtatctctcttattgctcattacttgggaaatctggaaggaacggaacacaagaatcttcagagaaaaggaggcgacagtacactagatgatcgcatccaagaggagttgggttggtgaggtatggccggcgctaaacatattgggagaatgttgccatgagaagttaggagagctgcttgtttgcatgtaggcatgtacggttttttctcttcttccttgcttagccttttggctgtttgtactttaaccctctcctatcaatataaagcaagtcaaatctaaccgggtgtaaaaaaaaagtaagaggaccaccttcttcagtgcgtgattcctctggattaggttaaacgagtgaatcatcaatagcgagcatgagaagaactgggggcaaagcaattgaaaaggacaaagaaccacgacagcccagattttggatggggattgccattctgatcctggaggagtttagagattatcgcctgacatctcaggcactggaacgaattactgtcaggaggaacagcatcaagggttcgtgcttgtaggatctagtcaagcaaattccatagacttctttttttttaagaactaaattccgtagacatggaactgaattttagtggattggtttaacaaactggatagcaaccaattaactggatatatatagcaatcaaatgtgcacaaatgacgtatgccgtcaataattcttgcaggttgtaaatatcaatatgactaataacatggtagggtgttttgtgaggtctagtacgaaactggctacgaaacaatccaatggatcaattagctctccagcaaatcaacatatagtaccttttatctctgagttacattacatggaagattcttcagttcttcactgatgcagccaaagaattcgtagtactgtatcggtcccctaatttatgagtaaaaaacatgatcctatatgattttgtcttctacaggaatctctcacaaagatcaaattcttcctagataacagaattgaacatcataatgcaacatgcaatatgatgatcgagtcccctatggatgatcaagcattcaagctagtttgagaattgctatctagagatcagatcattgtattttaattttagtggatatagtgataatgggaattttcttggtctaaagcctgttccacaacttctaaaaccagataaaactcgtctgtgtacatgttaattgtagttttaactcaacatagagaggagtgtgtatattatatgtcataagaagatagcaagagagaataagtgaaaaaaaacttgtatgcccgttcgactaatgtgagttgaagaaatgataaatcttaaatgacccgccataatcttctctgacaagtgagcactactttaatggcaataaaattgagcatagtgttttcaacgtaaaaagcacatgttcctcctttaactaggataactttcgaagctcgaaacctacatatcatatatatttaataatatttaataagtactccctccgtccaaaaaaacaacctcatactatgatgtgactcatcctagtacaacgaatttaaacatactatatgacatagattcattcacattaatattatagtataaggttagcttttttttttaggtagggagtatatggtaccaaaacaactcacgatgtaaatgctcttaaaaatgaggttaattagatcatgccactgcaaaggctgaaaccgggtgtgtgcctgtgacgaacctacggatctccgctagtttgagagctagaattggggatttaggagaggatttgcaggtttggagcagagtttggggaagaacagaacgaggtaggagaggtagttgagtttgatttgttctttacttcatcgataatctgtctcttacaaagctcggccttatataccccaactcccacgccaccaagccaaagactaaacctcacacctgcgccaacctcacactcagaatacaacggcccaccaggcccatctccctctcactctctctcacacaagtctgtaacagtgccactaagaattctctaaactagaaccatgctaacatatactacaccccaaccattccttgaatcaacttttcagataggtcatattgcccctgctgatgctcacatcatccctgttcctcgttggcgccagcagactgcctagtaggccatggagacaacctgcttgtcgatcgcacaccgtgaagctccctcgatgtggacctcgacgtgcaccaccacggtggtggaaaacctcgacgaccctacggcggtggtcgtcgttgcctttctcagcaacctagccaaactccgcctccgcatcagtagcatcgatcccctgcttccagggttgcataggatggagccaagcgctaattgatcgatacacccttcaccggtcagccgacgatatgtgcataaggtatcacatgcatgaacgttgtgcctgcaggacttgtgtgtctcgtagtcctagacccccgaatattgtcgctaccctagaggtcgaggccaggaaggttagatccatcagcgggaggcacttcaggatgatcatctcctacgacgacaataaaagggaccctgcgaccatcgtcttcttccggcgatgtgagcggcaggaccgaaagaggacatagcatctagagccctcatgtgtgatgatggcttctccatcttcctcctccctctcctaccaaccacctataatccatcttgaattatgacgactctctccaaggatagagggcacatgtatcaaatcaaatcaatacaatcggggcaatatggtccatacgaaaatactaagtaaaaaaactaactcaagggtggctgaggcatatataatgatatattctaatttagagaagtataagtagcacctatctagtttcaactttttataatattccctccgtttcaggttataagacgttttgactttggttaaagtcaaactgttttaaatttgactaaatttgtagaaaaaagttgtaatatttttaacccaagacaaatttattatgaaaatatatccaattattgatttgattaaactaatttagtattataaatattactatattttctataaacttattaaaatcagtttgactttgacctga

SEQ ID NO: 66298 - DNA, 4549 bp, Oryza sativa
caagagcaggtaatttactaaagctcatatgcatgctattaagattcaaaatcacgtctgaaaaaaaaatataaacattggttgacatccttgcatgttcgatctaagcgcatatgtgtgcaatagaacattagtgagaaaaattaataagcaaaagtattagcatgtttttgatcttttttcaattggttagaatatgggcaataccagaattagtaatatcgtatctatcaacaattaccaatactagtgtggctcctatttcttgtgaacaaaattatttacttcccaatcgtatatttagcttgttaacgaagttagtctaactccatactaattccgtatcatcaacatctaatttcattgtcctccttttcttagatcaatgaactttctacatatatagcctatacccaattacctttccaaaggatcacataaactatatactaactcaaagttgcatatatagccactgtctcgatcgagcgattgcattattatttatctaaattcgattgcagttagctagctatctagtatagaaccatagatctgatgatagtttatgttctcgatagatcgatcgcgcctcgactcaaaaaggagatcattaattttctaactaacggtgccttccatttgaaaggaatcagcaatccatcatcgatcagtatgtaggcatgtagctagccatagtagcatagacaaaccaatattgttctaaccttgttacacctcgatatatcgaggtcctttgcccgaacgtgtcgatggacttcctcggcacggcctctatcgcgccaccgcccggcgaatccatggcgccgctggcccgcttgttctccgacgatgtgctctcggccgctccgccgctggcgttcccgccgccggcgacgacgataggcagtgcgagtgcgagcccgtgctcatcgagagcgccaggctctgcgagctcgtcccgccggccgccgccgagaccgcgccgccgttgttactcctccccatcgcgtcggaggagcacccgaagctgctcgcgctcgcgtcggtgctcatctccgccgcctcgtgcgcctgctgctgcgcggcggcggccgcggccgccggctgctgctgctgcggctggtggccggcgggcacctggccgttgttccggagccaggtcttgatcatggagagctccatagtgttgctcccgctgttgctgttggtgctgctggccatcgggacgccggagaagaggaagccccccgccgcgtgatgatcttgctcggagacgaacgagttgccgccgaggaagtcctccagcttcggctcggtctcctccaccgccgccgccctcttgccgccgctggagccgacgagcatcgacagctccgaggcgccgccgttgtagtccagccccctcatgttccaatctgcgttaacatcaaatatcaagatcaaacacccatcactccatgtactactagaaaacgagagacacacgcgtgcatgcataccttgtgcctcttgagctcccctattgaaggcctccatgatgccatacgaggcgttgtgatgatgccccgccacgccgaggtgcgcgtcggccgccgtcggctgcgacgtcggcaggccatagaagtcgccggcgccggagacgtcgatggctgccggaggcgagctatcctggtgaggctgcggattctcttggccggagagcgagaagcccagccagttgtttgcagaagccatctcagggggagaagaagctgatagaacagtgggattggttttcttgctgatgatcagagcagcagtgaaaacattggtgaggatgagaggagggatgtactaagttggaagctgatacgggggaggtatagcttttccaggggatgcactacattttgggtcaatgtgaagatggcaggagagagaggccaagaaaaaaaatatcctggccacctgagaggaggggaaatgttctaggaggcctgtatttataagttaagaacagagtatagcagaagactagtcttaggctctgttcgtttcctggagttcccaactcccccatctcattttccgcgcgcacgcttttcaaactgctaaacggtgtgttttttgcaaaaagtttatatacgaaagttgcttaaaaaaattatattgatccatttttgaaaaaaaaattagcaaataattaattaatcacgtgctaatggactgcttcgttttccgtaccggagggatgggttcccaactcaaccaaaagaacagagccttagacgttgtgctggtagctagcaagtagttatgtttcttttgtttcgtcaggattctgaagctgaagggggcaaaaaaatattagaaatgttcacatttgagaacggatggagctagcagttgtttaccgtcagttaatacatatggagagcaatttaactcctaccaaatcaagaaaagttcaggcattcataaaccatacgggatatgacaattgttttgttgaattattgtcatatagtactatatagcatggatcaagttctccttttaattagtatgaatctgaacccaaacaaaagacgacatgcatgacatgtagatcgaggagctcgatcaatccaaatatatataccaatgcaagcagtggcgggaaagagctagctagccgaataaataagcttaacaagaacgagatcgatcagggacgacatatccttggatcttaatcaatctatcttagaccttactcgatcagagcttggatccgatagcgcgcaagcaagcaagttaagatcgccacactactatgtatgtatatacgacgtatgtacgtgcacgcgcacgcgtggatggattcacgctcgggtcctagcgcgcgcggacggttcgtcccgtccaacggcgacgaatccagcgaaagattcccgctcgcgccggagaaaagaagaaaaaaataaccgagagcatagagagagagacgaaacgctcgctgcctcaacaacgccggtcaaaccgccgcgcacgcacacctgtgcagaaaaaaaatcagtccaacccgcctctctcttctctgacatgtcgtgccgccggacgcgcgcgcgcgcgcgtgcgcatcgtcgttcgtctcgcgcccatggcccatctctctcgttctctctccactgcttccgagttccaaccagccattgcagcgcggcgggcaccaccgataatagggcacaaggctagccaagggcgcgcgcctaggcctgcccgctgatctataattatggtgctttcgaggtgaatcgctggattggactggtatgacgaccctgcatgcccagccgcctgattgactgtgtttttgcagcgtccatcgacttctggttttagcaattgcatgcatgcatgcaaaccggccgcccaccttaccttccgctccgatccggcggtgtgtgtgaacatgatcttggaagatgagatgatgggatcacatttggtagttggaatgctaaagtattggagtgtttgaactcgatccacacaagaagggaaatagaaggtcgtgaattcacaatttaattatcttcttttttcccttcacaaatatggagttgattttttttaagatatggtataattttttgaatcttaatgcaccgagatgttagaaaaaaaatgaggatttttggtaaaatatctgtgttgcatttttaactgtgcaggtgaaccagtgatgacatcccctaagagtttagaacatatcaccatgcataaataagtggcttaaattagcatattactcccttcatctacttttgatagtcatatttccaaatctgaaaaatttatttttgataggcatattttaatccaacaacctatcatcttaatgactttctcgtatttaatacgtgactctccattcttccatacaagattggctacatggacatcgagaaatgtaaatattaatgaatcgcttgtttacgaggaataactagtactccctccatctacttttgatagtcatattttcatatctgaaaaatttatttttgataggcatatttcaattcaacaatctatcatcttaataactttctcgtatttaatgcatgactcttcattcttccacacaagattggctacatgagcatcgagaaatgtaaatattaatgaatcgcttatttacgaggaatgactagtatcatgtttaaattgatgatgagtagaattacttatccttggtctgtgcgtcaagatgaaatatgactatcaaaagtagatgaagggagtagcatgtttaaatggatgataataagtagaattacttatccttggtctgtatgtcaagatgaaatatgactatcaaaagtagatggagggagtagcatgtttaaatggatgataataagtagaattacttatccttggtctgtgtgccaagatgaaatatgactatcaaaagtagatggagggagtacaaattaacagaccataagccattaatacaactattaatacctatttaaaatttccagtcacctaaaatctggacactcccttttctata

SEQ ID NO: 66299 - DNA, 2574 bp, Oryza sativa
gtataaaagtagagtcaggtatgagctctacgctatttagaggctagcatcatactccctccgtttcgaaatatttgacgccgttgactttttagcacaggtttgaccgttcgtctttgtcgacgtttgatgttgcaatcctggtatttcatagtatggggatcgttggtgctaggatatatgcgagacggagacgaggatttttatatagattcgggcccctgaattgtcaggtaataaccctacatcctgttggccggagccggtcgttgctcttattcaccataatcacacaagtacaatatttgggatagcctatctaactgttatcgacatgacggtttgaaggtctgactcgtagtcgacaacatggtagccttcctcctcgaatctgtgcccggcgagatcagagatagcgcttttgtctctcctgacagtatccggagacaccgtagggtactagccgtgcttatccctgaagtcgatatccggcggcgtgtcttggcgtatgtaggcttctatgtcgattgtgttaggtgttgatcctccatggtgggtgttgattctctcgtgtcctctctcctccaaagggggcttggggcttgtatttatacccataggtgtccccttgtccaagtagaactagggaaaccaatatggatacaatccgagtagtcattgtcatttccatgtagaactctggttgtctttccttatccggaactccctcgaggtcagtttccatataagatatggtatgtggtggatcctgccgagatttagtcaagtactattaggtatgtggtatccataaccctgatagtcttattcaaaaaatttaagtaattattaattctttttctatcatttgattcattgttaaatatattttgatgtaggcatataattttacatatttcacaaaagtttttgaataagacgaacggtcaaacatgtgctaaaaagtcaacggtgtcaaacatttcgaaacggagggagtacaatagttggagacaatatggactctaatcattaatgtatcaaaatatttttttactattctttcctttctttcaccactatgtaacaaaatttgctttaataaatgctagagtcgactctaagccgttgtcgtgcataacaaccatatttcttttttctcctttctctttcttccatgtcatcaaatttacttatatgtcaatagagagagaccactaataaagaacattgtacatgccctaagaatagattttaccctgggtgacaaaagcagagcgcacaagcggggagggggaggtaccggaaaacataggcagcaggtttttctccttttgggctggtcctggcttgtgccaacgatctaaaggcacgggacgcgctttgcaaagcgatggatgtactgtaacggccaatgtccagagttgaaaaaggaaagcaaacgtaccaattccaatcgcaccacgcactaataaagcacatgagtcgtcaggggcgaagcaggatttgagattagaggggtgtgggggtaaagataaatcatgagatcgaataactaatattgatagcaaaagatgtcaaatagtcaccatcaataacaagtaatgcgtaaagtagtcctttaagaaaaacttgaattttagctatttaataatatcattggaagtatgaaactactctttattactaaattcttttaatgtaaactattgaataatctcacaaataatattgaataatctcacaaataagtatcatctattttactttgaaaaagacgagaaatcacaaactaattttgtagatcatatttcttgctaatatttttagacttgctaactaactaaactgataatactttcaagctacacaaaataaattagataaatacttatcttagttaaccttaatatagagtaaaaacatggggtgtaatggtggcagtgtttgcatagggggtgttggcaccctttggcacccccctagctgcgccactgtgagtcgtcttcctagtatagactgttttttttacaagagcacagtagaaacacgaacactcgtaacacgtgcatgttcactcttataaatacatacatgcacacccattcaaaagatgattttaacaacggaagtaattaaaaggctctcagcgtcgaccagcccagacttccggtgaggcggtgactacactctggctctgccccctgaaaacaccattttttttaaaataatcccaaacaccaaagttggtaccttgtgaatagggatggcaatttaacccgtttatccatgggtaaaaaccctaatagagttgggtttgttctacatttagtacctatgggttttttattgggtcaaaacctatacccaacgggcatacgggcacgggcatgggtagtcactacccatgcccgcttcgcccgtttacccgcgaaaatcaactgacatgtggtccctcagtcaaattagtataaatgccaccatctagtattgatgaacttgtaatgcttgtattgttgaacttggtacaactctaccctttctttaaattgtgataatgtctctctgcttgtg

SEQ ID NO: 66300 - DNA, 1959 bp, Oryza sativa
attgaaagtatgtgtatgattttttctagattttttggtgacattttttagttggtgtgcacgtgtgtacacgtgagggcctgtgtgcataggatatgttgccctattagatagagccatcccagtgacattctccttacttttcgaaggaattcgtcactcttcagcatggagtgccatttgaagaagatctcggctggagtacaaatatgttatttacttacactgcttgtcctgtggatggagttgtttgagttaaaacaactataggatgtttggaggtccattgaaattatcataggttatttggaggccagagcttgttaagctaaccttgtagaactctggagatctctaagtagaatgttgagcagattagctgtttattattccgtgccatgagattagttccaaatgttcatccttcagtaaatagaagcacgaaattttatctggatttattgctgtaacttgcattgaagtaatcatgtttggaagtaagaactcctatcatatccttctcttagccttttcatttcagttgttctcttgatgtcatcatgctagtaattaatttagcttgtttcaaacacagcttgtagtttgttatatcctagagaagtacatgttagttaatccttcagagttagtatagtgatagataatgttcatatgatagtatgtaagtgaacatcagtgctcaggcttatcagttgttttgtgtgcatttcccattgtgaaggtcagaccatgttacatgaaatcttccattcacatgcaccatcatgtgttcaatgttggtcgtgattgttatcatattgaaactagatttgttgatttattttttgggggtaatgctgactagctgagacaatatgggaaaattatcacctcatgtcatgtttcaatttttaatatgatagccatagttatgagtacaagcatcttctcctttttcatatggttctgtttatattacagtccacatcagcaagcattttctttccatatgtgatttgtctttagccttaagcaaaaaatatgcactggttcagtggtttatccaccttttacgcttttgtgctagcattgaaataatgtctatctttaattaattttcaggaatgggagaaaccaaagcctgggaggaggcctgatatcttcccaaaattcagccctatgaaaacaccattgccccatccattgccagctgatgatcctctggatgatgatgaggaggaggaagaggaagaaccacaacctcaggaggaaccacaggaggatgatcctgacaaggaagaacctgaggaggatgacccggacaagccaacggagtaattttggatgatgtgggttatgttagataaaaacactatgtttagatctgccatatccttgagagaacgtcataggtctcagggtcaggtttgacctgttagttctgccggctcatataggctgtagacacgtttgttttgggagcacccctgagcttttctaaagccatggaagttttgtctgactgatcacaaatatgcaatgttatatttctgcagaaatacttctctctctgcccgttgaatattcataccgccacaagctctttgccagataattgtacgagtacgacaattgtgtcgctctatagacatgtaatgctgcttggtattctgaattttgatggtatttttaactgttagaactcatcagcagttgaatttccagcactcttgccaaaagtgaaaatatttgatacagaactaggcatttaaggtgctcctcctggcgcactttgacatatgtctggtaaatatgatcacagcacggtgtaggaaactaaaaggacgccaattgtacactacgcgataatactgaaatcttgttatattctatttccttgtaaaaatgtaaaacaatggctgttcactcgaaattgtattcaggaggactgaagtgtta

SEQ ID NO: 66301 - DNA, 12868 bp, Oryza sativa
tgctaaggctataaataaacctctagggccatgtaatggggggatccccaaaaaatatttcacgaatcaatacaattgcttttacattccaactactgttgagagaaccacgcctttcgacatggcatagttgtacattcgacaacagctggcgccgtccgtggggaacccagaccgaaaaggcgaaatgggacccctttcaccacaccctttgccacagtacccgcgtggtacggcgacaagggctgggggcgaaagtgagttaagtccaagttggggggctacgaagccgcccaagcctctggacacctttcgccacatgccacgcccttcgccatagtaccaataaggcacggcgtcaagggctgctggcgaacaggtttcgccaacccacgcccttcgccatagtgccaatatagcacggcgtcaagggctgcgggcgaacaggtttcgccacacgccacacccttcgccatagtaccaataatgtatggcgtcaagggttgggggcgaatataagttgcttccaagctggggggctacgaggccaccctagcctctggagcctttcgccacacccacacccttcgccacagtacccgcgcggtacggcgacaagggctgggggcgaaagtgggttaagtccaagctggagggctacgaagccgcccaagcctctgtcgcgaccgagaaaaatacattttcccaaatgctagtgtattaatccccgtcccaggaaaagccgaggtacaccacacaaacatgatacaaaaggcacatctttattatatcgataatatttacattattacaaaggcacttaaggcctgacaatcaaaaataaacagcagcggactagcgggcctacggctccatcttcacaggtgctcaactggggtataatccaggactccacctaagacttcttctccaaagcttctcttactgaagggggggaaagattgagcaagaatgagtacaaccacagtactcagcaagccacaccggcggatgcatgattaatacaagggggtacaaggggtaataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctaggcttgcccataaccgagggcgcggctattcgaataggttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgaacccctagcagcaggacaccagccctgtgccatgacatctcgactaccgagccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcctgagcttaatccttatagtacccgaggtacgactaacaaaacccaaccacgcacctcgagcccagcctaaaaccattttgggggttttgaatagagggggaggtgtgtgtccaattccatcataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaatagcaataataataaggtcataacaaagataaataggcatgactaaataaaacaatgataacgcgggaatttaaataaagcgataatgcattaatttaaatcaaaataattttataaactgggattcaatatgttcaaggatgatgtgacttgccttgctcagagagaacggccttccgaaccttcggcgacgaccacaaagcacgcttcgggaacctccggaacgacagaagctacgcgaagcacacaagcaaagctacaagcctataaagaagcaataacaatatataaaaagaaagcacacggttctttaggttataacaaacattaagagacttgaacgggtcgattcggagctcgtatgaccaagatatgatcatccgaagtttaatgctgttatatggagatttgcggattattataattaagctttgcaactataaaacatatggaagcgctagcctggaaaagacaggaaggctgcgctgttgacatgcggaccccacatgtcaacctaaaggaccgcggtagaccgagtacacagagacggtccacgggtcgacggaagcggaccccgtgtgtcaaccgaggcgagtggccgacaaacggactccactagacaccacacgggctgcacacatggaaaccacgcggctactgagcggacacactaacacggacactacacggtcaccacccgcacacgtgaacgactaccgacaccggtacacaggtaccggggtcgacaaccgcacaacgggtacggggcgacaccgaaaggacgaggacggggcagcgagaggagagatccttaccaccacgcgacaaggcgtgggaaagacaacgacgaacgggtgcggcggagacggacggcgagggaacgacttcggcggcgatccttgaacgaaggcgagacacggccggcacgaggcttgacgacgcggaggcgaggacgaagacgatgatggggctgcggcacttgacgaagcgaggacgacgaacgagaacggctggacggagggacgaacgccacgacgaccaggaacgacgagagggcgacgacgacgacgaccggggccggcgagaaagcgacgagggcagccggcagcggctgcacggagacgaggacggcgcggaacacgccgctgcgatgccgacgacggaggcggcgccgcgagacgacgagccggcgaggaggaacgatgacgacgacgacgaacaccggcggggttcggtcgaaggggagacgaggccgagggtgaccttgccgctgcgatgccggaggtggtggtggcgcagcgagccgatgagccggggaggagggaggggcggccgaagggacgccggcgacgaagaggatggagaggccggcgcgggcgacggcggtctccgaacgaatcagagggtaggccggggtggaggtcgacgcggcgacgccgagggaggagacggcgcggccggcccgcacttgagcggtgcggcaggggcggctggaggcagtgggtggcggcaatgccacccgttgccggtggggacgcgcctccggcggtcaccgcgcgaaacggagggcaggccggggagaggaggcggctgcgacgccggggaaggcggcggcacggccggccggcgcacgggtgaggagggagaggcggctggaggcggttgacgtgggggaaagagaagggcgacgacggggaggggtgatacgaccacggggaggctcgggatgaggctaaaacgagagaacggagcgagggggttccgttttataggcgtggggagggagctggccacgggaggagcggggaacggtggcagaaaaggcgcccggcggccatggaaggcggccatgaatggcgcagccgttccggtcaaaatagtgcacgattaaaggggagattagggggaaaagggagaggaaggaaaggggattaattccccccaattaattttggaatccaatgcttaaatcgtgcggtttcgagggaggaacgaactagggttttcacgggagagagaggaggccgtgcgggaggaggaagacgaccggcgcgtgggccccacgcggtcagcgcgcgcagtcagcgcacgcgcggcgcgcgtgcacgcggctggcttggctcggcctggcttgggccgggctgctgggccgaggcaggccgagaggaaggaggaggagggagtgagctgcccgggaggaaagagagaaaaacaaagagaggggagagggatttggactgtgggccgagggggagagagggagactttgggccagacttggcccaaagggaggagggggattatttttagctttttctttttaataaactttgttaattgttgttgtttaataaatattttcggtgctctgaaaattcaagtaaaatttgagggctccttttagaccaaggagaatttaacaaaaattctccggaccacattcgaatttttctagcaggtattttagtgtttgtcaatttctttttgaattttaattaattctattattccttttagaaaataatttttatttcgggatgaatttatcagggcgtgacagcctctgcacacctttcgccacacgccacgcccttccccatagtaccaataaggcacggcatcaagggctgcgggcgaacaggtttcgccaacccacgcccttcgccatagtgccaatatggcacggcgtcaagggctgcgggcgaagaggtttcgccacacgccatacccttcgccatagtaccaatgaggtacggcctcaagggttgcgggcgaggaggtttcgcccacccacgcccttcaccatcaaaccaatgaggtacagcgtcaagggttgcgggtaaagaggtttcgtccacccacgcccttcgccatagcgccaataaggcacggcgtcaagggctgcgggcgaacgggtatcaccaacccatgccctgcgccatagtaccaataaggtacggcgtcatgggcttgcgagcgaagaggtttcgtccacccacgcccttcgccatagtgccaataaggcacggcgtcaagggctgcgggcgaataggtttcgctaacccacgcccttcgccatagtgccaatgtggcacggcgtcaagggctacgggcgaagatgtttcgccacatgccatacccttcgccatagtaccaatgaggtacggcgtcaagggttgcaggcgaagaggtttcgtctacccacgccctttgccttagtgccaataaggcatggcgtcaagggctgcgggtgaacaggtttcgccaacccacgcccttcgccacagtgccaatatggcacggcgtcaagggctgcgggcgaagaggtttcaccacacgccatgcccttcgccatagtgccaatgaggtacggcgtcaagggttgcgggcgaacaggtttcgcccacccacgccctttgccatagtaccaataaggtatggcgtcaagtgctgggggcgaaaataagttgcttccaagctggggggctacgaggacaccctagcctctggagcctttcgccacacccacacccttcaccacagtacccgcaaggtacggcgataagagctgggaacgaaaatgagttgcttccaagcttgtcacgaccggaaataacccaacgggcgttccttacgtgcgtgtattattccttgtcctaggaggcaaggtacaccaaaagttgatacaatatagagtttaacaagcgggagcgtaactagataatttattacatgggcagcgaaggcccagcacacatgaagacaaacgaaaaacagcggaagactagggcgacgaccacaggcgcttgatggcaggcacgagctagacaccaaagccttcatcttccaggaactcctcttctgggtttgggaaaaattgagcaagactgagtacaactaccgtactcaacaagacacacccataagtgcagaataaatgcaagggagtacaagggagccataatatagggggttagggtttgcagtaaacagcattaaaagtcacttagttgctcaaagctactttgtaaacacgatcctagagctatgcaatattattaatcaaggccgtgaacccacacgaacctgccttaacccaaggcctacgatgattcagatcgaactggcaacccaaccctgggtcccagctcgtcccaagccaacccaggccaaccattccacatttagttgttaagcaggttttatgaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttctaacccatcctagccatagacaagagtaccgacccaaccccacctacggccggaacctccgggacaggtaggcaggactgagcccctagcagcaggacaccagccctgtgccatgacatctcgactaccgggccgtagctcatgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgagaagaggaggaggtgtgaatccaattccacaataatccaaccattccatagtgtccaggtgataagaatattcccaaagtttagagttgtaaaaccacctaatgttgcctaattaagcagcgaagcatctacctaaattcatactagtggtaccatggatagagtatccactagttggggttttatttattctagggtgaacaaggtaataataacaataacaaaaataataaggtcataacaaaggtaaaaaggcatggctaaataaaacagtgataacgcgggaatataaataaagcgataatgcaataatttaaatcaaaataattttataaactgggattcaatatgttcaaggatgatgtgacttgccttgctcgctttcccaaacgtcggcttcaacctccacgtagagcggatcttccgaagctgtagcgtctgcacgatcaacggaaagaaaaaaggcttttactctaataaactccatataacaagcaggaacaaagcacaaaaatgggttcttaacttcttaaggaaaaattagagacttgaacggtccaattccgagttcaaatggccaagttatggccatttgaagttcatatgctctttaaatgaatatttacgaatttcttcatttaaattttaatttaaaaatggtttattgcgtcagccgaggggagagggcgcgcggaccgggtccatgggagtggggcccacgcggcagcctcacggtccacggtccacggtggcccactcggcgcgcccgagtgcggctaagccggcgcggtcggcgggaggcggcgcccccgtgccccgttggtcgccgccggcgaccaccagcgcggcggagcggcggccgagagaggggagggaagggggaaaggaggcgacggtccacggctcaccccggggcgacggcggcgatgagggaggcggccggagcggagggaggcggtggcgcggctcgggttgatggggtcggcggcgctccggcggtcggcgaccgaaacggagaggtggacgaggtcggcgaggatgcggcgaagccaaaggaggcggcgccgaggtgggaggcggtccggggcgacgatggcggcgtacaagagctcggcggcgacggcggagagagaaagcgacgtcgcgagctcgaatccggcgaggaggaagggcggcgagaggtggaaacggacggaggaggtgcggggagggtttaaatagggttggaagggggagagagtggccggggaggtaggaaaccggcgcgggaggtccggccgccatcaatggcgccggcgagatttgcgggggcaaatccgtccgtttgaaaccgagagagagagggaaaaatggggggaaaggaagagggaatcacggggagtatttccccccactttattgcacgcggggacggcgggatgcggtggattcgcggcggcggcggcgctagggcgcgggcgaagcggcggaagcggcgggagcggcgggaggtcagggatgacgggtgggccccacccgtcagcgagggtggcgggcaggctcgcccgtcagcggcgcgcgcgtggggagaggccgagtgggccgcggggagagaagagagagagagggggaaggagagatgggccgggccggcccaagggagggaagggggacttttagggtttttctttttataaaaccttttcaactttgtttatttcttaataattattatttgtgctctgaaaattccactaaaatttatttacacattttaggcttttagggaatatacaaaaatcctctaagccttatttgacttttaactttgcacattttaattgttggaggctttcacaaggattttaattattctagccataatttaaaggatatatttttgggtcattttgggacgtgacattgagcatcacttccagaaatgatcttttgggacttggttaggtcagcgacattcttgatagccgatttaagccttgctttttgctcttcgacagattttgggagatcggctagctttttgtgctccatatccaattcagcattgcattcttcaagctgtgccaagagatcgttcttgcgggcttcaagccaatcgatattggatttgattggaccttcggatagctgatcgagtttgactttgtcttcatgcacaagctgccgattgacttggattgtggcttcaatctctttgcgctcacggcgttcggctaatcttagcttggctttttctagtttaaattgatgctgctcaagataagcggctgcagttaggacatcggccagttcttcaggaattagagcttgtacttcgtgcaatcgtgtcctaatcgatccacagtcgaccactaagctatccagagaagaggcctctagctgacacgagatatcttcaagtgttttctttgcatcgtcagataagggagctagagctttgcttgaagtatcttcttctgcctcatcaagataatctttgatatcaaaagagaagagatcggctagaacctgcaggtataagtttagaaagtttgagagctaagtcaatatagtcgatctaaattcttgcatcaaaggaaaacttactgggatagcaggagcagccgattgttcttcttccacaatatgatgactccccacggccgatggagctcggtcactcgatgattgttgtacaggagaaaaagaaggagcaggctgtaaaaagacaagtgttagaaaaaatcggctgaaatcaactagtaaaattgagagtgtcttactggtagagctggtttgagaattggagctgccgatttcttttttatagcagttttcttcttctgtaactacaaaacctatgagtagttggttgaagaataatgattataaaagggtttgcaaggaaagatgttttactctgaagaagtgagtgggggcagaaggagttgaaggtatctgcttaggcgaagccgatggtgttttttcagtatcacttacttcggctgcagcctgatcaacatcatcctcaatatctttttcatccacagcttgttcaatggatggatccaaagcaggcatgtcgtcggttggcttggttttcttagacttggcctttttctttggagctagagtcaaggtgctcacaaccgatgatctagttttccttttcttggttacatcggttggttctctgatggcgccttggaggagggttgagaccttgggggcatgatagccgatgacagggggagacaattcgcctccattaggaatcagacctggggcatattcattgttcctaccaatattgctctgatgtggacgggaggactctgttgtctgcaaaacagggacaaaagattagtcaagtaatgaatcgactaaccgttatgaaatttagtgatgacaaagtttacctggggtatgatgtcagggaatagatctgtcatgtacattgtggccaattaataaaatagatgcaatttccattcaccccaccatctgtcaaagttcctgctcctgaatcttgctaactcaatattatagggtaatagaattcgtaggagacttggatatttcctccttggtgaataccgacaggtaggatgcatgggctgattgcagctgtaaagacttccctggacgtttgatatctttcatgattgatgtcttcaaatctgaagtctaataggagctcaaggtctgctgagtcttcataaagaaaccaaacctgggcatctttctggaagccttcaaaaaagctgcagaaccaatctttgagcagctcagccgatagttttgcaccagcatcggttggtgtggatgcatattctccatatgacatggatctgcgatgggtgcgttcttctccattgtcttctacaattgggtccaaccttgggaattcagcttctgttacagatggccgattgacaactttcatgactaccaagcttagccaggtctgcagtagcctccatggtccacctgctccaactattgagccgacggctatcttagccgatgcattgtttaacatttggtatagatagccgagaaggattttgcctaagggaaattgtttctttgatcctaaggcttcggctacaaattgccaattggttgtgggaccacagctggatccacagaagagaaacttttctagccacataagcaagaaagctacgtactcccgaggtgtgacaggccctttgcccatgtatgtcgctacataaccagaccaccctcctatgcttttggtcttgaagtcaaattggttcttggtgttcatactcgtagggttagctgatgaagttacatctaatccagtaatcatgataatgtctatcaaaattggagtcatcggcctttggttaaataagaaggcattgatggtgttggaccagaaataggtggcggtagccatcagaggttcatccttagcagaattggctatggtgagagcaagcgcttggcctatcccaatctcatcccagtgggctttcttactagccgatatgcgttggtaccaggtggtccagctcttatcaggggtaggcttttcgagagatggccaagacttccagtgacccaagttagggttggctagtctaaaggggattctgttggtttcaccaatgataaaatcagtggggtcaagattgccgattgggccaagaaaatagtagtttttgtgcgataggctgggaatcataactagattggaaagatgctgcaaatccaaaggaatcgggaagcagaaaacataataagaaaaggagaaatcgatttcatgcgaggaaaagagatctagccggtgagaacttacctcagcgtacttggccaatggcgcagtagatgggctagtagaagacgacatcgccgtaggcggagatctgatcaaaagcgaaatcgcctggggatcgcttttgtgtcggaggaatcgccggagagacaaaggacaaagtttcgcttgagcgggaaaacggaagtcacggcgtgagatttctcgagggcaatggttggcatttaaagcgatagaataacggtcgaaaaatggcagagtgcgaaacttgctcggagtcggtacaaggcaaatccggaacattatcaaatatcccggacttggggggcatgtgttaacgaccaaatttggtaatatcagcatcggaaaaggagattagatcaaggtggagtcgaaggcggagattaatccgagaacagagcaagaatcagctgaactccagatcggctacgattaggatcggctgggtctgaatcggactaggtgagccgatgcagccgattctgatagtataatttggtgtatgacattgggttgaattgaggtgcttcaagatgattgccgcacatggatagagtcctgagaaggcaattgtatctattaattaggatgttttatgtaacttccttagagatatgtttgggcaaaagtctgccgcaaagacttatggtatcttagagtttgttagagatagtggttgtgtccggtatggacatatcttgtaattcttgggtataaatagaccccgagccctatgtaattggtaacacacacgttcaatacaatttcggcgcatcgccacctttttgctttagttttgtttcgacgagttcttgcttttgggttgagctgcatcggtttcgatcttgaacaagaggtaaaacttgttatgacgacttgcgttctcgagattagtgcttccatctttatgacactctaatcttgtctatataattcgtcaagttatcatatatcctacataatctttggcaatatcatcatctaacctataatcggctaatatctgttaatagaaggcagccgattaggttaaatagcgacgttgtcctagattatataagatatctaccactttatgaaacacccaacggcttgattgtctagatattgttcttcttttcatacttaatgctgcatcagttgagtttgatctattaagtcgtgcttagaatatcaatctctagcctgtcctctggttgccgattagggtagcatcggagtttcagccg

SEQ ID NO: 66302 - DNA, 12603 bp, Oryza sativa
  unsure (1)..(12603): unsure at all n locations
tttaaccaagtgaaaattaatgcttttttcgtcctgtgatccctagtgaaacaatttaaccaagtgaaaaaaaatgcgcaacactttcctctatcataacacctgacgttttacaccgaatcgaaggcgtgatacgtcaattaagagatgtgcccatgatgcatggataaaaatcctagctagcttcgtactataagaggacgccacgtcatctgttaaactagcgtgtttatatatatatatatatatatatatatatatatatatatatatatatatatatatatatatatatatatatatatatatatatatatatatatatatatgaaagtcgatttttttccacaataattaactgcattgatctcggtagctacgccacccacagaatttaaagagcctaaggagcatgggtcatatattctgccgaacgtcgttcttgctaaggttgtatgtcttttttcaacctactcaagtccaaaccgttggggccctttaaaggttctaaccatggagcacgaaggtcccaaaaacgcatagtttcccctccaaaaataacctctcccgttggggaacgcattagatatttacctaaacctgtgggtccttgggcagatcccacattagctccaagacgctgatctctaactagaaaagtaaatgcttgagcttgaaaagcttctggcccagtaggtccataaaactcactcggataagctgtattattaaaccagacaaaacaacaagcgataaaaccaaagacagataaagcgcctaaactataagacaagtaagcttctccagaccatacaaatgcacggcgagcccatgcgaagggtttggttaagatatgccaaattccaccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctccccaggagcctaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaaattctcccccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcgtttccacgtggtagaacctcctcagggaatataagattttcatgaggctgatcctgagctgccatccacgcacgaataccctcgtttaaaagaatatttttggtgaagaaagtctcaaattcaggatcttccgctgcacggatttcctgggaaacgaagtcataggcacgtaggttcagagccaggccgactacgccaatagcactcatccataaaccggtgaccggtacaaatagcataaagaaatgtaaccaacgtttattggaaaaagcaacaccaaagatttgggaccaaaagcgattagcggtgaccattgaataagtttcttcagcttgagttgggttaaaagcgcggaaggtatttgcaccatcaccgtcctcaaatagagtgttttccacggttgccccatgaatagcgcatagcagagccgcacctaatactccggcaactcccatcatatgaaatgggttcaacgtccaattatgaaatccttggaagaagaggatgaatcgaaatatcgctgctacgccaaaactcggcgcaaagaaccaaccggattgccccagtggataaatcaggaatacggaaacaaaaacaacgattgggccagagaatgaaattgcattataaggccgcaattgaacagaccgagcaagttcaaattgacgtaacatgaaacctattagtgcaaaagccccatagagagcaacaaaagtccacagaccacctaattgacaccaacgagtaaaatccccttgtgcttccgggccccatagtagcaacaaagagtgtgctaaactattggcaggggtggaaactgccgcggttaagaaattgcaaccttccaaataggaactcgccaatccatgggtataccaagaagttacaaaagttgtccctgtaaaccaacctcctaaagcgaaataagcacaaggaaaaagcaataggccagaccatcctacaaaaacaaaacggtcccttcgtaaccagtcgtccataatatcaaacaaatcattttcttctttagtaactctaccaagggctatagtcatagtgatcctcctattcaattacttcaaccatttccgagcaccttatatcacttccaaggcatacgatagattatctgtggacgattttttctcgttcaatgccttttttcaatggtctcgaagatagaaattttgcatttttatctatggggtcacagccgaggtcgtggtaaatccatgaatttgattcaattagtttttcttatactatagaaataaacattggaattcaggattattccatgattcctatttccaagaaagcctattttttaagggaaaaatgaaaaaaagtaacctctcttttcccactcgctctctattgcatgggtataagaacaaaaataggattctgaaaaaaagtaaagatattgaaaagaaaaattgactttcgaaatccatttttatgtgtagcggaaaggggttgcgatttcttcttattcctatagaacatctagtaacaagaatatgaaatagtaaatagcgagaaattcttgccttgcgtggtctaagtctaaggaaatacaaaaaaatccacttatacaatttcatctacatcgaatttatatatcagaatagcggatagaggcctcattcaaggagtcaggtccacttactttatctttctttccaattttatggggtgggttggtttgataagacccctttttgctttgttgataaataataaaaaaagagtttttttctataacctgcttgttttattataacaagtcctatatggaaatgcctgctgaagagaaaatctatctgattgtcttttagccaatatccaattttagaattagaaagaaaaaagaagaattttcttcttttttttattaacattaagaaaaaagaatataactaaaatggaattggcaatataatttttttgaacttttgaaagaaaaaggaaggattttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccctcggatcgtttgggactttcgaattggaaggaattctgacccccggattttctcgtagataaatgtatgaaacaaatccaatttgtaagaaaaaattttggatttttactcgtcacgcccaggattacgtcctggatcattagataagaatccaaagataaagagggaaacaaagaatatcactactgtataaacaaaaagtttgagagtaagcattacataatctccaagattttttttaaggaatagattacccgtttttccttaccacacaaatccactaggatgggttttgtttattttgacacctaaaaatgcaaaaatcaatttttgaaaaaaattgcaagaattgatttataataagcactcttatcaataaattaggttaggtattgtgcggttacctaaagatacctgctcaacgtagatgcagggagtagaaagactgatccaaatttattgctgcagctatacattcaatgtagaagaatttgaattttagaatcgaaggttcataatataagacttctcggctcttatccatatttcgaatttttttagaatgaatacatgattcaatttggcagacagagtagtaaagatttcatcgaaaacttacagcagcttgccaaacaaaggctaatagaaaaaagagtacaggtatgacaggcataaaatccacgattgggttgaaaatggcataagcttcgggcaatttggcgaagaaaaaactagtcggataaataatagaattaaaacaaatacaggttaaactaagtatattaggcataacaagcgtttcgttcttgtagagtagataattggattttgattgagttatttttctaagggaaaaaggaaaaggaggattcaaaatccttttttcttcggactttcccaaacacaaaatacctccttgtattcgcactctcaaatgagagtggaagaaattcgactttcatatatatatatatatatatatatatatataatgtggcaatcgatcgatctcatcatttgttagatgcattatcacttatctgtgacttaatttgttaatgtaactttcaacttactttctctgtagtttaaaaaatatattctaaaacgaagaaagtacgtaggtggtaccactggtacgttgtccaggtagagcacacgtgggcaatggcgaagccaagatttagtgatagggggtgctggccacgagatgcaagaactcaccagcgcctcggtagacaaaagtgtggatcttgatggctcagttcatgctgagtggcagattgccctcacctcacctcttgttcgcactaatatacgtggtcgccaaagaatcattttttaaaattaggcaactaaatagcaccaaatttactgaatacatgaatctattcatccttttttagttttggagacttgcaaccgcatcgcttagttgcattaactcaggtaatcacgtattggttagttatgtataggctcaacttgcaactaactaatgagttaattgtatggattagatgcctaatcaccgggggtgcatggggatggggggtgccaggcccaccctggcaccccggtggcttcgccactacacgtgggaacgaaaatgtatatgcgtgctactttctccgttttaaattataagtcgttttgatgtcaaagtcaaattattgtaaatttaacttaagtttagagacaaatatgttataatatttacaacaccaaattaatttcattaaatcgataattgaatatattttcataatatatttgtcttgtgttaaaaatgttactatttttttctataaatttaatcaaaattaaaacagcctaactttaatcaaaattaaaatggtttataatctaatacggagcgagtagataaaaaagactctgatatgcaagttgtacgtcgactagtcgtgtgtccacctgctcgatcgcttgaccgagacatgtcatctgtgagtagatttggtttcatcacttggtccgcaagttaattaaacagttaactaattaattaatttgctcgatttgcgctggcctcgggcgtcctcgacggctaacccaacctgattagtttagcgattaacctcgtttaattcctgagttacgtgtgctctgccgagagattaaaagcgtattaattaatactccatccgttttttaatagatgacgccgttgactttttctcacatgtttgaccattcgtcttattcaaaaattttatgcaaatgtataagatataaataacacttaaagtactataagaaataaaataactcataacaaaataaattataattatgtaaatttttttgaataagacaaatggtcaaacatgtgagaaaaagtcaacggcatcatctattaaaaaacggaggtggtatatattaatcgagtaaccaatggctgcctcgatctgtcacgtcatagatcatctttctttgaccttctttcacattaattttccatgtacgcgtccacatcagctaacacacacgtcggtgcatgttatatctttttctttttttaaaataaggatttgaattacaatatttgcgtcgtagggttaaatttacatgtatggatgaaaaccaacaaaaattccgtttccacgtgaacgaattaaccacgtatattaattatagtagagtatatttagtttgttttcgccggtccagcattgtagctagtatatttgcaaattaagtacatggttgatgcgtacagctgcagcttcgtcccgatgaggacaaacaaataccgtcagtgatatatatagtacatgtgctgttgatgccgacctttgccaaacttaatccatctcgacgtaattcactctctccgacttatattaaagaatctttaacttttctctaagtcagcttttttaaaaaaaaattaacataatttataatatttctaacacaaaataaacttactacgaaaatacattcaatgctaaaaactaattcagggttatatgttgctattttttatgtaagttttatcaaattttaaaatgttatatatatgtcttatattgctaaactgatcgatggagtatttctcctgtgtggctatatatacttgcctcctactagcactctacatctcctttactgatattttgtgtagccgtctgagccgtctgagccatgcatgcatataaaaatgtaggaatagtaaaaacataagaatattataggaatgtatgtgtaaaatagagaaataaaaaatatacgaatttcttgttcttcgtgcgaagaattcttacaacaaagagggtagatcgagtggactatttttatgtgaaaatatgggcaaccctttgaaatgaatgcatctacaagatctaattcaaaggaatcatcaatcctctatttttctatttttccttcacatttcctcccttcggaatgagcccttacggcttgtttggttggagggagtttttagaagggattgggagtttagagggatgaggctataagtgttttgtttggttgggagacatgtgaattttggtgggatggggatggggaattgaggaaggaactccctccttttcaatacctgggtaggggcaggtaattgggagagaattcctcatttactttttctaagcaaatctcagccatccgtttttattaatgacctaatctccaactaaactccctatcaatttctatcacctctccaaacaagatattaggattaaaaatcaaattcccatcttaatctcatcatcaattccctcgtgtaaactcccgatccctttccctcgagttaccaaacaagccgttagtaggcagtagtaggagtagaagaacagccagttacccccactagctagtaggagtacgtcttgtacgtcgtatgcatgcatctgatcggccgaattgagaaggatggatgtgtttgggtggagggggtggagaaaattaagaaggatacctaaaacaagataagtcatagcatgttattaattaagtattaataatttagaacttaaaaggaacatattaatataattttttaaacaactttaatatagatgtacttctttaatctttataaaaaacactataatctcctgtatcacgggaggcccatcgatcgtaggatgtggtgtcatgtatagtagccaacccggccggccagtgcgtgcagtgcagctagctagcttgagcttgctacagtatgcgtgatccatccagatctcatctctcggcctgccctgcccctacgcacattgatcaggatcactgccaaaccatgacaaatctgctgcaagtgcaatctaccaatactattgttcactgtaccacccttatcagtatctgcattctgcaactctctctgcattcagtaacagtaacttcggaacaattgattgtactgtaggggtgggattgtgattggaaaatgaatgaagggttaggattaaatggaagggggagaatgaatagttaggatttaatgatgttttttggtgggtgggaaatcatttccctatctcatttgcgcctaagagtaattaattaacaaagaactatataatcgaagaccaaatccacgtctatattgggcctaatactgtcctggaaattaagttgggtcggcatcctcggtgttgatagttatagcccagtagtacatttgcggcccactaagaagccatctccggaagcatcgagaaggagaagccatcgtcaatctcatcctcctcgacgaaagaaagaggagcagaagcagataagagaagcgcctgtcctcctctccggcgaagcctctgcctcctctccacttcttctagaaccttccgcgcttccgtgctccccaccgccacctcgcccgctcgctgtccccagatggccccctccctcctagccgccgccgccttgccctttcttctccacggcgccgccgccgccagtggcagccgcaggccgcttgtcgccgccgccgccaccggccgccgcgccgcctcctccctccgagtcgccgccctcaagtacgacccttccaaggtaaccgcattacgggtggctcgagttcgagttccaggggtttgggggggtagggttctgacgtctgtgctaatgtgctatctggtggtggtgttgttgttgtccaggtggcgccgcagtccgaccgggtgctcgtccgcctcgaacagattcctgaggtatctcgtgctccattgcctcgcaatgccctttaatttgctctgcattttaatttgttagttcaagcatttcagttaattgcttagccattgtctgtggtgatagctattctgaatgcctctagttgagtgaatcctttgttgatgtagcgtgaatcgaaacatctaggtttaggtggaatgctggtaatggtgcagaaatggtaggaaggttgtgactagggagtcagtttttacatatttaatttcactaggattaggcttcaattatcatattttggcactgatacttgcatagttgcagatatattatactccctccatattttaatgtatgacgccgttgactttttaatcaacgtttgaccattcgtcttattcaaaaaatttatgtaattatcatttattttattgtggcttgatttatcatcaaatattttttaagtatgacataaatatttttatatttgcacaaaaaatttaaataaaacgaatggtcaaacgttgttcgagaagtcaacggtgtcatacattaaaatacggagggagtaaaatgtaatttgcctgcttttcagctaatgctttttcagttatgttggaacttgtgatatattatctaggaagctacatgtttaggtagcataagaaaattttgaattctggagtggtgaagaatttatctttaaacatcagcacttcgttatttgtcttacatagcgccatttgtttacactaaactttgaaataagttaactacagaaaataattcaggtgatccagttagtttcgtgccaaaagactgcagaatgtaacacactgttcagctatcactgggtcactgggtgactggattgtctaggatggctactctttttgtccgctatggcaaataatcattatcatagcattttatgaggaaaaacttctgaaaattttcttcggccaatctacagatgcgtatttccatgaaaatcatgttatggttattctgaagttataggcatagtcactaggagtagattatcttgtaacgtagcttattcttataaaacttttgacgcctacagaaatctgttggaggagtcctgctgccaaaatctgctgttaagtttgagaggtatttgatgggtgaggtaagatcttacattgccatgctctactcttataattgttaccttcaccgggctataattccttaacatcatactatttctgctagattttgtctgttggtgctgatgttaatgaagttgaagctggaaagaaggtaaactcttaatgcatgttccgagtgtgtatgtacgtcaacaaaggagaattctatgcttgcaaaactttgacatattatattcacttctgaatagcacgtaccagattgtatgttattgcctgtggtgttcttcactttgcatagtacttccatgtactgcactactacatttagattagatgcaggggggatctctaatgacaatttgttctttatgggtataactaaatttatgataacttacagtttgcgccagatttggttttatgtgtagttacctgcagaaattgtaattgctgtaagcttcatccattagaaaatgcaatctgcattttaaaatacttcccttttagtatagctacttcccttgatctttttggtggcgagaagtgagcccgccaagcactgctgtgggataacacagtagaaacttaagtgatactcggattgtcgaacattgaaatcttaaaatcactaatatatgaaaaggcatcaatattacattagtaggtttctcatatatataaaggtgcaatatcatgttaaacacaatacaacatggagaaaaaactgcccactactaatttttactgtgtgcttagatgtggtgcgatgatcccatggtcagcaaggtctcatttgggcttgcttatcttgtgcttctacacaacctattaattttccttttattgtatagtataaaacgttgcaatatactattaacttagcatattcatatttcttgtatgttatagggaaagatacttgacttgctgcatagaaatatgcatgaatgtcatgttaactgtttcaaagattgctccattaaatgtgaaatgtttatgtggcttaatgaagctgagtgatatctttggtctttaggcaatttcatttttaatggaaactccagtttttggtcattagagcaggtggttttttaatgcaagctgattagatgcccatggcccgttgtgtgaatctgaaaccactgcttgatcattacctcttttattatgcccttcatttttctgtttcttttccctggagctccactgcaattcttgttttcactctcacttgtcaaatacaacatatatcttctgctttcacctttacagtcggcacagctgttccgcctgtgttctttgtatcgcattaaaatgtcaattgaacatgattcactgacctggttctgcttgtgactttgcaggttctcttctctgacataaatgcttatgaggtaaatgaattggcttctccctaacggatacattttgtggtctttctcctaagtactccctccgtcccaaaaaaaaggcaacctagaaggggatgtgacccctcctagtataacgaatctgaaaggagggagtacgatgccttttttggtttttgttccagtcatctgaacgctcatggtattgcatgtacttgcaggtggacctgggtaccgatgagaagcactgcttctgccgtgagtctgatctgttagccgttgttgaatgagtttttactccaaaatcggagtgtccaattccacaggctagaacaaatcccaaatttattatctgctatgtgatggcgatgagttgaacaatttgatatgtcattctctacaaatgaattttggcttctaggagtataaattgggacagcaaatatcctatcaatcaatcttattcacagttacactaattttcttaaatatattgatgtcctggagataaacgaaacatgaattatggctaaaaaaaggccagagtctagaactttgacttgtttccaatgcacggctggagcttagagctggctgctgagtgttgaccgcaattcttgcattaatcaagccttgtgtatctctgtgccagggaatgttaccttctgattttcttatgcactataggatgcttactgtttagatcgcattatgtactacagcttggagtaaaatattttgagagagagagagagagagagagagagagagagagtgtgtcataatagtgggtaatagcattagtaggattcatgcatatacgggggtgnnnnnaaaatttttnaanccctcattttctctaaaatacacaaactacggatataaaacacatctaaacgaatgccaaagtaaacgaaacgctaaggctcttacaataggggtatatcaagccgggccacaattaaccggctccgaatataccaaaaaaaggatgcctgaacctccagtaggaaagcggcctcaccagtttganttcctggagaagccgtccaataaaaggttcgctcgattttctctttgaacacacaagccacgttgcgcgtccagtttaaacaaatacaaaaagtaggacctttagactgtagcttcatctggcggatctaagaactatcatcaatctttatgtcgatgctaggaggcaataacttactcgcgtacattagccg

SEQ ID NO: 66303 - DNA, 892 bp, Oryza sativa
  unsure (1)..(892): unsure at all n locations
caagaattgatttataataagcactcttatcaataaattaggttaggtattgtgcggttacctaaagatacctgctcaacgtagatgcagggagtagaaagactgatccaaatttattgctgcagctatacattcaatgtagaagaatttgaattttagaatcgaaggttcataatataagacttctcggctcttatccatatttcgaatttttttagaatgaatacatgattcaatttggcagacagagtagtaaagatttcatcgaaaacttacagcagcttgccaaacaaaggctaatagaaaaaagagtacaggtatgacaggcataaaatccacgattgggttgaaaatggcataagcttcgggcaatttggcgaagaaaaaactagtcggataaataatagaattaaaacaaatacaggttaaactaagtatattaggcataacaagcgtttcgttcttgtagagtagataattggattttgattgagttatttttctaagggaaaaaggaaaaggaggattcaaaatccttttttcttcggactttcccaaacacaaaatacctccttgtattcgcactctcaaatgagagtggaagaaattcgactttcatatatatatatatatatatatatatatatatatatatatatatatatatatatatatataatgtggcaatcgatcgatctcatcatttgttagatgcattatcacttatctgtgacttaatttgttaatgtaactttccccttactttctctgtagtttaaaaaatatattctaaaacgaagaaagtacgtaggtggtaccactggtacgttgtccaggtgggtaccgaaataaaattcgcgntgtagtctcacgttgctctattttacccact

SEQ ID NO: 66304 - DNA, 2955 bp, Oryza sativa
aggaactagctattgggctgtcgacaggttttgaggcccaaaactcattttttgcacctcacgatctgcaatcaatgggtcacagcaaaataaaattgtctaaataagaatctttataacaacatgttttttcctgtcgatccaggcattgtaacagaaacaaaaatgtctaaataagaatctttataacaacatttttttttctgtcgatccagacagcgtaacaaaaacaaaaaatcgagaaaacatggggtcggagaattaaacttcgacccccagcctccaggttgctatgccgccgtccacgagtgatgtcaccttcatcgttcgcctacgggccagatcaggtgggctgtagtaggagcactatttttcaggcccatggaaaagtggccaaaaggcccatctctcgctccctacaaagcggcccacctatctgtggcgcactcgtcttccaccttgagtcgcgtaaaagaaaaagaaaaatctcccgtctcgttctcgtcgtctcctccgctccgctcgttgcgccgccgccaagacgagcaggggagggccgggcggcgatctccatccggcgagcagcggaggggaggggatcctggtgcgtcctctttctgattcatctctctctcccaccccaccgggacctggctggaacttgcttgcgttcgtgaaccctactagcttctcttctagatctcctcctcaatttgatagccttaaacatcttaattcaagcaataacagtttgtttgttcacccaaaatgtcccaagtactactgcctgacatcatctgttggctatgtgtgttatgggaggaggcagaagtctgccacaccttgttatgttgttttcgtttttcttgtggagtttactatgtagtaagttaattgcaagatatcattcatcatcatataacatccaagtagaataacagatggatgccgcagctcttcagtatgagaaccagaagctggtgcagcaattggaggcacagaagtccaaaatgcgtgcattggaaggcaagttcaaggagctgagggatgagcaatgttcttacgacaatacattgatttgtttgaataaaatgtggaatcaggttcattcatctgtctttcatactgatgtaaattctattcgatgcatttttttttccagttcaatatgtttctgatgcacttctgtgaattatagctgattgatgatttagtgctgcttggggttcgagctggtggggatttaaacggtttgcaagcgcttgatcatgaagagatgtcagaaggttggctacttggctacttgttttactttgctctctgaggtttgtttttctttcagtactgtcattgactattctttctctattccgcagaatctcttgagtcatgtccttctgaggagatatttctcttcagactcttgaattccaggaatttcagaaataatgatgacagtagcctgtcaaaattagttgaggaagctcttgccttgcgctattcaacaacagttactctgatgaagtccctgcaagaggcttttgctgtacagcaggctagaagtgaatctttatcattagctttaaatggacagaactccagtgaaggtaaagatgaaagcaatatttgtgcccttcttttttttttttggtctaacattgcaactctattatttaatcaaataaatttatttccttcagacgttattgtggcccttgaaaaccataatgattacttgaaagaagtggttgacaatttacgtcaagctgtgtctatcatcaacaggaagcacgaaaagtatctggatgagattgaggctttcaaaaacaatcaatcaagagaactacatgaagtaaagtgtctttcaggtgttaaagaatgccacttcttcccccatttgtgttggtttgtttaaaattttgctgcattgcatttatgttgatctattcacagtttttggctgttgtctcatgtactaaatgtaaatcagttctactaaatttaaaaacaccattttttaaaatagcttgattgcataaaattgtattttggcacataccctgactttgcattttggattggattactcttgcacaccaaaacaacctgtaatgcacattcatatgttgtattttaggtgagctagaggaaagcatggcagagcttgaggaaagccgtcgaaagttggctgttctccagttgcaaacgggtggaggctcactgatgaacacatctgctcctaacggtgtgaacggtagtgtttcaactgataaatcttcagacaagggtatgggctggcgagatctgaaagatgctgttgaggaggctaaggtactgtgataagacattattattattattattttcttttcaagttttcatggatgctttgaaggctgaagagtgttattttctcacttcttatcttattgttgtttttttttctttcttttcctgctaatttctcctatggagatcagactcttgctgcaaaccgcctatttgaactccatgagactcaagaggataatctgatactatccaagcagttggaagatattcaggttcatacctttttaatttttctgatttgagttcgctttcttatttctttttaatttgcgcttctttgctatgtgtgcaggatcaattaaaagatgagaactatattgttacatcaaaaccatatacgattctcagtgaccagttacaccatctgaatgctgagatagagcgatacagggggttagttgaagtgctacaggtatgctgcttttcctcaggtgggctgttttacaatggtattgttgtttgatcaaaccctggcccccccccccccccccccccccgagttagaatgaaaaggaccagctcatgcaaaaggaagaagaaatgcttgcaaaggcagaatcagtggacgctgttcaacaatccattaccacttacaaggccaaa

SEQ ID NO: 66305 - DNA, 6736 bp, Oryza sativa
ctgctaccccttacttctgtcatatccttcttttgtttcctcggtctaccactatttctattcattctccttgaaacctcttaaaattggatcttatagctttttgagtttattatctcgttgggtttcgtttttataatttctagaagtcccgtcaaacgctgccattatactcctctaaggcccgtccactctcttttctctttattatcattgggattttacaaatcgaacataattatcgttcgggtttattttttttactttctataagtcccgccaaaccgtcagcgggtttgccattgtactcctttatggctcgcccgctgcctcccttgagattttaaaatgcatcatgattatcattgttttatttttactttttagaagttccgaacctttaaaaattggaccttgtagtttttagagtttattgtcttgttgggtttcattttttatagtttcagaagtcccgtcaaacgatgccactatacacctctacggcccatccgccgtctattctttattttcattgtgattctaaaaatcgaacataactatcgttggaatttattttttattttctagaagtctcatcaaccatcggcggctttgtaactatactcctatataccccacccgctgcttctcctttttattgtcattgagattttaaaaattaaatatgattatcgatggggtttattttttttactttttggaagtcccgtcaaccgccttactcgtttgcttcacggcctgcctgtcgtccctccttttaatcatcattaggattttatttggtgttttattaacagtttttatatgtcgtatcaaccaccaccacgctactcctttataggcctgttacttaatttatctcgtcatgtgttttagatggtcttttctttcaatagtctttatttttatcacaaatttttgttatttataaattgtattcctaactgaaatcttatttttctttttctaattcagaatttatttttttcaaattttaattaatatcgtattgtgttcttttaatttttttattttttattttcaatttcagttgttttaaaattttattcctacttgaactctcttttagtttttctaattttagatattattatatttttttattctgaattttaattaatctcgtattgggttcttatatggattcttcttttaatattgcttatttttaatttcaaattttagctaattttaaattgtattcctacttgaactcttcttttttttcctaatttcgggttttatttttatttttatcctcaattttaattaatctcgtattgggttcttatatggactcttcttttaatattccttatttttaattccgaatttcacctatttaaaaattgtattcctatttggactatccttttcttttttaaattttagattttattttatttttattttgaattttgattaatctcgtattgggttcttatgttgaaacttcttatgtggtgtctcctttcaaagttgttttaataatatcatagattttagtagtcaaagctttgtcattaaaattatgcattagttcctatatctccttatttctcatcttatttttcgtggctaatttattgtctgtagctagttgcacaaatatctcctcgtttaagtctggttagtgtccagcacaagttgctcatttttctcgattggttgaagcatctacttgagtcgaatgttgcattaaactagttagtttgctcataaccgatttgttgtgcaattttgagatggaatctgaagtgatttggggtttgaggggagtacaacgtaggtgatacatatgcttgactttgtcttgtggacttatttaactactgcaaactaattttttttcacttgccatgctcttttttgccaatttactaacgtcactgctatctatagtatgcactgaactgaagctgttgatgcaccatatattaatgtactgcttgtttctagaggtagcacagtgtacttcaatgtttttgtgactcgggaaaatttatgcatgtcagaattgtcttcagaatttctcaattgacacatcctaaaatacttaatgccttatttttcttgttcctctgaatatgtcagtgaaggatatatagtttgtgcaaagcctgttgcttaaaagccccctcctcaatatgtagcatttcaaagacatacaaaagatgataaaatagctagagcttaaatgcttggaagagggataagttatctgcatttgctgtttcatctacttgtattattggtactggaagttgtaactcccataactcgtaacttacagtggtgataaaagattcttgttgaatgtaaattggttataaacttataagttacagggctgaaagtttgcttgtattttgatggatgaatttgtgtgcatgtgaattgctgtgtatatatatataggaaacaactccattgctataatgtgttgagaaagtattgttcagtaatccatattgacatatgaactgcattgttggttttttttttctgccttgaagttaatttttctgacggttctacctttgtttttctgacggttccacgtcaaaattatggggacaaaaacgtgacggcagtggattttttctgtgttcctccatcagaaaaatacccacagaaattgtttttctgtagggaaaccgtcaggaaaatggaatttttccgtggtgatttttctgtcggcaatttctgtcgattcacccacaggaaaataatttctgacgggaaaactatttttctgacggtttcgctcctacagggtaggtcccaaatctggtagtggctctgataccgctatattcgaagggcgtacccagccttagctaaatcttatgctacttggagttctagaacaaacagaaaaggtgctgaaattaatttgaagagagagtggcacagcgcaaaaagcctgaaaggccaaaatgatagccacattcgctgcatggccaacttaattggttagggccacgtaatcagcttgggaaccactgaaacccatttgacagggcaccagtcattacggtctcctggttttcctctcttccctatctccctaggacgacggcggtagacatagagaaggacgacggccaacggtagaggagctaggcaatggcggtgggcctcgatggcatctcggagaggggcgatgtggagggagctcaacttggacctcttatcacgtctggtgagagatgactcagagtaagccctcttcagcaactagagggtaaaaaaaagaggaggaaacaacgagcagccggcggcaaagtacatccgttgcgctccccatcgccgttgccgccactgcgaactttgatttcccaagtccctctgccctgatcctcctttgcgccctctcgagctcgtcgccatctcactcatagccgttagtggcgccaacagtctttcaagcggatcttagcagacgaagcgcatgcagatgacgactgaccatccccattgattccccttatcgttgtcagcatgcaacctcctcacgcgcggctagatgaggttgctcacgagctgcgatgtgactcccaaccccgcgtgacggcataacatccgatgaacacccagacaacgagaaggccaccatggctagttcgttacgctctatcgccgcaacagtccatgtcctcccttttcatccccttcccctacctcctcctttatgatatcctttcctttttttggcgccgttgtccctgagccttccctatagccactgccctggagagatggtgaagaaatggggaagaatgtaagggccctgacataggtttcatgtggtctcacggccattttgactacagtcaactcaccatgtgagtgaaaatcggtcaaaatactgtcctgcgacctcgggtactctggttgtaagttgtgggatatgttatatctggtattaccattcaattacacgatgcaaactcgaagttaaaatgagggaccaaaagtgcacttattccgctgaagtgctgaacattggaccgatctcctttgtgcgtcctaaccgatccaacggctgcccacgcacacgtacgagtaacccagttttatttcggcccaactggtgcccaagtgcccgaccgcgcgtaggtttgctattgccgccgcggatagctctcgtggccgccacggaacgaggtccgcgcgctcgcgattgggctggcagatggatgcctggaagcgttggaagtgggctcatatattaggagaggaacatacaagtcaatagtggtaggcatgcacactgaagactgaactgactgatctgaactgttgcttgcatgattggattggttgtttagataggagtacttggataccttaatcaaatcatactacaacatgcatatggtactagagttctagagtactctctgtatttattttgcgatggagggagtagaaagcaaaggtgttgagattttctttagaagagagagtgccacaacaatgtcttactttttttttcagattattcattggattatcaaaacggattatttggtatatacttttaaaaagaatatgttttctacaaactttttctactatattgcttagatcactcgttttaacttttaaactctttttaatttatttttaaaaatattttggttaccccttaaaacccatcgcaataagctgcaaaataatctgaaaagtacggggtgggtttgaaagtttatactttggaatggcaaccacattgctgcatggccatcttgaggagagataaagactcaaagtattctttccatgaggttctacctcatgttaaatttcctctaatattcacatgggaagaggcatttcataggattccataggatttattcttttgattcaaaaggctatataggaaaaaaaaatcatataggaatgaaattccctaaaatttttatgaatttcctttcaatcaaaaggggtctaagtttgctagccaacaatgagatggctagctactcatagacttactttgtacggcaaacataaccaaaaataccataattagaaccatctcgatctaagctctagcgagctacttcaaacctttcgccactagcgcgcagcatgtcgttcttgttgctttcctttcgtagcccttgggctacggtttactttcccgggttatacggctcatcagagttagcagtggggcataatccacaaactgccttgttgatcgtcgaaatcacaaagaaacacgcaaaattctggcgtggcggccgcggggaaccgtactgcatgccggcaatacggcgaagaagcaccggccccagtaccgtgtggatgcacggcatcatacggtacgaccgaccccgccgggggctgcgctgatgaaagatgcgcttaaaccgggggggagcagtatcagcatcagcagaacgtgacaccccggtcccgcgcgtcatagtcgatccaaaagccccccatgatcctctcgccagagcctggcaccgggccccacatatatcgcccgcccaatcgagcggggccccgaaaagtatcaggcacaggagacgcgatgcgttcgctgatctgaaaaagataaaaaggaccaacgtacgcatgcaaccgcgcggaggagaggaggcgagcgtgcagcggggcagagctaaacacgaacgaaagcccggtggtggcgagttggcgactgagcgcccgtgtacgtcgctggattccccgacttgtcaccgttgcaggcttgatgtcccccgctgcgttcgcccgacggcgggggccgtccgcacattaaccgcttgtgtaagtgagctttatgcgcggtcgtcggaagctagctagcaaacaatgccttgactgttgggggcgctttgggagcagctggcgcgcgcgtggggtcttctccggcgaagcagagcggacaacgtgtggagttcccaggagagatcgagcgagacgccgagacggacacggtcacgcagctttgctgctgatgtgggggcttcgttcactgcgtgcactcggtccgtggaacagtggattagataagaggctccgacgcgagctgatcggacaacggcgtccggctctccgaaaggccggctggagtggagtggagtacaggagggttcagcacagcgccaggccggcttaaacatgaattctgtgagaaaattttgtcatcgatcttcatctcatctctttaaacgtgtattaagagtagttatacctacgggtgtttgctgcacaggcaatgaggtgtatgtgtgtgcatctttctcgaaaaatataaatgtactcgtgctgattttaaatataccatgtaagttgtttagacttgtgttgtgtatatgaattgagaaaacaacttgcttactccttgtttttacatttctgagatttacgagggggatactaacatagtaacatttagagtatatttcattttgaaccacttttaataaccactggtagagaaaccatctttggtcggtcgacctatatccacaatagtcccggttccattaaaaaccgggactaaaaatgatttttagtcccggttaataagaggaagatctttagtcccggttgttgttaccaaccgggactaaaaatcatctttactcccggttgattccatgtcaggctgtgtcagggccctatgatctttagtcccggttagtaacaccaaccgggacta

SEQ ID NO: 66306 - DNA, 1859 bp, Oryza sativa
catttcgagttagtggttcatgagcacatgagctataggcctacctgaggaatagcactgcatccccagatactagcttcttcttgttgataaacccgctccatccagtggttaaaaggtgcctccgtggttggcctgtaacaattagaggcagacctatgagatattcatggaccataattttctcaagactcctccaaattgcaattagcttaactattagagattatgtcgcaatagctgtagaaataggtagtctatgcataaattaaaataatttattgaaaacactcccagagtaagtgagcagagcctaatgagaaaaaatagcatagtttgctcatttttatctcatccagccagccaagttacagtttggtttgcttgtttcgtctaaactggacagccatctcgcttccaatacctagacatgatagatgtatctaaaaaggagacctggataatcttactaaaagaaaaaacatatatatactaatgcgttattcggtgaacaaagtacagtagttcaacctaaacagcctgtgatgtactataggaagatgtaggactgtacagcccgtaggttactaggttctctcacgcattaagaaaattaatcccatgttcccagggagaagcctaacaaccaagctgtatgacatatatatggtagttagtgatagtacggctgatatcccagtcaccaagataggctaaaccggcgaatcacctcgatagatatgtctgaacctccattccgtgccgtgcagatcctttgccacgagctcctggaatggcctctgcaggctgtagtcctgcaggcgccaagctgaacagagtcaccacacaagcaatcaaacagatcacggtgaggtagcttgtcccaatcgatatcgtcccgtaccagcggcgggaagcagtcctcggcggcgcggcgaggcacggagaagccgccgtgcgtgctggtgtcggaggccgtgagcgtcttgcagaacatgtggggaatccgggccggccgcttcacggcgtcctcgccctcgccgtcgcaggccgcgccgtcctctccctcccgcatccgcctctccacttcctgaaaaaaccacccagaaataatgttcgtttgagctactagcactgaccgaatgtcaaagatattcatcccatttttggatcagcacgcacgcaaacgcacctcgttgtcggcgaccaacgagacctgcgcgtacacctcgtccgtcgcggcgtccgcctgcaaacagcacaacgggaggagcagaccctctctctcaatcaatacctcgaacacattgcgctcgcgcgagagcagcaagcggcgagcgcactcacgtggaggctgacgtcgacgacgcggcagaacacgtgcggcggcaccgcggcgccggggccggagccgggcgcggccccgaggtgctcgaggtggccctgcggcaggtacacgacggcgctgcccttccgcggcagcggcgccacggggccagcgcaggcgtgccacagctccaggcacaccgcgccccccgccctcgcctccgcaggcgccgtgacggtgccggtggcgccgccctcctcctcgtcttcctcctcctccacggtgttgaggtcgatgcccaccatagccgcaaccccccaccggcagctcgccgcgccgccgccgcgcttgcttccaacgcggtcgaaagaggagagacggggagggaagcgaggaggggaggcgatcgaggtccctcgcttgggtttaatggagcggagagcggagtgggtgaggagaggcggaggtggggaggcgacacatggtggtgatggccatgaatggctgggctgggtggtggtggggggggggg

SEQ ID NO: 66307 - DNA, 2081 bp, Oryza sativa
cgcacccacgcatggcacattgtcacaatgtcacgtttaggcacagtcggagaagagtggacacacacacacaatagctagtgatgagagatataggcggtgagggtctctttataaacagagagctgtgagtacagcaagtttaggacctgtttagatcccgccaaaagttttacaccatatcagtagcggagccataaattactaaagagtagggcttaagtagtgagttatttatctttttctaaatttacatggtgatttaacataatttagccatgattttgaaggcaggcctagggtctaagccctagctgccctaggtctacctccacccctgcaccatatcacatcgaacgtttgatcacatgcatgaaatattaaatatagtctaaaaaataactaattgtacatattgcgactaatttgcgagagaaatcttttaagccaaattgcttcataatttgacaatgtggtgctacagtaaatatttgctaatgactgattaattaggcttaataaattcgtcttgcagtttactgataaattctgtaattagttttttttattagtgctcgaacaactcacgtgacaccctatataatatccaatgtgatacgccaaaactttacacccttggatctaaaccaccccttaatagtatagccagctactagctccaattcatatataaccaatccaatagcttattcatacaatagttcctatcatcatatactacaccattaatatttattcacatatcttagaagtctatgctatagtttcctatagaagtctatgctatagttggctataaatctgtaacctctatctcctcttctctcttcttatccgtatgtgtttagagctgacttgtagggtagtattgtactcgctcgtataggccgcgggctgctggtttccaaggataataaacgcacgacgaccccggcctccttttctttcctgctatatatatacctcctcaccccacaggccacacccgtccaccccccgtaacattaactcctttgttcagcttgacactccattgcagagggagggtatagctggtgacagagagaaatgggcgaggaggccaattgcaacgtcgcgatggagtccgctgcgcccaaggagaacggccacaccaccggtggcgccgcggcggaggccaaggccgccgccgcctgggctgagatcgccgtcaccgacgccgcggcggtgccaaagccgacgccgccgcctgcggccgtggccgtcgacccccggcttcagggcatctccgacgccatccgcgtcgtcccccacttccccaagcaaggtccgtctctcccctctcggttcgccagtttgccatatgtgcaaatacctagtggtatctgaatatctgcgcgcgcggcgtgcatgcaggcatcatgttcaacgacatcacgccgctgctgctgcgcccgggggtgttcaaggacgccgtcgacatcttcgtcgagcgctaccgcggcatggccatcgccgccgtcgccggtaaacactttttgatcagtactactctttattgtcatttgattattgtttctgtcgcgcggagccggagaggtgggcagtcaggggcggagaggcggtgttctgagattccgtaatatctttgcgcgagatctcccctggtcctctcctggtccttttgctcccccatgccttgtcgtcgcccgcacgcacatcgcctcccgctgcacttttccgcgtaactaccacccccggcgccgttgctttcctcgggagaataatactagtagtagacgctagtattatcataaccacttcggtgatcctctcacagcgacaggacacacacggcctcacggcacagtgctctggccggccggagccggcaggtaccggctgtgttatttccttgaagttctcaacctctatctcgtttttccgtacgcacgcttatatttttttataaaaagttagtttctatatgaaaattgtttaaaaaaatcaaattaatttatttaaaaaattttagctaatacttaattgatcatgtaacaatatatgcttcgttttgcgtg

SEQ ID NO: 66308 - DNA, 16583 bp, Oryza sativa
tatcggagtattagcggatacatgctagatctatctgattggctatgctataaacatatataatcatgttattaatatatatttcgatataagtgatttatactgtctcggcatggtgaccgatctatcccaatcacttgatttaagtatatattaatataagaactatatatcgttaatatctacagccgatcgaatagatttagttccttactatatatttataaccgccgatcgattcacatatgacatcggcttaaagataaatgatatgtcattggtacctagccgatcggctatcatttatagatttaaccacgaattctttgtctctatttcttgttgattacaggatcaaatcaactggcacgctcatacattcgaaggcgagttttggacctgcactggaattaagcagatctcccaggcctcgtgttttttgccaacagtattgtacctgtatataatttgcgcatagttttgaataaccgaagatgactggcgtcgcgaactagcagtttgctgaaatctctgacatatgcaaacaaagtcggaattatactggagcgagaagctccacgacaccattgaaccaaacgcactctgttcattgactcgatgagattgatctagcacttcaacctcttgtcagtgcctccaaaacctactctgatgaaatctagcaagatggtctttctccttttctgtttgaattgtcatcctcgtgtacttagacatgttgatctcattatgcaaagttaatctcgcgagttaaatgtttgcaagtccatagtccagttggagcagagttagtcattagttggagcagagttagtcattgataccctttcacttctttcaagaagtatcagggcctatgttcttggagaccatggggagttgcttcgacaaaattaaagtattagagagctaacgattcataaagaaacccaaacttatatacaaactttccggtcagttttagtcgacttacacccttgattttgactgtagggaatcaggtagataaatttgttgaaaagaaaattatggatatgtgatcttttactaatcatcattgggcatgttttcttgaattcgcaataaccgatgctcatttggtttgtctggaatgcatgttttgtttttcctcacggtcaaacccatgagctatcagagtcccagttccattgattatagagaaattaatgctagtagttctgatttcttataataaatagtacattgatgttagaacaaaatccaacattcatgacaagagcaagtccaacatgtatggcaagagcatccctccaatgagagggagcccaagtttgatcccgtgagaaccacgagagtggatcagagaggatgagaatggatggaatgggggagccagatctccctctcttgcccttgagggcttattttattcatatgtcacaggaaattatatttatgctcttgatttgctatatatgtacaatatcctcttgaaggtattttagtccttttatacaccagtttatacaacactttaagtgtggggttattccctaacaattgacacaatactcacgtaggtctctagtagaggtgtaaggtaaagatgtaccaacaaaaaaaacattcagtgattatcacagtgcactggtttgtatcaccccgcagtagcgagttcctgctgtcgtgagttgtcataccagaggaaacaattctgaagatgagtaacccatctttttagtgtatatggtgggccatttcttccagaggtttctcattcctaccattatttcctcatatattgccaatgcgattcttttgggaggagaagaaagcatagtgtatgatcaaatctatctatctattatatactaaaaatccattaaactttctacaaatactctcgagctgtcaggcacacttacaaacactccctacaaacactctcaagctgccacgtggcacacctacaaacactcatgggttgccacatggcactatctgatcttaccgtcgattttcaattaaattggtggccccgatattttcaaccattagattagatttcttattaaaaggaactgaagtatacgtacacatgatatatatccacacctacgtacgttaaaaacaaacaaagcttaccttctgttcccgaaaagaagaaaaatagtacacacgtacttacggaaagaaaaaaatataaagtaggaaatacatatgtgatatgtacctgtaacagcaatgaaaaaaaaatcaactacaaaataagattttctaccgtcaatcaaatatattactttacaaatttacgtaaatatatacagttaaactagatatataatataaatataaaatattcaatctacactgtttaaacgttcagattattttaaaattatatatccacatagcactatctattctcaccgttaatttttatctaaattagtggctctaatattatagaccattagatctattagttaaaaagtaatacatttaccatgtatccgtataaaaaatatatctgtatgtacgtatgattaaagaaaccaatatagcttacctactatttgaacaggaagaaaaaaaaaacagacgcgtacttacttaaaaaaacgatagagcaaaaaaaaattaggcacatctaatacgcgtggaaaaaatcgatggtctttaaactagaatttattttctacgattaataaaatatatttctcaaaaaatttagcaaatatacacagttaaactagatctataaatataaatataaaatatgcaatcaactctctttgcacgttgtcttagaaattattataaaattatgtatccacatagcattatatagtctatagtctcaccgttaattttcacttaaatattattaaaaaattaatattttcctcatatatacatgtacatgagaaatatatcctcataatttaattagcttacctgctgttcacgggaagaaaaaacatatgcgtacatctaacatataccagtggaaaataatcgacggtatttgaaattggattttctacaattgataaaatatattaatttacacatataaacaaatatacgtagttaaactagatctataatataaatatacaatatccaatcaacactctttaaacatcctatcttctaaattattttaaaattatctatccaaattacgatcctgttttattttttagttaaatatacatttgatgtttagggtcctaaatacgtcacaacacatgagaccaacatgtaataataataataatattatgagaagtatttaaataatttccatcatgttttagggtgtgaaatatatcatttcacaaatataaaacactaatttaaatctacatatgtaaaaccaatcaaaaaaacacaatttttttcatgtagatttgattttcaaagtttttttgttggattttttataacaatttgattgcatttgagaagtgagcaacatagacgtgtaaatattatcaaaatattttcaaccaatgaacttgctataatagagccccttaatccatcgtgagatttatggctatacatgtatgtattttctctttgccaaatagttttgataacaaataaacaatcacataacatgtgcaattaaatacttatcatgtatgtttttatagttgaggaagtcctccgtgtcagttattacccaaaacatgtctaaaatgaagtcaaagaatttttcaaaaattcaagcaaacattaaacaaggtgcccgcgtatattgcaggtccattaaacttcctacaaacgttctcaggccatcacgtggctcctacaaactctcctaagccgtcacgtggcactctgataaattagagaaatataagatattccaagaaaaaaaaacgaaaacatcctaccattgattttcacttaatatggtggacccatcattttacaccattagatctatatatgttaaacaaaaatgtcacgtacatccatacctctcccacctctcctcatacgtacgttcatccaaattaagtacgtctccccacccctctcttcttcctttccatttacagtagcaaaatttttatatataaaaacaacgtaactaaataattagaatatcttataatatattctattttaatgtgaactatatttacatatatttgcgcgtacatatataagaaatatatcatttgacataatctcctttatatcacaactaaatagtaataaaatatttaaaaaataacatatatcatgtctcctactcactttcttatccatatcttctatagccagcagctcaatacgtaaacaataaaaaatgctatatattaaaagtccattaaacttcctacaaacactctcaaactataacatggtgttctacaaatactcctaagatgccatatgacgctcaaataaactaaaaaatagaaattatgataaaaaaaatcgaaccattgattttcctttgaatagatgaacccaataattataactactacattgcacataaataaatctgttacccccacctccaccgctaccgtatgtgagcatgcacgtgtgaatgtactccctccaccgtccgactctcctataggatgcaactctcatctcctattttagctaacacataatatataaaaaataatagctaaatgatcatgactctcaagttacatgtacttttctcaatttatttgatctattgtgttatttataattaaatacataattcaagaaccataatgcctatatttactatataaaagttagacaatgctgttgttctgactacaaatatttgagcaaaatagcactttgaaaatgactaaggaattcaaatatgtgagtctaatgtccaagttcaatcactaccaagaaacttgaaactatgatgcatactctgggcctgaacccgatgaaggcggagctacaagacattattagcgaggtggacatcgacggcagcggcaacatagacttccacaagttcatgggcctaatagcacgctagatgattaggtgaagggcaaggactgagaggaggaccagagggagatgttccatgtcttcgacaagaactagaaaacagcttcatctctgccactgagcctcgccacataatgtccactacattaagagaggctcactcatgaggaggtcgacaatgatccgtgaagctaatggtgacaagcggatcactacaaagagttcgtaattaaattcagaaaaaaacaagtaattagattaaaatacatatacaaaaaaaatcattaaaaccatagaaaatataacaagattccatatagaatataaaatatgaagagtccatttatacatgcataagttataaatatttgaaatttggaataataaaataagtattaaaagaagaatccaaatacaacatgatacgagaataagtacattttaaaatccctaaaaaagacaatttataataagaatcactcaataactaaattcaaaatacaataaataattttaaaataatttttatatctttattgattcacatgtataaccaattgcatatatatgaagcaattaaagagagagctagcatgatggtaaaaaaaccagttattaccaatcaaagttggaataattaaatgtcccaatgaaagtttgttgagatttcttcacgaaaaagagatataatgaacactcaattaaaactagaaaaataccttaatttaatttcaatttgttttgttagaactatttttgaaacaaactaatgtgcatgcccgcgcgaatgcgcgggctactatcttcctagttaatataaaagagtgttggtaagagatgccgaaagaagtagtagaatatatattcaagtattcgatcgtataatcaggactctaggttaggtcaatccatcaatgctcagtggcttcccttattaaaagcaaatgactgaatgttcacttgtacttggtagttcactatactgcaaatttgtacatctattctcagtttatagattttacatatgttacatacaagacagccttacagtttataggatgtgtacaataggccagcatagacaaaaaaaaatgtgatgaatgaaataattcagggtaacatttttttttattcaccagatgtttaagtaattcagttattttcacaccgaacatcatactaactgtacagctgtattggatcttctctctgctatcataagcagaatctaggtacctttcaaattcagctctcgaccaatctgacatgtgacatctaactccccatccattttgaaacttgtttagtatttcgaatgtgtcaaaatgaacaaacaataatttgcatgactacatcttaactgaacaattaaattacacaaatatgtaagaaaaaaatatcattggcgcattgaactaatgcttgcagaggaactttatttttttttactaacggaatgtggataaccataaactaatttggggaaagatttttcattgttgtcacacattagttgcaatgccattattgatgtgaatataaaactccatataaaattcaagattcaagaacaagaagatctttcatgtgatggaatggtcacaggcaacaacaggagccgtacctcattcatctcaagagaattgcacagacgcaacaatactcagttgttcgatacaatgctcctttctttcaaatgccacacaaaagtatgttggaaacaatcttgtcatgtggatgagttgaattaatcatgtgcatttgttagtgtggttgattagccatgaatggtgtttttgtgtcattgtaaccagcttgtcaagttgcaaagataagcaacaaaattaaaatgcactagaaattgtgcgcggtgccaccaaaattatgtgtatcgggtgttctcgttccaaatgaatgtgaagctgtctccactatgttcgtgttaatccttatattcccaagaaagcaaagctagcacagcatccacaatcgcaacgcagtacaaagcaatatgtttttcaactaaagttttcaaacagagaagcaaattttccctggaattttactaattgagattcgagttccatcaaaagctgaatgcaaccgagtgtataaagatcgataatggaccaacatttttccttgaagaaatgttcttggcatgtgtgttgtgttggaacaatttctgctcaggaggaatggaggtcacaacctacagaactagggagatttaccatggcaatgatccatgattgacaccgttgactgcagcgagtcgcagctctagtgaactgctatagcagaggcatcaattccgatgaaatatagcccctcctttgtttatggtacgctatttcttccagaggcttctcattcctatcactatttcacttgatcaaagtacagagaattctactcatcacagtaaggtatactacatgcaaaagtgattcttttgggccgaagaagaaagcatagggggcatgtggggaatgatatattgatcaaagagtgtcgtgataagagagtaagagataccataagaagtataacgtatattgaactatttgatgggacaatatatcagaagtctagtcaatctattacactcaaatgcgacctccctcgttcaaaagtttggttgattcaatccatgccattataaaaaaaaggaaaaagtacgaaccatctgaacaatcttggccaaccgtattacccccctagactcaaatgccagatattttacacccctcaattattcttaccggacgaattacaccctaacactgttttgagttattttgaccggaagtttgcacgcgtggcgtcaacgtgtcaatccagtcaaaaaaaaataataacaataaatttgtagggctcacatgccatctatatcttctcttcctcaatctctcctctccccccttctctttcccactcttttcagctcgggatgggcggcggctagattgaggaagcgggaaaggtagggctcgggacggggccagcggccggtggtggaggcgggagaggcagtgctcaggacatgggtagcggccggtggcggaggcggctggaggcagggctcgggatgggggcggctgccagtggcggaggcagctggaggcaggactaggccccttctcttttcctcttcccgagtagttgggaatgggacaacgaacgcctgggagtggttgcgctcgggatgagagtggcagccggaggcgaggcaatgaacgggctcgtcggctggcggcggaggcgtctagaggttcggctcggcgccctctcttcagcggttgggaatggggccgacggccggtggcaaaggaggggctcgggatgagagcggcgtcaaggagaaggctaggaatgggggttgcggaggtggttcttcctctgaggcgaggctaggaataagtctattttgcctccgtcaactcatgctccatgttgaatcgcattcctcaacccctaaactgggtataacctgtccgccaactttcaaaaccattgcaaatcgatttcccggacggtttcagacatgaataagttcaccagccgtccctcaacttttcggcgagtttgtaggaaatgtctaatccccaatacgagacatatttacccctaaactatacgaaaccatgcaatttgggtcccgtaacaatatgtatcactggtttcgctgacgtagcatcctagtcagtaaaataaaaaaataaaaaattatgaggctcacatgcatgtaaatgaggtggctggcgggagatggggaagggaagaggcggccagcgagcctgggagaggaggcggcagcgacggcaaccacgagaatggtatatcgacagcagcatgcgaacgtcgaaagcagcgccatgggtaagcgcccgcggcagcggatcactagtcgtcaacaacgctgctccggtgggtgcaaacgcacgcacccaactacacccaggtcgtcgtcttcctcacgctcgctgtcttcggcgccgtcctcctgctcccgactgggctcccgctcgctgtctccatcatcgcgctctgcccatcgtgctgctcaccagccctatctaggtgcatgtagccatcccagtcacagacgaggcagcagcatccttccatggtcagaaaacaagcactgaaaacatcgttgccagggccatcatctgcttcaatgatcgatatgtaagcacatcactgacagttcgtattcaaacttgagcagtgattgaaacaatttcagccaaagaaaaaggaaaaaagagttccagcagaaaacggactctgtttatgatattctgcaatcttggatgcgtgcgttcttgcattggtggtcgggtgtagatctacagcggatgccaggggacagcacaggctggggtgggagggcgtgctgcgtgtgccgtcggaggcggaaggatctggcttcccgcccctcgggagtggcggtggctgaggggacgagcggcgccggcacgcggatccaataccaccgctagcagcaaccgcccgtatggcatcccgccgccatcgccacactagccccttctcccctcccccatctcccgctgcccgcctctcccatgacccaccctcttcagctggccgcgtcgggttgggacaaaaagagaagaagaggaggatagctatcatgtgggcccacacatacgttttgttattgttttgttgactaggaagccacgtcagcgagactagatatatatactgttataagaccaaaattgcacggttttatatagtttaggggtgaagatttttttatattggggattagagatgttgtacaaactagacgtaaagttgagggatgacatgtgaacttatttctctcagaggcgattccgtcctacgtgggaccaaacagcccaacaagggaagtagcggcccatgagggcacgacgggcccaaatagccccaaactcctcagacgggtgggctcacaatggttcatgggtattcaaatgaaaacccaaaattttttttaaaaaaatacacatgtgaagtatatattccatatgtatatgacatgtgaacttatttctctcggtaaaaagtacatcgaaggtccctcatgttgtcatcgggttacaaaatcatcctccaactacaaaaccaggtaaatcacatccctaatcttacaacaccgggtcactttaggtccctaggtggttttcactctggttttgtccgatgtggcagctgagtcagcgtgggatcccacgtgggtcctacacatcagcctcttcttcccctcctcctctctccacggctgacgcctgacggaggctagctgtgcgcggcatgccgatgcggcgggagcgggcgcgggcgaaggccggcagggtgcgggcgacggccggcgggcacgagcggcggcggcggcgtcaccgagctcggccaagcatcagcgcgcaaagagagagcggtggcaacaatcccgtgtctgtatcagccttcttcccgacggcggggagcagctaaactatgggatggttgacgtcacgcccgcagcctttttccaccagacgcaccaccatcaccccaacctcaccggcaacggcaatgatgaactccctccaccattccccttccttccgccatcgccctccttcgcctctccccacctcgccggcgacgacgacaacagcaacgacacgagcgcaaggtatgtgagcacctccttcctctccgccccaagtattgccaccatcgccaccacagccgctggtagcagcctcagctcctcttcgccaatgtcgctgctgcctacatcctctgcgccggccagctcctctccgcggagagctccacccgccaccgtcaccgcggcgctcaagggcctccccgagcgtcgacttgtgcttccgccgctcggcggcatgctcctgcacctccttcccggtgtgcttcgctgctccttagccacccacaacttccatgaactctttcatgcgctgctcttgttcctcaaccttccttgtcagctccgccacggcctcgccatgcgccgcatcccgtgcccccactgcagcgaagacggcgtgcatatgttgtcgcacaccccttcctctcctgcagcgcgggctctatatgcggcgaccaccggcaccgccgcctcccgtcggtcagtctcgtgcactggaaagagatggtggaagagaaaggaaagaggaagaggagctgaggctgttgtcggtggctgtggtggagatggcgacggtgctcggggtggttgaaggcgttggcggagagggcgagaaagagcgtcgggcgtcgccgtctctgttgccttcgctgagcacccctcccccccgcctcgaaggtctcacacacggacagaaaggggaggaggagaaggaggaagtgcccaggtcgtggtcggtgacgccgccgccaccgcccgccacccatctttgccagcgagcgccgccgatggccgccacttgtctttgccagggagcgtcgccgtcgcgccgcgcccttgttgtcaatcgccaagaagaggactgcaggacggaggaagagaggtagagagagtagtgcaaatagtcgctgacaggtgggcccacatggggacgacgctaactcagatgccacgtcatctaaaaccggagacaataccgtcgaggaacctagtttgcagttttgcactgttttgtaagttggaggatgtatcatgtcgggttttgtggttcaagggtgattttgtaattcaatgacaagacgagggaccttcggtgtactcatccaaaagaagcccaaacctatccctcccaccatcttcctctccccactttttaaggcccattggcccaatagcaaaaaaaaatatggcccaaactctatcaaaccctatctcctcacctccttgttcccaatcccgccgcccggcgacgcccgtcgcccccgcgccatcgcgccgtggccgtcttgccgttgccccgccgctccagtcagcccctccacgcagtcatcacagtaagatatactgcatgcaaaagtgattcttttgggccgaagaagaaagcatgggaggcatgtggggcataatatatcgatcaaagagtgtcgtgataagagagtaagagataccataagaagtataacgtatattgaactatttgatgggacaatactcccttcgtcctattataagtacagccataaatttccgtgcccaacgtttgaccgtccgtcttatttgaaaaaattatgaaaaaattgtaaaagttaagtctcacataaattactattcatattttaccatctaataacaataaaaaaactaatcataaaaatatttcaaataagatagatggtgaaagttgggcactgaaacccacaactgcgcttattatgggacggagggagtatatcagaactctagtcaatctattatacccaaatgcggcctcccttgttcaaaagtttagttgattcaatccatgccattataaaaaaaaggaaaaagtacaaactctctggacaatcgtggctgaccgaattaccccactaagctcaaataccagatattttacacactccattattcatactgaacgaattatgccctaacactgttttgagttgttttgaccaggagtttgcacacatggcgtcaacgtgtcaatccattcagaaaaaataataataattcactctaacaacaaatttgtagggccttccagtcaaaagaaaaaaattgtagggcccacttgtcatatatttcttcttttcctcgatctctcctctcctcctcttttccacactcgtcaggtcgggatgggcggcgactagatggaggaagcgggagaggcagggctcgggacgatgatagcggccggtggcggaggcgggagaggcagtgctcaggataggggtagcagccagtgacaaaggcggctggaggcagggctcgggaagagagcaacagctagtggcggaggcgggactcgggatgggggcggcggccggtggaggaggctgctggaggcaggactaggccccttgtctttccctcttcccaagtagctgggaatgggacaacgaatggctggaagtggttgggctcgggatgagattggcagccgaaggcgaggctatgaaggggctagctcgtcggctaccggcggaggcatctggaggctcgggatgagagcggcggcgtcaagggtgaggctaggaacgggggtggcggccggtggaggacactagtacagatcctctcatctgtgacggcccatcacatgcctaggcaacgtgggccgtcagaacgaagtcatctcaatcgggcctaaatttttgccgttgtagatgtactcgtcagggtgcatattccaatagctcgttaccgatgacactcatctatgacaggctcgaagttaggcccgattgagatgacctccactatctcaatcgggcccaaatactaagcccgtcacagatgagtgtcattggtgacgggctccaaagaaggcccgattgagatggccttaatgcccgttaccgatgactcttatcggtgtcgggcttctatttgtgcccgttagagattagtgtgcagccgttagagatgacatttttttggcccgattgagatatactttgcacactatatatactccagcagtccattgattgtagttatcccactgttcactattttggtgggaggttggagggggcgaatttttgtaatttttttgcaaacaaaaacaggaaaatcataaaagtaagtaaaagggtactaatcatttcctattaatttagtagtacttatgttatgagatgttaactaatattttgttcattgttcagcgatggatcaaagttggatgtacacgactggcttgaggcgtcagtacaaggagtatagagatggcgtattaagttttatgaaagccgcagaggaggataggataagaagaaacgacaagtacatgtgttgtccatgtagcgattgcaggaatgagattttatgggaagatgaaaaggaagtacacactcacttgatacgccggggattcatggagagatacacatgttgggtgaagcatggagagtaagatccgggtactgatggtgcacctgcagacggaagtggtgcagacaatcatgaagaaggagatgaagaagagcatgacatgtttgtcccatctccattgggcggtgaaatggttgatgtggaccctgatctgctgcaagacatgttacgtgacgttgatgacccagctatgaacgagagagattccatgaagttcagtaggttggtcagtgactcggagactcctctatacgcaggatgcaagccaaagcacaccaaattgttagcaacattagacctaatgaagttgaaggctagtagtggatggttagacaagagttttacagaacttttgggaatactaaaggacatgcttcctcaggagaacacattgcccgagaccacatatgaagcaaaataggttctgtgtcccctggggctagaggtccggagaattcacgcatgtccaaacgattgcatattgtaccacaagcaatgcgcggacttagatacttgtcatgtctgcaaggcttctcgatacaagcgaaagaagagcgcgggggagggaaagaagtcaaagcggggtggtccggcgaaggttgtgtggtatctagcaatcattgatcgtttcaagagaatatttgccaaccccaatgaagcaaagttagtacattggcatgccacatagagaaggaatgatggtttgctaaggcaccctgcgaattcgattcaatggaggaatatcgatcaaaaacacaaagactttgctgctgaccccagaaacatgaggatatgtttgtgtactgatggcatgaatcctttcagagacatgagcagttctcacagcacttggccagttcttattgcgaactataacctcccgccatggttgtgcttcaaaaggaaatatattatgttgtgcttgttaatccaaggtccaagacaacccggaatgatatcgatgtgttcttggagcctgttatcgatgaccgtgagattctgtggaaagagggtgtggaaacttgggatgcatatggtcgggagaacttcacgctacgagttccattgttctgcaccattaatgattatcctgcgctgggtaatctttctggacaaactgtgaaaggaagaaggcatgctctgactgtatggaacatacacgcagtaggtggctgaagaaatcaagcaagttggtttacatgggtcataggagatggctccctcaatggtaagaaagaacttgggtctgcccctgcggatttgtccggagatcaggtagacaacatggtgaaggacattactaatgagtttgggaagaaaagaaaacgtaacaaggaggacaagaagaggatgtggaagaaaaaaatccatattttggcggctaccttactgggaagatcttgaggtccgtcattgcattgatctaatgcacgtagagaagaacgtgtgcgattgcttgctggggctattgctgaatatgcctggcaagacaaaggacgggttgaatgcgcgtcttgatctacaggagatgagcattcgcagtgaacttcaacctgttacggatgagaagacaggaagagtgtacctcccaccagcttgccacacattgtcgaatgatgagaagatcgcaatgctatcatgtctggcagatattaaagttccttcgggctattgcgcgagaataagtaagtacgttaaattggaggatctaaagctggttggaatgaagtctcacgattgccacgtgctaatcacacaaatcttgccagttgctatcagaggcattctaccaccacaagtccatcacacgatccaacggctttgtgccttcttcaatgcaatcggtcagaagattatagatctagaagacctagatgggttgtaggccgatattgtcagtaccctgtgtcacttggagatgtattttccactggctttctttgatatcatggttcatctcactattcacctagtgaagcaaacaaaaatatgtgggccagcttttatgagagaaatgtggctgttcaagaggtacatgggaattctgaagtcctacgtacggaacagagcaaaaccagaggggagcatcgttgaaggttacacgactgaggaagccattgagttctgtatcgattacatggccgatactaatcctatcggagttcctacgtctcgccacgaaggaaggttggcaggtgtcaacacaactggcagaaaaagaattattccctatcaagcttcctacgcgcaggctcatttcgcagtgctgcaacatatggctgaagtaaccccatattttgaggagcatttagcgaaggtccgacgggacaatattggtcgatcagatatttggatcaatagagaacatggtgctcgcttcaacgaatggctcaaggatcgtgtagcacggtcgaccgatggcccaagtgagatattacaaaggttggcaaggggtccatcttgggatgttgacacatagcaagggtacgatatcaatggatac

SEQ ID NO: 66309 - DNA, 629 bp, Oryza sativa
ggactcggagtcaggcagataatatatccacggacatttatagaaaaggttatattcaattctcccccgctttgctgggttcagcaaaattagaatctccaaattctacttgcaagattatgttttcgaggcgagaaacttttcggtagagctttggaaaattttataagtcacatatttcgtacatttgagtttattttttctatggttggttcttgtatgcttctaaacgtgaaagaaaaataaaaataatagttgcacatctctctctcctctacactatgcgggggacgccagccacattggcgcgctccccctgccacctcagcgccgacccaccacagtggcaggaggacggcgatagcgactttggggccccaaaatggaccattttttagataagtttttccaagtgtctatttacaaaataattttttcaaaaggactaaattgtaaaaaatccagctcactcgatagtttccgctggtggtggtgttgagcttttgatgacgctttctgattaacataccgattttaccgctggtggtggtgttgagcttttgatgacgctttctgattaacataccgattttacgtatgttttcattaacacgatttttaaattacta

SEQ ID NO: 66310 - DNA, 2848 bp, Oryza sativa
tcaagttagtacgtaagttaattttttaaagagatttcttatacgaccgttcatgtatttccaaaagtgaacgaacttaaaaaccgactcaaatacagatctgtatttctaaaaacaaacgaacttaaaaactgactcatacacggatgacgtacctaagtaccaacaaaaacatcttcaatctttataatagttttactgtgagaatttgcttggatatatatttttctagaaaatcatgagctgcaattagaaatccgatcatctcaagttagcatgcaagttttttttaaaaagatctcttatatgactcctcctgtatttccaaaagtgaacaaatttaaaacccgactcaaatacaaatatatatttccaaaagcgaacgaacttaaaaaccgactcatacatggatgacgtaccaaagtaccggcaaaaacatcttcaatttttataatagtagagatatagaaatatcaataaatatatgattttattgaaataatttttaagattatttatacataaggtcttcatgtttgtaacacaaatattttagaagttattcgttgttaagtttttaaagttcaacatcagttttatccgcaacaataattaattttaacctagagaaaatattattttttattatgtagctactaatactactagtaaaaatctgaattgtttaagaagctaaggaatttaagatgtagctagacttgtactctctccgtgtaataaaaaaatctaatccaaattggaatatggacatagagtttgaatcgattcaaatttggattgggttttatatgggaccgagtactccctccgtcccataatataagggattttgagtttttacttgcactgtttgaccactcgtcttattcaaaaaatttgtgtaaatataaaaaatgaaaagttatgcttaaaatacttttgataataaagcaagtcataaaaaaataataatttcaattttttttaataagacgagtgataaaaaagtgcaaataaaaactcaaaattatttatattatgggacggagggagtagctaacagaagcttcacacaaacatgacctataattctctccaagtttcacgcgaaaaagatgatcagcaacagctgggcaattatacacgcaagacaaatcgcttctgttcttccacctggggtgctgatccgctgctacagcgttgctactggcaatatggaagccgacggcgacacctcgtttttggccgcgctggacttgctggtacagctaatgatgctggcttttgacgggagggcgagacagcgccgagagagaggcagaagcagggataacaataagcaagatcttagcgccttccgtatcagaatcgctggaaatgactcctcgtcaagattggccatggaacgatgttacattaattgacagcaacattacagattcagagtatagtacccgctacaatcaatgcaatgaactggtaaaaaaagacagaaaaaaaaaaggtgacgaaccgaatggggcagcagcaccaactttagcggaagaagatttgggaggattttcatcgggtgaggatcgatcttttgacgatgatgatggcagtgactgattcctgatggtgaaaacgttgtccgtttaccattttgtggttatttgcgggtacggaacgaaatgcgggtacgtggaagagacggaattaatcatggaaatgatttcaccatgaaaatggcacaaggcagtgatcacatttgtgtcttatgcctgataacgaccggggcctcctttggatttggatgaacttctgtaaaaatcctgtaaaattcttataaaaatttggtgaatccgattagtaaaccgaggaaagaatgagactggtaaaaggaagagttgattggttctggagaaaaaggttcggtacgtatatactgttgactgttgagcaattactgaaagaaaaggaccaaatgaaaagtccctccttttacgttgaaaggctggccaggctaggtttgtagattcttgagcaccttccatgtccagaggagctttactggaattattctactgattgatactggatgaatgggaaatgtttaggccatgattcatcacaaattgctatgcttgctagaatctaaattgtgggccgtgggagtcatgataacaaacacaaggaaaaattaggcatatgattgtaaagctgccaatttgaagcagggaacttttttttttccttttgacgctaactatctcattttgtcatattcatctctcttttccattgggggtggtacaaatggcggacaaaagtgaaattattttaggcctactggcaaaacggagaatgatatcgctagtgacaaatcaaagttgtcccgttgaaatatgccaccgcataattccaggttaaaaaggcctccacattgctacgttgacatgacctataagatgtaactttggatattctattctaattaataccctcttccgtcacaaatatatggcaaattttattatatgacattgtgacttcctgatttcaactactggacacggtaaacggaattgctagattaccgttgacagttttgggggaaaaattttaatttttagaccattagatttgctttaagattcgtgctagaaagtatgagaaaaaataaataggcaagtaaactttcaatttttagatcattggatttgctctaagattcgtgctagcaagtacgagaaaaataaataaattggcaagtgcagctgctgtgatttaacctcacgcccttgagtttgttgaagatatatgctaccaccacgccaacaaaatttgtaatagttttattccagat

SEQ ID NO: 66311 - DNA, 2835 bp, Oryza sativa
tggagttgctcttaataaacatgtatgtacgtagaaatgtcgttgacattttgattagaaaattcaacgatcaaaaatgtgtattggatgttactgtactaaacaataattaaaaaaaacaatattgcgagtatctaaacactattgcgcccagcttttaaaagttggactagctaggtacatggacaccccacagtatcaacttcttttcggaaaaacggcaaagtactgcaataggcaaatcaatgctgtggcaaacaaacaatctagccttgcacgtacacggtaggtcactaatatatttgctgaagcagcagctagctatacgacgtcctttacctcctccaaagcacaggccatgttccctcccaagttcatactactactagtaccagtgtaccacaaatcacaccagaccaatagtatagggttacggttatatacttccttcgtcccaaaaaaaacgaatctagaactggatatgacatattctagtagaggtatgtctagattcgtaatactaggatgtgtcacatctagtactagtttggttttttagggatggagggagtacgtacgtagcgctccagattcgcctatcgagctccgtcctctgaaccatatctccatgactccatccacccatatgcatcgtggcgttgcgccaccgccccacctcgcacgtcgtcgcgtagctcgaatccactcaaaaacgctcgaaacatacgtacgtcggcctcttcccgtggccggtcgttgtacccatcgagagagaaaggaattagtactaatcaacaccgcacgccaccactgcgaaagatatgatgcggcggatcaggacggcttcggtcattgaacaatgagagctagagagtagagacccctagctatagtataggtagctaactattcttagtagcagctttgccacttttggaacctagggaaggaaaaaggggtcgccgtgacgatcttccctgggatatcgtgatcatagcggcatcatcatcgccgtgaaaacgaacgagctgttgacgacggcgtccccccgtctcacgtccttccttcccactcgatggcgctacggaaaagccccggttgtggtggggatccccacgcctcagcgtcatagggtctgtttgagcttgatagttgtagctttctcttaaaattttcagctgccataagctcttcaaataattcagatttttatttagattttaagaaattgtagttgtagatactagaaaatgaattagaaattaaaaactgagtttctcagtttctctatattctcaccagttaattttttatcggctgtttctcagaattttaagctatctaagtaggatcctaatatgtttagctcggctttcaatcgatcgggctatggctagaaacgggacgggatgggatcccctgatccgcgctgccagtctaaaggcgcactcatgtcgtccatcgttcccatcattgcgagctccggtgaaaaaaaatatattttgatctaggactagcagtacgtatgtactactctacgtaccacgatgacgcgacggggaacggagtggaccatgcatgaaaaaaatcgatttcgcgcgcggccatgtggtttactacatgtcatcatgttggatctggccctatatatatatatcttggtagttccatcgagcagttgcaatatatgatacaagttgcaagtccatacagtattcgggaaagatataatactggtatgccaggttattaatttaatccttggcaaatatacgaaccggggaaaagttctgttttagattatcacaagctaaaagctaagctatagattcaccggaacaccaccatggagggagggatactaattgcttctgtggaccagcatctaacaaatcatcatggagcagatcgggaggactacggagatattctctcgatcgttggcttagcacttagtagcagttccaaaagctcgatgatgacgatcgcaaagatatgcatgatagtataaatcaaactccccggagaggctctcatgtagtagcggctctgctgctttagagcaagtttaatatagtcaattattagcttcaagccttcaaataatttatagttaatttaatagtcaattcatataatagttacctataaatatatattacactattaatacataacccccaaatatcatacacacattatgtcttaaagtctatgctacagctcgctggctataaatctgcagctcgctgctcttctgtctcatttatcttctagatatgtgtttatagttgacttatagtctgttgttacacctgctcttagctaccagctttcgtctttcattatattttctctgtacgtacgtcttccaaacaacattgtctcgtctcttatctatcccagactgaccccaccggacgatgaaacagttggatcttgagtagcagcaatcaagtgatcacgtcaatctatcgagatcccacgcagtggctcataatctcacatggcggcctgcctcgcactttttccttatccatgctaagccccctgctcctcgcagaaaagccggcagcacggttgcttttgccctctttaaccatcacactcttcttccattcaccacctcggttgtttgtttggtcgcgtgcatgagacctggctcgcgaagcgtacgcaaccatatccaatccaacgagagactcgtcgccggccaacagccggcgtccatgcctccaccgtgcaaacgcataagttgcacagtgtttaaatacacaatttgtttgtggtatactcgtgcaattattgtaagtacgtgaccccgacgacgcaatc

SEQ ID NO: 66312 - DNA, 16396 bp, Oryza sativa
tgcagtggatgaattttgcatgatttttgggggaaatgccatgttgggatgcagtgggctgtgatggaattaatttgtgatttttgggggaaatgccatgttggcatgaagtgggctgtgatggaattaatttctgatttttggggaaaatgccatgttgggatgcagtgggctgtgatggaattaatttgtcatttttgggggaaaatgccatgttgggatgttgtgggctgtgatggatgtatttgtgatgaatgtccaatgatgattgctcataaatagaccctacacacttgtgatttttggggttttttcaataagaacagaccatctacacttgttcattttatttgggggagggggagtggcagtatgggatgttttgcaaaatggatgcatttttgggctggcctcactcttgggccagcctcactcttgttcttgtttaggtttaaatgtgggtttttaatgcataagaacataccctatacacttgtgatttttgggtattttcaataagaacagaccatctacgctggttcattttatttgggggtggagtggcagtatgggatgttttgcaaaatggatgcatttttgggccggcctcactcttgttcaacatgtggacagatcctctacacttgttcttatatggctgcttgcaatattcttgggattttttgggtccaatgggatggatgaattgatgtgagctatgacggttgaattattttgggggaaatgtgagttttggtatgtgacttgtgttttttatagctgtttctttttttgcataaggacagaccctctacacttgttcttaatttcttttgggggtgggggcagttgcaaatgatggtaattaatgcataatttctgagcaaaactgaggccaaacttattatatgtcaagacttgtgtttttttaggtacaaaaataatatatatgtgacttgtgtactatgggctattttgggtgattttgagggatatgggatggatatgcatagggctgttattaaatgaagttagtgcaattatggcatttaggagaatacgaagtgttccggttgccaaatctggtttggtcgggttacttcttgcacggtaccgaccaagacaaggaataaggtcatttctagattgttatcgttactaatttcctagattgctttctaggtcatttctttctgaaaccccgttcacataaattcagtatccaaagctggttgttgtatctatggaaataagagtttcagaatgaaatgatattggatgcaatctaggagtttgctgacgataacgttaggggtctagtgcaattgtatggtaacaaggataggaagggttttggttgcctgtgtgttcaatctgcgtccgcctcgtcagcagatatgtagcatccatgttccttaaggccggagtagacgggatctcgacatcgacatccatatcccactagaacttgcaaccgctgccactatcttatggtagtgacattgatagcaagttcgagtgggatactgatatcgaggtcgagttcccggctgctccggccttattgagcatggatgctatggttccgtcgacaaggagaacacaggtaggagatagaggtacatcaaccgtgacataggacatgtcgcagcaaggcgaaccaatgtcgacgacgactactgggactacttcgagccataatcctaggacccagaataagatttctaaggaagtctacaccataacagaggtggacgatgttggatatccgatggctccgacgaaagctgtcaaaaagttccctacattatgcggagtcctagggaggcggaacttcactattctgaaggaccacatcgatctggtccctcaagaagaaaaagaagaggcctggaggcagttcaaggaaagcttccaataccctacagaggccgaggcaggactcaagcagcaggctatccgcaagatggggaattgttggaaaaatttcaagacaacactggtcacggagtacgtcctcaaccccgcccagccagaaccatttgggaaatacccattcatcacccgaaccatgtgggatgagttccatgccgccaaatcaacgaaagagtctcgggcaaaaagccaggcctaccgtgatctgcaggcaaggaaccttcacccgcaccggcttggcaccggaggctacgcggggaaacaggcaaaatgggacaagaaggatgaagctgcagcagaatctaacaccccgctagtgcttgctgatatcccgttccagcgggcaaggaactgggcaagggtaagggggaagaagaatagtgacggaactctttcgttctcaaatcccgaagatcaagcggtgtaccagaaaatcgtaagttgaacacatagaataaggttcattatgttgtatcgtattcttcgtctaatgcgtcctaactatacccaggtcgaactgaatgctgagagacaggtctcccaagaggtctgctcacaaagacgcgaggatggcatcctcacgaaagcgttgggaaacgaagaacaccgtggacgaacaagtggcattggctccaatgttccatgaaagtttgggtttccccaatacgtgtggcagtacaagaaacacaagctttccaaggcgcagaaagctgcacgccttaaggcccaacttcgggtggagcttaaagaagagcttagagaagagctcactgccgagctgttaggtatggaggctcggatggaggtatgcatcagggataggtcgaccgatgccactcccggtcccatagtacaagtgagccccacgcagaggcatagcagctgcgcatcaactgaggctccagcagaacaacctgaaggcctcgccgcggtggaccacataatggtaaaaatcaacttaataacgcatatattgtattagcaccacaaatacattgcaacatatactaaggacactaatgaatctatcacaggaacccacatcgtgtaccctagtcgttagggtgacaccaggatttgcaattcctgccgcagagggtcaagcgttcaagcctaccccggagacccgagtgcatggggcgcagctactagccggcaatgccaaagttcaggtggacttagttaagcccgattgggttggctacactatcccacacccaccgaatgagaagattctgacccttggggctgcacgtgggacctttattcaatgacccaagcacagcattgagatcaatataactccaaggccagcgccaagttctcatccgtcgccgacgcgtccccatccaacttttatatctctccctcctgccgttgaacaaagagacgaagatctccaattacagtatgatacagattttggggacgacggtatggaggtcgacagcaggccgcacctccccccctcctgccaaaaggagcaagagggcgaaatcttctccacccaagcttgatacaagtagaaaagctgctagaacggggagaggaaaaataaaggtgccattagccccaaagaagcttgatcttggcaaggcgccaatagctcctccaaatcatccagccgaattcacattgggcatggcattggtcggagacgatgccttattcaagatgggccctgcatgcaatgagttgcacgggtactacatggagaagtccaacgcaaggaggaagaacagagagacctccatgttgggccagcacgatggtcagccgttcctcgggtctactgccttcatcaccatagacttcaaagatcaatgggacctctacagggtgcgagcgatcgacaccaacctccttaagtgctactccttataagtatttctgggtacgcgatatggtagtaactgtccataaattatgcttaccctgattcttgtcttgctcgtaggttaacctggaagcatgtccatcgtaaagcaccccatgttgccttactcgatccagctgtcgtcaacgagacaacactgaaaaatgatcgagcaaacatgatgggctatatcaaggactgcttatttgcccgtcaagacaaggacttcattatttgtgcctacaatcaacagtaagcgtgtaccgtacttatactcaaatactcgacgcgtacaactgtagtatgtaactggcaatttaataatttcgcaggcaacattggattcttctggtaataacgccgaactggagtttggtacactaccttaactccaatatcaagccagaaatatacgattggtcggccatcgaatatgccttgaacaaggcatgggaccaatatgtgacaagaggcgggaggcataaggatgggcatcccaaactcggtcacaagaaagacttcccaatacatcaacaagttggcgatcagtgcgggttccatgtgtaacaccccagataaccacgtacctagagtgccacaccaaaaacactcaaaaactactaactcccaaaattattagaaatttcggcagtctcccctgcatatacggacatccacgacaggcagttgtaagataactcaataacaaaataacccacacaatccaaaccatcctaactccataaattccaagtgaaaatatggaccagaactttaaatgacctttacaagttctatgcaaaacttatgcttagcaaaaacatagtctaaaactaaatttcaatagtgtgcaataataatgtgtagtccaagggtgctactcccgccccatgccgatcaatgtcattaggtacctaaaaaccaaattaaacacaagagtgagtaaagaatactcagcaagtacaatattgaactagtaaaacatacacaagatttatgcattaagaaaccaatatgaagggttgggtttactttatttaaacaacgaagtcagaatatagtagttccctcccgggcaggtatgaatatcctcttagcattaccggtaacccgagcaagcgtgatcagcgcttctcaaggatcatgaataaagacccaaattgcactcccatgactacgcatggttcttggataatgtaaacagaacatccggaataatgaaacatgaataacatcgtgaatttgaatatggattgaaacacgaataagtagcataacatcagagccatacgatcagtaatatcaagcaattgaataataattatgcaagtaaaaccaaacaaaacaactcagtttgtccatcacataagtccgtcttgtacttgtcttaactccttcgataatctgactcaactcctccaacgttagaaccctccacacttgtggagcaaaactatacataaaccactatactcaactaatgacagttacaagggatatttactaaaatcgataacctagaacatatagacttttttaccaatttgtattaaataacctatagcagttccctttctgttttatgcataacttgcaaaccgtctaatggaatctagcaaataatataactttggacatctcaacaaaattatctacaactttcatgttgagcacaaaatcagattatgcctctgaaaatcccagattaaagaaaacgaattgctatcctgatttctggacccggtcagcagtactgttttttttttgtttctcccaaaccgtttatcagaattgagtgaaaccagcggaaagatcgggccaaacaatagccttgagtgtctcgagtggtactcagggttcagcagttcgaatcttcctaggctctgtaggcgctatagtagccccgcctgcgaaaataacctcggtgaaaaaaaaaatcctgccccccctccccagggtttcaaatcactttcacaaatctcgtccaagaaacaaaatccaatcacagacattgtaaacttgcaacataaaagcactggattcaaatccatagcaagttaacatcaataaacatgtaaacttaagaaaaaacaacatcgtcatcgccagcgaactcctctgttgcatgcggtggccgccaccgcctccctccccgctccggcaggatctaggagggcagcgagccattgatgcggccggcgctagtcgtcgccgtcctgcagtagtcttcgttgtcgcggccgacgccctccgcccgtgctaccgccgacgcccctcctctccaccggatctaggaggggaggggttgaggagaggggcagcgatgcagctggtggtagtcgtcgtcgcgtgcagtagtcgtcgtcgtcgtcgctcggtaggcgccgtcgtcatcgcttgctgtaggcgtcgtcgtcgacgcgcggtaggcgccgtcccctccgcccgtgccgccacagacgccattcgcctccgctgccaccgaccccctatgcccgcgccgccgccgatgccccctccatcggaaggaaggaaggggaggggagggaaggaatgggggagccggagggaaacgagagagagagagaggagggaatgagtggtggggagaggataagatggtagaagagatgataagatagaacttagattttttttatgtagacatgatttttgcaggcagaccacgtaaggttttgcctctaaaaatcatattttttaaggcggacctcttaagtagtcagcctaaaaaaaattgattttcgcaggcggatgataaaaatcgaccttggattatatttttgtaggcggatatttggctccgagggtcatacccgtctggaaaaataaaaggccaacatcgccaaaaatcgtttttctagtagtgcctaaatcaccaaaatttggccgaaatagaaaatgcaaaccctgggtctgtcaacaaagacattaactggcaactccatgattaataacagcaactgcatatagtaggatcacatcgtcagatatacgtaccccgtgtcattgcgtacggaaatatgcattgtctaaacaaagatgatatactcattatcttttggcatgtctttcctcttccttattgatacccattggacaattgaattttatctttgctcactgttcacattgttgtttatttggaaacaaaccacaattttcattagttatttattcaacttaatttttctacgtcattctcatgcaataattagttcattgtttgtcatgaatggctatgttcagccagccaattaaatcaatattctttcaactaggaaggtagcccgcacacatgcgcgggcatcttgtttaatgtgtttgaaattttcttacaaatgtttttgtgtagttggttttttttattggaatatcttttatactctattcaaatttatttgggatttctatgaatgttggttatgattttcttctagtttcccttgcaacataaaaatttgttaactaacattgtgtgaaagcgtgcagttctgaatttataagaaaatattgtgtcatcaccatgaagttggtttctatgaaactatctatattttgtactgtgggtatttctatactttaagtaataattgcttttatactatctatgtctttgtggattttaggataaattaatttaagattttctattaaacatatagctaatagaactatgtcatataattaaagatagattatacttcgtcgcataaatccgagaaagttaaattttgtgtcaaaatataagggattttagagtagtactacttgtcatatccaaacaactattatttattgtttaccctatcttaccctaaccttcttcccactctctacgtttcttttaattaataaggggtaccatagttccttttttttcttccttgttagctattactgtaaatatgatacgatggttctttactacttgtgaaatataacttgatgtatttttccaatttgttaacacacttggattattgtttttaatctaaatgcttatttataatgtagaaataatccgatagctacgaataacatgaccacttgactaatgataaattacacgtagaatgttgtgtcttcataaggaaaattttcaagaatttcttttattgattatatgctttaggagaccaataaatatatagattatatgccacatagattagtcatttttttaattatatgtagggtgtatattattgatgtcttttaatttatgttttttcatattgcagtatacatatttttttatttacagaaaagtcatgaggatgtagtttttattttgttccatgagattatagacctaatttagttatttgtgtttatgaatgacttattatacagctaggaaagtctgtaggagtcccacgtgacagcttgagagcgtttttagtaagtttaatagacgtttagtatataataatagatagatagatttttaggatttgtctgatttttatagcgcctcacgtgatggtgtaggagtgttttacttctagtacataatataatagatatattataatcagctagttatctaatgtttgattttattttcgtatgaaattttgctaggtagaaaattaaaagatgaaaagagtgatataagatatgcaaatgtacgtacgtacattacgtatacgtacatgagggggagagatgcctgggaggtggtggggtatgggtgggatatttttagatctaacggtgaaaaataatgggtccaccttattaactgaaaatgaaggggtaggatgttttgctttttttctcagaatttctttgatttctctaatttattagagcgccaagtagaggcttaggagcgtttgtagaaagtttcacggagttttagtatataataactaggaagatagcccacgtattcgcgcgggcatgcgtaatagtttgttttgaaaatagttctaaaaaataaattgaaattaaagtaagatgttttctatttttaattgagtgttcattgtatctttcgtctgaagaaatatcgacaaactataattaatgtatttttcccaccctgacaaccctctctttaattgcttcatatatatgcaattcgttatgcatgtgaatcagcaaagatgtaaaagttctttaaaaaatatttcatgtatttcaaatttagtgattcagtctaattttgaatttgtattcaaatcaaattattgttttattctaaattttatttatagggatttttaattgtacttaatctcgtattgtgttctgtttggacttttcttttaatacttattttattattccaaattttagctattttctataactcatacttttatcttactcttgaaattttatattttacctggaatcaaactgtattttttatagttttaatattttcttattttttaatgtatattttaaacaaattgcttgttttattttttttatgaatttagttgcgaactccttgtagttgatccgcttgccaacatcggtctcgttgatcatctcgtcgacctgctcattagtgagtctctcatgatgcattgaacatgatgtggcggggcttggcgttagagatgaagccattttctactccttgacgaagacgcgaaacatcttcctctgcccctcctctcggtacttgtcctttagcatgccattaggcccgagaactcgtggaagttaatgctaccattgcgtgtccacctgactaataatgtcttgtagctccgctttcattgggttcagagtatgtatcatggttccaagctctttggttccaagctctttggtggttattgaacctatactttaaactcacatatttgaattcattcattgttttcaaagtgctattttgctcaaatatttgtagtcagaacaaccaaattatctaacttttatatagtaaatatgggcaatatggatcttggattttgtatttaattatcaataacacaagaaatcaaataaattgagaaaagtgcatgtagcttgagagtcatgatcatttagctattgttatcttttatatattttgtgttagctagaaaataagaaaggttagctagaaaataggagatgagagtgggaaccaagaggagagtaggacggtggaggagtacgtagaaaataggagatgagagtgggaaccaagaggagagtaggacggtggaggagtacgtacgtgcgtggccacatatggtgggggtggaggtgggggtaccggattttttttgatataatagttaaaattattgggttacctatttaaagaaaaatcaatgtttttagattatttttttctttttaattataatttgcatgatttatttttaaatttattagagccccacatgacatcttagaagcgtttgtaaaacgccacgtgacagtttaagaacgtttgtagggagtttaatatacttttagtatataatctaatataatgttcccgcaaaattatttttttatgatttaaaatatactcaaaactgagtttttaattgttgatttaattgtaaagaatatgatgtttcaaacggatcagaaatcaaatgtataacttaatacttagtataagcgtgtaaaagcagggaggcacatacgtagaattagaaagaggtagtgcacgcgcgcttaaaaaccacctgataacccaaatgcctaaaattaattaatttatattccaaaagctttgtgaaatttatatgaaatcaaagatagccttgctgcactactacgtggaatcaaagtgataagccagctgtaaggtgacagatcaaacaaagagatggaagttgcttgcattgcttatattgatacagcagtcggtagaactgctccatatatcgatgaaggattttctttatctgattgtttgcttacaaaatatattaaaaactatagtaattattttgaactcatcgaaccgttgatttcttgataaaaaaatgattgcttagaaataggaaagagaataggaggggaggggcagcaaaagagaggagaggaggtgtgcgtacggaaataggcgaggtgtacagatcaacctaatctaagtagatctaatctaagtatcttacgctggaaataggtggtttttgttgttttcttattgagataaatttaatggtgcaaaataatgggtccaccaatttaaataaaaattaacggtcggatgttttacttttttctagaatttctagtattttctctattttattagaatgccacgtggcggtatgagagcgtttgtagaaagtttcatgcacttttagtatataatagacagaagatagatagatatatgccctttatcgctgaaccagcatatatatatgcatcctttgtgaacctggtgaccagagctggccacaataaacgcacatcttcatcgttagctatttactgtatgtatctttccagttgctgcacgcaccaacactatatgaacaaaccaggactcttttctaaaaacaaaaaaaacattaagtcgagtagcaagctgtagaactaaaatatgggtgcagtatgctatctatataggtataaggggcatctggaaaataggtttggatttgagggatcagaaacgtggattgagaatgcgggcagccactggtgaagaaaccgtttgtagtcccggttcgtaactaaagatcgctatctttagtcccgggtgaaataacttggactaaagatcaatctttagtcccggttggtgttaccaaccgggactaaagatcgagctgatctttttttatttgcatggccctgttactgcatgggttatatatatatatatatatatatatatatatatatatatatatatatatatatatatataaaccatgcatatatatatatgtttcaatacatatatatttataatatatatatatatattatatttatatatgtttcaatacatatacatgcataatatatatgtatttatacatatatatatgcaaatgcatatgtatatatatattaaagcacttaacattttatgtgcatatatatgaccaaaatatatatttaccctaaagtaaatgtgtacatgcatatagaaaaatagacatgcattaattacaattcattatgatgtcctagctagctacgacttcgacgtagtagtagtcgttatctcagaagctaacgacctatgaattatatttccgtcgtagtagaattcaccctcgggatcaaggatttattcgttgatgaatcccataagttgttcttgaaccgccgcgataaattccttatgtgtgagcttatccctcatgtgaataacctatgaatgtatgaaattaattagtaaacaacaaatcgatacgtacgcaatgaaattttcaatttatttgtatgtacatcgagctctcttgtgttgatgatttggtctgcaaggcagtggcaatactcgcacacgtagtaaccgcacaagttaattccctgatcttactttgcgcactatatatacatgacaaacggtgagagatctaattaatatacacttgtatttgaattggagattcaatataaatgtagagcatgtgtactcacatgaaagttaaacttccgcctaagtctttctctccatttgcagcggaccaaatgtcggaaccgataccaagccctacatggagtttaaagctatggttcgtagtagcaattaattataacaagactcataattaacattggaacatatgacagtacctgctataagtttcaaaaatctagtcaaacgtagacttctttttatctattgagtcatatacattgactacgcaggcctccaagtcgaagagtaaacggacccagtggaatctgcaatgtgcgtcggatgtattacatatgaaacacttagcatgttcgtacgggaatgaaatttggtaagaagacagtaaaaactaactctgtgttgtacggcaatagtataaacgtcttgtaatgctgcgctttaaggagatggacgagattgtcctctgtggcttgcggatactggtcgagcattgcgacgtttactttccgagggtcgacgaatccagtatcaaaaacccccccgctgtcgggcccgttgaatctccattctacaacgataaaaggaagtatatattatatatggtgtacttatatacaaggacctaattaattaaaggaggcgtaataagaaatctaactgaatgatacttacaaagtccaacaactcataatagagacgtcgagagcgtctagctggtatagttcgtagatacccttaaaattgatccagagaatatcttccccttgcatgaagtctgtgtccctgatcctcactccgatcatctctctactagtggcgctcatctccatgtacagttgatggaattggtacatttgtgttggtagggactgcagctgctcaggcttgacaagcggtttaccaagttcgtacatgtatttcacttccgccttttcgattggtgcgcctcgtagcaattgatccgtagttagcccgatgtcattaataaaatcttgtatcccaaattcttcatcggtcaccaacggctcgatctcctggtttggttgctctccaagctaagggactggtttggactttccagaagttgctttcttaagtgttcgctcatagtctgatagctttatggcctccttggcaggtgcagacatacccctgaagaagttcttgacactcgggtctataggaatcttattttctggacttcgaggcttcaattgtctcctgacttctgatgccacataagcgtcaagcttctcttgcgtgcaatcgtaccccgggtccttgtttttggcggcgtcaactttcgccttcttcattgcctttgtgggggcaggcggtggagcttggggggcccttgacttggaaggtgccggacgaggagcttgcggaggagttggtgtaggagcctgaggaggagtcggtgcaggagcctgaggaggagacggtgcaggtacctgaggaggagatggcggagccagaggagatggtgcacgagacgccgcttgtcgcccagggaggatgatgtaccgcttgcaccatagtataatggcgtggcttgtgtcttgtagatgcgtctcaccgtctcctccagggtagtccaactcaaggtcctagtacgcggctttcaccaactcaactttcaccttggagtatcctactggaatcggcctgcagtggtaagtctttgaagggtccgttaggatggccatgcccgacgccaccttcacgtggtgagaggttatttattagtaatcaacatatataagcagcaacttgcggaatggacaagtctaaaatctataaactacgagcttacctttattgataagttcttgaagggaatatgcacctcacatggtgtccgctgagtgatgtcatcaatgaggcaggtggtttcgtcctgggtttggatggcgtccatgctctgtgatcctacctgccccgttgaggcgcagctgctacgattgcctgaagggctcatcattgcaggaggaatggtcggctggggatcatgggaccgatgtgcggccatgcgttcatccaccttccttaccacctcctcttgcatgctgagctcgtagctcgataccctgtactcaagatcttcaatcttcgcctcggtatctctcttgctcctcatccgactcctgtacgtgtggatgtcctccttgaatccaatcttccaaggaatcacccctttccctcgtgttcgtcttggatgctccggagtctgtagggcgagtgacagctcgtccttctctctgtcgggtcagaacgtgccctgagaagaggcttccactgcgtccgttagtcgactcgcagcctcgcgtatctgatcgctgaagaccaaggagccatcaactgggttgagcgttccaccgtgagcatagtaccagaactttgatcgatccggccatttagcggtgaccggttcgatacctctctcaagcaagcttgcctccatctcctcgcacttcggcatcgcgacgctatagccgcctgaccccaagtggtgatggtacttcttcttggcggcattttctttgtttgtttccatcatagcctgcccttgttgacctatcttgtaagcaacgaactcgtcccagtgatcccttagcttcaggaatgtgttgaagttcggtgtctgccccttcaggatgtatgtgtggaacagatctcccttgaagctctacaactgttgtgccatttagttaagagtccaccttttccctatgttctctgtacccgcgggaagggtgaatgtctcgagcattgtggtccacaacatctctttctccgaatctaggacaaagccctcatgatctccgcgtgcctttgttctgcgaatacactgtactgacaggcacgttatcccgcacaacccaaccgttgtgtctacgtagttcttggctgcttctgccggggcactaggtcggccgttgtcacgcccagaaactcacgaatcagaatttctaagctgaatgtgtattaaacccctgtccaggaccagccagggtacacaaatgacaattgttgacatacagatccacgtcttacaaaaatataaaagattataaatgcagcggaaaaagataaaagcgagctgagcctgaagacttgactcctgcagcggacgactccattccacaggcatccttaacggcagcgacgaaaccaacctcttcgagacatcttcaactgagaaggacttcaactctggtgtgggggaaaagagagcaagactgagtactacccactgtactcagcaagtcataccggaagaggaggtatgatgcagggtatatccaagggaggctaaggttcttttgcataaagctagaatttaaaagcagttgttgaaagcagtaaaacaattgcagtaattaatcaatattaaccactcactgtccaacgctacaccacgttgcaacaggcccaaccaaccacctgaactacgccagttcattagctaactaggggtgagactaatcacggtgaatctggtcgaccgcccataaccgcgggcacggctattcgaatagttttactctgatcagaggtgtacaactgtacccacaagacacagccccacgacacattcccgtgcgccgacatgctaccacgacataccggaaagaggccgtgacaggacccttcgcataaccccctctaaccgatcgcaccacaccttagggttcgccccgtccccagcaggcaacgggcagcccccctttcatgccgcagtgaatccggaagccgatcaactggacaccccggtcgacccaactccatcacgcccaccctcgcctgggtacgtcggctagagaaaagctacactacaagcccagccgttgcccacgatggcttgtggtaagtacgataagttcttccagggcatcccgcgaaccggtccttaatcgccatgggcacaactagcaaaaccatgcacccacagcccaccatgtagtgtattttaataagccaacaccattacggtggcactaatccaaagctattgccaaagatca

SEQ ID NO: 66313 - DNA, 2049 bp, Oryza sativa
tcatctcctgtttgccgctgcacagcatgatttggatgtgtatgtggttacacgtttggccggataagcccatatgcatgcagatgcatacatgatttcctaaccacgcgcgataggaaatattccacctggtttaccacgattcctcattcaatcctccgagcgaagtcacaataagcaatgtcacgcgtttcacttgttacaccaggatttctgaggagattcaccaaggatgttgacacttgaaacaacacgatcgatagtttcttacccccccccccttcattcacaaatatttcataaggtcatttgatgttttagaataaggttcggtcagactcttgagaagttgaacgtataatttctcaaaagcttatttttaaaattatatggtgcatatgagttatgatagtacttaaaaaacacatccacaagtgtgttaagcaatatatactatcttcattttttaatatatgatgtcgatgacttttaggcatgtgtttaatcatttgacttattcaaaatttctgtatagatttaaaaaatataagtcatgcttaaataacttttaatgataaagcaagtcacaataaaataaatgataattacattttttttaaaaaataagaggaatgatcaaacatatctttaaaaagtcaatggcaaaattattgctagatttctaatcaccttcagcctagcaccttggaattacagagggatgatgtgcgacggcgatttctagcagtggcggcatcatcaacaggctcatcttctctgacgatgttgaagtcctcttcttctttgacagtgtagtgcgtggcaacgaagttaaaatttagggtttcggaataaatgttgaagtgggatggcttacccggggagggggaagaaaagggttttcccgggcctagagagatgaccatgagcgacggcggtatgcaatggtgtagtcggggtgccaccagagctgcaaggatgaaggttggtggttggcggggatgtgagctagggaaaggggaggtgcaagggaagctataggttaggagacggtggtggcagtggtgtttctgtggtgcgagtcaccggagttagaagatgacacgacaaggaaatggcgtcaccgcttggcttggggaggaggagatggggagggagagaaggacagtcaaccaaatgaggctcaccgcacaaaggtggggaggagagcaatatcgcagatctcaatctgtctaacttactctcagggagaaggataacatgataagtaaggaagatactactgtccacgtacaaaagtcgatagaaccataactgtccaaaaaattgattgaaatctagggtattttcaggtgaccaaaatttacaagtcctatatctcaaatgcttgttttgaagttatacggtactcggtgcttatgatactacttccatttcaagttataagacgttttgactttggtcaaagtcaagctgcttcaagtttgtagaaaaaataacaatattttcagcccaagataaatttattatgaaaatatattcaagtattgatttaatgaaactaatttgatattataaatattactatatttatctataaacttagttaaacttgaattagtttgactttaaccaaagtcaaaacgttttataacctgaaacggagggagtagtacttataagaaaaaaatgcgtatgcgttgagaatgcacattcaatttagtactccctccgtcccacaatataagggattttcagtttttgcttgcaacgcttgaccactcgtcttattcaattttttttgcaaatataaaaaatgaaaagttgtgcttaaagtactatagataataaagtaagtcacaaataaaataaataataatttcaaaaaaatttgaataaaacgagtggtcaaacgttgcaagaaaaactcaaaatcccttatattaatggacggaggaagtacgttgtatgcgtgtggtgtaccgtgtattgcgcgcgcatgcctgccttatttgctgaatgatggagtatttaaagcatgcatacgcc

SEQ ID NO: 66314 - DNA, 45004 bp, Oryza sativa
  unsure (1)..(45004): unsure at all n locations
cccccccccccccccgagttagaatgaaaaggaccagctcatgcaaaagaaagaagaaatgcttgcaaagccagaatcagtggacgctgttcaacaatccattaccacttacaaggccaaaattgaggacctggaacatgaaatccagaaacttatggctgaaaagaatgatcttgagatcaaggctgaggaagccttgcaagattcaggtagagtggacctgatcacatttatagcttgctagctggggatggctcatctcttcgtgaagagcgtaacataagtttttcttaattccactgtatagggaaaaaagacttcaaggacgagattcatgttatggctgcatcactctccaaagagatggaattgttggacaatcaaatgaatagatccaaggatgcggcttctgaagcacttgcactacgtgaggaagctgactatttaagaactttgctagctaagaaggtatttctttgatttgggtaaccatatctttctgttttctgtgatggtctccaatctgcatctattacggtggtttggaattttcttaggcttctgtaaattttgttctaccttctaaaaacatcatttatatctcttccttgcaatttcatgcacttgttcagttgccatcgattcattatgttgcattcccccgtttcagctcatgggacatttttccataaattcaccatttaaattcaaggaacaagtgcatttatattcactctgatggtctccacagaactgtccatggctatattcaaaacagtatttttcacactaaaactggcatacatacttgttccatttttctcttcaaggttgatgatcattttacacaatcagaatgaacttaatgctccagggtaccttcttgtcaccaggtgctagcatggtcatgcataaatgattttaggtccctttgaattcatttacttcatgatattgattctgtaaatattcatggcaaaactttgttttttgttttgtttttttttttttggggggggggggggggtatgtgtgtgtgtggatgctcttatgcatagttgtggacttggtgtttaatgttcaaatacattgttttttcagtagtctttacctgattaggcctccatgtgttgcgttcttcttgtgataatagctatctgaacctctaatacaattaaaacatctgattgaagtgtctggagttttcagattgatgaacaaaaggagatatctgatagatacaacacacaagtcaccgagatcaaatccctcaaagcattggtaaagtatcctgatcttcaccttttcttctagggcactgatttgcaacaatcgaatggtcagccaacatataatgatatttaggtttcatcattcagaaatgaaggcagacctctctattaactggtggatagcctgatacatgagagcttataattcttggaattgggtatcctaggtcctaaaactattgttcaaattttagcctaaaattagattagccactttattttagcctacaaactccatattctgcagaaatccatgagttcgagcattcccaaacaggcccttaactgctattactgttaaataattgaaaatttaattgtcattcacagtgtgcataaatctgagcatcatttgtgggtaaaagatgttttggaacaaaaatgcaattaacagggcttctagttctgtcattcatttttctccatataatttcaacagattgagacactggaccaggaaaagcaggagttacaatttatagtggatatgctcggtaaagaatgttctgagtcgaggtataatttgtttgctagtaccttttctgctgatttatgattgttatgggttgtattgttctcaaaagtggtgaaccctcatcatctattcttaaaaattctttatcagtaatacacaaaagactcgtgtataattgcattaagattgggaaacgaaatttcagtacacttggtctagatgcacaaccacatcagacccaaaaagaatacgaaaagaaaaggataaacagacactcacgcaactgaatcatgcgacctattcatttaatatttaagcatgttcaaaaaaacagatatggttctaagatagtataggtaaaaacatatcttgttaggaaattttcagctttcatctatttgacatgcatattacatatggtagatccttccagtttgtttcttaccatactctgttgtgcactagggcaatttcagagattgaagaatcagaaaaccgagctcgcaagcaagctgaatatttgagaaaatgtttagaagagcataatcttgaacttcgagtaaaagcagcaaatgaagcggaaactgcatgccaacaaaggctttcaattgctgaagcagaactggaagacttaagggccaaagtggatgcatcggaaaggttagtattggtgaaaattttgttttctcaacccctccgtgcaaaattgttctccagtttattgggacttgccttttcaaaataattctccattgagggaatttatagtgtagttgtattctctaaccctgctatccataccaagtaccctatttaacaaggggttaatcagactctagaaaccgggggaacttctatacacgaatctggacatagcctctgtccagattatgaacgttgctttttttctgggatgaagggagtaaaaaataatatgtgctggcttgggggctctaaactgtcctggatgaaaattgtagttgaccagctctcaattctagcccccattttccccaccacacaagcgcacaccaactcccaaaacaaaaaagatccctaaacattactttgatcttttgtctcccttgttctgtgagcatagactatgtggacaactatattgaaatgagtagttataatttgatatagctcaacaatcttcaattagtttcctgcattgaatccttttcatcacacgcattctgttttgccagagatgttatgaaactcaaggagtcaataagaattaaagaagctgaagtagatggccatatttctgaaattgaggtaggcgcggttttctcttcttatcagcagtcctttttgtgtgtgaaataaaagcatatgatattgtcattgcagacaattggtcaagcatatgaagacatgcaaacccaaaatcagcaccttcttcaacaggttgctgatagagatgattttaacataaaggtatttagatatccatcaatcttgttgcttgcctttgtagagttcctggtagtctgtagcaccttacacggctagtaggtgcagggatttatagactgttctagattctagaaccaaagctaatctgctcttttttccccaatcacaagttggttcctgtcctaacatggttctcatctaacagctagtatcagatagtgtaaagatgaagcaagcctatggttcccttcttgctgaaaagaatatgctacagaagcaacttcagcatgtcaacagttcactggagtcatctaaactaaaaatcaccagtggtgaagagcaggtagccttttatttatgcctaaagtcgttctttctgcgtaaggcccttggagatattgttaaaacaagtgttgatttacaagaaataaattgaagatgtatcggattacttgcatcttatactattaactgttacagatgaagacctatgtagcacaagctatgaaatcttcttcagagaataggcatcttgcaattagccttgaaaggactatgctggaggtatcagatgcagagaaggagctcaagtggcttcggtccgctactggatctgctgagaaagaatatgagataaatcagaaaaaaatagctgagctaaaaatggagctagagcgtgagaggttaggctgctctgaactccaggattggtcatgctatgctgccatcaccatcatgtgttcattacattttttttggttaattcagaaatgagaggataaagcttgaggaagaatacgaagaggtgaaaaacgaagtcagtgagctaacctcagaaactgaagagactactatacagaagctccaagatgaaataaaagaatgcaaggctattctcaagtgtggggtgtgcttcgaccggccgaaagaggtgatgggccattgggccactgaatcaacttattctggattatgtcgatttgtctctgaacctagatgtagatatctgggatttaattattatttacacccatcacaaattcacgtttctttgttatactcttacatgcgacagccaattctgttaccgccgctgatggcatttctgttcctttctctcttttttcttcttcttcttcttcttcttttttttttggcaggtcgtgatcaccaaatgcttccacttattctgctcgccatgtatccagaggaaccttgagatccgccaccgcaaatgcccaggttgtggcaccccctttggacagagtgacgttcgggaggtgaagatctgaagcgtcagcaaaacagcttgaatgactgacttggtagcgagcatgtaaatatatagtagtagtgctagtttctgttttcttggaggacagatattagatcgaattgtcttggtgtgcctctgccaagactgccatgtagaaactattattattatcacctaaaaatagtgcaattgcggggatctgatactgactgtgtctgttttgcgtgttgtatcattaatttatctgttaattgaggtaccggctaaagttgttttacaatttacccgggaaataatgcattttgagtttatttattgatccatcccaagatatgaaaaaaaacacaaatattagggaaggaactaatatcaaataattagaatgggtgaggttttaaatccaggtcatctagcccaccaccttgtggaagacctctaggtgtttttcatcccaaggtatgaaagaagcgtgtcaaaatgaatctgttcgatagttttggatgggctactgctattgcctgtgtaatttctccttggaggtttgggagagctgtagaagtgggcgcccttggcagcccatccaattcctaacagtgatcaccaaatgtatcctgaaatttctccctgatctgcctctgccaatatactgaagtacaactcagtgcctgcagccagtgctgctgatatttttcccggatcgatcgtcgatcgatcaatcaatacttctaatgctggcggttctgccagctgctgattggtccagatggcacaatcatcctctgatgcgtgttatgcgaagatgaaacttcaagctagcgctgagcatgcttcatgcgtacatgcggctggttgtctgcctccctgctgtcgtgcggcatcatgggccagcgacatgcatgctccatcactgagatcaaatccctcacggcctgttcggttggagggagtttttaagagggattggaagtttagagggatgaggttattaattgttttgtttggttgggagacatgtgaattttggtgggattttttagataatggaatgaaacaattttggtggaattttggtgagatggggatggggaattgaggaaggaactccctccttttcaatacttgggtagaggcaggtaattgggagggaattcatcctttactttgtctaagcaaatctcagccatccgtttttattaatgacctaatctccaactaaactccctatcaatttccatcacctctaccaaacaagatattgggattaaaaatcaaattctcatcttaatctcatcattaattttctcgtgtaaactaccaatccccttccctcgagttaccaaacaagccaagcgattggtaaagtatcctgaccttttccttttcttctaaggtgctgatttgcaacaatcacatggacaaccaacatggaaaacggaaaataggaggtgggagggagcgcatgcgctggaaacagcgagtaattttgctactcttcacgggatgcggaggtgggaacggagggaggctttgaaaaagggaaaaatgggagagggtctcgccgtctcggttgcgcactgtcaaataaattacgatgagaaagccacaaaatttagcttataaacatatataggcatgagcgaaacaatagggctccaggtctcgtagaaggcgagacctatgtgcaaatgggccaaggacagctacgcaaatatatagaccactttctggaaaagaacaattacacaactaatgactatgcaatacatctaactgatctgaacaaactgtaaaagactttgttaagagaaaccctaaacttatgggggtggctactgcgcgcatacgcgccaactaaattgctggcgcgcacgtcagctgccccaccccaggcctcccttatctttttttttctttttgcactttttttttcgattttggtgcctccgggcgtgtttttctttttctttttcgccgtttctttttcgatcttttttcaatctttcgcacacctctttacaaatatataactgaaagtttttaatttttatttgtaagttttcaaatttgagttgaaagtttttaaattttaagttgaaagttttataatttgacttgaaagttttcaaatctgagttgaaagttttaaatttgagttgaaagttttcaaatctgagttgaaagttttaaattcgagttgaaagttttcaaatctaagttaaaaattttaaattcgagttgaaagtttttgaaattccggtcaaaagatttgaatattcgagttaaaagtttttaaaatttaggtcgaaagttttcaaattcaggttgaatttttttaaatttgagatgaaagtttttgaaagtgcatctaggcccctaatgattttggtgattaattacaagcgattagagaggactaacatttttatttaaacaaatgtgaaggttgttatgtcctcaatgagttagcgtaatgcatatcccgccgaatatgttgatgtgatgtgatgtggcaaatgagcaaatggtattttgtacgttttcgtttccttgagttaataggaaagccgcactattaagagggatgatgcattgacatacgaggagtgatcaaagtgctcaaaatctatttttaaaaagtgtttctcctcagtttggtatgttctggattttttcggagttttccgaaactcattttcggactttccgaaaacacacagaaccagattttcgcttctggaaattttcggatatgtccgaaagtgattttcggacttttcgaaaaagactgcgaaggcaaaagtggttctgtatattttcggacttgtccgaaacttttttccgaaaatcatcagtagagtcaatttcgcttctgtatattttcggacttgtccgaaagttattttcggactttttcgagaacatccagaacgatgttgttggtactggaaattttcggacttgtctgaaaagttttcggaatgtccgaaaaatccttcgttgactttgctgttggtgctgagctggaattttcggacatgtccgaaaatctttcggaatatccgaaaatctcaattattgtgcataacgggcagaatatggactgtggctataaatagcccactcccatcacttgtgagggctgctggttccattccaatcatttgtgcccttggcttgctctctctctagcacttttgagccttgttttcttgtttcccctctcacctgtgttcgatttggatttggatttggtgtgtgtgtgagagttgtggattcgagtttgtgggagtgcttgttgttgatttcgtgaagatttgtgagcactttcatcatctccgggagttctttgcttcatttgttactcttggaggttgaggactcctaggcggttaggtgtcgctcccgagccaccgatctacttgtggttggccgggagaagtttgtgaaggtcggatctcacctccgaaagggaagagatacccttagtggaaggaggagtgcttagtgcaacttcttgaggaaagggttagctaagacccggctcttagtgagctcctcaacggagagtatatccctcaaggattcgaacttcgggaacaacctcgtgagcttcatctttggtgactttacttcctccctcttcactagctttgcttgtttgagccgctacaggtctagttactgtttgtgctagcatattcttgttgtaggcaactagatctaggatttactttgctgtttgtgctgacttcgaaaattttcggatatatccgaaaatttcggaaatatccgaaaattactgcttccgcttttaattgaatttttgaattagcctattcaccccccctctaggcctaattgacactttcagttttcaaaatttacaatgaaagttgtagattttcaattcttttgtgctgagaaaaaaagaaatattagcttaatataccataattatcgataactaattacgtataggattttttcttcaagtactgcgcaggaaaaaaaatccgagtcctgcgcacttcgttgcggaaaaaaagaaaaaggaggttgtagctagtgggccgcgcgcgagtatatgggccgaaaacgctcgcgacttagctagccggcgcgtctgcgcgcgataggaatctcgcaaaccttactgtcttcctggtggtgctgaatgttacgctgtttattactccctcaaaccatgaggtagcccggttcctatttacgatgtttattacttcattcatttcaaataataaggcctatatttatattttcatcattaatttatttcatgctatgttcccgacaaatataaaactaacatcacatgaaagtactttaaaacataaatctagcgatataacatgcataatgcatagatatgattatagtatgattattagtcaaaattttaccaaatttgaatttcattaaaaagagggcaccctataatttgaaacggagggagtataaaagtatgtcaagaaaaaaatcgtatagaaaaaatttacacgaaacacgtcattttaaaacttgggaagcgtgcacaatcagaaatgaacgtgcctaaatctccagttcaggcagcagcccaacacataatcggtccagcccagcccaacggacgagcaaagagcaaatctaaattgcctcctccaaccgacttcgaagtccgaacggcagaaaccccaacccgaacccgaaccccctccccatttgcgaaggcgggagcagaggagagagagagagagagagagagagagagagagaagagagagagagagagagagggagagggcagtgcgccgcggaagagacagctggaacccgatcacgcgcgcctacccgtccgtagaatcggcggcggcggcggcgtccgcgctcgtctccggcgccgacgagctcctcgaccacggagaacgcgcggaccgcggccatgtcgaagaagaaggcgcccacgtccatcccgtgcgagctccccctcgccttagaccctagcgtgtaagttgccccaaaccctaacccctatcgcgattctttggtggtgtgcccgtgtgcgattctttggtcccgtggtggcgatgttgtgtaggtcctgagcattctcgttcttgcagctccgcgcgcccatcggatcgtcctgtggcctcccagtcttccgcacgtcccccttttccggcagcctccgccgctgccgctgcgcctgcggctgcgcccgcggttcgttcgctcgtcgccaactcttctggcatggacacccgattcgacgaggacgaacggacaaccgccgccacgcggcgccgccagtcgccctctccttcttttgcaccatcgacgtcgaaggcgacggcggtgggactcactagatacggtgctgtcaagtcctgggggccgaggagggagctggaaactggggagaccagtaggtgcatggaggtgctactgctagagaacccaatcgatgctacaaaaccatctcctctccatgttgatgaagacaagcaggttatatattatttttgctccgatcccatctgtacgtgttgatccaactctaaatggaattatcacgttttccatctatattagctagctactgtagtggacttaatcggatgtttgcaaaagtttctaacagagatcttcatgcaagtgaaataacactattaaggtgctcctaatttgcttcatttgatatgtaatatgtatgaaatgccatggtgaacctttcatattttttccccttttttgaaaactatttgttcttttctctttctggataactgttccatagttggttccaatggttgctaatgctgtgcagggtgaggttattggtggtacccaacagaatgctccagagagctgtgtaacggagcgagcacgactgaatctgaaatctcgctccagtgcagtgggacaatctgctggcagtcctctcaaggaaaggtaggtggtcttgtagcccttttttgtatttcccttttcttttctataagttcatggattttctagttttatcatctgagtcttgctgttagctaccttatatatatattgaccgctatatgtgcagtacacttagcctgtccaagcacattcattaaatgccattaatgtttcattaaattttgaagtttcaagtatccgtcctgtttattgatatatgattgatgtcaaataggtgtatttagaagggaaaatttatctctgatgtttctgttcagtatgtacattcccaaaatgcatgcacatcctgtgcaattaagaatgactcttcattttgtttgactttaccttgttggaagactaaagctactcgcgatattgtcgattcaaggatcatcttttttctttgttgtaatacatgtttacacttcctacctatcagggtcagtttatattgatagccaatgctgatccctttaggttgtattgagtatttatttgtgggaaaccacttccctctggttccactgcacattatatgtgtgatgtgatttgtttattgacatttagatgcaccattagaaataaattgtgcttcttagtggctgcacgaacaatggataaattcatatgtgtaatgagtggctgaaaatgtataagggcatctggatattactatctttaatttggctccataatccccattccttgttttttttaatctttggaagcttggaattttttttgaggatttatactgatgttgaatttgcccgcaaattaatatgctattacatcttatgccttaaagctagaccttatctaactttggttttatctttctacattccacatggtagaattctggctccatcaacagcaatgaaaagagcaacggagaacaaatatttggcgaacttgaagacagatattgttgagaaggcgttgaaatatgatagaaaagagaaaatgaaggaggttatgaggctgatgatattccagaggagggttttgtattagagcctacaggtcacggaaatgggaagcaatttcgtcttccgcactctttgtatgatgtcctccacacttatcagaaagaaggtatcaagtggctatggacattgcatctcaagaaattaggaggtgcactatgtgatgaaatgggcatgggaaagacccggcaggtaaattacatgcaatggtttgttctttaggtgttagaatttcaatggttactctcattgagaagaggatggcactcgagatggggcaattttctggttttcttcattcactaaatacaaaagccatacctacccgagggaggttggatacatatatatagccatagctggctgctagcctattgctgcaccctcctagtctaaaattcgaaatttgaatgggatgctgtcctagagggcatccaaactgaataaagcataaaggaggcataaaggagatgctaactgctgcagtcctactaaccgcagctgtcctagcaactgaaaaatatgctaaagggtagatgctgtcctgaaaaaggtgaaactacccaaaagcaaaaagaagaatcacgaccaaggaccacaaagacttatccaacattctccccctaagtcttgtgcgtcgtcttgtggggaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttagtgaaaaacggggttctttgccagggccagagcggacttgctatccaccctgagctccaccgttctagtgtctctgccgaggagatcactaagcagtcgagcaagccagagcgcctgggtcgaagcggcggaggccgccatgtactcggcctcgcagctggacagggccaccacctgctgcttgaccgactgccagctaacgaggcacttgccgaggaagaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtaacggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccaaatcactcatctagaaagtggccttcatctcctccttgaacgccgcgacctccgcatccttggtgccggtgatcaccaagtcgtcgacgtagacacccactagcaaggcatttcctccattgccccgccggtagatggccgcctcgtgcgggctttgctcgaagcccatccccttgagcgtggaatccaacttggcattccacgccctcggtgcctgccgcaagccgtaaagggccttgtgcaggcgtagcaccttggcctccttgccggggatcacaaatcccggcggctggtgcacgtagacctcctccttcaagtcgcagtttaaaaacgccgacttgacgtccatgtgatggacgccccagccttcccgagcagccagcgcaaggagtcgcacagactccatccgtgccacgggagcgaaggcatcgtcgtagtcgatcccctcctgctgcacgaaaccgcgtgccaccaagcgagccttgtgcttgatgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctacaaaagaccgaggctcaccgtcgtcgcacgcaaggtgcaactgcgcctctaggtcgcgaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgcttggaggagtggctgttggtgctggagcatgtggagtcactggctggggttgtgtcgacgaagagctcgtcgtagtcgaagtcgtggcccgagggtgtgttggtgtcggagtcggtggagattcgggggctggggtagacacgctaggtgaagaagagctgcctactcccccagctccctcgaagtggacgtactcgacggtgaagtcgtcgtacgtcggagtcgaaccatcgtccaccgccttgtcccatacccaccctcgcccttcgtcgaacacaacgtcgcgcgcagtgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctgcccccagaagatggccggcatccccctctgcttgaggagggcccgagccatccccacaaccgtcgggttgcgccgctcgacgacgccgttctgctgcgggctgtacggcgtggtgtagtggcgctgaatgccctcatcagcgcagtacgacgcgaattcagccgctgtgaattcgccgccgttgtcagtgcgcagcacgcgcagcttgcggccgcactccgcctttgcagcagcctgcgcatgcctgatggcgtccgcagcctctcccttgctgccgaggaccatcacccacatgtagcgggagaggtcgtcgacgagcagcaggaagtaacgtcgtcctcctggtgtggctggtgtcactgggccacacaagtccccgtgcacgagctcgagccgctccttggctcggaagctcgtctgctggggaaaggggagccgccgctgcttcgtcaccacgcagacgtcgcagagctgctccacgtggtcaagacacggcatgcctcgcaccatctccttggcactgagctgcttcagggcctcgaagtggaggtgcccgaagcgctcgtgccactgccacgcctcgtcgtcccgatgagcggcgaggcaaactggttgtgcgacctgcacgttgaggatgtcgagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcagggatgtagtagactccggtgagcagcctgtgctcaccggacttggcggtgaaggtgacggagccaacacccttgatctccacgccggaggcgtccccgaacttgacggagcctcggacgctggagtcgaactcggtgaagaactcccgtcggccggtcatgtgatgggtggcgccggtgtcgaggtaccacccatcagccttgtcgttgctggagccgttgcagagggagacgagtaccttcggctcatcaaggtggaggaaagccgctgcggccggtgccgctggaggtagctcgatgcttgcgtgagccaggagcagagccggctcttcctccacccgtgcgacgtgggcctggccacgtcgtggctgtcgacagtctttggcccaatggccaagcttgccacagttgcggcaggcgtcgtctcgtgccggcttgtggttgccggtggcaacgccctgggcgcctctgcgggcgccaccctcggcacgtcttcgcgcccaccgtagctggacacctccccgcgccttgcgcggcttacggccggctgtcggggaagatgactcccccttcctcccgtcaccctgagaggcctcccactgctcccgagtgagatggagcttcccgccgatggtgatgggccccgagagaggctgtggctcatcaccatcgacgaccttgaggcgacctaacgcctcctcgatcgacatcgtggagaggtccagcagagattcaatcgagcgagcgatctacctgtacttctcagggacgcagcggaagagcttctcgacagctctctcctcatcgtaggtgtcgtcaccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttttgggaaagcgagaactgcatctcgggcgggactgcagcgatgagggcatctagtgcccgccgatcctcgtcgtagtcgacgtcaccgtaccggactgcttcccacatgtgccgcacctggagcctcaccctcatcatcgcggcccactcgatgtagttggttttggtgagggtaggccaccgacgggaccaaagtctctgaccaccgtctggacgccgtggtgaccatggcgccggtcaggggagagagagccgtgctgcctgcaagggccgcgtgcgggctccgggctgccgccggcacgcctgcgcccgtctgggttcccgtcggcgggcgcgcggtcccttgggccgccgccgccgccgtggacgtgggctgctgctcaccgctctgctcgctcccgtgcccttcctcttgccagctcctcaagctccctgtcggcggtgatgtcgccggcgatggagccgttgatgttgctgcgcaaggtctcaacctctacctccgccgcacgtgccgcatcttccgccgcctccgcctccgcctccgccctggctgctgccaactccgctgccgccagtctggctgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgcgtggagagggggaagggaaaggggaaggaggagcaaccggtgctgttgctgctgctggctaagagctcaaccgagcttgggagggggtggaacaagagatgtttagtctacaggaaagtatggctctgataccagatgttagaatttcaatggttactctcattgagaagaggatggcactcgagatggggcaattttctggttttcttcattcactaaacacaaaagccatacctacccgagggaggttggatacatatatatagccatagctggctgctagcctattgctgcaccctcctagtctaaaattcgaaatttgaatgggatgctgtcctagagggcatccaaactgaataaagcataaaggaggcataaaggagatgctaactgctgctgtcctactaaccgcagctgtcctagcaactgaaaaatatgctaaagggtagatgctgtcctgaaaaaggtgaaactatccaaaagcaaaaagaagaatcacgaccaaggaccacaaagacttatccaacattaggcaccacacgccccaaaattagctatataaatgcattttattttgtttatgttccaggtagctgcttttcttcgtggtttgctccaggcagatgtcatacacaacgcaatgatcatttgcccagtcacggtgatagaaacctggcgcaaagaacttaatattgttggtgtgctggttatcaaagtgtaagtttacatgatataactatttatctagttgtttcagtaatgatatctagttattttgtcagttttaatggatttgttttctcttgcaggttccgttatgatagaagaaccgactgcattgcactaaaaagcatagctactgttagcctgcactctactttaatgtttttgcattattctttttatccattaaacttgcttgttattttttcttttgattggattgaattcaatctgtcatgttaccacttatgccatttatttgatggacaatgtttatctattgaatttaatttattgaaaacaatcacattaaaactgtgattatagtcgatatctgtcagagttaccgattctattttttggtaggttgccttccattaatttttactgtcatcccatacagcctttgcttaactactttctatgagttagaagaaatgctacagctgataatataaaatgagatagatgcaacaccaaagtttccttacttgagattcaagacttgaccacactatcttaccttttgtgtttgtgtttgtggttttgggaatggggtgggggtggggtctggaatggttaaacctcactattgctcaactcataagcccgtgattatttttagaagaccagtacccattttattaatgcatcataaaagatggaatactgcttctaccctcgcttttatgcaagtagtcttgaaagatccctaacacagagaatcacattacttgctgatttgctatcctgaatcttggtatggtggttgctataggtattcagatgaaatattttgactcaatatccatctcctgtgcaggatggaggtgtccttataacaacatttgaagcagtccgggaccatattcaccgcattctggagacggggcacggcttgggattatattgttatcgatgaagcgcacaggatgaagaacgacaggacaaagctctttgattctttatgtagaattgattgtacacacagaattttgatgactgggacgctcatccaaaacaacttgacggtacaccctctccaaccacaatagtcataaagaaatttggttgtttatttttgtttacttatttgtaacggaacctacctgcaggaattttatgcgctgatgaacttctgttgtcctaatctacttggagagtccggacaatttcatgaaaacttcagcatgccaattgaaagggctagatatagaggcgcatctgcgcaattgataaaagagtcaatagaagcatctgaggtaaataccttctgttctacatacaggcaaaataatttctatttttctggttggtacaaatatcctgaacaagcttgatttgtattctgcagaggctgaagaaacttgttagcccttttgtattgagaaggacgaaagagatgttaaagaatagcgcctctaaacttggtactaaacatgaattgactgtgtggttgaagatctctgctgctcaagtaaacttactaaagcttatcaatatgttatcaaaatttattcgtcatctttaacttctttttttttcttactctccacaggaatatctttacaccaatcttatcatgagcaatgttttgggagatgagcctggcacacctttggcagcttctcaagtaatctcccctacaatctgaagtctattttttgtcaactctaccttttgatgtacggatctttcacctttgtttttgtctaatcacaggttgcgaggagtatctgcaatcacccagtaatggtgattggttctgactttgaacagaggggtgaatcagaagagaagaaggatgctttaactgacattatccgaaaaggtttattggcggtcagtaacatcgaggatattgaagtcgacgactacagtttgtccagcaaagtagcttttactttatatttggtggataggctcatcaaggaagatataagatcttgttattttctcaatctccacgaacattgacgatgatagaggtagtttctaacaatagttgcataactctctttttgccgggtcagccaaaggttggccaaccaatttcttaagattggggagaaaaacaaaggaatgttacagcgacattacaatgtcgcgctagtccgggagagatcccagacacagcgtgaacaagcgaaagagaaatagacaatacaacaacgattactcgccgaattgggagaagatcccagctaccctccataccgtgatttcttcttttatattctcggctacttgctccgtggtcatcgacacatgctgaaaaattctagcatttcgttccttccaaataagccagcaaattaacatgaaggcactgtcgaagtccactttgtagctcgtccgaaaacggcgtcgcgttgcaagccaccagtcagcaagtctgctgtcaccgtctgcctggattgcaaagtttgcatcgcaccatcttctgatctttcgccatacctccgccgtaaaaggacaggttacaaacaagtggtggcaatcctcgtcttctctctcacacagtgagcagagggggtcgtgcggccaatttcgcttcgcaagattgtcggcggtgagacatcgatccttcaacgcaagccacatgaagaaacgcacacgcgagggggccctggatcgccacagtagctcgccataggagcagtcctcagcagctatgaagaaaacatcataagccgacgccgccgagaatttcccgtcgcccgtcagcttccatctgatctcgtcaggcgatgggagcagggagaaatcgtggacctcatcccataactgaaaaaattcgcccattgcttcattggacagtgcaccctgcagaccacggacccatctgttgttgcacaaggctttagcaactgaaagtctagcacgccccacataagaaaatagcgttggccatcgccaagcaaagcagccgtgcccagtccagtttgctgtccaaaaatcagtgttttcgccatttccgacaatgtacttcaccactgatctgaacatgagattcacatcgttccctagcttaaaggcagccaaggtccagggcctctccctctgctccagcgacctcgcaggccattgcaaccggagagcctgaccaaagaaattcagatccttcacacctaggccgcctttttcaaccggggagcacacctttcgccacgagaccagacaatgtcctccacttacctcctcctgacccttccaaaggaagccccgacattttctttcaatatccttgattgcccactttggcaattgtaaaaccgacaagtagtgaaccgggagggccatgagcaccgacttgatcaagcaaagtctgccatcaatggataacatctttggtttccatcctgctacaatagttgcataactctcatttgtccatgtctctattatgttcttttatttatcatacttaatcatttttaattgtgaaaattgtagagagcattgtccaccatagtagatccaagcaaaatgattcgcatggatgggaaaacacctcagaaacagcgaccaatgttaatccaggtttttattgtcttctgtattacccattctgtttactccatctcttatttattgtagggagtatgtgttcttccttctttatctcagttataatttttgtatacaggagtttcaacaaactaacagatggtcactttttctgatcacaacaaatgttggaggtgtcggaattactttaactaaagcaactcgggtcattgtttttgatccagccaagaatccaaggttttttttactctttgtctctttggtaaaattgtttctacttatatgtaaagttggatcattttatttcagcaatgacactcaagtgttgatcgagcccatcgccttgggcaagataaagatgtcattgtgtatagattagtcacatgtggaacgattgaagaacacacctaccgacaacaggtattaattgcttcctgcaggcagcaataattacaggtattgcatttttaatcgatcaaatttgccatctgcaggtgattaaaggtgagaaggcaacagctgtaacgaaggaaaatcagagcaggcgggaaataacaaagccggtatgcatagacttagttcttattgctgctgtagttatctgcaggactttattgatgccagttttttcttactaacagacaaggagggtcctgagtatgcctcctgaaggttttggagtctccaaaactttgattgagcttctagctatacatggaggtgcttttgatccgtaaggattcttcttttacaaactcattactagttttaagataagataaatcatctactttttctgggtatattagtgagcttgtattccttccttttgttcattgtgtaggtcacttgatgaatctgaaatcaggcaagtcagaggacatgaatctgttgttggtgtatcaaaccatttgcatctgttttcccagagggaatctgaccctgtcacaaatgaaaaacacaagttagtttttctatttgttaatttgcatgaatttttcctgtgcattggttccctaggttattatggttcctctagttatctgcagtctgctgattgatgtttttgcaactctcaatagtcttttcctttttttttggcagatatacagctggcccaagtcgcaagcgcagcgaactatctatggttgttttttgaactatattatgcagatactttactgtttctctctacctgatcttaatattaactatataatatttcagccagtagatgcagaaattctgaagtcaataaggagcacatttatcgaaattcctatacaacaggtatattcatatatcgtaatttttcttgtaatgcctaaaatccaaactatttctgattaccctctaaaaaagtaggttggttgtttcgttggtgaaaaaggaggaaacattatgaaactagaaaatatttccggtgcaaagatacaccgccttggtgtagattcttatacacacatgcagctttataagatatctggcaccccgcatcaaataagcaaggcggaaaatcttgtaaaggaattcctacaagaggttaattaatttgcttcttttttttctgtattcttagtgtttgttaatatgcatggtgtactaataaaaacaaaatctttttagatggattctatggttgaggaggagatctccgttcctatggagaaggtggggctgctgaaaaatactaagtccaaaactaaattagtttctaatgtaaaatcttgtaggttggtttggtcatcgggagtggtggtgcaactattaaaaaatacaaagtatatctggagcatctgttaaggtggttttaaatgaataaatacccttttcatctgtctatttaataattagattggtaacttgtttcttttttaatcttggtagaatttacatccaaggagtgagtcaggcactacaggaaggtttgttatccggggttctcaaaaccaggtagaccaagcaagatcaatgataaaagatgttgcatctaaaggtttgttgataccgatacaagtagttaatttattgatttaacatgctcctatcatcttgtgtctcccccctaacttgtgtgtggataatgtgtctcagagaacctcgggccaaaaacaaggttccgatgatgattctttccccaccaaagatggatgcactaaaagtagatccacaagaatgatggcattgagagatccggggttactttggtgaatgtcatagcaaagcatttcggttgaggaagtcggccacatttgtgctgtataatataggttcaccaattttaacagtgaaaacctttgtcctattgctacgactgacatggaaatttcttagtattgtgaaacagtggaagtcgcttatttcctaataagccaaaacggcttattaggaaataaaaatgaatttgtgggtaaaacttttataaatgtattctttgtgacctaaaagccaatgttgaaaaagaaactatattgaaaatatgtcaaaatcaatcttaaaattaagcttgaaaatttaaaatctggctttttctttgacttattaggccatccgatggggctggaaggccttttactctgatttacatgtttgccttggtgatgtggccttttactctagatactgcaggaatgttcttaggcagatactgcggtaatgttcttgtaaagcagctgttttgaagcacttgatagaccatttctgacataaattttgaagagttcagactcaagagtactcgggggtatgaagaagattcttttgttgtagatggaaccagcgggagccgggaggtacagtagcgcagcacaaatttccagtttgctctgtgatggtttattaccaaaagatagtgaaattccccttgctctcttttatcttagtattgtgatggctatagatttaagggttcaggcaaatttccggctagcgtgaggaggaggcgatgagacgcggtcgtatcggcctcgtcaaatggcagtgtactagttgatttcaagggtacataggtaatttcacatgctggaacagatcttggctccgtgggctaggccacgcccactgtgggctgagtagccccatgtgtgtcttcaaacagaaatggacccgattttaggccacatggcattgtgtagcttatggtttttgaagttttttagtctatttggcaccccaaactgaacggattgagtgatacattgctcttgctcttactcccctctccgaatgtgggtttagattgtcagtccgcctaagcgcttgtgctgagcaggcgattgtagaagagccagcttctttctctcacatccgatttttccttccacgtcagatccagatgacatgtaccggctaatcaccgacttattagcgctgctctaagagcaagattaatagagagagcttatcatcggatccaaagcaatccagctcagccttacccttagagcaaatttatattgtttaatagtatagagtctaataatatagctgggtcattagctccaaaatatcaaaatattctatgtcagctgtagatgaacatggtgttagctacataacacaatcctctattttttttaatctaactggttataaatatgttgttgtggaatctgtggattaggcagcacaggcatacatgcatagcccacggtaatcggctcaagcccagcgcaagtttatctgtttcctcagcaacattgttgtcccgtgcataaagtaacaagctcttcattgcaatgcgatggcttggtcatctagctggattctggatggttcagctcacggagaggcacgggagtggaagcctggaacttcgctggtaagtagagccgcacaaagcaggcggaagattgcagggccctgcacctttttttttaacgactaagttcagcgggaaaaaattacaagattacaaccctgtagggtcgtaaccagaaaaaaggaaaagaaaaataccatcacccacacatcgacatcgtcaacacaagcccaggagaagactaacaccggaccggccgccgctaaacgtgaccgaccgccactagatcaacaaagggacacagacgagatcgccccctagaggatacaaaaacgacgtcttgaaaaagagaagcgacagaaaaaccgccgccaccgtccgtcgggactcaatggagccaagactaggctttcgcccggcaatcacccttgaggggtgagacaacacgacaacgccctcaggagggggaatgaaccatcgttgtcggtccggccaaggccggactgggttttcacccgccgctcaccacctgcaaatccatggctgaagcactgatgctccaccaccatacaagctctgccgacatgtgagacccctgcaccgacgtcctccgccggccagccttcatgtgccgaaaaccgcgccacactcaccggcagctcctccccacacctaggtcgccttctccaccgccggccgcgcctctcgcgccaagtcggcctcctccaccggacgagcctctcgcgccaatccggcctccctccatcgggcgcgcctctcgcgccaagctggtctccatctccgccgcccgcgcctctcgcgccgagccggcctcccctgccatcggctacgcctctctgcgccaagctggtctccgacccctctaccaaacgatgccacgctggccagatgcagccatctcccacgccctcggctagccatccgaagccgccatgcctctggtgaccgcagacacggtcaccaccaccgcagccgctgctgctgaacgcccagccacctcacctcgcacccgactccttccccgccaccgacgtcgccaccggcttcacacgcgccctcggccgacgccatccccgccgccttcaaccaccaccgcccggcacagcgcaccgcgacggccgccacctcagccacagccaccgccagccgcctcagacgccgccgtcctcgccacataggagccaacctccccgtttcctccacgcagccgcaccccgccgcctcaccaccgctgcaaaaagtgctgctgtgtgctgagtctgggcagggaaggtgggtctggccatctcgccccccaaacccctgcgccaccgtcaccgatcgcctccgcctctgccggctgaggttgccggcagcaagccatcgcctccttcggcccgtcgagccgccaccgcgcccgagggcaaccgaaccgtcgccgagctgccgccgatgctcccagccgcctcatgccgccatcgcgcccggggtgctcccaccgctgcgcgcaggctgccgcaccatcgctgagccgccgccgtggtgtccgggctgttccgctacctctgcaccgccgccgaagctcccagccagctgctccggccgaatctaggcatgggagggccaaatccggcctcagaggagccagatccgccgcctccccaagccgccacgccgtctcctcccctggctgcgacggagtacttcgtcggcttcccccgtcctcgtcgcaccgaggtggagaccgtcgagttgttgggtcttggcgagctccagcggcgacgagatggagaaggtggagtggcggtgcgggcggctaggattttcgcctcccgagccgcccgcgcgagagctacgcgggagttgcaattgattttcgcacagggccctgcacctgggacaattaatgctagctatgatgggagtttatcatttcggttcacgtcctttatcataacaaaactatgattatactattatagacactaatatagtaatatcttctataccaacgattataatggtaatagcagagtatcctcaccttttgtcattatgatcctggatgagttggaggctcgcgcccatcaggtaccagaacaatctggcagggacaaaatcaaggttagcccttgtagaatctagtaaagcaaattctacagacagggaactggattgatgtaacccaataccagctgaagctctagtttacatatgctaccgtgtcgttgattgttgtcctaggaatttaaataatggcatgagtgctaatatatctactcctagcaaacgtaatatagttgggaggtttgtgaggtcgtctagtgtttaagtggcaaaagaatatgatccattgggtcaattagctctctagcaaatcaacacatgatgccttcttaccgctgtattacaattaatggagaattcttcgatgcagctaaagatttggtagtatcagttcctaaaatgaagagcaggcccctaattttgagataacagtacaatcctacttttctttttgtgctatagaaatctctcacaaaaaataagatccttattactacatagtagaactaagcatcagaaattcactacgtcaagaccacattcttcccaatctctataagtgaatggtggattttgaaatgtcacctaattgatccgcgtaagctaaaaaagttggaccatcggataaaggaagccattggattgtatcagtgaaaaagggtaaaactgatcttctggagctttccagctcctccggtcctccccacacaagtgggagagagtgcaaagaaaataaaaaaaaattgcaaagggaacacaggaataaaattatcttttgaagcaaacccacatcgctcttgacactggcagtcatggtgttcaaaacaaattgcagaaaggcttgagggataaaattgtaatcatcctacttttgctataatatgaaaaaagaaatagtaaaattgatgagggatgttaggcctcgatcttccaataggtattgataaacaatcgatttgggcggagtcgcgacacaactcaatccggcttctgaacgaacacgctactgagccccgcaatcgcaacaccacgtctcctctggttatcaatcgtgccgaaacctggttgacctcgccgagaaggctaatacctgcatgcgtatcgaagaacacaagcaagaacaagatagattgcaaccaaattgcatatgaatgattaagcactcgaatttggggttctacaaaccgatctagcggcgaaactgttcttgacagactaatctaagcaaaacccgactctaaatgatgacggctactgattaagtatgattagggacgtcctagggttgccctagggcgcacatccccttgggctaagcccacgacacaattataaggcccaaaacataaatcagatttggactggataaggtacgtgttttgttttgtagattcccggcagctcggtaggaattttgacatggaaccaaaaccatatgaaagtagactccataagctttccaacaactactcatgggcttcgaaattccttctagatcagcagctaggtccatttgaaattgatgctgtcaggagatctgaatccaatatgtgtggaactttatctcttgtcttctatggaccaaaagtgacatggtgaggtagaagtagacttggagaaggtcttggtttggtccccaatcaatttctttaatcatccatgcatttattacgctcggtctcttttctttcgcttctttcgcccaagcaagtacctttacaaacgaaaacgcacgaaacttattatgtagcaacggttgttcaaatatataacaagtaaatcttatatagaacatatacgcctttagttgattaatacataaggtagtcatatttatatccgagctagtcgtgtcctcataaaaatggtattccgttgtactttttattcattccctacgattaaattaacaataggtaataacacttactaaaaatatgcatggcaaaatatgtcaattttagaacgatttcataattatacgtagagctattgacttaatttaaaaattaaaaatttataagcatattatttcaaagcaggtgcaccaatgaaaagtaaggacaagataaggggatcatacaacaatggagacggtgaaaagcaaggactcatacaccatagaagatggcgttaataataatactaaaatcatgtaaatttagtttaacatctgaatgtaaagtttgcaataaatgtttattgcacataaaaataaatctatacttattttaactagactcctggatattttttttgtctaaaacattaaaataaatctaagacaaataatataaactagctggtggcccgcgcaattgcgtggctagcacccatataaaattatatatttttccatatggttttacttaaaatttattaaatagttatattgatgtcttaagattttgaaagaccaaaccttatcatcccatgtttctaattttatacttttcaaaagtcacaccagttgctacccctacttctgacatattattctttattagcttgtttgatctactactgtttctaatcattctccttggaacctttaaaaattggatctttttagagtttatcgtcctgttaatcttcttttttataatttttagaagtcccatcaaacgtttccattatactcctctacaaccgtccactgcataccttatcatcctcgtgtttctaattttatagtttttaaaagtcacaccggttgctaccccttgcttctgttatattattctttattagcttgctcgatctaccactgtttctattcattctccttggaacgtttcaaaattggatctaaaaacttatagtttttagagtttattgtcaagttaggcttcttttttataactctagaagtcccatcaaacgctaccattatactcctctagaaccgtccactgcatcttctctttattgttattgctatttgaaaaatcgaacataattatcgtttaggtttatttttttactttcttgaagttccgccaaaacgtcagagactttgtcactgtactcctctacagctcgcccgctgccgcccttctttattgtcattgagattttaaaatcaaacatgattatcattgaggtttatttttttttactttttagaagcccgaacctttaaaaattgaatcttatagttttagagtttattgtctcgttgggtttctttttttatataatttttagaaatcccgtcaaacgctaccactatactcctctacgacccgtccgccacatactctttattatcactgggattataaaaatctaacataactaccgttggaattcatttttactttctagaagacccaccaaccatcggcggctctgccattgtattcctatacgaccttcccgctgcctctcttttttattgtaattgagattttaaaaatcaaatatgattatcattggggtttatttttttacttcctaaaagtctcgccaatcgccttgaccgatttgctacacgacctgccccgtcgtcattccttttaatcgtcattaggattgtatttggtgttttattaatactttttagatgtctcatcaaccgccaccactttgctcctctataggcctgttacttaaataatctcgtcatgtgttttagatggtcttttctttcagtagtcttattttttttatcaccaattgtagttatttataaattgtattcctagttgaaatcttatttttctctttctaatttcagaattaattttatttttcttattgtgttcttttgatatttgtattttttttgttttcaatttcagttgtttcaaaattgtattcctactctaactctcttttcaatttgtctaatttctgattttattttattttatttttttattccgcattttaattaatctactattgggttcttatatgtactcttatttaaatattgcttatatttaatttcaaatttaagttaattttaaattgtattcctacctgaactcttcttttcttttcttttttctaattttgattttttattctgaattttaattaatcttgtattggattcttttatggactattctttcaatattccttatttttaattccgaatttcagttatttttaagtgtattcatactcgaactcttccttttccttttcctattttcaaaatttattttatttttattctgaaatttaattaatcatgtattgggttcctatatggactcgtctttcaatattgcatatttttaattccgaatttcagctatttttagattgtatttctacttgtactcttttttttctttttctccgattaatgtgggaatttctagcctccacaacgaacatggtgcatccttttaaggctgttttaataatataatagatagatatagagggggttaccatgacttaataactaaggttatgtgtcacgtgtcaaaatttctatatttttttaacttgaatcataataggtggggttttatgaaattatgtttgaaaaaatgatgtatgccaaatataattcatatattttgatatacatagcaaatagtaggatggttagagtcgtacaaatgcgcgactatatacactagttctaaaccgaaatgaaacaacatcttgctcaagtggaacggcaacaccatgatttactcatcaatctcttccaaattcaccaatttctcattcgtactcccttcgtttcatataataaattgttttgacttttttttccttgtcaaaactttttaactttgatcaagtttatagatagcaataattttagcacaaaacaaacatactatgaaatatatttaatgttatatttaattaaactaatttggttttatagatgttgctaaattttctataaacttataatatgaaaagagtcaaaacgacttataatataaaaatgagtacataacaactaacgccaaaacgatcaagtcaaagtgtttgtggctgctcaacccaaaaaattctacaccctccatcctaaaataagtttatttgtagggttatgtgtctagtgtttgaccgtccatcttacttaaaaaattattatgattaatattttattattattagatgataaaacatgaataatattttatgtgagacttattttttttatcttttcataaatttttcaaacgtcggatacaaataaagttattttgggacaaagggtgtacctagaagtgtcatggattaatttacagcgaagacgagttgtaccaactacactccctaagagcatctccaacagcctctctaattgactctccaagttaaattttagcaattatatccaaaaaaaacatgctccaacagcctctccaactcactgctatttggctggccaaaccatcctcctcactggctacatttggccattctacttggctggtcaatggtgggccccacacatcccatctcctccaccccctcccccctctctctctctctcgcagtctcgcatccgtctttttcccacccaatctcgacggcgagctcgagcacggcgcgaggaggcacgggaaggagcactgctacgatgcggtgacgacagtgccagccgcgacaatggcgcccgtagccccaggcgatggtggacaacggcgacgacaacgaagagaccgccatccgtgcgcgcatcctctcccatgcgagcggcggcggtgccgcagccgccggcctacgcctgccgcttccgctcgccgcttcccggctcagctcgcctcagcccgcggcctcaactcgccacagtccccgcctccgcttgccgcagtcgtcggtctccgcttgcctcaacccgtgacccgcctccgcctcagcccgccgcctccgctcgccaccacctgtcgcctccgctcagcccgccagctctgcgtcgcctccgcttgctgcagtccgccgcctcgccgccaccgctatctgcagctcgttgcttcgcacgctcgtggcccgccgtccgccgtcgccgcatcggaggagaggttgtgggaagaaggctgtagactgtagtccaggaggaggaagggagatgtgagtgggaaaatggggtggaagaggaagaagaagggtagcagagactaacatgtgggtcctatttgtaatagactagtaatagactagtaatggagagggtagacagagaggctcttggagcgagtaacgactttgacttgctaaatcaaatggatagctggctatatagatgtttggagagtctattttagagagactgttggagatgctctaacaacccaaagatgaggtcccgcatcttgtggatgagccacgctgagcgcttcttcatgtggctcggcggcttctgttgctctgagctcctcaaggtttgacacgagtgatcacccacccaattcagtaacaagcaaagaatctgaagctaccattgactgctattgttgaatgatgatgatgatgttgtttgtgcaggtacttgagagccatcttgagccgctgacgaatcagcagttgatgggcatctgcaacctgcagcagtcgtcgcagcaggccgaggacgcgctgtcacaggggatggaggctctgcagcagacgctaggagacacactggcatcggcggccgccaccgtggtcgtcggcggtgtaggcgccgacaacgtcaccaactacatgggacagatggccatcgccatggccatgctcaccacgctggagaacttcctcaagcttcggtcaaacatcaatggcgaactaaattgcttattaccatggcgtgatgcgatgatatttttgtgtaggctgatctgctgaggcagcagatgcatcggatcctaaccacgaggcaggcggcgcgggcgctgctcgtcatcaacgactacttctcgtggctccgagcgctaagctcgctgtggctggcgcggccgagggacgcgcgtcacggcatggcagagcgcgcatcgcaccgaccgcgcccccggcggcacggccaggtacgcgccgcagccactgcatcccgctgtcggcgaccacctccccacccaccggccggcctgcccaagaggagaaaagtgagagagagagagaaagagagagaggaggaagggagaggaggggaaagagatagggtgatgacgtggaatcctggcatgtggggcccacatgggttccacgctgattcagccgtcacgtcagacaaaaccgcggtcaaaaccaccgagggacctaaagtgaacggttttgtaagttgagagatatcatatatctggttttgcggttgtgggacgattttgtaactcgatgacaagttgagggaccttgggtgtactttttcctttgaaagttgggacaaattgagggacctatagtgaacttaaccccccccccctaccttttcttttcatgtgcttgacgggccgcgaatgtcgcgtttgacatgtgggcctgtgggggcaaaccttagggtgtgtttggataatggaaaatgtggagtggaattgggattgagaaatgaatgaagggttagaattaaatggaaaagggagaatgaatgattaagatttaaagatgtcttttagtggatgggaaatgatttcccattagccaaacaggaccaaaataaataaaaatcacccccgtggcatgtgcccccgcaacacagaattccccaattccccttctcccatcccaggaggagccgccggaaccctcaccgtccccccaagatccaaccaatctaccggtagacccggtgttgtgccgtgatggatccattaggcggtcgccgccgccgtactgctgcatctgagagtggaggaggatggatgaagggttgtaccagtgtgagggcgagagatgtaagtcacctccgatcccttcaaaacccaccattttttttcttgtcttggcttattttgtggcaacacatcaggccagccagacacataatttaccaccagatctgaatcgctcccgcggttgtaatgtataggatgtatgtatgtatgcatgttcatctgtttgtttggttttccctttcactagattcattctttcttagcacaaagcacccccccaaaaaaactctcttttcgttgtccttgtggatttctcagaattcggcgcagctgactccgattcgtttttggtgttagagagacaccgattcggactatgttatgttaccttttgtgaataaatatagtactagtgtatatgtgcaccgcaatctcagagttaagcatcatacatagtctttgtttgtgtgtttgctgcatgtacgacgacaccatggacgtgaagacgaggagcaggaataggaagaggaagaggactgtagtaccacctgcagcagctacttttcctgatctgctgccggaggagattgtggtggagattctggctcggctgcccgtcaaatccctgctacgcttcaagtccgtctgcagagggtggcgtgcaatcatctccgagccatccttcatccgaacgcaactccagtgctcggcttctaaacaggagccatccatcctcatcagcccccacaccctccttgggcgttgcgatattcaacccccagttggaggactaggtgattggcccaacaacttctccacccaaatcagcttctaccaatggcagcgaggtgcctccattgccaggttcatggatgccacggccttccctgccaacgagttccacctcgtctgccacttcgcccactgcgatggcctagtgctcgcccccacagacaccaacctctacctcttcaacccggccacgagggacaccatcactctccctgacggccatggtgataaccaccaccatggcacggaaatggaagcttgctacgctgcagggctaggcctagatcctgtcacacgcaagtacaaggtggttcgagcattctaccgttcaatggaccccatccgcatggggatggaggtgttcaccgtcggtgaaacgggcgcaggctgtggctggagggagaccgtcactgatcctccctaccctgtcagtagatggctcactgccttcactgtcaatggtggctacttgttctggtacatggatcggtttcgctaccctaatgacactctccatggtggcctcctttggtttagcctgcaagaccaagcgttccgcgtcactcttcttcctcattcactggaccctgccctagatgacaaggtcaggccggacgtgctacacggcgaattgtgcgtccttcatgccaacagtgacaccatgcctgtgacgatttggacgacaaattcgccgtcttttgatgattgggagcggcgatactgcatctatgtctcgagactttgccatccaatgggccttcttggtgatggcgggatgttgctgtgggcaaaacacaccatccaccgctacgacctgtggagcgatgagctgacggccgtgtgcgagctgggtggcatcaggtatcagggtggtaggccaccaaggtggaagaatctcttcaacttcagcgtaatgccatacaccgagagtcttgttagaatcactgctgctgcttaaggcatccggaatccggatcctataggcttgtacttaatgtatatctcactctatttatcacctaaatacagtgcaattgccaggatctgatactgacagtgactgttttgcgtgttgtattattaatttatctgtttactactgaggtactggctaaagttattttgcaatttgcccgggaaattaatacattttgagtttatttattgatccatcccaagatatgaaataagcgtgccaaaatgatctgttcgatagttttggatgggctgctgctattgcctgtgtaattttttccttggcagcacacccgattcctagcagtgatcaccaaatgtatcctgaaaattctccctgatctgcctctgtcaatatactggagtataactcagtgcctgcagccagtgctgctgatatttttcccggatcgatcgatcgatcgatcaatccatcaatacttctaatgctggcggttctaccagctgccgattggtaaagtatccctcagcattggtaaagtatcctgatcttctccttttcttctaaggtgctgatttgcaacaatcagatttcatcagtcataaatgaaggcagacctgtctattaactggtagatagcttgattatacatgatttagagctgtatgggagagttcaagctcctaattcttggaattgggtatccctaggtcccaaaattgttgttcaggtatcagggtggtaggcccaccaagttggaagaatctcttcaacttcaacgtaatttcccctacagtgagagtctggtcagaattactgcgcgctgcttaaggcttttacgccatgagaagcaacttgtatttgatgtatatcaacctattaattttatcactaaaaatagtgcaaatgatcgaagagatctggtactgagtactgactgtgagtctgtgaatgtttgcatgttgtattattaatgtttttaagggctcctttaaatcactggaatgaaaaaatggaggaataggaaaaacattggattctgatagaaatgtaagtgtaaaatagatgattgtaaaaacacaggaaaaacataggaatgaccgtttgattggatcacaacaaaaacataggaatttgaggtgagataaaaacttgaaggattctttccataaggctctacttcatgttaaattttccttcaaaactcgcatgggaagaggcatttcatagaaatttcataggattcatttctttgagctatatagaaaaaaattctataggaataaaattctctaaaatttctatgaaattatgaatttcctttgaatccgaggggcctagatctattaactgaggtgcctttatgtattgatccatccaaagatatcacgagaagtgtgacaaaatgatctgttagatagttttggatgggctgcgctgatgcctatgtaatttctccttgggctcgcttgggccaggctttgggagagctttggcagcccacccaattcctaacaatgatcactaaatgaatccagatggttctgaatttttttttccctgatctgcctctgccacatgcaactcagtgtctgcagccagtgctgctgatattttcccacatactactgtatagtgctgatgtttcttggccattttaacagcatcaccatttcgcttatacttattacaagcgaaatggcttattagtgttattagtgatttaaaaacgaatactgaaaaagaaaccacaatgaaaaaaaccgaaaaccaactctaaaattaagttttgaatttaaatataagctgaaggctaaacgatgaagctataacactagtaagatgatgagtatggcttgcatcgacggaatggtatggaagcttcactttttcttatcagaaagtggcaaagaggcagcagacagaatcgatccatggcaaaggcagagtcactgagagtccttccaaagctgccacttgagaattgccaatgcattgctcctcctcttttcttttccttttcatcatcttcttcttccttaaccaaaagagccccttcctgcctgcctgcctagctatgtggctagaaggaacaaatcctaaagatcagagagaatcagtgacacgtttcgactttcagctccaagcctaatcatcatggccatcgtctctccctgcagattgctacttgtttgtgtgtgagagaagcaaagaacagagtgagtggtgttccttttttttttcttatttcttgtttatgaccatggaaggaaagaaagatacctttgattttgtttctcttggatcacttctctttttctttctttttgtctgtcgagcgatagatacatactggctttgagcctgcaggtcagtgccaaaaaaatgttgtgttgggagggtatatttgacgtgaggctttattcgattccaaccttagctagcttctctttctcctcccatcatttgctacagaaactgtatttgcatctggttattcatgtcgttttcatcgcataactttttatatataaaaaaattcactgacttggcattgttcagtgttgagaggtatatagtatctttggtcgatctgctgcctttgccgaatcagttgttcagtactcgagtcggtgcgtgccttgtcttctcttcctctttgcacagttgcagatgcagagagctgatgggcctacatatgtccaaatttaaacctagaattaagtttttttagatggagggagtatgcgtctagctatagtttcatgggggaaagagcagcagaagcagcatgaatgcacggttgaaaacttgaaataatctgtttcctttccctggtaaacgtatgcatggtttcactccaatcggggcatcaaactataataactgacttgtcaacggcatgcgtgtacgcgtgatctaaggaacgtatccggaggagttcatttgaggcgaaaaatacccacccagagagagagagagagagagagagagtttacttcctagcccacccagagcatttggtcactgatacagtaaggccttgtttactttccttttttttttcctaaaaacatcgcatcgaatctttgtacatatgtatagagcattaaatatagacaaaaagaaaaaactaattgcctagtttgcatggaaatcgtgatacgaatctttcgaacctaattatttcatgattagctataagtgctacagtaacccacatgtactaatgataggttaattaggcttaataaatttgtctcgcggtttccaggtgagttataaaattagttttgttattcgtgtccgtaaactccttccaatatccgatcaaatattccatgtgataccccaaaattttcttttcagtaactaatcaggcctaagcttcgcatagtaatcctagtactctctccgtttacttccgcacgagtcaccgttgactccaccaagtagaataaactgtagagtactgtataaacttttgaatagtacttattccatactatattacggttctactatatatggatttttatccctcgatgggatatctgttgacgaccaaattttcgcgtcaacaatatcccttcgttgtttgtatgtcatctaaatagttatcaacaaaaattgacaatatagattaatatgaaatatattactccacaaacatgcaagaccaaatttaacttctacaagtagcaacaaaaatactaaattaaaaagtatttatcgtacattcgcatctatatttgttatttttgttataacttgtagaagttgaatttgatatatttcatattattctatcttgccaatttttttataactatttaggtggcatgcacgaaacaagggatatctccttgagggataaaatcacttcccataccgttgagctattatgagatggaaggagtaaatcattttagtattatcgtaagccaaacttttataattctaatcaagtctttagaaaaacacatcaacaagatttagactatcagaattaaatcaaacattgatgtcttcatagtgtatttatttgttagtacaaataaaggtgtatattttataaacttggtcgaagtttgacttgagataaaactgaaaataacttacaatatagaacaatgggagtattcagctttgatattatgtggtatttgcaattcattaacaagtcgcttttgaaatgtcggattctttttaaatttctgttagaaataagatgaatcttatgccttcttgaatgctaagctactttatacaaggaaaaaaaaaagcaaaggggaaacaacttgaataaaagacattttattttatttttatatatgtgcgtgcttacatatagtatgtggaattgtaaagctgatggaactgagaatcaaatcaaacctgatatcgatatgtctcaaagttacttgttattattacctgcttttacatttgtaaatcctcatttactttaaaccgaacaaatatataatcctaagaacagaatctagaaaagcatacaggattacctgcatactcacgtcatgctgatcgtagctgacccaactgcaatgctagtttctgcagagataatacggtgcaaactgaaccaaaggaactgaagaagaagatcgggagtttttttcagaccaacaagttcttttttttcccgagaaatttcagatcaacaaattgagagacatactactacaggagggagagatagatagggcttgttcagtctattaacaaaattaaccttactaaaatttgataatatcaagatattattgatttatagcctcgtcaaattttggttggagtgacattgataagaatactgacattggtaatagcaaaatattatgtttagtttattactctatcaccattttgataaccccggaaatccatgcactaccaaatcatccaatgaggagtctcacacagccagcaagcagaagtgagatgtggcatcatgcagattccaatttgaagattagtggcctgattagacactagattagcagcagttgtgatgaatgggaagcatcaagtggcgacatggttgcaggtggtggcaggagacatgcacgtgagggctcccccatcattggagagtacttgcagatagaccctgtgagagtgtgagacccattcatccattcaccaacaaatcgatgcagtgccacttgtagatggagtacctagctatagtcacaaatggagtactgatcaggttattatgttgctcagctactcataaactaactagggagtaccaaggtgtacgttttttatcagttctagtgaaaccgttagggatcggtttgtaaaaatcgaacaaatttagataatttccacacaaaagttgtcagtgttttgctcggttttcagtaaacaaacatgatcgttttcagaaaacggtaaggtaaaccatgaggagcactaccttgcttgctcttcatgtgtacgttgctagcaagcaaacatgatgtatgtaccctaccctcatcatgaatgaaaccacgcccccactatatatatgaaggtatcagtgaaattcagaatggatgcaaagccttactgtcttatagcatcacactttgccgcagtttactatgtgtgaaaaatgctaggttaatttgtagtatagtatttgattcaattctcgtacgagctaaaggctcatgcattgcaacggatattatcgaatattataagagataaaaacaaaaaatacaagtttatagcatagttagtttattaggcatataatactatatatttaaggaatgttacatctaaagcaaaagcattgacgtctggagaccttatagccccaaatatcagcttgttgtgtttaaagacaggctcgaataccatcactaacataatttaaagtagtatagatttgatttgcacagtagttttgtaccgtcccttatctaagttgcggcactactcgtgctgccgtgcagtattggtgggcccgtggtagtcagtaggacgaggtccaagaaacccgccacaagcccaccgctgcagctcagctcagtacaccacagtacaagtagggtcactcacaaggctgcatgtatctaaatatttgacaccgttaacttttttaaatatgtttaaccattcatcttatttaaaaacttttgtaaaatatgtaaaactatacgtatacataaaaatatattaaaaaatgaatcaaatgataggaaaaaattattaattaataatgaattaaacttttataaaatatgtaaaactatatgtatacatcttgaccttgacacatatgcaaattaaattgggattttatctaaattttcttttcatagaaggagtaatattaatagtgtgtatttgcttttcaaacggaaaaaagaatcatacgttttccctcacttttgttggctttgaaagataagaatgcatacaaggcaggcagcatggacagcctaatatatgattggctgttggcccatgtatttctagacacgttcatgtagtagctgcatgcacttcgtttgtttatagatcttgatatatacaatccacgagcaacttggtatatacatcgatgtctttgtgttccattagaagtgtacgtccaattcaaaatttaagaaaaccatgggtcaatttttaaattaatccctacatctgcaatttttagttccatttgtgggaagatcaactcattgaccggataggccttcatttctacgaaatggcagctctccatgcatgagagcagatttaattgacttttgcttgtaaggtttttgtcgtgctacagtgctgctctctctttttttccctttaattcctagaataggagctctactaattcttcaaaaataattaataagaaattacaaacagcgtgtaaaagtctaaaggcataatatcgtgagctacaaattaacatttacgccacgtggacaacccaatacaacataccacacgccaagtatataaaactcaagaaaaacacgacactctaccaaactatcgcaccctcacgctctacatccaactcaccatttacaattgtcgctttatatcgctcacctcatgaagctagctctaacttcaccaacgaaggcattgtcacgtgtaccatctattgtacatcatcgcgacggtagcgccaatttcctcgtgatacttctaaaaatatcgggaggctttttaactctcaagatgttccaaatatctcatgttattggtatgaaacttacttttccttaattatcctttctttggtatgattaattacagcataaattaggccatgttgatatattcctttcttaagaacattagcactaccaataaacttcccaatcctttagctataatttatatccaaagtttaaataattcaaaagaagataagggaaagcaaagaattcaacggagacaaaccctcttgagcccccccaaatcccaaattgcgaaaatctagtacactcaaatcacaacactagccaagccagcacaccactactctactggatcgagtacagtacacagtatgatgattttttttgtgattatagaaattaaatgttaaatagtgaaattaggagaggaagaatccaagagcaattaggatgcgagtgcagaagcgtccctttcccggacaatttcccggcagaagtataaatcacaagccgccatggccgccctcgcttcctgccaaaatccttacttataagccacagacaagtgccgtagctaagctagctcacctttctcctcaccggcaagatcgcaagaacgcaacaagagaggaggagattgatgtcgtcttcggctgtgattccgccgccgtcgccggagaggagggtgccgatggtggctgtgccggtggtggccgacgatggaggcggagggcatggggcgaaaggggaggagagtgtgagcgggagcgtcgcgggcatttcgccgagcatcctcatcatcgccgtcatcgtcgtggtgatgctcctcgcctccgtctccatccactacttcatccgccacctgtgccgccgctcgtcggcgtcggcggccgcgtcgtcctccgcgccggtgctccccgtcgtggtgcgccccgcgtcgtcggcggccgtgggggagcaggtggtggggaaggcgtcggcggagcgcgcggcggagatggagcggctcatctcgcggctgccgctgttcacgctggcgtcgtcgctggcggcgctccccaagtcgtcgcgcgactgcgccgtgtgccagagcgcgttccgcgacgacgacgagctccgcctcctcccggcgtgccgccacgcgttccactcccgctgcgtcgacccgtggctccgcgccaacccctcctgccgtcccaaaaaaaaggcaacctagaaggggatgtgacccctcctagtataacgaatctgaaaggagggagtacgatgccttttttggtttttgttccagtcatctgaacgctcatgggggatcctctagaatcggcttcgagctgcagcatagttctcatngaccag

SEQ ID NO: 66315 - DNA, 3360 bp, Oryza sativa
aaaaaggtacctatccaatgactcattttccacatactcgtagactaataacctctgacgaccctctgagcagaatccccacattctgaccaaatttatgtgattgatcctcccaattaacgtcacttctgcccaaaattcctcttcaccctgtctaacatctgtaagtttctttactgcaaccaccttcttatccccaagtattcctctgtaaactgtaccactgccaccttttccaagctcttctttaaattttcccgttgcttccaccaattcgcggtatgtaaacctcctgaactggcttgttatcattttgtaacctttctccatggacttgggtatgttatgcattttaaaaagaaagtaccaccctgtcatgataaagaccaactcaactgctcctattatagtagcaaaaacatataagtatgcccacattatgttgtcagaattttttctgtatgcatctatggatactaacataacttttgaagcatttggcttgcaggtaaaacaaaaatgtttggagatcaaggatgttgaagcaacgttcttaggaagtttgatgtagttgtctccaggaaaatatggataaacctggccattgtagagcaggcctttagtgtaacatagaccatctccacctttgtaggtaaaagataagcacacgcagctgtccatacaaatcctcatgcattcttcaagcgagattgacttgtttgaagtcagatcaaagccataatagtcaccatgaggaatcttgacgaacgtaaaatcctcgcgttgctggccacagctgacgctgaatgttggcctgcagcctctactccagttctcgggatcagtcatctcgtatcctggaggacaagtacatctgagacctggtgagtactcacaaattccatttcttccacacaatccatgcacatagcacatctgcaatacaccttcccctgtgatagtccagttgccatctgatgcattcaagctgtacattctgaggttgccatcataatcaattgtgatccttctctgtatccctaaacctgaatccagggctaccattttgaacccgtcgcttgacaagaacctgccctcgtcgtccaggaccgctatcttgctgctgttgaatctagtccggccgttctgcactgcggtgtagtctggacttggccagtatatgcttgtgatttctggtccattgtactggagccggaggacattatcgttgtcgaaatacaggaaatggttaccagattgggagactaacctcttctctcttgtgagacgctgcgatggtagcagggtgtcagtaggccagtcgaagctctgccacacgatcttatcctcggagtcggatgccttcattaccatattgccactgttgagcagagccaccgtggtgtgcttgccccagccagtcttgctctcccagaccgtggtgccattgacatcggtaaaagccaggttgccctcatggctcagggatatcttggagccatggccgttcaccggaaggccagagtctgcggtccagaccaccgtcctgtcggtggcatgggtgaaccagatggagaagtagaaggcgtttgtgtcatctccagatgggtagaagccgcaggagaaggttgtgtctggtgaaacaaggaaggtttctccatgatctacctggagagatgtacctgtgcctgtggtttgccatggggatgcagatgcggcgcagcacaaaagaacggagatgaaggaaatgaagagtgggcacaggaacttacccatctggatttttggttgttggggggtgacgagtgcaaaggatattggcttctttgtgtgtgcgcagactgtgccctgtggcctgtggcacactgattcttgtcaatcttgtgcccatatctcttgagatatcacatacccatatgcgttacctgtagaacgaaatgccacattgccactggatggtgactggtgactggtgagtttggctggcttattttcatctgcagcgagtgttactttactcgcgtgatcttgttcattggattggatcaccgagaatctgacgtgtgcttttttttttttggttcctgtgtaccctctccagctctcctttgcctgggagaggttgagattctcagcacacatcacattcgttctttgttccaccgaaagataacatggaaactgtggctgtgttctttggttagagcaagtataatagtaggttataagccggctaaatgttgaggtggaggagagaagaaaagagaagcgggttgtaaacttacagccggtttggatataaaaaccagaaactctgtgagagagacaagtgaaccctgtattaattgtaaagatctaactattatatgggtaggctgagagaagactacaaagaactttagagcaggtacaatagtaggctataagccagctataaacataatttaaagaaataaaggaagagagagaagagtagcgggctacagatctgtagccagctgcagcacggactccaaaacgtaacgtgtgtatgacatgtgagactaggtattaatagtatagtaagcaactatttgtatgaattggctattacattggctctagatgatttggagcagtagttggctatactattaaacttgctcttatagccaacagatcggctgtattattagccttgctcttacagttactaactcacctcattcgttattcgcgtgcacgttttctaaacggctaaactgtctttttttttaaaaaaaattctatataaaagttgcttaaaaatcatattaatctatttttttaaaaaatatagctaatattcaattaattatgtgttaataagctacttcgttttacatatgtgaggggataccatgaggaaagagttatctcctagtgttgtatatattggaaaactgtaattttgttttgtggaccaaccgactatatttcttctcaatatatttgtcaacaacatagacgaagtttttgtccatccatgtaattatgaacggccagaacggatcaacaggctaaatacagagtacttcatttgttctaaaataagttaattttaggttctactttttatcctaaataagtttactttttaatctatctgtcaaaagatgagttttattccttcaataagcatacccacccatcaatatttgtcgaaagatgagttttatttctttgatacacatactcacccattaatatttccttttcgattgatgaagaacatttttattttttttcacttcattttaatttgtgtttcaatagctaaatgattttgctattcctctgtcgcgtgattttttcttacgcctcactcgcttttgtggtcgt

SEQ ID NO: 66316 - DNA, 5422 bp, Oryza sativa
  unsure (1)..(5422): unsure at all n locations
aggcaaaaaaactgttgggcatctccacggtgtacacattgcattgtcctactatattgcttgatttagactgcaagacggaatattgtcaacttcatgggggcatccatgtttctttcaatgtgtgaaagaggagtaccgatgaaaccgtgattttgtatattatatatatcagtttttcctcccttctgccccaagctaagttcttttacataagcaactagtgtatgaaagttaaaagtatctttaaagaagaactttatttgggagtaaaaagaggacaatttttggatgaatagtaatagagaaaatctattatatgccattaactttgtcacacttctacaatttaccactgactttatcacgttctacaatataccatcaactttcacttaacttctacgatttactattgccgtccggttagtctcagtgagtactgtacaaatttattgaaatgatcaaaatatccctgggaacaaaaactttcaaattttggacaaaaattctgaaatatcaaatttcatgttttagaccaaattttagatggttacaatcttatgtttataatatgatattttgaaatttttatccaaaatttgaaagtttttgtcgtaggggtattttggtcatttggacaaaattgtacagtgttaacggaggctaaccggacagcgatggtaaatcgtagaagttaagcaaaagtcgatggtatattgtagaatgtgacaaattcaatggtaaatcgtagacatgtgacaaagttagtggcatataatggattctctcatagtaatatggcactattcacctaaaatttatctcttttttttcctctcaaatgaagttgagtttgaacttgtgatttcgtgtgaatgtatgtgatgcctactgctaactccaatattttttttgatgaatttagagaacttttaggtatggttttcacttatgattttcactggatattttctcattatctacccaccagatctgtctctgatgtcatgtttaatatttatcaatttatgatggacaaaacaaatagtatggctgcatcgtatcgtaaaaagtttgtgtacgatcttattttgttcatgacctgaagtcgtcgtcatctctctctcaatatttaaaagtcatttctttggtatttgcccaatataagaagcgccccactgatagcaatttggatgacgaaatcaacgatattaatagtagtttggatcttgacatgatagcttgtggtttgatcaaacgactcttcgtttcagtttgcccattctatctttttatcttgcactaagtctcttctaaagcgcacacagtcatcagcacttaccaatttcgctttccgatttgatgtgtcattagctgatctttctctggtggcgagacattttacctggttttgacctgaccagctgatctcattctgcaggggaaaccatgcacttggtcatactagttctactgcccaaataatgcaaaactgcaagaattacccctcttggctactggctttgtttgacacaatggcacttacactctttcaggatttgatagtacataaccacaaatagtagacgcacatatgcatgtagctggcaatggcatcttcttgacctgccgctccaattgtaattccagtacagtctatagggaagttgaagtatcatattctatagactgtcttaatttaagactaattgcacaaattttgtacgacctagtggcctaagacttcacatcttgcctggtttttttttttttgtgcatctttcagcttctagaaccggctggcctgcgagcacaccagtagtgacttcacatctttaatctgctagtgctagttgtctgaaggtaagggttcatgctcaaccgctcaaactangacctgccatgcaagtgtcgtatttttcttctcacattcttgtaacataacatcagtgcttggacagcatcgaccaactggtctttcttctcccttgcccggtcttggatccatggatcgttttcctgcagctttctgatcgatgcaattaagcttgctttgccttcagctatcgtcagtgcttgactgaccatgcgagtataacgtagctgcctcttcctggtcaatatcgttacctgccatggacaaaatgtaaaatactccagaaaatccattatatatctatatgatacccacaaaaccttatttttgtggtgtactcctaatcttattgtatactccctccgtactcataaaggaagtcgtttaggacagcgacacggtttccaaaacacaactttgacttcttgtttctataaaaatatttattgaaaaatgatatatgtatatttttatgaaagtattttttaaaacaaatctattcatataatttttatattttcaaactcaacaacttgagagttattcatgatttatattctcaaggtttgacttaaacattgttctaaacgacttcctttatgagtacggagggaatatgtacaggatttgagctcttcttttcgcgaaaagagagaatttgagctcttttacagtgctccttggcattggcgttgcaagccatgggacctcactgggctgcaatgctgaagcttcttccctatctgaatagattgacctcagttgtagtgggcaatggtatcagagccagctttcggaaagatcgatggcttatacaaatgccactgcaagagaaattcccagctctattcaccccttccaggcaacaacaagcaacagtggcagtacatgcaaagaatattgttccgtctccaatttgcgcaaaatatgcagcttagcagatgaaacaacaagctacctctttcttcactgtccttttgcctctggtctatgggcttcactccacatcgatccaggtattgacgatgtaaaacaactccatgcattacaaccaccatcagtcatcccgacagcgcacttccgccccttctttctgctctgcctttggggactctggaaccaccgcgccatgatgccatcttcagaaaccaggagccttgtcatcgtcgcctcctccaacgatgtatcgaagacgcaactctctgggcacaccggttaaagagccaggatagaatcgttgtttccacctggaagcaagtactctcccaccccctaaattctgatcaaatggtgcaattggatctcaaatttattaggaagttcttcctctagaatcctcctaaatggatgccccggtaacccaattttacataagagaggtctaagacaaggagacccactttctcctatgctatttattctagctatggaaccactgcatctgatcttcaaagcagccgaggaagccttaattctcaagaaaatagatccgagacgacaaagatttcgttgttccttctacgcggacgacgtggctctcttcatccctccagaggcacaggaactaacaactgtaaagaacattctccacacttttgcaaggatcagcggcctccacacaaatccttccaaaacagaggttttcccgatagcttgtgataatctgaatgttgaaagccttctaaattcattcatggggaatttaaaaaccttcccatgcaattatctcggcataccccttcatacgagaaaactgaggaaaatagatctacagcctctagtagataaggtgggtgcaagaataccaggttggaagggaagattctttacttcagcaggaagggaagtgttagtgaaaacaacacttacggcaacaccaatttaccacctcacggtactgccacaaatgaaatgggttttcaagaaaattgatcgtttcagacgtgcctttctttggaagggagaggaccctgaaaatgtgaatgccggtagcagtttaattaattggcaagaggtatgtaaaccaaagaatttgggaggacttggtattttaaacttagaaaaatttgcaagagcattgcgcctccgttggctttggtataattggaaagatgatacaaaaccgagggtgaatatgtcagttccatgtgatgaaactgatagatgcctattcagagctgggacaaaaattgagatcggggatggaagaaaaacctctttctggttagacaattggttggatggccaaacacccaaggatctagctccgacaatttttaggcttgcaaagagaaaaagtaatagtctacatgctgatctgaacaacaatcattggctatctctgttaaatccaatcacttccttggaggaggtaaacgaccttgtccagctggggggaagacttcagaacatatccctacaagatggactggcggatgaaataatttggagatggactgaaaatggggtttactcagaaaagagtgcctatcttgcccagttccagggatcacacacaaacgttttttacgagcctctttggaccacatctgcagaaccaaagcatcgattttttggctggttagtcttacaccaacgaactcttaccgcggaaaatctgctgcgctgacactggccatgctgactggaatttagtagttctatgctaggtggggacctttcgaggtatgctcactacatgctagtctaaaatgagtgtcctcctttacgcacacttggttttgtgataccatgttcagttagtatggtcttgatctattcatagcactcacatctaactatacatttattctttcattgtaatgactggttggatgcactcctttgcaggtatcatagccttaaatcaagaaggaagcacattctgagtgtccttttaacaacatggtggaatatttggctagaacgtaataggaggattttccaaaattcttcaaaaagcgagctgcaggtggccttcctagttaaagagaatatagacctcatcaaccaatccaggctctattgctgctgatagaacctggtcctcaggcgttctttccttgggttgtaaatttaatcgcaggagctgtactgccctgttgttgttttcgtttatgcaccctctgtaagactctcttgatttatttcttctaatatatacggcaaatctcctgccgtttaatgtttcaaaaaaaaaattctgatcaaatgtaatagcaggccgctggcccttcttttgtttctgtttgtgtttgtatgaacatctctgctttaatttcaatggaaattcaggtggggaagctctcccctccggtgattattaaaaaaaaaaagagtattcagatcatcagatgtatatcaaaattttagagaaaaaggtatatacaatatgtaatacgcatgtgcatgaaaaaaaagggaaaaataaggctgtattcagaccaaaataaatataaaccaatctttcttagtttcttacactcttctgatcttctccaatggtctaattcgcacaagtttactcggcgccggcgtagacaa

SEQ ID NO: 66317 - DNA, 10756 bp, Oryza sativa
gcaggttcgtgagggttcacggccttgtttaataatactgtgtagctctaggatcgtctttataaaatggctttgggcaactaagtgacttttaaaggctgttactgcaaaacttaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttccctgtcgcgacacctagctccgcctcccagctcccgtattgaaggcggagggtgtcctgcgcctcgttcatcacggtggtggcaatgagggcagccccccgctcctcctccacttccttggcgatttccgccaacaccttctttcgggcttcaagctccgaaacgtgccggcggtgtgccttgcggcccacctccaccatggcctccactgagcgccgcccctcctcgacacgcgcccacgcggcgtcgagctccgcccgctctgcttgcagggcctccacctgggcattaaacccgtccaacaccgcggtgtttgcggcggccaaggccagcagaaggggctctgcgctcagcggggcgatagaaggcgcggggaagagccgccttggagaggatgccgcgcggctcgggccgccgatggaagtgccggactcggggatgtcccctggacctagttggtcctgggtgtcgcccgagggagtgggcccaggcgacgcgcctgcagcctcgtcgccagctgccccggaagttgtcgcctgagcgtcgcctgagggagtgggcccaagcgatgcgcccgcgacctcgtcgcgagctgcctcggaagtcgccattgcctcgtcctggcgaaatccggctttctcccgagcggcttcctcggcctggtgggctcgggcggcctcctcccgagcggcttcctcggcctggcgggcccgggcggcctcctcccgagcggtttcctcggcctggcgggcccgggcggcctcctcccgagcggtttcctcggcctgacgagcccgggcggcctcctgggcggcctcctcggcttcccgtaggcgatccgcggccactcgccggtcagattcccgcctccgggcctctgcggccgccggatcctcggcctcagattggccagacttggaatgacgggagggacgcgacgggatctcgctaaaacagaagaaaagaccagaagacgaacaaagatgggtgagtgaaaactcgcgttgaagagaatgaatacagccacgatgggtgagagacgaacctgcgagggggtcggttgaaagaccactttggaggggagatgaggtttccccgagatggttctgtctcccccatcttgcggagccgtttcttcttgtgctccccctcgggctgcgatgtcggcgcggccccctccgggcgcctgctgctggcacgtaccgccccgccccctcggggaggagattggggaggtgttcctccctgtttcctcttcccccgggcgtcggcagggcggctgctccccgggtctccgtcgcgagacccagaagcacgaccccctcccggggtagattgatcccccttgcggctcccgcctgcgccgtcgtggccctttggagctccctcctctgaggccccgaccgccgtcataatggtcaagatggaggcgcggtctggatcgctgcagagggggaggattccgtggggaatgagggacgcctccacggagttgagattcagcacccgttggaccactatcttgaagtcctcaggagcccagtcccatctgactccctggtggatcctcatgtagtcttcggacccggtgtactcccaggcgccccgagcgcgccgctggagcggcgcaatccgacgacggaggtagtcaccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggggtgtagaaccagtcgctcttccagtcatcccacttcttgcggaggacgcaggggatgtagcggttcaacaccggcccccgcggcaggaagtagcagccaccgaccaccgacggcggcgacaccgactgcacggtgaagaaccaccggaacagccgaagagatgggcgcaccccaatgaacatctcgcacaggtgcgcgaagatggctaatgtcatcactgcgttgggggtaaggtgcgccatctggagatcgtagaactccaggacatccatgaagaaagaagaaaatggcggaaccagccctgccattgcaaaggggagaaagaagacggaccgccccgggtagtctggcgccgggcgtccctcgcccagcatgactatctcccggccggtggcagattccggcatgaagcggcgcggcagcccagcctgcctctcgctcacgatgcgggaaggcggcaacacgctaccatcgagcagagcggagccccgtgccatggcgccggacgaagagaagatggagagcgagcgcgtgtggcgaaagaagggcgcaggaaagaaggagttagggcgcaagcggcgaagacaaggggaatgatggcgaaaggaaggaaacaaatcctctcctcagtgcctttatactcttgccaatgctgtgcccggctcctcgtttctcgcacccaccgtttcgccccctcgtttctcgcgcccacacctccactaatcccattcgcccgcttgcggcgcgtgaggtggatatgcggttgtggcagtcgagatagatcatttcgtgcgcgcgttgattacgctcgccgaccgaagcgccatcacatatctcctggcaaagcgaatcggctcgtccagattcgtgtactactcgagtaatgtggcagtctggaagagaccgctcattactgacagccgagttaccattgccgatgtgcgtagtttgtgaccgttgggtttctgcctaattgtagagaccggtcccacttgtcaccaggctttaggggtggcgtcacgcccgaccgcttcccttgaaaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggtcggaccactcctgcctcgcccccgagggccgaggcgccccgacccctcgcgggttctactccgcgtgtatgggttaggtgagcacagcggggctcacctaaccgcatttattgcggctcggctaaacgtgtcacgccgcacgaaatgcagtgcagtgcactcgtttatccggtctgtgaccagtcacagaccggtcagatcgcgggttaggtggcaacaggcggtctgacgcacgcttcgccccatcccgtcaagacgagagcttctaggcactcgtccccagctggagctagcgtgttacctcccagagatggcacgttagccccggtcggatatatgccaggcttcatcctaaccattacaagcaagatgttgtgtgaagaagggcaaacatgcacgttgctaagctgacgcgtggtggacaagaatgaccgatttgtgaccggtctgacactgatcatgccgtcagcagacagccacgttcccacgacgcgcctgcctccggcagaagtggaggtaggtatgtgccgtcccgtcagaaggatgttcggagggcaaccgtgcaaatctccgtccatttatgaagagaagaaaagtccagtttggaaaggggggggtgcatgtggtatccccttgaaatataaaaggaggaccttgcccattgagaagaggggatttttctccagattcggaacctagaacaagggagaggttggctcacactttgtagctccttcatacacagatccaccaaaacacaggagtagggtattacgcttctcagcggcccgaacctgtatacatcgcctgtgcctcatgctctttcgataggtcgcgatctttccacatacagagagagcttgggatttcaccctgagcccccggccgaaccggcaaagggggggcctgtgcggtctcccggtgaggagccccacgctccgtcaaatatttttatataaatatacactatactattagtacttggcgcatctctcatacacatataatatcttatagctcgtgttaaagttggctacaaatatataacccgtttttttctccctcctctcctctacgtatgtctgtagctagctagcttagctaccttataacttgctattgtacctgctctaactatatatatagtcccaacccaccacataagagcaagtttaatagtatagttaaccactagcttcaaattatctataatcaatttaatagccaattcatacaatagttatatactctattaatacctgatcccacttatcatacacacactgcgtcttggagtccgtgctacagttggctacaaatttgtagcccgctgctcttctctttttttttatcttcttaaaatatatttatagctagcttatagcttactattgtatttgctctaagctggtgtctatggaatttattaggatgccacctaataaaaatttgatgtgacatggtaattaaagaaggaagagaaggaaaaagagaaaatgatgtggcaagcaccaaaccggatcgccgtgtgcatcaaggccctggaaagtagcaaaatcagcgttggggttgattaattgtttcttccccgacacatctatctatctattatattattaagacagctcgaaaaaaagacaccacgttcactgtggaggctagaaattcccatattaatggaagaaaaagaaaaaaagagttcaagtagaaatacaatctaaaaaataactgaaattcggaattaaaaataagtaatatttaaagaggagtccatataagaacctaatacgtgattaattaaaattcagaataataaataaataaatttctgaaattaaaaaaaagaaaaaaaagagagttcaagtagaaatacaaatttgaaattattaaaagaataatggtctagatttactgtataaaagataatcatatcaatctaattatagatcatacaatccgtactaggagtccttgtccatttagaaaaatcaattgcaaaactatacagtatatagagttatgattctaaaccaacatacattgccgcacatatatatatatagggtggagataccagaccagcacgttaggctgcagcagcagaaaaataatatagtgccctcatttcatacaagtctacgaacccaatacgagattaattaaaatttgaaatgaaaaacaaaataaaatccgaaattagaaataagaaaataaaagaagagttcaacttggaatgcgatttaaaaataactgaaattcgtaataaaaaataaagactatttaaagaatacaccatctagaacacataacgaaattaattaaaattccgaataattaataaaataaattctgaaaatagaataaaacaactaggaatataatttataaataaaatctatcggaacgaaaaatatggaaatttcaaaaaaaaaacatctagaacacaacgatgataaatgacaataaatatcggagaagcaacgaggcagggagtagagtggtgacagctgatgggatatctaaaaaactattaacaaaaccccaaatagaatctcaatgacaattaaaaagagtgatgacggacaggccgttaagcagcacggtcacgacggttagcgggatttctaaaaaagtaaaaaaataaacctcaatgataatcatgttcgattttaaaatttcaaatataataaagagtgggaggaagcgggcgagccatagagtagtacagtggcaaagccactaacggtttggtgggactctagaaagtaaaaaattaaactcaaacgatgattatatttgatttttaaaatcccaatgacaataaagagaggaagcaactgtagcacccgtattttatttgcttttattttaaaaaaaaagcttgtcatttaaaaattggagttaatttggttcttagatgattttgtgccaaatggatctcaaatcctctcttagaattgcctttcaaattcctgtgaaactctaggtcaaattcaaattcaaatcccttcaaattctcctcaaaattcaactctataaatccctgggaaaatgtgaaatatcactgttcatattgggcctccttcccttccctctctctcggcccaactctcctccacctctcctctcttctttcccctgagcaggccggcccagcgcagcccatttctgctcatcgtccccttccttgagccagccagtgcatgcacacaaggtgttcgacgaaataccgacccgagtcgctgcaccgttccgccctcgttcccgtaccgcgttgcaccataccaccctcccgtgcgccccacaacgtgccagggccacgtagcgccgccccgcacgccgcgccaaagccgcatcgcgccaaactccacgaaaaccgccgcgccctctccgggagacacggagccacgtcgccccgcgtcacccccgtctcgtcgccgttccatcccgagctctcgcggacgcgcgtcccttcgctgtcgcccgtcgtcttgtcgtctgtctcctcccgggaagccgccgagctcgcgcctccctctcactcgcgttccatcgccaccaccgtgtgacgtcgctcgcgtcgcatcgatctgagaaccctaccacccaaatcccggccgtagccgccgtcggccgcgcgtcatcgatgtcccgtcgcctttcccgctctccgcgcgtcacttcgtgtcgcgtcgccgtcgttttcaccgtcgagtcaccaccggtgcatgacgccaagccatcgcgtcgccatctcgtccaccccggaatcccgccctagccgctagccagctacccccggagctccgcgtctagaccgccagctcgccaccgcgccgcttgcctataaaaggggaagcagcccgagctccttctccccacaccatcaccatctctccccatctctctctcctctctctttctctcgttttgctctctgttgctgccagccagagccgccgcgctattctcccggcgccgccgtcgccggtggagcctcgccggagttctccgccgccctccctcagccgccggtcgcctcgccgcgccccatcgccgagacgcatcgctatcccagaccgagccgagcaaaagagcgagaggaggaagaagcaggcctcctcaagcctctgccaagccggccccaccttcctttattccttcctgccactgacgagcagggcccgtgtgccttttcctctctagcagccaccgacaggtgggcccctcccttttcctttttttaagtcaatttccaacattccagaaaatcctttattctttgaaaattcatagtaaatcaaccgtaactccgattgaccccgttcaagttcctaaattttttataaaattgagatctacacagtggcaccattgtttctctgatttgagctagttttattgccttttcttagttagttttatttttcgcgtttagagcccgagttcgaggaagctccggacgccgctttcgaaggagaagaccccaacgctgtgcaaggcaagcccctttgatcacattgcccctatattttcaatgatatgttgtttgcaaagatgcattgttagttcacacgattaacatgtttaggcctcggattgtttatacaaccgacggaccaacccagtagtcgcacttatattacataggttgatgtttccataccattgatagctccacaaatatttgcgccggtatcattattcgattaccgaggtagtttcgcttagccatgcttacgttgttgccgtgtgggaaacttgggttattccaaatccatgtttaaaaaaaatccggtatgttgtaccgaggaattgtgaaataaaatgtgttgtgaaagtggtgatgatgcggagtcatgcctttgtggtttggctacgtattgtcgttaaggaccgattcctttgggaaatccatccaaacacgttacagtgcgaccacacgggtatttatgggatgcctctggctaagtaaattgttttcacatgggagttggtgtgccgatggttgtggaatgccgaggatgaggagacgaagtgttacacatttttgcccatcatgggtgtcttttgcctctattgtggcgtggtaccggtaggagtaggaggcatcctcggtatttcctgagtggatgacggctgtcattgcctgatacttggctatggatcttagcccaactaggtggcatgcggttttcatgggttagctttggaaaggccttatcacgaactttcattgccgacgggtaaacgatgtcagtttcgtgtcgtgtgggtaaagcgtgcaacctctgcagagattaatgaactgttcgaacagccgtgcccacggtcaagggcgagtgtaaggtgtttctcatagcgtagatttgtttgacaaatgtttgtgaagaagtggttacagggaagggtaacgttaccagagtccgcctgtgtggcagacggctaacctgggtggttaggaacgggtctgtgtgacctggggtgtcgtctgacaccgaggtgttgttagggccatgaagatggcgttgttgtgctgagataactgtgtggactatgtgttgttgtgagaagaaactaatagaggaacaaattaatttgctgttcgttaatcgtgacaagttgttgcaaagcaacttgtggaatgggtcgaggcgtgagcctcctcccgacaactaaaacttgactcactcactaggagttttgtgaaataaatcactttgccaaaaaggcagctttcgcaaataaaaccttagcctccttgtttaaaccaaacatgtcattctttcccctggcttgctgagtacgttaagtactcacccttgccccttataatattatatagagtatggagatgaagacatcgacccgaccgccgaggagtatctccaggagcaagccgagtatgaagacttctagatgtttcgtgcctagccccaagcctcgcctgtggaataagatagatgcctaggttattcgcctagtgcatagttgcttagtcgcttagtgctccgcgctgttcgcttctgcgccgttgcttttatggttttctgtaatgttgtgttgctcatctatgggcctgtccatgatagcaacttatgtaaggactactacccagtgatgtaataaagcagtttactttgattccacatttattctgtgtgtaccagctagttgtaacatcctgaaaattcccaacaataaaaatcactaaaatttcgaactttttaaaactttttgcatcatgctggatgttatggttgcttttacttgccaaactataaattgtcacaatggaaaattaaactaaagttatacagctaagtaataattataataataagatatttattatgaaccccataaatatttacgcacgagaaaacgaagccagacaaagggaaggttaattaccaatttaatttatggatcaaatattaaatacttgaaccatgtgatgcgtgccatgaaatataaacacttaggaaatgataatcattcaaataaatggaactctatctatagaatagttttactgggaaaaattaattagatattatataatttgaattgaatcacaaatgctaaattatagaaatccatgtggtggtaaaaccaatccaaaaagataaaccaatatatgtgaaaacatataaataccaaaatcccaaacataggaaattataaaaatctaggatatatattaaatattggacaatattaaattttggggaaattcacatttgagcacttaatatggtcactcaactgcttagtagtaaaatacaaatttaatttgcaacttttctcaatttataaataaaccaaaaccttaaaaataggaatacttagaaaaatatataataaaaataaaaatatgttcaatattaaatttgaatacaaatttcgatggattaatttaggcttggtgtattgtgacaaaattaggggcaatagtatatttttcctaattgcaaaataccctataaaatcaaaaatagttggctagcattgttcattagccctctaggtgtttgatttggttccctaaccaccacccctcctctgccgcgctccccctcaattctcgcgccgcccctacgtgcgccgcgacgctgccgccctctgctgcgccgctgccttgcgccccgcgccgccgcgcgccgtcttgtcaccgccgtcgccgtcgcgccatcgccgtcgcgtcttgtcgccgccgccgcaccgcgcgtccccattgccgctgcc

SEQ ID NO: 66318 - DNA, 14575 bp, Oryza sativa
ggtacataaatgatggaactctgtcattaaagttaggatttcatatccattagcttataaatcatataagaaaaaaactaacttaaaagtctatgaaaataaactcaatcaatagccatgtgagaggagagaggaaagataaattatttttatttttttcataaaggtatatcttatgcataacataaaggcaaattttgctacaggacacccaaaatttgtgtaatttgctgatagacatcgaaaaaacatgtcatggctgaaagacattctaaaaaaactggtaatttgctgtaggacacttttggctcaattgaagggatggattccaaaaaaaagacgagaatgcccctctggccacatgcttcaaacatggtgttagagtaaaaattaagaatttttccaactctaaattttccatagcccaaagtatatcactagcatacaccatatttcattttcactctagtatcggctcaaaaagcttttgaccctagggtcattcttgtctttttgaaaaatttctctctctgattgagccggaagtgtcctctagcaaattaccatttttttagagtgtctttctgatgaaccctgagttcctctcgacactcaaggcagttgtttggcccgatctttcggtgagttgatgataactacgatttgtggaaaagacgttgacgacccgattacaaccgtacaagacgttgcgttgcgccttagcgatcgatacacctctccgtgggttgttgatcttgccggtgcagatcaaccttattcctgcaagcaatcgagaacaagcaagaacaagatataaagcaactgaattgctagatagacaagacttacaaagataaattgatacacgataaagtggggttccgaacaagcagacggacggtctagccgacacgcgcgctgcaagcgaagtagcaatggctaaacttacaattaatcaaaacccgagaaaccctgaaggggtaactagctatatataggggtgggagcacgacctaggggtgcctaggtcatgctccaccagcttggggcgcaccccacatgggccccacctgggccggggtcccaaatgaagttacaagcccataggcccattataggtgacgcagcaccttgttcctgtgattccggccacacgagatggaattcagagaagaggctggatccgttggaaagagggctccgagagctttccatcaagtactcacaggccgaaaacggaggtcgtatgcagattcggtggccgtttgaagtcagcagtgtagtaggtggccgaatcggattctagcacttggaggacttgatcttgatatcttcttgttcatccatgatgtgagcaatggttgcatccgtggtagccatggtcacatcatctctttcagccataacacgttttcaagatgtctatcagcaaattacacaaattttcggtgtcctgtagcaaattttgcctaacataaaaagtgttatattgatcactttcacaatgttaaggcatgctatatagaccaataataaccaatttttctatatatttaatcgtggtgtattacgtgtttacttctaccttaaaatatgcctaaatattttttatttaccttataacaaagggactaccacaacgatattacgttttccaagttgaaatacgcttatatatttttgtcaaaaaaataaatacatctatatttcattttgatttgtatttaacttctgactactctctctgtcaaaaataaaagattttggttggataagacattgctaatattatgggcatattcagattgtagccaaaattttggcaggatttcttatgtattgatcaaatttggtaacaaactaaagacattcttttgacaattttacttagaaaaataatatggttgaaaatgacatcaaagtgaacatgccctacgaatcatatagcgaggaacggaagactacgacctgttgtgtcagttctcagttgtgatcaccacatgaacaggcccacgtgaatggcccatagaacggcggtccacttctactccggcgagccacctccctcgaactactagtcctttcgccttcctcgtcgtgtccactccccacgcacgcacgcggcggcggcgagccgccaccccccctcccgtcggctttccgatctccgggaacgtcgcgacggcggcgccaatgcgtatgctatgccgcgcgcgctggttctctccctccccccctctgccgccgcaggcgtcatcattgccctcatgtcaggtgccggcagtggggactggggaggctgttgcccttgcaggggcgagaaacgaggtaaagctgttcatcttccctgctggttaagtcgcatccatgtcgtgttcaccacttggcatcgcgctctccttcaagcttccagtgtgccttgagcgacgcagaagccatgggctcaagcagaattgttcggtgcaatgcaacttatccggtggccatcacgcctagaagagatctgcccttcgcaatccattacaaggtgcgtatttctgaggtgagggcatggtttccttgtaaactatgcacgctgcagataattttattttgctctgcatatattgaattaatatggagtagtttctggttatttgggtggggttatggattcgatgcttgtgaaaatgacggttaaagtttgtaggcttgtagagataattgagagaaaacgaacaaaccaatcaattctggaatagccctgcatactattcattcactcatttcatctacagaacaaaacttgttacattatgcaatataatcattccaatgtcataaacaataagcccttgtcaccatatctagctatgcctataattacatcatctaggatatcctattacgtacacatctcaaaatttatgcagtagctgcaggctaatatgaataggcaggatggtagtcgtcttcgtcatcacataacatgagagccttcagaatttcatccattgttggcctcttgcttctttcttccaggcatgaaagagctaccttcaccattgtaattacttgctctggatcaaagtgtccatgcagtctgtcatccactaaatcggtgacattccctgtagcctgaatctttttggcctcctggacaaactctggaaactccacttgcctttcatctaccactatgccgcttgaaaccctgattcctgtcacaatctcaaggagcactactccatagctgtagacatcaacctttgcattgatcggcaaattcaacgcccattctggtgccatgtagcccattgtgcccctcatatgggtgaaattgaaactagtgctgtctcgctttgcaagtttggctagtccaaagtctgctatcttggcatcgaaatctctacttagaagtatgttttctggtttcacatcacaatgcacgacccactcaaggcattcgtgatgaagataagcaagacccctggctgtgcccagggcaatcctgtacctttggctccaacttagcaggctttcgtggcatctctcaccaaagaggtacttgtccaatgactcgttctccacatactcatataccaatagtctgtttgtcccttctgagcaaaacccccacatccttaccaaatttatgtgattgatcctcccaattagagtcacttctgcccagaattcctcctctccttgccgaacgtctgtaagcttctttactgccactattttcttatcttcaagtactcctctataaacaattccagccccacccctcccaagctcttctttgaattttccagtcgcttccttcaattctcggtatgtaaatcgcctgaactggtttgttatcatcttgtatccatcctccatggacttgggtatgttatgcttcttgaaaaaaaggtaccagcctgtcactattacaagcgactctagacctcccaatattgcagcaaaaacatagaagtatgcccactttatattgtccttctttgttccatacatacttgctgagcctagcatgatctcaggagcactgaggttgcaagtgagtctttgttgtttggagattgagggtgttgatttgcttgaattcttaggtactttcatgtagttgtctccggggaaatatgggtacacctgaccattgtagagtaagcctttagtgtaacataaaccatccccacccttgtatgtgaatgataagcaggagctgctgttcaagcaaatattctgacatgcttcaaatgagatggatttatttgatcccagatcgaagccatagaagtctgcatgaggctgtttgacgaacataaagtcctcatgtggtcttttgctatcgattgtaaacgttggttcacatcctttgttccaatctgttggatcaaccatcacatattctggaggacatctacatcttagacctcccgagtagtcacatatcccattcttgccgcatagcccatgaacataacacatctgtatcacggcctgccctgtgatagtccagttgcccgttgactcgttcaagctgtacattctaaaattgccatcataatcaattgtaatccttctcttgatcctaggacctgaatctgtagcctctatcttgaatccatcacttgacacaaaattaccctcatcatcaagaaatgctatcctggtgctgttaaatctagtacgcccatttttttcggcattataatctggacttggccagtagatgcttgtaatctctgggccgtcatataataggcgcaggacattatcgttatcaaagtagaggtgatgataacgagagactaaccttatgtttttggtcaggttctgccatggcagcaaggtatcggtcggtgagtcgaagctctgccacacagtactattgctggaatccttgattacaagattgccggtgtcaagaagggtaactgtagtatgcttgcctgaagatgtcttgctttcccacaccgtcgtgccgttggtatctgtgaggactaggttgccatcatggcccagcgacaccctggagccgtaaaggttcactggggagtatcccccattcgccggagagtagggattcgccgtccacacggcagttttctcggtggtgtgggtgtaccagatcgagaaggtgaaagcatttgtgccaagctgatggaagccgcaagagaaggtggtatcaggtgagaggaggaagatcttgtcatggtcctcagctctgatgtgtgagccggtcgtcatggttcgccatggggaagcacaagagcagaggtggaaggagagtgatgagaggatggttagatacagcagcgcagccattatctccttttccagggagctttggctatcgaagtagagagaagaagagagacagagagaggcaggtagctttaggttcagttttaacactatgcggcttacttaggtgacgatatgcattagcgcgcatgtggccgtaatacccatgtatgttgctgacttgaacaattgaatactggggttggtaaggcaaaaaaactgttgggcatctccacggtgtacacattgcattgtcctactatattgcttgatttagactgcaagacggaatattgtcaacttcatgggggcatccatgtttctttcaatgtgtgaaagaggagtaccgatgaaaccgtgattttgtatattatatatatcagtttttcctcccttctgccccaagctaagttcttttacataagcaactagtgtatgaaagttaaaagtatctttaaagaagaactttatttgggagtaaaaagaggacaatttttggatgaatagtaatagagaaaatctattatatgccattaactttgtcacacttctacaatttaccactgactttatcacgttctacaatataccatcaactttcacttaacttctacgatttactattgccgtccggttagtctcagtgagtactgtacaaatttattgaaatgatcaaaatatccctgggaacaaaaactttcaaattttggacaaaaattctgaaatatcaaatttcatgttttagaccaaattttagatggttacaatcttatgtttataatatgatattttgaaatttttatccaaaatttgaaagtttttgtcgtaggggtattttggtcatttggacaaaattgtacagtgttaacggaggctaaccggacagcgatggtaaatcgtagaagttaagcaaaagtcgatggtatattgtagaatgtgacaaattcaatggtaaatcgtagacatgtgacaaagttagtggcatataatggattctctcatagtaatatggcactattcacctaaaatttatctcttttttttcctctcaaatgaagttgagtttgaacttgtgatttcgtgtgaatgtatgtgatgcctactgctaactccaatattttttttgatgaatttagagaacttttaggtatggttttcacttatgattttcactggatattttctcattatctacccaccagatctgtctctgatgtcatgtttaatatttatcaatttatgatggacaaaacaaatagtatggctgcatcgtatcgtaaaaagtttgtgtacgatcttattttgttcatgacctgaagtcgtcgtcatctctctctcaatatttaaaagtcatttctttggtatttgcccaatataagaagcgccccactgatagcaatttggatgacgaaatcaacgatattaatagtagtttggatcttgacatgatagcttgtggtttgatcaaacgactcttcgtttcagtttgcccattctatctttttatcttgcactaagtctcttctaaagcgcacacagtcatcagcacttaccaatttcgctttccgatttgatgtgtcattagctgatctttctctggtggcgagacattttacctggttttgacctgaccagctgatctcattctgcaggggaaaccatgcacttggtcatactagttctactgcccaaataatgcaaaactgcaagaattacccctcttggctactggctttgtttgacacaatggcacttacactctttcaggatttgatagtacataaccacaaatagtagacgcacatatgcatgtagctggcaatggcatcttcttgacctgccgctccaattgtaattccagtacagtctatagggaagttgaagtatcatattctatagactgtcttaatttaagactaattgcacaaattttgtacgacctagtggcctaagacttcacatcttgcctggtttttttttttttgtgcatctttcagcttctagaaccggctggcctgcaggcacaccagtagtgacttcacatctttaatctgctagtgctagttgtctgagggtaaggtttcatgctcaaccgctcaaactaggacctgcaatgcaagtgtcgtatttttcttctcacattcttgtaacataacatcagtgcttggacagcatcgaccaactggtctttcttctcccttgcccggtcttggatccatggatcgttttcctgcagctttctgatcgatgcaattaagcttgctttgccttcagctatcgtcagtgcttgactgaccatgcgagtataacgtagctgcctcttcctggtcaatatcgttacctgccatggacaaaatgtaaaatactccaggaaaatccattatatatctatatgatacccacaaaaccttatttttgtggtgtactcctaatcttattgtatactccctccgtactcataaaggaagtcgtttaggacagcgacacggtttccaaaacacaactttgacttcttgtttctataaaaatatttattgaaaaatgatatatgtatatttttatgaaagtattttttaaaacaaatctattcatataatttttatattttcaaactcaacaacttgagagttattcatgatttatattctcaaggtttgacttaaacattgttctaaacgacttcctttatgagtacggagggaatatgtacaggatttgagctcttcttttcgcgaaaagagagaatttgagctcttttacagtgctccttggcattggcgttgcaagccatgggacctcactgggctgcaatgctgaagcttcttccctatctgaatagattgacctcagttgtagtgggcaatggtatcagagccagctttcggaaagatcgatggcttatacaaatgccactgcaagagaaattcccagctctattcaccccttccaggcaacaacaagcaacagtggcagtacatgcaaagaatattgttccgtctccaatttgcgcaaaatatgcagcttagcagatgaaacaacaagctacctctttcttcactgtccttttgcctctggtctatgggcttcactccacatcgatccaggtattgacgatgtaaaacaactccatgcattacaaccaccatcagtcatcccgacagcgcacttccgccccttctttctgctctgcctttggggactctggaaccaccgcgccatgatgccatcttcagaaaccaggagccttgtcatcgtcgcctcctccaacgatgtatcgaagacgcaactctctgggcacaccggttaaagagccaggatagaatcgttgtttccacctggaagcaagtactctcccaccccctaaattctgatcaaatggtgcaattggatctcaaatttattaggaagttcttcctctagaatcctcctaaatggatgccccggtaacccaattttacataagagaggtctaagacaaggagacccactttctcctatgctatttattctagctatggaaccactgcatctgatcttcaaagcagccgaggaagccttaattctcaagaaaatagatccgagacgacaaagatttcgttgttccttctacgcggacgacgtggctctcttcatccctccagaggcacaggaactaacaactgtaaagaacattctccacacttttgcaaggatcagcggcctccacacaaatccttccaaaacagaggttttcccgatagcttgtgataatctgaatgttgaaagccttctaaattcattcatggggaatttaaaaaccttcccatgcaattatctcggcataccccttcatacgagaaaactgaggaaaatagatctacagcctctagtagataaggtgggtgcaagaataccaggttggaagggaagattctttacttcagcaggaagggaagtgttagtgaaaacaacacttacggcaacaccaatttaccacctcacggtactgccacaaatgaaatgggttttcaagaaaattgatcgtttcagacgtgcctttctttggaagggagaggaccctgaaaatgtgaatgccggtagcagtttaattaattggcaagaggtatgtaaaccaaagaatttgggaggacttggtattttaaacttagaaaaatttgcaagagcattgcgcctccgttggctttggtataattggaaagatgatacaaaaccgagggtgaatatgtcagttccatgtgatgaaactgatagatgcctattcagagctgggacaaaaattgagatcggggatggaagaaaaacctctttctggttagacaattggttggatggccaaacacccaaggatctagctccgacaatttttaggcttgcaaagagaaaaagtaatagtctacatgctgatctgaacaacaatcattggctatctctgttaaatccaatcacttccttggaggaggtaaacgaccttgtccagctggggggaagacttcagaacatatccctacaagatggactggcggatgaaataatttggagatggactgaaaatggggtttactcagaaaagagtgcctatcttgcccagttccagggatcacacacaaacgttttttacgagcctctttggaccacatctgcagaaccaaagcatcgattttttggctggttagtcttacaccaacgaactcttaccgcggaaaatctgctgcgctgacactggccatgcgactggatttgtagtctatgtaggggggccttcgaggatgccacacatctagcaaaagagtgcccctttacgaacttggtttggaaccatgtcagtagttggcttgacattcaagcaccacaacaacatacagcaccttccattgaagactggtggagcaccctctgcaggatcaagcctaaatcaagaaggaagcacattctgagtgtccttttaacaacatggtggaatatttggctagaacgtaataggaggattttccaaaattcttcaaaaagcgagctgcaggtggccttcctagttaaagagaatatagacctcatcaaccaatccaggctctattgctgctgatagaacctggtcctcaggcgttctttccttgggttgtaaatttaatcgcaggagctgtactgccctgttgttgttttcgtttatgcaccctctgtaagactctcttgatttatttcttctaatatatacggcaaatctcctgccgtttaatgtttcaaaaaaaaaattctgatcaaatgtaatagcaggccgctggcccttcttttgtttctgtttgtgtttgtatgaacatctctgctttaatttcaatggaaattcaggtggggaagctctcccctccggtgattattaaaaaaaaaaagagtattcagatcatcagatgtatatcaaaattttagagaaaaaggtatatacaatatgtaatacgcatgtgcatgaaaaaaaagggaaaaataaggctgtattcagaccaaaataaatctgaacaactctttcgtaagttcttacctcttctgatcttctccaatggtctaattcgcacaagtttactcggcgccggcgtagacaaaataccatgttattattcccgaaaaaataccatgttattactgttttttttaagaacatgctattaaccatttaaccgaattaaaaaaccctaaaatacccaaacaagtcaatgatactacaccatcacgagtaaaagatctgcaaaaaaacgtagaaggggaaaaaagggagcgacgacacgagccaatcagccaaatgtcacgagtaatctattgaagatttctctggaatgggccttatatgggcctagattctccctctcaaccaaagtgtggcctcagcagcccacatttattttccgacaattatcgggctcggcctcttcgcgccggatcgtctcactctcaccccttccatagtggccagctcggcctcgatccacatcgtcgttgttgcacacagcttcgatccacaccgccgccatcgttcatggctttgatccacgccgccgcaaacatccatagcttcgaagccaatagttaaccctgattttgtctgaactctgatttttctctgaacaattgagcaagatctgtctcctttggtatataataaaattccagcacatacatcactaaaacttgaaacatggaaaggctcatcctggtacttctgaatgttatttcatacagatgaaagcttacaaatgttaaaagttcgttgagcaataggtagtcaaatttctgttctgtgttttgttcataccgtaacctgctcacctgctgctagcttcataatacccaaatgttcagaaatggaattggcgctcgtcgattcgttaaaaaaaaaaaggaaaaacagatgttcagaagggaaaagaaattcaggtgtaatagaagggttttttgggtgaccccaaaattacaagtggaaaatatttgtaggggtaaagattaaccaaacatccaagcgtgcccttagcaatcagaaccgcatcctgggtaggggtggataaaaagcttgggctcgtgagctcagctcgggcttggctcgagctcacttagctcggctcggcttgaatgccaaacgagccaagcccaagtctccctttcagctcgtttctaaaacaagccgagcccgagctggctcgcgagccgcttgatttggctcgtgagcctaggccatcatgtatttatatggatgattttatcttctagtggagttattatttgttaatatgtaatttatcatctatattttgatgaattgaatatataaagttattttaattttacatgttgatgatttgttattgcttttcttaatgattacaaattatgtatcttcaacggaaggctcgcaagccagctcgagctggctcgagctaagaaataagccgagccgagctcatattttaactcgttttactaaccgagccgagccaagcctaacttgttgcgagccgagctaagcttgtcttggctcgtttccacccctaatattgggtgacatagaatgatggtgcaccatagtttcttacctaggacctgtttagatttcaactttttttcttcaaacttccaacttttccgttacatcaaactttcctacacacacaaacttccaacttttctgttccaatttcttcaaacttctaattttggcgtgtaactaaacacagccctagcgtagaagctctatgaagctccagtattaaattctagcatcggtcagtttaggcatgcacaagcacaagtggtatatcgtcagtaacaagaagacaaaggagcacaatcaatcactgaccacggatgaacatattggaccaatagctagtagtaaaccaatcatcagcacttcaaatcaaatggaatgttctatactaagcagctggttccttccaggaacatgaaaaattgaaaactctaaacactagcgacacgctcacggcggctcacccgtgacagatcctgacctctctcgcggagcactcgccgcctcgtcggcccttggaccggcatgaggaatccgactcactgctgaactttgaacagctccagctggttcattgagctgaaaatgttttggatgtttgtttagagatcccctcggaagtgttacaacctgcaaagatttatcgacgtaaaatcagcaagcataaatcataagccagctttaggaagcgtgatcacaatttgccggctacaccaatcaatttgggaacctataataacgggcacaactttagtgttcagtctacttttaatagccaattaaaaagaaaagataaaccatgtcagttcggctagcatcgccgcaatgatattggtaccacgactccacgagacagtgacaacacaatgatcaatgacaatacaataccgaactgcccggtcagacatggctacatgacttgcgcgtcactgtcaccctaacgatcagggcatttatcatgcaaattaccaaacgaattgtccacctctacaactggcaatcaacaagtcagcatcccaaacaatggcatggaatgaacatagccaatctttgctccaagtagacaaattactcccatatatagttatatactctagagtccatatagctagcagcaccaaacagaatgttttttttgggatacgcgagggacgcatctttgtattaaggaataaagtatttacagagcgggccgaaaaatcaaaaacacgaaggggacaagatacaggaggggggaggaggaagaaaataaaagcctaatctcccaacgaatgtggcgaccttccacccgacataggggtcgccatggccggtatcgcggctctagccaaccgccaaaggtctgcttcgcccgtcatggccctagcaatttccgcccatgtcctactcttttggttgaagacccgattgtttctttctttccaaatcgtccacgccaaacagaatgttggtattgagaaataatgaggcagctctcaaaaatgtgaaagctgtcatgaagattgtatgaccaagacaagaaacatgtcaaatatttaagctgcacgattagagaatgatggtaaaaacaaaagttcagaccttctaaaattagagagctttaaaagcagtaatatattcaatcactttcatatacctgaaagccgccaggactgaatgcaatgcgacaatgtcctgaaggagcacttaactattcccggtttactggtttaggcatgtagaatttgcagcatggattcaaatttgactccacgaaagaacctttgcaacaagtggatatcaaataaggatgaggcagagcatcataaatggaagcaaacaccttcctccataccatgatctgatggcctgaacacaaagaaaacaaaatggcaagattactctgtctagtcattcttcccttgatcagtgtactgccattctcatatgcttcacccctgttgatgctaagcaccggctcatccttatttgttgaagagcataagcaaaccttccttacctcaccaaacgccgatttctcttgtggcttctatgaagttggagggaatgctttctccttctccatctggttcaccaacagcaagaataggaccgtcgtatggtctgcaaaccccaagtccccggtaaatggccatggctctaaggtgacactgaaccatgaaggtaacctggtcctcgctgatgtcaatggcaccgcaaattgggacagcaagacgagctctggcaagggcacaacggctgtccttcttgacactg

SEQ ID NO: 66319 - DNA, 716 bp, Oryza sativa
tcgagtgtttgcttggattagcagatctgcttagtaaggtaaggcgtcatttgccgatacgaattaggcattgttatatgatgtacttccggttttggttgatgcgtttttgctttgagcgtcattgaaccgagcaaatcctgatagtagctgtcacctccaaattagtacgccatcatggtgtgtgatacacctccacctttgggtagtgcgctttatggagagcagtaatgcgttccgttttaagcatgggcaaacggagcaaaacattgtatcctcataggtagaggttgttactaaatctaaccgctttaagcggttaaatgaacggtattgagaccagacaggttggtgcatggtaatatcattggtggagaaaccatctttcctcccggttcgtaacccccatttaattccagttatttaaccggggctacaaatccgggactaaagatcgctatctttagtcccgggtgaaataaccgggactaaagatcgatctttagttccggttgttaacaccaaccgggactaaagataggggattaaagaggagataacagcagtctaaatgccccatccttttttttttctttttaattttctcccaaatcaagtaaaatgcgtatcccaaattaaaccccaaataccaaatcaaggtaatatcccaaatctacatcacaaatctttaaagttacttatacacacaaatcaaa

SEQ ID NO: 66320 - DNA, 22077 bp, Oryza sativa
  unsure (1)..(22077): unsure at all n locations
ttgccttccattgcaagaattccagcatggtacccaactttttgtgtacatgttcgcaacctgggtgttttgtggtccgctaacatatgctccaatttctagacctcctttttaatttcgcaatccttctttacgtcacacaacatctcaccaagatcatctgcaccatcgttttcttcaacagctccgtctgcctcgcctgttgtattttatggaagtccatcgtattgagcccaatccggaatgttgtcgtcttcttcttaatcttcttccattgcaacctctaactcttcgtgcgagatccaacaattatagctaggcatgaatcctgactaaaacaagtgcatatgaagaattcttgatatagaatactccatctggttttgcacttttcgcatggacaatatataaaacctttaggcttgtgggcattggccacactcaaaaaaataatgcgagccattaattaattccttcgatcgtcggtccgtggtgtacatccatagccgattcatctacattaggaagtaacaaatgtaaaggaagtccatgaaagtgaaactacttcaatagtaatacaataatttaaaacatcgtaactaaactgaaaactgagggtaaacatttttaatgtattcttcttatttctaacgattttaatgagtttaaagatccgaaatatttgttggttttgccgatcgagcaaagatcggttgtccagtagtagtgtcagtagtgtcttatgggaagtgccactgatgtgaagaaaattttgctaaagtgactcgttaactttatgttgaaattctctatcattaattcctgtagatatgttcaaaactatctaaatagttcttttttttccaaaaagcagttgttatttttccaaaaagcacttgttatttttataaaatagttctaattagtttccaaacatcccatcttttctagtagagacactccatctactagaaaagactaagaaaattaaggtctactgctggctcagtcgctcagatgtgtggcaaaggtcaggatcactctcttgctgatttgctgtagaacaaaagatgattctgcatacccttgcccggacgcctcaaaccgctgctcttatgtcatagaacaaattgttgatgtcacttagtagcgatggcccacgtggcacctacgactggtcaaaaggccatttgatcaccacacgcctgcttgcgactgcgaggatagctgagcactgcacacggacgcacgcatgcacagccgacttggatgttgtggggaattcccaccgagactactacaccggcgttgttcgcagtttaagcatccaaataagtgcctttttctttccagagacctctcaaccccatcacattttttccacagaatttaaacattatatttttactagttatatattgctcgtgaaaggatatatatgttatatggtatagcatacaaatatccatgatgtagagggccatgttctttaattagttatatttattgaactggggataaatgacaagttcagtagaatccatgaaaatgcaatcaacaattatctatagaaaccaaacccatgcaccccggttgacatcgacggattttccttgcacaacgaagaaagctaggttccggcataattggtacatgagattggttggacttatttaagccaaacacattgaccttgtttgttcttaattagacgtatttttaagctaaccttttgcttatacgtcttataagcaaatggtatcaagcctttaagtttatagtttaaaaaaaagaatggcttatgactttaaaaagtctaatcgaaaaagctatttgtgtacttaggcttagactattcgactcataagttagcttaaaaacctaaacttaatatgatgagaaatttaacaatatgcatgttgggtacgatggtgggtacgatttcatgtttgcatgttgcaaatgatttttttctcctaaaccatttacccaatttgtgagtcggtttaactattctattaattattattaaatctgtgaaacaaaatgtcaggtgattatactttattaaatatgcatatatacgataagcgggccacataaaatttgggcttatccatctatatatgttttatctttccatccgaactataaattggatgctcccatccattaaaatcaaacagaaaatttgatcgctatatcgaatagattagggattgacatatcccatccacccacgaccataaacaaaacacacatttgataaatctaacggacaacacattttcaaccaagtgatttaccacaacgtgaaaaataaggatagagagaactttaagaacatttctttcaagctttcaaaatagagctagctactatgtaccaacagttattacatatgatttttacaatacatgctaatgtcattggtgatggttaatggctaaggcacaaatccaacagtgaatcacgatgctgagattcaatgtgaaagcgcaactgtccttgtcgagggacgatggaatcacgttggaaagccctgatgttttgttgtgcacccgccgccacactcaaggccgagccgacgacaattgaaaccgctcgataatgagggagctcttcgatgagaccttgctgcacaccgtgcacccctttccttttttccttccatgttgaccgcagacgcaggccaacaatctcctagtgcctcccatgcatgcttagcaatatgtttgctgccctgcaggagatgcatgctcctatcctagctagcgtgctaactggctgtatgactatgtagttgtacttatatacgacgggttctaaatctcggagtattgaacaaccatcacgcacacaagtgtatatcaaatggaaatagggatggtaatttcctctacgggccgggtccccacaagggacccaccccgcatttgggcgagcgaggcattccacccgctgggtcccggggtaatatattacctctcaaaatatagcctattgcaggtccaagaagcccatcttaaaatactaggattctaggatacaataaaaaaaatctaaccctaccttatcctcttgacccccacgccgcactcactagtcaccactccatctccagatcttgtctctctctcgccggtcaccctccctttctggatctcgcctcactcgacgctctccctccttacagccacaggtcaccgccctctccactccctcccttcctcaccggttgccctctcccctccctttcccttccctccctcaccggtcaccctctcccctcccgtcctctcccctgcagtctccacgtgatggcgtgtgacacagtggcggtgcgcaggtgcagtgagctagcgcacaggtgtggcgcggcatgtaggtatgggcccacggtgagcggagttgtgtggcgagcacaagattcgcacattgagaggcatttgtggtcatgcatgcattgagttcatggatggaataatgtatcatggaaatatttattttcttgatgaattttcgatgatgctattcatgtattcatgctattttcgatgatgtgtcaagtgattggatgaaatgacttcccaatgcggaggccccagtcaggttacagaaccctggaggggtcggggacgggggctgatttggtgccgcatctccactggggaccagggccgggtggagaggtccggggtcaggggcaaggccattccagcccaacctgctccgttgcatccctatatggaaaccatcattaccatcacatgtagtgttctttagcctatggatcccacgtgatatctccttaacgatttagagctcatcttcaaatatgtctagtcctaatccatcaccggctatacttccatggcttcgagcaacacctacccattaaacaagaaagaaaccatatccgaacacaagttcaaattaacttgactcacattagcacacaaacatcgctaaaccgcacccagggtgcgctatatctaaagcgctcccctcacatgcctcccacaccttttcttgctcatatattctttctttcagcaaataaattactcatagtaaaatctttctattagtaaataaattacaaacagatatgttgatctttacattgttatcccacaccttttttccttgtccatcctgactgccaccacacatttctcttgcatacatagtcctcttatagtaaattaattacttacagttattatattgtgattagtaaatggactactcggatgccttatcttagtaaataaattactattactcgtagttattatgtttttgttagtaaatgaattactcgaacatcttctcttagtaaataagttactccttgcaatacattctgtcagtaaatcaattactccttccgatctcttctttaaatttaaaatatactaaaattctagccacataatttctcctagtaaattagctactatccgcaccaatatttctccctcaataaattactcatagttattgtccttcccttaataaataaattactcttacttctcgtagtaaactaagaagtccttctagcgatgcttctcttagtaaattaattactctttccaacaccatctttcaaaataaattactccagggagtaaaagaatcacaaacatattgttccaaccacataatttaataaattcttaccaaaccagaaaatttttcaatggtattatatcaacgatctgatcacacatgcaatgtggtacatcggtagaatgcagagaagtaattaaagatcacaacagctcccgtaaatgaatcacaacagcaacagcactgatggatacggtgatgaagatttgatgccaagactaatacgacaatctagatcaaggccaatgacgcatctatgcatgcacgaatccaacaagcaagacaacaccaataacataaatcgacgttgagccgtagaggtgctgcaaattccagttctctctgtcgacagatatctgtcaccacggctgtgtggagaggcattccatagccacttggatataaaaaaaaaatgaagattgcatctaagtatcacaaaacagcaaaataaatatgatttcacttaaacctagtatttcatagccataatattgctgttgtgaattgctttgccatagaagaaagcaaacatatttatttttttcctgctggaatataactctgagaatcaacgagatacttaattgaaccaatccccccatcgtacagtttattcaccatgtaagatgctatagcagaagcactgcactagaaaggaaagcacaatctgaagttaatcatgcaaatggctgagatgcagcatccacctccatggcaatgcatcaacaaaacatgaacctccatgaccaaagcaataccaagaaaataagaaccggcaccaagaaacccaagaagcgaatggatccaacgatgatgagcatatacgaggacctccagaagaccatggttgcggacgctggtaacgtgtgcggcacaaaatctttcttttgttcagtctgaagaattttgttctatcgaaaagcaaagagaaactatagtgtttagaaaaaaaatcaatgtatcagctcagttgaaccacaaaatttcagagaattgctatccaatgacctttataggttgctctagctccaacttattcatccgtaaggtgagagtcccagttgagttagtaaatattatttactagcataagcatggtacttaggctaaataaatgtcgttggatttaggtgtgccccacggaaagtgaggtaagcggcaggtggtgacagccttgtccgtcctatattttcctccacatacgtatatgacataagagtgcgtaaataccataaccacgctggcggaccagctgggagtggtctctcggtagtacctaggtgactggagtggtcttggcggaccagctgggagtggtcttatgttgtaagcatgtacatgttaattgttgttagaggcatgtcacgagggcctttagccaggctttccaaaaccacaagaaccatgaggtgttggccaagtccaggaggcaaagcagctgagcgaagctagatgatgaaaaccgaatggtccaccaccaagcccactatcttgacaagtcattactatgggcgaagaccataatgcgaagcaggagggtttcgcctgagctagaagcggcatcggtagagggcttgggagacaccgcggcccacagatgcttttcgccattcatgggccggcccaaggagttcacttaaaagcccataaacacaaaggacactgtgtgccctcactaaagtccctatcataagggtatcgatgtaaattcccatgtacaaactaaaccctagagggtatgagcctgtactaagactataaatagcccccttgggccatataatgggggatcccaaaaaaatttttgtaccaattaatatattgctttttactattctaacaatctaccaagtgtaccacgtctttcgacatgatgcagttgtctttcgacaacaattgtatactagacatgattagtatagaagtatagatgaatcgtaatttccaaatgctaatttcctactagacatcctatcttgctataaagttataacctactaattctaaagctcaacatgcaaacatgacacctcatcacccactagcaataattacatacaaaacttatgcaagcatgcaacatcatccaattatcttccttcacattatttttcacaatatttttaatatatatatatataaccatcatttttataatacttaacatatattcatccatataatcaaagtgcgggatatcatatttcatctacaatttcatacattgtccactaaatttatttctctcttaacatagtttgacaaaccagtttatttgttattttacttttagctcggttattaaaaaatattagaatttacttagtaatttccacagcaaagcgcgaggaataacctaattcttatagagctgaatctcctgtgtgtccactaccatatccattattatcctaacccttgtttagactatggtgaattaattataggttgattaagcagatataaaaatcataactttatgccgccgccttccccgtcgaaatataaatacgatactcttgagaatacacatgggtgaaatgctacagcgttatccgtgcacttgcggattcatccatgaacataagaaaatacaaacaccaaccacaaagatgacgataataaacagatgataggaggcgaggagatttcttagctgatcagatttcggcagcgatattagttcgtgataggtccttgtgggcctacgttaggcggtcgtcaatagtgaaccaatgtcctccatgacagtgctgtcttgaaacttcggtgatgttgatagatcaaattggtgcatgacgatgattccgatctggtcaaggaacatactctggtcgggtcagatatcctaggaacaaagtcattgaaatatcccttgtctaaaagtccatagcgccaatatcttgataaagattgagacagcgagggtcccgatccataggagagtgcaatctggtcgggtcatatctcccaaagctaaagttgaggagttttttgccggaaaatccgtcttcttgaaactcatcttgtcgaaacgttaagcaccaagttccctacctggcggaatatttttgaggttggatatcctgacgatgacatttgcagagtatggggatcatttgggccaagccatacccgagattgaggtaaaaaatataggagacatatttttatacatgttcggaccccttaactaaccggtaatagccctagtcttgttggctgaagccggtgtagccattatatatcagtatcacattagtacaatatttgggataacctaatatagtctcggttagtttggcagaaaggagttctcacacgtagccgatggctagcgtagtcttcgtcctcgaatatgaactcgatgagactgaaggtagcgctagatctctcttgtcggtcattgtggctggcccccgattgagtatgtctaggcttttgttgttgtctgttggcttgtttcctctcctccaaggggtcttgtatttataccctcgaatgtccccctgtcgaaggaaaactagggagacaagtatggatacgatccgagtagttctatttttctttccttatccaaaacaccttccgtatatcaggcatgattctgcataaaacttggtatatggtgggctacgtcgataccaatccaagactattgggtatgcccgatctataacactgacggttagtataataaacttataccactaattttgatagtatatttggcatcttttatgcaatagctaacggttaaagtttgcacttaaggaccgtcaacagtaacgaaaatgatggctttcattgtaaagtattgtcttaaatacttatcccacacattcatcccatcctaccataaatctttcatatctttcatcaatggctcatggacatggacaatgtatctgtgttccaactgctcaacttcttttcaattctctcctctttcattttccaatacttgttatttaactttctagaatgcataggaatgccaagatatttaatagggtaagacccatgcggcacccaaaaatttgagaatattgttcttaacattcttttgcttcaccaaagcaaaagaattcactcttatgaaaatttattttaagaccacaaagcttttcggacacaaaaagaagtaacttcattttcttagaattttctaaattttctcaatgtgtcatccgcatactacaagatagacaaaccctcatcaacgacatatggaaccaaccatttggccatctgaataagtacagccaacatatcaacaactatgttaaacaagattggagagagaggatcaccttgccttaaacccttccaaggtttaaaatttggtccaatctggtcgttaacttctataccaacattacccattggatgaaggaatcaatccattcacaccatttagtggaaaagcctttcattctaatagtttgttgcacaaaagaccaataaattttatcacacgctttctcaaactcaatcataaaaataatcccattttgttttttcctatgcaactcatgaatcgtctcatgttaaataactacccgtccatgatattcctaccatgaataaaagccatctgagttgggcttataacattttgtgccattcccataattctatttgtgaccaccttagtaaatatcttaaaacttatatttaattagcatattggcctatattgttgtattttagtagcatcgttagacttgggttacaagataatcgtaccaaagttaagcgaatacaagtgcaatgaaacattatgaaattattgcgttaacaagtctagagaatcatcttttataacattccaaaaaacttggtaaaactcagttggaaatctacaaggaccgaagctttgttgtgttccatttgaaaaattgcctctctaacttatttttcagaatagtttgcttttaaagcctcattctcaattcgtgccacttgcggaatatcctccatcctgttctcatcaagagagaattgtgttttttcagatggcccaaaaagacctttataataagttgtaatatgcttttttaattcagcatacccacttattatatgatcaccatctagcaattggtatattcttgtttttctttgcttaccattagccagcaactgaaagtatttggtattggaatcaccttccaacaggtcccttactttagcacgttggtaccacttaatctcctcatatcttagaagcatagctgatctattattcagaagcatgcctctgcctttttgtcctgactatataacctgtccaacaactcttttttctgtttcctaaatgaaccacaaatattttnnnnatcctctcaaatgctgtcttatcttagcctacgtaatttcgcttgtcacctttcgttggagtattcccaacctgaacacttgcgcatacctccttaaccatgtcaaaaaaaagtcatctcgcaattaccaaccaagttcgaatttgaaacttggaaggaaacttgagaaagctgagttagagtttaacaataatggagtatgaccagaaatatctcaagataaagctaaaaccgaagataaagagtttatttcctcccattcagtagaaattagaattctatctagcttttcaaaggtaggaacagtaagaatgtttgcccatgtataattcttgcccgacatttgtaattcccgtaaatttggaccatcaattacagtattaaaaaggaacggctatctatctatcattaaagttagaattattcttttcttcaggacttcaaaaaatattaaatcgccgcctattagaatcagtaaattctcatgactacacaaatggactaactcagcaaggaattgttgtttaaattcattctgtgcaggcccatttaaacttatcactcttattacacaaatgaaatttaatataaaaatcaccctcttcaatcaagccaaatccacacacactgtaaatcgacaccccacaacataccaccaaatctacccttaggaggtttcagtgccaaaaaaatctttaccagcacaaagatttttaagggcatttgtcgtaaattcactcctaatagttgccgcaatagcaatgaactccagatgatgtttttttttgttaaacctatctctagtctcccctttatctcttcgtcctcaaccaagctacgggaggcgagctcccatcaagcacctcaattcatccacgcacataacatgatggtatgaaaaatgtaatattctccactttagtctttattaattaacagaatttgttccagcaagaaaaggctcagtgcattattgttggtagtgcgtgttgaatttattccctttgctgtgcaatcacgaactggatgcaatattctgggagaatgttatacttggcatattcttcaaatactggtgaggaagcacacacctttctacatcggttaaaaaagagatattggactatcagaatttgcaaaatcgaaagtatagaaatatcatctttacattaattccaggcagagtggtggcactcgtacagaaatagcatgttgcactggtccattattatttttagagtaaatttcagaaaagccatgtttttatggtcaaagttatagaaaatcacaggtattatgacatgtgccacataaccacaagttttatggactatatgtttcataaaactttacctttattaaaacattgattaatcacagcatatttgaagcattatttttcaatgtagccaatatgtaaactatcaaccttaatcaacaaccaattttatatacactctatggtttagaattttaagtattttatactcaacatgcacaaaggtgggactagtataagaagggactattgcaaagtatatttactgatgccaatactgtcactgtcgtggaggagaaggaggctgccattgagtacgttgaggcggagctggccatgatgacacatcagcatacagaaggggctgcagaagtagtggtggttcgggtgggtagatgtgagagggagacaggagatagagtgaagggggaaaggataaggacgaggggagaaaatgagaatgtgagggaaaggataaggaagcagctgtttttttttctcccccgcactcggcattgctatctgctcgatatgtgtcggtttaataaaaactggcaccaatgtcattttaaatgcaccagctaataaaaaaagtatgggaaatatatatggttcatttttattaaagaacctgcacagacgaggagttatcagtgccagttttttctctctcaggatgtggcggggttgggtgggcacgaaccacttatcattaccggtttttcctaatccaacgcatataacgttgtcccctattaggatttctgtagtagtgccttaaaatctgagatgaacctttccattctacttactgacttgtacgcctaagtttggttttgatccacttatacttcttccttggtgagtcgtttaacaaccctgcgaaatttatattagttttatccttgaacatggacgaaaatttaaaatttatagagtaatgtcatcttatatttacctataatattaacttcgttctatatatatgaggccaaaatttaaaatatattcaaaaagacatgcataacattattttagattcgatgtacaaaggtgagaccagtatagcaattctcagatactgcatacaacatccaaaatttgtcgtatatagcatcaaaaaaatacaatataatctctttagtgtgtattaaattttatcttgcattatgtaaaaataaacttgtttactaacaatatggcctcatactgtaaaccttatgattaatatgaactcatagaacaaactcatgtactccaaatattcttacattcctgtcatgctcgaagggtaaattggacttttcagagctattaattggtcagctaatgataaactgatagaatgggtatgaaaagaatcaacacaaattcaatagtatgcaaagaaagtgagaataaacaggggtataaaagagattgacaaaaaaattaaggccatacaaagaattctctctttggacctatatatccgtctatctatctatagtgtgggatgctcaaaacccaagtatacacatcttagctagtacaaatatgaactgtttctaatcttcctggttactctagtgcagcaagctatacatttgcgaacttaagaagaagttagctacatcagtcaaaatggtgtgttatcctcttcctccctctaaagattttatcaacattttccacattcaaaactgtaacaacataccgatctgtctgtggatgatttagagcatgatagttaccaagtttggtccatggggaggaccaggcggagattatagagacgttcaggtggctccttatcggctcgttcgcctaacaatccgcagcggagacaccgtcgacgggatctccttcacctacatcggcaacgatggtctcgtgtaccacatgggtcattggggttccgatggtggtgttccgcatgaggtaaagtctaccactgatactcctctcttcctctatctctttctttctatgtctatgtagctgtggtttgcatctccaatatttatatataaagttataactagatggtactccatgtgttgctgccgaaattcatacaaaatgattagcttgaaattgtgttggatgatttttttataggtaatgttatggatgaggcgacaatataatggtgcatagaaagtgccataattctcttaggtagcccaagcaaagcgttgcacactgtattagtagtactattatagtaacatatccgaacaaggtttagaaggatccagtacagctacaaacatctccgaatgaggttaagttttgcactgggctctgaaggaccgatgttgatattgatgttagatacaagctaggaaggtagcccgcgcagttgagctggcatcttatttaaactatcatattttttgtggttaggattttgagtattatgactttaatttgtctgtcgatgaaagaatttgaaggttcctttatactacatgattgaaaaaatatataggtcagaaatagtttagaaatgcatgagtaaaatagagtaaacaaattttggaccgaggacagaaataacatgaattttaaaatttgttaacccacatagatcaaatcatcatctatcattgcgtaaataaactgcaattaaccagacaacctttgcattagcagcttgattgtctccatcccatgcgaagggaaaaaaacatgcgcatgcatcttatttcaattttattaattttattgtcatagacatatgctgcaactttttatatgcaccatgcatggatacctcgcaagcaatatgatttagggataagtagatagtgatagtgaggatatacctcctaagttagaattgatcaagtatattgtatactacatattaagcgttttagtatctaagtaataaatttaaggccgagttctaaagagcttattggattggctactcgcttatttatagtgagcacacttcccaaacggctaaacgtgtaatattttatatttttctcataatttctattattttctcaatttattatagtatcaggtagtagtttaagagtcttcgtatggtgtttaatggacttaaactttcctatgttttttttggcatggtattggttggttatgaatttttccttcagaattactataatatattcatgcaaatcaaaggatagtatagatatgcaatcgataggaagcacactatttcttcctacaatccaaaggagctttgaattttaattttaaatcccaaatataattttgagctgaattcaaactttttaatggtgtattgctttttggatgttacaaaagaaaacaaaactaaagagatgaacgtggggcctgtgtgggtacttatgtaatgtacttatgtgcacctagaagtggggattttaagagataaatttaattggtagtttttttaggtagatgtaatggataaacaatggatctaccacaataaataaaaaccaacggttaaatacatttttcttagaatttatatgatttattacaacgccacgtggtggcttataagtgtttgtagatatgctatgaggcgggaaagaagcgttcgtagggatgatatgtggcagcttactagcgtacgtaagaagtttaatgaactttcaatatataatagatagatatatagatagatatataggtagattgtcaagaatagaaaaaattgaactgagcataaaacctgtaaatatgaaatttacactctggaaaacaagttaaaattttaatttgaatgttttatgaaaaaaatatagcggcatatataagtattgatagtcctttagtcaaaacttgtgaattttttaagttatgaaaccgtttttttctttaatttgtgacatgttcatgcatggcaatgggcaaaatccgatgatttatagtggatagaggtttgaaaccagatgaattaattagacatgtactatccaattatgtaatccatgtaaattgtacctgcagattcatctcggccttatggactttgtgatggaaatctctggcacaacgggcatgtgggtcagtggaatgagtaacgtcctacgatcactcaagatcaccaccttgaaaaggacttatgggccatacggcaaccctaaagctgggatcccttttagcttctcagttgatggcagtgatcggatcactggctttttcgtacgcgctggctttataaccgatgcaattggagtctatgttcgtcactgctagagttttaggctagaaaaaatacccatgctttacaacgggtgaaggttattttattgttatatgatttagttaaggtgaaattcactgtgggaattcacttggatatatatttttctaaaaaatcatgagctgcaattaagagtccgatcatcttaagttagtatgtgagttttttttaagaaatatattatacgactccttccgtatttccaaaagcgaacgggcttaaaacccgactcaaatacggatctatattttcaaaataaaatgaacttaaaaaccaactctatatatagatgacataccaaagcaaaaatatcttcaaattttatattactatagataatgaaatgaatctcgatctttgccgcactgaaaagctacagccgctgctagctacatagttatccacattttcaaagataagttttttactcgattaattctcagtgcctctagccgggtgggtgccggaagtagtttctacccatgtagtgatgtagacataccagcatgcaaggacaatattggttctccaacaattatagttcaatagatttaagtgaaatgtaataaacagtgcgacaatatattaagtgaagtattggattagacatattagtcgtcaacctgtgagttgcacatgtggaaatatttaaatcaaattgaatcatacatgtggttaaatgcattgttattttttccctaaaaatgattttatcatgatcgcagctcaaaaaacgggtgttcccaacattacaatgattagaaaaaaagataatatacaagcactatgagtatttggattagtgggatccatacacacataagtaatactcactctcattgtctatgaccacagttgacaccttcccatataataacaatgatgccgagtagtgagtaggagagatactcaataggatagcttaccagtccctccccaagatacgccggtcaaactacacaaggtggtgtatacataccacagataagtcgatctataagggctatcccataactatctcaagtgttcaaaacgcatacttgtgctcgactaattccgatcccagcaaaagaactagcctcccacttttagcttaattaaccaagttatcgaaatatggtgcaagaaggataatttaagaaaaactagagacatatagccaacttatatgcatatggtagactggcgtaatagtaaaagttcagtggactaggggtaggcccctaggtcaactagacttatactaaacatgcagactgactaggggtaggcccctagttcaaaccatcctgaagaagttaacaactagtgatatttgcaatcatatgacaatattgcattgcacaaaaggagatacaatcattttgtcttcatcgctcatgttagtttgatcgttgtgtctggtaggagaactaatgcatactatggtatcttgtgtaagatgcgcatttatggaagtacacttgcaccatcaaaaaacttacttacttgaaatgattttccttgtctgatcacatgtgactgatctagttatgatgcctacttggtcatatatgaccacgatcactctgatactcctgatgatgctctaaccattatatttggcatctcaatggaactcttcgtttgcttatttttgaaaagtcgtgaggcctcaataggcaaaatacaagaagaatcagatcaaaattaaggaaattgcaaaaaaaaaaaggtagtgcgatcaactgatgtagagtcctttccgtcttgaatgtcatacaaatgatctgaatattcggaaccatcttcacagctgacacatagagttcagttgggccacctgaccagtggctcaattgataccattaccatttgttaaaagcgaaatttaacaagattcacatggatttggagttggatatcgatgcggaatcaaaggagattgaatcttaccaaattcgaaatgcgcatcggctggaaacatagttggaaacggattgagccgatatggcaggtagccaatacagcttgacttgggctcggtttgggtttagattggaataactgatattgccgtatagagattgagctcgcctaaggcaattgtatctattaattaggatatttatgtcggtttaaattagagatatgataagagtttgccatgtggacttgttcgtattttatctttaggaaagcttgagtcgtgtccgtaatggacaagttttgtactcagggtatcaatataagccccatacaattgtaatagacggatcgaatcaatacaactttcagcgcatcgccacctttctcttttttacttttcgacgagttcttgtttcaagtcggagcatcggttgcgatctcgcgatctctcaacaagaggtaacttgtcttgatggcttgcgctatcgaggctattatgtcgctttagatgtattagtcctattatcatagtcattattatcatatatcttaaataatcctgacttagtatctcgatttagtcatatcgactgtttctcactttagggtttacgctggcatcgactaaatcatcttactaaattatattaactaagttatctaccatcctgaaaagcggttaatgacttgattgtctagactttatgcttctttgcatactttgtgatgcatcatacctaaccgtgcttagaatcatagaaactaactaggaattaatcataactaaggatagtatcggggtttcatccgatcttacctaatatacttgatagcgcatatttcctgatctgtttatgtatattttccatttatatagatagagattgatctcacttaaacttcatatttcgtgatcaattgctatttggtatatttatatatattgatttgtttacataaatttgtattgaagtattagccagcacattatctatctttgctttaaatactgatctattggttacttccataatattgtcttaaaataattgatataaaccaaggaaacagtattacagttgatagggcatatttagggttttaatctgattaactattataaagtcgcaaccaattaggtatacccatatcggctaggtcctgacgatacgtcatcgggcctattagcagatccgctactattcatctaattatattttctgtttctcttgctggtttcaggatcaaaccagctggcacgctcttgacactcgaggcaagcgttggacctgcactggagtgaaggaaaactcctagggtgccgtgttttccatcaacaccattataccatcggcacgagtcattgatcaacttgttaactacgggcaactacatcaagcttttactgttgcatatggaatgtaggagatacattagggatgctggcatcaggaaaccttttttttggaaggcagagaaaacataaacattttgctagttgctgtcacgtagattaccaaaatgctcttggtgtggtgcaacacatccattatgaattttgggatgtcatgggcataatagacattccgaacaagatttcacttgatgacttcgtgcatgaatttttgaaagtgtcgtatgagcaagactgttttggtataggcaggtaaaaaattgttgatagtccaactaatttaacaccgaacaaagtatgacactccggtgcattataggaagatccagtcctaagaagatgaaggcaaggagtctggaagtggaagatagtgttcgacggatagtccatttaatttgttgacaaccatttcacaggttggcacatgttgattccaactacatcgtattctttgttctatttggatgcaacctaaactggggtacatacctctggtgtagatgcctacgtagtttattgctcaaacagaaatttagtaactctctgaaaaatccaaattaatatcgttgcaaagattcaaaaggtattgactgatgctgagtaaatacatcacatgggtttgggcaaaaccagggtgaaccggcaatattactcagtatagagttcacacacaaccggttgtaatgggtcggtaatgatgttttttgtagaagtgaatttattttattggttattatgcagttttaacctcaataattggatcgcctaattgtgcatgatatgtgaggttaattatatgtaatttttcgttgtatatagctagctaggggttgatcaaatttcctctggtttgtttatctttgtatattttctacgtcatagagtaattgtttcctatagattgtgctatgtttagcaataatgcattaaacgtgcttggcttcggccgtttcactaatttatggtaactttgagtagcaaagtgattttgttacagataacacaaaatatcatcgttccaaacaaaattaatgggcctatgccgatggaagatggaacaagcgtactgaaatgtcaaaacttccctctaaagaaaatgtaaaaacctgatagtgaaattttgggtactaaagcaggtagttttccaaatgaaaaaaaaaaagaaacaacaagagatgaaaacagtctaataccgtatttcattttcgacattgataagtcgattgtacccactgtaaccccccgccccctctgtttgatattataagaaagaaaagtaagaagcaaaacaagatttgataacctattgtacccctctgtttgatattataaaatgttttaatatttttcttcataagttttactccctctgtttcaggttataagtcattttgactttgatcaaagtcaaactgcttcaagtttatccaagtttgtagaaaaaataataatattttcaagccaagacaaatttattatgaaaatatattcaattattaatttgatgaaactaatttagtattgtaaatattattatatttatctataaacttacttaaacttgaaacagtttgacttttaccaaagtcaaaacggagggaggaccaaatttataaaagaaaacatagtagcattttcaacaccaaacaactataccgttaatatatattatatgttagtttaataaactaatttgatgctgtaaacttgattaaacctacaaaaatttggcttagaaaaaaatcaaaaagtcctgtgatatgaatatgaaacggagggagtatttgatattgatcggcatacaaatcctgcatctacccaaaacaaatcaaatgatgccagccaaatagaatggtagtaaaaagtaagaaaggtacaacagtccacacatagtgacaaatcacacacaaacgggtagcagcacaccacacattattacaccaagcagcaatacaggatgaagagttcagtagttcagccactagattattctgttaatgctgaagctgatgattgatctcgtgctcttgtttattctacccaagctatgaagctaggccaccaaattgagcaactcaaattggatcatcatctgtccataaagatgatgcatcgtttctccatggaagtccagcaaaggcaacaaaaaccaaacagaaatcacggacaatgcggatgcagatcgcatccatgacgggcaaaatcatgcagatgcaaaataagcagcagatctgtctgtagacaaggcatctcttccttgcaagcgagacgtcacagtgtcatgcaatgatgcaaagagtacaaggacatacataacttatcattgacttgaagaaagcagagtaagcatctcttctcccatgacatgccaagccgtaatcatttgagatagtagggattactggctacctgtagataggaacccgacggcgtgccagtgaaaggcgttatagtcagatacaaatttaatttgtagcgaatgaaaaacactgaatttctgatatttgtttcctaaacaataatattaattaaactatgtagagaagctaatggtgcaaccaatgaaatcaactcatgcagatgaagtaataagcaagataggaaggacagagggtaaataagtgagtcaatcacctgagtagggaggttctccgcagggctttcttgtagtagtgcgagtggatgggcttgtagagggaaggatggtggttggcttccatgccttcccactcaaggccatcccaccattccttctcgcagtccactataggtggtgtgctatcgtggcgaccaacagatggcagccgtttgaggctccaacagcccctgatcttcacggtctcgagctggggcgtggacatcttgcggccgcagatgcgctgcagcttgggtagctcgtgcaggtggatgcgctttagccttcggaatactatagttgaatcggaatccagtgggaagacatccttgagtgcaccgcagcacacgatttcaagtgttttcaagctacggcatccatttgaatttgatgagcataaggggagtacatgtaccaacctggggcaccgatctagatgtaagaacttcaggttctcgaatgaattgtagctaggctgaaacaatgacgtgtcccagtcccagatgtagaaaacctttaagagttgagatgcccagaatgtttcgagactccggaaaatattgtctcgagtgcaaggcgcagtaaaaatagtgccttctaagttaggacacctctcaattcggcaccaccatagga

SEQ ID NO: 66321 - DNA, 1289 bp, Oryza sativa
ttccccgacgcttttcaacatcacctggcttttttttctctactaacctaatactattgttctgaatatcattattcgccatgctcctctcattcacatcccctctgttcctctgagatcccttttgcctatcaaaagatgtactccttccatcacctgacctctcgtcccctcgccgaacaaccggtgcatcgccatcgcctgtaaacctcctcctcgagctccttccatccgattctgtgctctctaaactcttgctcctgtccaacttcaccgactccatgatcttcacatagtcggtgaagtcgggctaaacgtcagctccttctcgacgtgccgcaactcggacgaaccgggaccagcctcgccgccagccaccgcgcacatagcaccaaaaccatccgctctcgcgtcagaaacccggcctctcctcgccaaaccccaaccaaacggcgccacggagaccctcctcctcctcctcgtcggaaccacgaacccgtggcacgcgctcgaatcaggcgccgaggcggggagcaagaccccgcgccccgccaggttgggaatcagccccaccgtcgcgctcggcggcggcgccgccatcacacacacacacacaccacgaggtttcggccgcggcgtggctaccacattctccgccggcggagcaactccgagcgaggtaaaccccttcccaaccgcaagagaaacgcacggcgagtgctggtcggagcgccggcgaggctcgagctggtgggttgcggggaggaaggagcgcgagtacctggggagtttgcgccgcgaggcctccgcgttatctcctcctccgccggtgcccggtgccgtcgtggcgctccctccggtggagcccactttgtgtagtgtctagtgcagcgaatatatttccgcgtacgggccgggccgggccgacaatctatgcgttgttgggcctccaaagggtaactcaccaaggtgtggccgagccaagccgaagacaaatttgggcttaggctgctcgttcactgaagaagatttatctcgttattcatcagcgttctaaattactatatggtatgtttttacagaaaaagttatataagaaagttactttaaaagatcatacaaattcaattttctaagttaaaatcctcgcagacaaattatagttaaataattaatactaaattaatcacatactaatcgctcatctcattttacacatcttctcttttcccctccccttgaacactcttagtttggcaaaaattgacaggcagaatgtgcaggtgcac

SEQ ID NO: 66322 - DNA, 655 bp, Oryza sativa
tttctctctttgatgatcctccgtttgactaaaaccattctgttgaagagttgcgttgatttattgttaaaatggacgttccttccccactacttttctcctctgatctatgtgcggtttgacttgagaatacatgttagaaaatgcagcaatgcttcagttgaatttctggcaacacaagcatctatcaactttatagcccagagaagttagatgtgcaatgattgacttgttgtatttggtaacagagcctccttggctcctttggactgtgggatttctccggattcttgtgaaaatcctttagattcgtgcaaaatggtcctgcgttctaaaggaggccttggtgcaatcagctcctcttccagccaaacagtcaatacaaagcatcatacacaatattaattccgtcccattttgatttgaattcttatttctttgatacatatacagtattcagaatgtccataaaatgtgctgtagaaattaattttccctttagaagcctgtatggaagtttaaaacataatgttgatatcattatttggtttatttaaatggtttcttgactcagccaatgtgaacaagtggccagatggtacattcaattctgtgacagggagatgttgactaataaagtgagattatcgactaa

SEQ ID NO: 66323 - DNA, 8800 bp, Oryza sativa
  unsure (1)..(8800): unsure at all n locations
cagtatgcatttctcggctagcttctttaaaaccataagttgcagaaatattagcagtagatgaaatctcaacagatacacggttgccaagtctgtcgtgcaaaagtgaccgaatgaatcttgcattcctcaatgaaatgtagaaatcaaagttaacaactgcttggtcgccatgaagcacttttcttgatgatgaacctacacttgtatcgccactggctgcctctttcttgcttgatttgtcttctcccacccatcttgcatcagtggtgtcaatgtgtagcacatacaattctagcttcttccattccctaggccatagtattgctcgtagcttctcacaacccaacagaattagcttgttgagacgtggagcttgcattgcagtaaggtcaagcattttgattgctgtatgtgacatgtccatctccacgaggttctctaacaatcctctcagcaataggctcttcagttgcgtgcatccctggaacgagatgatctttatcttggcggcgacattgctgacgaatataaatgactctagcaacagaggcaggaaattgtgggcaagtttctccagctcaacacagccatcaagggcaattgtcttgatactagaggttgacaggtcagggaattctacaaatgatgatgcttggtttgtaatctcgcaacatgtaactcggagcttgccaaggttgcgcggcctgcagctgttgcttctagcaacatggccaggacctagatggcttatccaggtcgcattcttaatccccttcacattcaactcatgaaggtgaaccatttgatccatcatctcttctgatagcaaccaataccactctgtataacttatgtccaacacccaaagctcctcaaaacatgttctattgtgatggcccattttgctctgttgatgctcatcctcttcatcaagatgagctgccatttgatcgtctatgtccttgtccttgcaatggtcaagtaggaggaacctaaggttgctgcagccaaggaaggggggtgatgaaaaactgaaggtacactgggagagatgtagtacacgcaatctgctcctgtttgaatgtccaaacatgtcacctcgtaatatcatggagctacttttgtcaatcagtgatccggcttccgtcacaaagaaggatgttgcttgaggtggcacttttactgtagctacatactggtgggtagttgaaatccagcggtttgtgtgcctccactctttactactcaacccaaaggcatcacgaatattgactgcccagacctgatgccaatcctccaagtgcatagcactatgcagagcttcagcaatctcccatgccgatctatcaccattggtggcatcttttatgattccatcacatacccaataattggctgcgttggtgccccagttgatgccatagtcatcacctctcaatgccttgtacaagatgcactccatgacaagtttggtgctcatatcaggttcaaggacaccgctgtagaaggctacctcctcagcctctacttgcagcaggtgcctgacactattaagtatggaatcacttgacaaatcagcatatatagaaacattactctcagctaacttcctttcatgcacctctcttatgtcattgctatgaagtgaaaacctgcctcgggaggtccacaacaccctcttgcccaaaagccctgctacaaggataccacaatctttaagatcaatgtagcggccactcccattatggaagatcaccaggaatccgcggtcacgaaggttgtacaagatttcctccttgacatgttgtattgggcctctagcaacctggtgtaccccatcaaaatcgtccttctcatcccactggtcaaagagggctatcacatgttgaggaagattcagatcaatcgcaatggccttctgcacagccctggtgttttgccacagtgagcaatcaacgtggatgattttgtccatgcctgctttcatcacagtagcagcctctcctaacagtgatgctgatgatttgagccgtgtggcgatggctttgagaacagcggatgcccccaatccaccccagccatcaaagtgtatcacatctcctttgtttgaacccatcagaaaatggattatctcctctgcagcaccactgatgttgtctgccttgatattgattacctgttataattagtgctaataaatcagatagtggtggcatatttgtacatcaattgcagcgatggattacatacaagcctttatttcacaagagtacaaaaataattatcttgagagttgggatggatggatcagggtaatatgtttacattgcctttaattttgacacaatgataaaatctgcaatttaattcatccaacaaatatataaaaataaaactttatattctccacgtgaatattaagaacaaatagagttttttaacgaaaaagaacaatagaattatttgaagtaaaaaaataataagcatgtccataatgatatagaaaagtacagaacagaaatccaattattgcatgttcaaattaatgtgtgcgacgtttgaatttgccaagagaatgctgctgacgagagactttctatgttgtttggacgaatgacaaccgttaattacttacaatctaacaacgatttataagagaaggtacctaaagtaaggtactcaaatgtgggtcaagtattaacttcaatattaagtggaatgtcagactaatagtttaatctgtacgtagtgtgttagtatcatatttgatgatgaaggccaaattagtaaataattagccattcttcttgctgagtgtgcctcatattatcaagccgggtggatggaatagcactgcctttgtggccatggtccctgcctatggactgccgacgctcttagttccctaggagacaacaatgtagatgtataaatatggcgcgagagaggcgacatgaaagatttgcaccctcgatggctcgatgggcagaggtaacaatgattcttttgacggctgatcttgacgcttagtagaatacagttctcttttagtctcttcatcccaaaatataaggtccaaccactattttaagatatttcataatataaggcgtgcatatatgtatataattaactagcacctctctcctgtaacactctgaaaattcgactaacaaaatcaaaaccctaaaaatacggaccttcgaaaactttgtaaataaattgcatcatgccagttttattcgcctattttatttgcatttgatttcggagttcattgatcgtgagtaaagaataattaattaggaataaaccctaaaaataaattggcaaaataaataattgaaatataatttaagataaatattaggtgaggatagaaataaataaaatattatcgcgaccatattggtaacaattaaatttaagtgtgatggaataagaattagccctaattaaaattcaaataaattatataaaaataaaatataggtaatattaatatagggtgaatcctttgtttaaaataacacaaatattgagtaaaatccatttgtgcaaaaattaggatttacagaatgaaatttatataggaaataggctaaattaaggttaaataggagctagccctgttcattgcacagtagatgctcgatgagattccctagccctgccccctcctctgccgtgcgcgcctagccgcccctagccccgcgccaccctcaccgtcgtgtcccgttgccgctgccgcaccgtgcgccgtcgccatcattgccgcgccgccttagccggcctcgtgccctgagccgccgtcaccgaccatcgccgtgcacccgtcgccgtcctgtctcgcgccacgtgcccgccacctcgcgccccacgctgtcgcatcgccgcccatcgccctcgtgcctgcaccccgccacgcggccatctcgttgccgtcgccctgcgccgctgccgcgccgcccgtcccatcacaccgagcctcgtgccgtcgtgcgtgtcgcatcgccccgcctgtcacgccgcgcgccactcgcccatcgccgtcgcctcgagccccacgcgccgcgccgtcacgtcgccattaagccggccgcccctccctgcgccctataacctcccccccggtcgcccttcatatcacaccaccccacccccttttcccctcttttctcccctcttcctctccaccgcgctgccgtcctcggtgccgcccgccgtgtgctgcgccatgcgtcaccccgccttgcgccgccgtcgccgccgctgtcgtcggtaagccaccgccccctccccttgttcggtcgccgtcgccgcccgggtaggcagagggccgagagggaagaagaaaccgggagggagagaaaaagaaagaaaacaagagagagaaaaagaaaaaggaaaagtagatagaaattagggagagattaaggaggtttagaaaattaaaataattggggttagttgtagatttcttttagttgtagaattgcaaaattttatataattatagattattttggtaatctctgtaagtaattaattcatggtagataatcggatttaattactaagaattgtattgtttgatgaattttaaagaagatacttctaaatcgcaaaatgacttaggttgaatgagcttaaaattggaataacgtagtttcgctaactttgtagtcgatatagaaagatcgattcgcgttcgacttttatttgagtttatttggattttatttgaagtctaattgaattcaaatcatttcttcgcacgtaattttagagcccgaggtagttgcggatccgagcgaggaacaagacctgcaggactacgagcatggcaagtaatcactattctttgaacatgttgatcccaattgcgaaattattttgtttacaaataaaattgcatgcaatgatgaacatcctacttatgattatgccatgccttgattattgtttacccttaaatccctgtaaccatgagtacgtatgagtccctagtcaattatgacaaatgcttagaaatgttattctagattcatgcatactcatatttatcaaatgttttatgcttgggaaattacctttaggaaggtaattgagatgcggcatgtggagacatgaacgccacattgccatgatattgatgacatgatttgtgaaaggaaaaaaataaaactaaacaaatgttttcgactggggcggctagaggattttggtagtgtccagaaaaggctagtgccgtccctggtcagttaaggaccgaaccatgaagttaagcatgaaacgacccccgtacaaccgcacttctcgtatggttatagacctagcggagtagatagctgagcggaggcagtatccatgcatagtggtttcttgatgtgtgaggcaagggctctacggtggggcagccattggtaggaccacgaggcaggtgtctacagtggtgtcgccatcggtaggactgccatgtgagaatctaaacataattataacttaatgcatgtgtgagtcttcccttcccgggtgcgccagaactcctatcactgctagaaatcgtattacgcctggagtgcatgaggatgtaaagtttatggagcgggtactgccaatgcgaggttgtcgaaaggctttgccgtgacgcgtttcatgtgttggggcgaggctcatatgttgggcagtcgcgaagtgcgggtaaagtgtacatccactgcagtgtgagtaaaccaaatctattcgaatagccgtgctcgcggttattgaacaccgggacgtgtattacacttggctagactctaaattcttaacttgtatgggatgggatattgcatgatgatttttatgttgatggagccacttcctgagaggagggaaggtggacgtcctcagaaaaccatgacgactcaatggcgggaagctatccttaggatcacaatggatggtggacagaaccgtcgttgtttaatgtgaacactggtactaaaatttgatcagactatgctaggtcttaggcttgtgaaaagaattgcaaaacttgctttgcgcaaaagaaccatagccattccttgaatagcctctatcatgtgcattgctgctgtggtggcttgctgattacggttggtactcactcttgcaatatacaaacttaatcagaagtcagagataaagcttcggaggatctctacgcttactaccaggagggtgatgaagatgatggcgctcagtaggtcttagttatggtcgttgcctgtggcaatggcatgccgctgcctcaattccgctgccttatctatttctgcttttggaatgtattccggaccattcggtcctatgatctaagactatgcctgcgggcttatgatgtaataattcgcactagactctcatgtatgtgcacttggtatttcagctatgaactcgtgtgtaccagactacttgatccagggaaatggtacagtttacacgattgattcctattataaaaacgggggtccacatctcctctctaaattttttattttaagtcctccactcttaatatctctaatcccgttgggtgcatgcatgtatttattgagattattcaactaaggaggtgataataattgtttttttctttgcgtctatgatggttatgccttatattttgggatagagagagtatgaaatttagtcgtgtgcaatgatgatggctccccatatactgagtatgaacacaatagtaattgtctaagggtgccatcgtttggcatattggtggaataagccaaacgacatattagcaaatgaaaaataatttgtgaataaaacttttatatatgtgttcttagtgatctaaaagcaaaagctgaaaaataaacttcgatgaaaaaacctcaaattcagctccaaatttaacgttgaaaattcaaattttggctgataagcataagaatatgccaaacgatggggacctaataatacatggagcaccttctacaagtagggatagagagaaaaaaatctatcttttttgcgtgcacgcttcccaaactgctaggcagtgtgtgttttgcaaaaaaaattctataaaaaagttgctttataaatcgtataaacctttttttaggttcaaaataattaatagtcaataaccatacgctaatgctcacctcgtatatattacatatcttctcaatcttcgctttcccctcctctcaaacactctcaaactctctacagaaaagtgaaaaactaactaactcaatagacaagcaaagaaatagcaattatgattggggctcaataagcaaagatgtactcatataaacacatgtgatcacgcaggtaactttagcttttgatattgttatttttcagccatctgattatttttctgaacatgcagtcaactaaggttgcacactgcaagatttgcaactcatgtaacgaagtgtaacattttgttttctttgtttttcatttacagggttaatgggatgcatttttatgcttgtctagattaaagtttgttctttcattttgaaaataagttagatcattattgtgttgcatttcaacaaaaagtgctaattattcgatcgatgtaccccacgcttcaataaaaaaatagaaaataaataaggtttgtagagctcatccaactaagcaaaataaacggacacaattacaaattgagagcccgatttttttcaaaatatctggcgttgtttcacctactgtataaaaatgtctcacatgtatgtaaaaatttttcaaactattaaaatggagatgcattgttgcatcacagttaaaacatatcgctcttaatcatgaaacatcgagcttcaactgttgaaacagccacggagccgcaagaatcaaagacaaaaaaaatgaaacaccattgaaatcccaagtgcaacactttgatgcaacatgtggaacaaccatatattgactgaaacatcgaaaaatcataaaatatgccgattagatctggcttcttactcctctctggtggtacaatctacgatcaatgtggatgagtgacaaaggtggggaggggggggagatggcggcaacaacagcacaaagagcaacgacaactgacgattgccgaccctggtggaaggactgctcctcagcggcaaagagatgtggcctttggcactgctactgcttgatacctgtggatcacatgatcccaccaacattggtaccatgtacctgcgatgatatgaagcctcatcgctgaaaagatnnttatttactgtctacatactagattatatctattgttatttcctatttaattttctaacttaactttcaattcaacaagtttgtggtaataaccgggactaaaggtatctttagcccacctgtcagtccgtccccgatttttgaatttatttttaagaaatacattacaaactttaaaaaatatataaactgaaagtaatacattacattgcacaatataaataatacatcaattccatttaaaaatctatttacaatgtttacaatcttatagaatctatttacaatgtatataattccatttaaaattcattaaaatggttagaaaataaggagaacacactaaaaaatatgtttagaattttaaaaaattctaaaaaaagtaaaatatagataatatataaaattatagttacaacttgtgtgatgttttaattgttcaatgcagatattgtatttacttaactttatgattttcttgccaggattggatgcaggcgactctcaagtttaattacattattcgaaggtcgccaagcaa

SEQ ID NO: 66324 - DNA, 7930 bp, Oryza sativa
cattataacatttcatgtattatttaatgttacgaatagatgacagatcgcaacgattatccttcatcatggaaatgatgaatttcatacatttataacatttatatcattgcttagttttttaatctttttctactatcactatatcctattatatttttttttattgaagaggtgtatgtctaatatagcaatcctctcatatatatgtatacatagtatcctaatcagcctctaaatcaaaaagattagctatgtagtatccttttcgccttcctccgcacacatcagacaaattcatgcaccaaaaacgagtattttacaagttcttacactagattgcacccacctaataagtttgtgtaccgttgatgcaatttactcatgcatttttgtaccagttgatagcaccaaagcgtacgaatcggtactaaatatgcccttagggttagttgaaaaaaacatctcaatctatatcaaatgtatgtagtaggtgggatggcaatgcgtgtgagagttaaggtgagagatcttgagtttgaatcccacaacccacatattttttttaattagtgtgcatctttactaccggctgaaaaatggttaaagattgagatgtttggtctcgatttactggtttaggttgctacaaccggtactaaaagggattttaaccggtattaaacatcgtttctcatgtagtgattggtcaatgttttaaaagttaggagtagactgaatcatgtcttaaatatcaaatatttatgattggaattagtaccaatcttagtgttttttcaactttcacaaagattacaagtattctggaaagaggatctaaaagtctcctcatattttatgtattgattacatgaagaaaatgtagtatgctactcgcaacatttgaattttaggtgagaattaatacgggaaaaagagattggtagtagtatatatgcatgtgtcacaaaataagggaggactattggtcaggtaaggcatgcatcagagtggcgaataacaaacagcagatctagatatataggagatccagcaggtcatgcctaaaaacaattacttgttaactcccaagttcttgttattttatattcgtaaactgccttataatgaatcaacaataagtgtttaatagtctgggaggtaattggaatacggcaaaaactctctgctgttacgtagtctgtcatcactaaattccttcgagacaatcgaagtcagaagagtgatttacctctgtttccatggggaatacaatgtgttgttgctttgcagtatgtttagctagcacttgttaaactacaagctggactagcagctccatctgcatcaatgctttctggatctccatatctcaccatctgctcgcaaaactatctctttgaagctccctacttccttccagccaaccaatatttcctacacagatataaacagatacacttgatgggtccaaagtccaaactgttactagctccttaattacatcgatgatgaggtacatatatgatggctattcatgatttggcttaactaatcattctcaaacaaagtaaatacaagctgtaattaaaactggagtgtcagcatgtattcgtgaaccctcgttgaacatttaaacaagcttgaactatatataatgatgcgtaaatgggtagaggtatagactaatcaccttgatcttgacttcaggaaaccatgcatggttgcatatgcataaggaggaagatgagcgataatgtctggagagcagacaactgacatgcatatactaggtgcttctctaatgcagaggcttcaatgaaatgacgtgcggcgttccattccctggcatatattcctgccttgtgcttcctttgaattgcttttctgcaaagcccccaaatcggtcatatgctgcacgcagcatcaatcatcaaattctttgcttgtatctgtgtcagatgccaggctagctgggacctgccatgaaagataactaaaggtaaaggtacaaggcaggtagagacatgtacgatccaattggggatgggaatggatcaatcgactgaagatttgtctggttaggttaggcctacatggaagaagattagtacggtaatgtaaaactatttcgacccagtgattgatagaataatcttgggcatttgtatttttcttaagtttagctgcatttcagttcgttagttgtttcctcatgcatgtaataagctgactgaaaataagtttagctgcattacagttcgttagttgtttcctcttaagtttagcctttttttagtcgttgtggccgagctgggaacggatcgtgggatggcacgaattctcagatctagctgtttaatcggtcaagttttgcatgtagcaaactcttaagatggaggtgaataaatagaaggagaaaaaccgaaaagctgcagcggcattacgcaacgcaaaaccagtcgttcttgttgctctgttttcttcgtgctctgttcttcagtccattgttcacgtctggaaatattcagagatagtaggatagccatagatcgagtgcagagtgagggaaatttgctgacaattggtatcagagcgaggttccggttccgtttttgatgttgtcggatgcgcgctacattccgccgccgaggcgtggtggaagtgacggtagtagcagcgagcaggggagcggcagtgcaaatggcgcaacgatgccgctggtgccgctgtccagagatggtggcacagctgcgaggctgccaatgcgacgaggacgaactaccccagctgggagatcgaccccggctacgtgaagtaccgcgaggatcgtgtggccctctctgccatactccaggccattccgcgggagatgttgcgcgggctggcgaagcatgacacggcgaaggcggcgtgggaccccatcaagaccatgcgggtcggtgtcgaccgcgtgcatgaggccaaggagcaagggtttcgccggcaatttgaatcgatgcggttcaaggagggagagaagccggaggagtttgcgatgtggctgacagccgttgttgcgaacatttgcgacattggcggagtcatggaggacgaacatgttgcgtgttgtccctaagaagaacaagccggtggcaatttcactcaagcaactcctcgatatcaagaccatggccttggaggagctcgtcgggcagttgtccacgattgattcgtacagtgacgatgattggctagtgccagtggcaaactatacctcggagcagtgggaggtgcacgcgaagcaggagcaagaaggcgcagccgccaacaaggcccatggcggtgctggctcgcaaaatcgcctaggcaaaactactggatcaccgaagggaaaggaagcggctaccggtgggagcggcagtcgtgacatccaagatgaaatgtttcaattgtaatgaatatggtcattatgccaagcaatgtcgcaagccacgacgccaacgccgaggggaagcaaatttggctcagggggagggggagccaactctgctcatggctcatgttatggggttgtctctcactggcgaggcgacatttggccaaacacctggcgtctacgaggtgcatatgacaaagaagaaagtggtcttggatcacgacgatgtaggtgaggaggacactgcagaatggttcctagacacaggagccaccaatcacatgattggggcgtgctccgcgttcgccgacctcgatgccggcgtcgtggggacagtcaagttcggagatggctctgtggtagaaatccagggacgtggcgccgtggtgttcaagtgtaagaacggcgaccaccgctcgttggaggcggtgtattacatcccaaactgcgcaagaatattatcagtgtcgggcgccttgatgcacgcggttacgatgcacatgtctggggtggcgttttcacgctgcgtaacccggcggactcctgcttgcaaaggtaaaactgtctcccagctatctttatatattgagattggacatggcaaggcccgtttgtttggcggcgagtaggagcaaggaggcaaggctatggcatgggcgtttcgggcacttgaaccaccaggcgcaaggtgacatggtccgcgggctccctccacttggtcactatgatcagttgtgtgatgggtgcctcgcaggcaagcaacggtgctcgtcgttcctggaggaagctaagtagagagcgcaaatggcgcttgatcttgtgcatggtgacttgtgcgggccaatcacgccggcaacgccgggcggcaagaagtactttctgttgttggcagatgatatgagtcgtttcatgtggatacgtcttattaccggcaagaacgaagcagcagcagctattaagcaatttaagtacgacgtcgaggtggagactggccgaaaattggaggtcctccgaactgatcggctcgtcgttctgacggctccccggcctcctcgccccacttgtcccgtgcactcgagcacctcctcctcctcggcctccttgagccgccgcgtcatctcagcctctactccctgtgcacctcgtcctccaatagctcctcggcctcctcgccacgtacccccatagcagagccgcgaatctggccacatggccatggccacggcgaccgcagcatgcgcgtgtggcacgttcatcggaggaggaggttggtggccatcgacacgcacgggggctgaagaagaaaagaaaataaaagagagaaggaaaagagaagggagaagaacagtgtccaagggcattttaatactttcaacgccctttctctctctgttttcaccggaaataataaaataatgcctcttgtgtccagcagctaattaccatatttttacagtgtctccaagaaaatacacgttcgtttggtgtcttgcagtaaatgccacaaactttgagtatcctgtaataaattttgcccaattacatcaatcggctggtcgattttcactactacacatgtgcttttcctggacgccggcccctttaggttccaggcgggccgtaagtggctccgcctggaaccaggcgatcccggcgtcgggcagtggaccacatgggataatcaattatctcgtgtggcccgtgtaagccgaccgcctgcgatggtgggggagctatataagccccagcccgactgttgctatggcatgccggcgatttctctctcctaaacctccacaaattaggggggaaggttttcgacctcaaatttttgattgggttccatataaaaggtgtagagcttgctctcctccttcatttgcttccatttttgtcagttttcttatttttgtcagtacaatacgaagaaacttgcacatttataaatggaatagtgtaggcacttttttgtttttttcttatttttttagcaaatacataatgattccattacatgtttataaaagtatttagtacctaaattgaaaagttgggtttgtctctattaaatttattttcattcagatgaaagtacgatttttttcattttttttagaaatggataatattttattaatgcttaaaattgttgtgcggccgtttaaatagtccgtaaaactttaatttgttatgtgattagttccctccaatttaaatacattcgtgtttgaatcgggcatggatgtattaatgacaagctttattctaggtcatggatcggacatggatgtacaacacgaaaagagctcatccaacgttcttgaaggaagcaaccaaatttgttgaggtcgcaaagacacatgctgtgagggagaatttgagaagcattttttgcccatgcaaagtgtgtaagaacgaaattttgttgcaagatccgaatgaagtattgtcgcacatcgtagagcgaggatttaagaagggctacgagatatggacttttcatggggaagtcggcggtcgtaacgaagtgacggatgatttctgctttgatgatgcagaaaattttataatcgaagacatgtcacagggaaacatcccagaatgcggtggctttggtatagagaatgaaggtattgattttgatccggaagatatgttgcggcacgttgaaccagaggtcctaactggtagaacacgagggttggacaattcggaagcgttggaaaaagcagcgtaggagcttttgtacgacgaagcgaaaggatgcgacaaggactattcggtgctgcgctcgatgcttgaacttctcagattgaaggccagacatggatggtcggacactagcttcaatgatttgatggaccttttgagagttatgcttcctaagccgaacctgctaccgacgaacacatatcaagtgaagaaatcgatatgtccattgtctctaggtcttcagaagatccatgcatgtgaaaatcattgcatactgtaccgcaaggaattcacggatttagactcttgcccaacatgtgggacgagtcggtacaagacgggcaatggagcctccgatggagaggtggtcgacaaagatgatgcaccggtggatgagaataaaaagattcctaggatggtgatgtggttcctgccagtgaaagatcgcctgaagcagctatattccaaccgtgacgacgccgagttgatgagatggcaccaggagggtaggaaaaatgacggtaagatccgacaccccgccaatgctcgacagtggaaaaactttaatgcactacacccggaatttgcaaaggacccgagaaatgtaaggtttgcattgagcacggacggaatgaacccgttcggtgacttaagcagcacacacaacacctggctagtgctgctaaccatgtacaacttgcctacatggatttgctagaagcgaaagtatattcttttgtctatccttatacaaggtccaagacagcctgggattaatatagatgtgtttctggaatcattgatggaagacatgcaagaattgtgggaggaaggattacgaatgtgggacgagtaccgtagggaacattttactctgcatgccatcatattcgttacgatcaacgacttaccggtaaacttttcgctctcgggccagtttaaggggaagttcggatgtctcatatgtatcgacaagatgtcgtacaagtacctcaccttgtcaaccaagggtgtgtacatgcgttgtcgtcggttcttacctcagaggcataggtggcatgcgaaggctagattattcgacaatacagtagagaacgatctagttccggaaacacgaactggtggctctgttttcgagctgagaaagaacattaagattgtgtttggcaagccaaagaagaagcccgtcaagaggaagaaatggatggatcaggaaaatactgatgcagctgcagaagaaagtaatctgccttttaagaagcactcaatatttttcaggtatctggattactggaaagacctgaaggttcgtcatgccatcgacgtaatgaaccttgagaagaatatgtttgatagcaccattggcactttactggatatcccgagtaagacgaaagatgggttgaagtcccggaccgacctcatcaatttggacctaaggcatgagcttcaaccaaaagagctgccaaatgtgaagatcgatattcctccggcttgctactcactgataccggaagagaaaaaaaattatgtagatgcttgcatagtgtgaaagtcccgactggtttctcagcgaacgtcagaaaacttgtatctttgaaagatttgaccatctctgggtacaatgctcatgattgtcacaagatgctaacaatcttcctaccgattgctataagagcagtcaagccagttcacactcggttagtgataaccaagtgctactttttcaatcgagtatcacagaaggtttttgatcctgaagagttaggaccccttcaaaaatttgcaatcgagacaacg

SEQ ID NO: 66325 - DNA, 5569 bp, Oryza sativa
taaacctgacttggccgagctgaaagtgtgttcatcgttcacttcaatttagtttacttccaagtgcaatctgcctatctatctagctactactcctagattgttagaccagtgatcaagtagtcgatcaaactgttgatctgtttgaaatcctcatacttaaactggcaacttgtgcttgattttgctttccatgcatggacctagtcatgcatcactgatcgctaagtcaaaagatcaaaatctcgataccaagttaggaatattcttggagattgtacatatagaaaaatggagaagatatgaacaggtactgaatagtgatttctttgatcaatgtgcctggcaattaggaaggaaaaaggagtcaggctaacatgtcaaatggccatacatatattcagctcacaattaattaatttattacaagatactttactctgatttttccatgcatggacttcattggccgacctttttttaaggagtcctaatttttgttggggtccaagctaagaggcaacaagaggtcctgattttccctaaagtgtcacatgagtgttgagcactgtcatatggtgaagcatctaatgatggcaagtaaaagccattgcatcagcatctgttgcattcatatgatgagctttctttctttccaacactccacacaaatgttgcattcatatgcctgatctactctattacttaccttgttgcagagatttatgcatcaagtttaagacacaattgcactaattaattgaggccatgttggctgctttattccttacttgttgccacagcacagtgctagctaggcagcagtccttgctctagactttttccttttcttttttttccccttgatgaaagcaaccaagctagctagtcaattaccaaaaggaaaaatatgcacccttttgtttgttgcctagtcattgttaacacactttgagttgagcacggttgcttctttttaatttttttctagaggcctacatttttttgctaaatagttcgcctattttcttatagaaaaatttcagcatcgtcagatcgattgagattcatacgtttctaaactaccttgacggaattgagtcaagctaattggctacatttctagatgagaattaatagttagtagttgaatatattgtagtcactagctagctgctaatatatatgacttgtacatataccacaaataatatttctttccttataaacaagacatgtcatgcatatttttcatcccttcagtatatttgctttgcaaattgaagtgtcacttatgcatttgttatcttttttcccccatgttaaatatgcatcatattgcatcccggtcattgcattgcattgcaccctactactagtaataagtaggccatgatgagcttgtgatcacaactttgcaaccaacacacacattcatagattttccttttcttttctttgccttttttttccctttgcattcatgagtagtgctttctagctaggacctctactgtacatgtattttcctaattaataattcatgtatgcagattgccgtcgcttccgtgcgatatctcacagaaaaggatcgcaaagtgccaaagcaggtcagcgtctaactagatgacaagccacaaaatgcactacttgcaccatatgggctaatttacaagataattttgtaccatgaaatctgttaatcttgccataatcaagccctagttggcagattaattagggggctcacccaatgaaagatatgattaatttagtctcagtaaccaactaattaattgtcgttagctgagacaggagacaaactaacaaacactgatcgcgtcctgattaagacaacccatttttgaagctcattccttactccaatttctcgagacaatagacaagtaggcatgtaagtgactctaattgcatgcagttcttcaacttatttagaacgtgggggaatttgcatgaattgtttttccatgtagagctgtcttactattggcacacagagatcggacctaccggccggccaacgactagctagctagcgagtgtttcacctgttttcagctggaaaaatggacgtgatgtgcgtatcaattcaaaggagatgctctctccggtcatgcaaacaaattgtcttaaggtatagtatggtctttgatatatagtcaataatttatgatatagcatatttgttaaaccaaataaaacttactactagagtatgctaatttcaagacagttttaacaatgtgattttcatgtatccaattaaaatattttaagaagatgtgaaatgaccgtagcttaactagttaggctccttatgattgaatctgtttacccggatttaatttttgggcttggcatcggtgctcgtgctcgcgtttatgattaatcacttttttattggtacatgacacccattgacaacggtttttggacgtgttcataggatagtgtaagaatatatttaagaagatatttacgcatgcttgagatttataaatgttctattatagaagtgcgccctaagccacaagctatcggaaatcaaaatcatgcatagccggatcttcagcagagtcgtgtcacctgttttgatcgttcgaatggtctaaaatattggacggctaacaaccttctttgcttaatcttgcccccatggtcttaattaatctttgcccagaacgattaggtcctggaaactaggattaacaaaactttaattgcagtgaggatcaagaaaaaaaaaaatctccctgtataattttcggttttgagaggtattccgtaccaatcaacgtcgataagatcaaaaatcgaaagaaaagcgaaattaaatatggcacacgagggtgacagccgtgcactgtccaggcgcgtacacgtcgctcgcgtacgtactttgtgtgcagtagcagttggtactcctgcacagtgtacgcgcgcgcgacatctgtacactacgtacacgtttacgtatacgtgtatatgcttgtcgtccacgtaggcaacctccgctactcggtctctaagagcttacaatagcagtctataaaccagctataaacatattttaaagagataaaaagaagagagaaaagcagcgggctataaatctgtagccagctgtaacacggactccaagacgtaatatgtgtatgacatgtgagatcaggcattaatagtattgtaagcaactattgtatgaattggctattatattggctatagatgatttgaagctaacagttggctatactattaaacttgctctaacgcagagctgatcaccgatcagagtgtagtacagcgaaataagcgtcgccagactttaccctaaattcaggactatatgtttctgttttctcgcgcacgcttaacaaactgctaaacaataatttttaaaaaaattataagaaagttgttttaggaaaatgtattaatccatttttcaatttttttataactaatagttaagtatgcattaatctctgttttatgtgtgaagggagcggttccccaactgctccagaagaagaacatagcttaattaaatttcctacggtgaaatcagtctatacagatttaagttctaaaattgatacaaatattaatatttactactaattgttttttcagtattagacaacgagatgtctatggagacatcatagtagtatccagcagcctatgtggcgttgcattgggaagcctagcgcggtgagtcaccctccaccgtggcatggccccacctgtcagtttgtaactgccaaccaagtcactgaaaaattagatggacgattttgtctccgtaaaacagagtgaaattaggaggaccactggatccgctatgccagggatgtactcatgatctgggccatccacgtgtctgattaaatacttgaccctgacatgacatacacgcatacttaatgcattagcttaattagctagcaacaattggtttgggatcatggcaatgcaaagcttctactactagctagctaggcatgatcatgcaagaggcagcctgatgactctgatgtatgttaacaactgcaagcaagaggggttatttcactagtcttgtcttcacatgttaactgcatgagtagctgcttagtttggagaggcagtgtcctaatccagcaaagggcagggcagggtcagaccagaaatgctgcctcatggtaagtgggaacattagctttctcactggaatatgatgccattgcttgaaacaactgtgctcactgtagtgtaacaaaatcttgttcctgctatctttgataatggtacccgtgtttatcggaaaaatgcttactgtaccagcctaatgaagacgaagttgaagaagaagatgatgaacaagaagaggaaaagatctttccaaagcagccagcaaaaaaaggatttataaaaaagaaaagaaaagaaaagaaaggtagccaaaggagaaagcaggggagaagagaagaagatgagatgagctgagatgctgcagccacatgaggaatgctaccttttgtctccacttgatcatggaggagaccaagaccagccaaccaaatcaccaattagttaactgcatttgctactaattgctagtgctaaacaaaggtttggttaaacggtagccaccagtaaacaaatcagtatgcaaaagaggaatggggttttaatattaccaaagtcagcaggagcgagccagtaacatcctagctggaccagcttcctgggaatttttatttcagctcaattctcgatttctcattgcattacacactgattaacctttttttttcattgggaactcagtacagaacatggagtacacagtatacatcacctaaattctagcaaggtcaactagtagcagaattcacacataactatgtagcaataactataattaagttactgcagatagtactacatatatagccttttttttcctcagtagtatttgtatatatatatatatatattagatattatattaccccttattaagtaaatagaaaagggaaaaggaggaaagaaatactgcttttccaaaggtaataaactacagaagaaaaggaaaaaaaagataagagagagaaaaaaagaagaaataaaaagtggtaattaatcctagtggtgtattgcaatttagtccttgggattaagcatctgttactcccaagtcccaaagcaatggctcctcaagccggagctccgcattgacctcgtcgacgtcggcgagcggcgcccacatcgccgggaacccgaacggcccgtcctggatgtcgaacagcaagtccggcaggtcgaacagctgctgctcatccgccgccgccgccgccgccgccgccgccaccggcgcggtggttgagccgtcgtcgtcgtcgttcttggcggcagcggcaggctgctcgtcggcgtcggcgtggacgacgcatggcgcgacgtcgtcggccgacaaggaggaggagggcgacgaggacggggacgtggtgaacgcggcggccaatgcggcggcggcctggacgtccttgggcgaggcgga

SEQ ID NO: 66326 - DNA, 9021 bp, Oryza sativa
atgttgattgcgtgtagtattggtgtgtggtggtgcccttattgtaattatgctggttagggtggtcttatcttgaagttattggacttgttattgcttacgattgtaggcagttcatctctcaagatgatgggtagtgaacagatggcattcaatatgttttcctgcatttgtatctcgcctggtttggtgtgactcaaacagaacgatcttatttataatttggttcaaattgatgaaagcaataatctatcattctatctgttctctgaatgtgttcgaaattttgtattgggcactcacattagtgttgtttgcattattgtttagtcgtttgatgttatcctttggattcactaactgaatcaatcccacgcctcttggttataggttcttgtgtctgggaaagaagacccagccttggagcttcctccagctatggatgctctcatgagagtttttaagcgtgtcagtggtataacagatggagctgctgagggcacacaggcagctactgcacctggtgtatgtgctgcccgtttgttggttcctggagctcaggcaattaacctaattgggaagcaaggtgcttcaattaaggccatccaagagggcactggtgctacaatacgggttatatcaataggtaatgtactctcgcttgatgcatagcatgttaatacaccattgcctttgtgccaatttgatggttaaaatttctgtaaaagtttgattttacaccagggcttgctgtgcattattctgtgatcctttgtttatactgtttgtatgggtttaaggctttaagcaagtaatagatattttgaagtcttcccctgttagtattaaccatggtcttgatatgcgtattttattcaaagaaagcgtggtagagcactttgcatgtcttcttgcatggaagaacgtatcatgtccattctactcttggtcacagtcagtagaaaatattgtgggaaaagtttcaaattagcacataacattgttgcgtagaaaacccaaaggcttaacttttctagatgtagaaagatatcaagggatcaacaaaaatgaattagtacaattttgtacaaacaaatgcgtgttgatggtattgtacttaaacaccctctaaaattttcaattaccctgaaaagtgacagcaatatataatatcaacttataaatttatgtagatgagcgagagcgacctttctatgtaattgaagatgaaaggatagttgagatccagggggaaacagagaaagtcctaaaagcacttcaagcagtttctaatcatctccggaagtttttggttgaccatagtgtacttccattgtttgagaagactgtaagcacatttatctcatgttttactttacccttcttatcaatcctaatatatgccgtttctgatttgtttctcagaatgctacagtaactcaagatcgcagcactgatgcttggactgatatatcacatccttcaattgtttctgcacaaataaaccaaccacctcctgtggttgatgaatatattcttccaatgaagagagaccctctgtttctcgaacgggaaccattgatagaccacaatattcatcgctcaggtgtttcgctttatgggcgggatcctgccttgtcaacattacgaacctctggaatacatggtggtggacctggtggccctctactttcacaggtatggttgatcttgggtttcacatgcatcttcattttttttttctgatgagctgtttgctggaacaaacatgattcatgtggttctttgattttgaaatctgttgtaatttgagtctcttttgcctttgattatgcatcctatccattaatatatgtttgccagttattatttatcagtacaaatatttatttcctcgtactgtttactgactagaacacgtggcacgcagataactcaaacaatgcaaattccccttacctacgctgaagacataattggagtgaaaggagcaaatattgcatacatacgagctaacagtggtgcagtcgtcacaattcaagagagtttggggagccctgacgatattactgttgaaatgaaggggacatcatcacaagtacaagctgcctatcaactcatccaggtaataccatggcatatatatactccttaaaattttgtattttcaagtttcagccataaaaatctctaatgtcatgtcctcctccctcaggattctctggcggcacatagggattctgtcaggagcagctatgcaggattagatccagtatataggccaagctattcacagtatggcagctcgacctatccgtcgtcgtcattgccatcgtattctagcatggatgggggtggatattcgtcttcaggtctcggtggatatgggtcatcttaccggtactaagcagttagtcgataggcttgttgccgccctgtatccatccctgggccatccttgtactgagccagcaatagatgttttgatggcttttgttcttctcggctgtagtcctgcagaaatcattgtgtcccggcaaatgtttttggtatatctgcttttgttagtgtgacagggcatgtggtttatatctcatcatggaaagatgcccctaatttttcatagtttagttgcattttttgtgattcttatggttgtgtggtctacctgtttgtgttgaaaacggatgagtcaatgcacgtgttatgttcatccaatattttcatgctgtaagcatatgaatgaaaaggaaaaaaaaagtaccgtgaagcataactgaagcataaagtcgctgttacatgtaatactttgatactgtgcccttctacaaaatatatgaaaaagaaatagccgtgacaactagatgatacttcaacaaaatcatttctaccaatacgatcttttacgtacaaagatagcaaaactaagggactttgaatcaaaggatttatataggaattttataggatttaaatcctatagtaaattttactatttggccctttaatttaaaggattgaagctttctaaatcctatgaaattcctatggaatggcacattgcatgtggattttgggggaaatttagcaagagctccaacctcttggaaaattttctttgagtctatctcttatccgattcctgcgtttttcctgcactccaattaaacgatcattcctgtgttttgcaatcctctgttttacacttcaatttctgtcagaatcctatgtttttcctattcctccgttttttctaccttgcgattcaaaggggccctaaagcttcatatttctagatgtacaaagaatgtgagaatatcactgcctaccgacaatattaagttgattggaccttcaaattgatcccgtatcccaatactgttgttgtaacgatgaactaatgaagaacacactaccgagcgtaaccacttcatcgtaccctgaaaatatgggctctgtgaaacaggcttttactgtggattctctggcgttttcagtgatcttccagtgaccaaaaaattagtactcctataattacaaggccacatagatgagccaatcattcaagggccaagcgtacaggacatattgttatccaaattacatctccagcggcacaaataggagtaactgttagcttctaaattgctgcaaaaaaaggcctacgaggaaataaatatgaagattactcttcacttgcatacaatgttgtctgtctgttaaagttgaccagcatgttccacagttccactagcccatcctgtagtgacaagaaaaacagtatatcagtcatatcgaattgttttattgaacataaataccatacttctgagttcaaaacatacggaacagggacgaaaggaaataagctgctgtagctacatgacacacttcaaagtttaggcaattcaactgactactcatctttcagtcatagcaatcctactgtaaaccttgtactcgctgacaaaatcactgaaaaatcctgaccatctggaaaactccgttccctcaccatatacaaacacacaacgggagagggaggagggatggagaaaataaaaggaaaaacacaacaagattcctctgttcagttttttttttcaacaaataacgattcctaccaaagaggaacaattcagctctcctgcaaaagcacattgagagcctcagccgtctttcctgtataacaggaagaggatcttcataatctagaaaacagaaacaaaaatatgtttgcatagacggaaaacaactcgcaaggcaaaacatcactgcaaagaaaacaaacaacttcataagagatatggatgattgtaagggaagtgcatactttctctttctaccaccctgtccacccatgacatttctcatgtcgttctttgggatattggtgccaggggttcctgcaaactgcataggagacattgcagatgcaccagctgctgacataggtggcaaagatgatgatggtgcagcaacaggtggaaccacggtcgacggcactggtgctgctgggggcactgttgctggtgcaggtgcaggtgcaggtgccggagttggttcaggaggagggcggggtaagatgtgcttcaacctattgttcctatagtttttccagaagaaatattgctgcctatgagcaacttcctgcgaataatttgatggaaggaattagtttgtgctactgatgctaataaagcacaacagacaaaacagaattacgaatatgcagtacaatatgaacaaatgatatgcttccaatttgttcagttgccccctaactaattcataaacaaataaaggtgcccattcataagtctgtaagaacaacaataataaagttttagctcatccccattcactaacaatctacagtcaaagtaatacattccaaatacacttaataaaggggaaatctgaaaggatgttataggcggtactataaaaggttgaaatggcacatgtgtactaggaaaaagggtttcaaagggtcaccttgcttgctggatgggccattgcattccggaaattcgcattttggaggagctcaagaaagaaaaggcagtgcggatacctacacaaacaacaaccagtgtgaccaagctattttgtcacagcaagcacctactagcaaacagatctaaattatacggccactcacattatgtatttgatgtactccggacgctgccagtatttgagatacttgagatacccgataaatgcctcatcctcaaagtacctattctgtgctagatctgtttcaacataagaaatattagccaaatgccattttacatacagtattaatttcagtactcatttaacaagtttgattccattaaaaatagcagaagcattgagagtaattgggcataagcaaaacataatccagacatccataccttcctactgatcaacatacacttcaattatgcatccaatctacggtaccagactaccagcaaactaattactctaggcagtgtatcacgcttgctgaccaacacaatcaaattgctgtttatttttccttaactaataccatcaagtcaaagattaaacactaatttgttcaataaacctaatgaaaagatccgcggtaaaaccccaagccaagtgaaacgagaacgaggatacagtacagtacagtggatgtaggtagggtttgcgaggcactggatgaactcgagctccaacaagaaccgctgcctcgcgtcgttggggtcaggcgccggcattgcctccggctccatcacgcagcaagcacctgcaagtgttggagagagagagagagagagagagagagagagagagagagagagagttagcacgactgctccggctggatccccgatctactccggctcagcatagcaaggggggaggaatacctcgaaggccctggatgcgcgcggcactcggacgggaaggggaagccccgccgctgctcgcgctgagagccgcccttctctctctctctctcccccccccccttggacgaaccctagagcgaggcagcagcagagagggccgcggcggcgggcggcgcggcggcggcggcggcgtactcggcgttcccctttgcactggcgctcaggcggcgagggcaaaagtgaggaccgattagatcagggacaaaatcgtccatgaaaacaaactaagagcaaagataataaaaatggagtaaatttcacgatactacataatactttgataataaaactacatatttaataatgtgtttcataaaactatagatttagtgtcaaatttatcatggaactaatgtattatatcatataactatagatttaacaactattttatcataaagctacatatttacaactttaaataaataatagtgatacgatctaaactctagaacatgtagttctttgataacttcatcactaaatttgaagttttgtgatatggtgcattaaatctgtagtttttgtgaaaagtttgacgctaaatctgtagttttatgatactttgatccaagtgtctacaattttgtgaaacttactataaaaatgagaaaataaggagagaatggcactaaccggaatcattcgtaccgcgggacatttaatttattgctactttaagatgtggcaattaattatttgccactcgctatctataacatgtcagccctcatgtgtctatgacatgtggatctagtgataaataatttagcaccactcgtaagagtggcaaatagttaattattctctgaattaatagatgtgaaatgttgtaagacgttagtgttacatactagtaatttcttcgcatgagaaggggacacgatgaggatgagagaaatacacaatgcttcagcaaatacatgttttttgaaagttaaagtttttccctcgctattattttccaaccttccattgcacacaatttgatagtagaatctcatattgaggaaagatgcttggttgatttagatcacataggcttatctccaactataagggcccctttaaatcgtaggaatgaaaaaacagaggaataggaaaaacacaggattctgacaggaatacaattataaaacagaggattgcaaaacacaggaaaaacacaagaatgatcgtttgattggaccacaggaaaaacgcaggaatcagatgagagagatagactcagaggaaatgttccaagaggttagacctcttgctaactttccttcaaaatgtgcataggattacccatcccataggaattttaaaggatttgataggattcaatcatttgtttcaaaggccttcataggattttttttttcatagaattaaaatcctccaaaattcctacatttttcctacaaatcaaaggggccctaaaaaaagaaggaaaacctagtgcgtaaaaacggatgttaagttcatccttatgtaaacttatgggacgagaaaaaaaaatataatgcggttacactgtatgagctgcaaaattgtatgatggtcttgacactcaaaacgatacaaccgaacaacagctctatccaacgcagctccgaagatccaattactaaacccaatgatatctcatgtggaaaacaggtttaggtaagacaggcttggtgatatgaggcagacctcaagctacatactatatactagataactaaacacatttctttacttatgtataaaatttatagaacaagtccttgtatgtttctgagaaaataattataaccctttatgttataccaatgtattattggtgtattaaataacatgatacatattgatgaaatatgagatattccttgtattttatcttagggacatgttatttatggaacttgatagacatagctcacgttgtcgtgacaaacacctactaaaatacacacagtagtgtgatgaatgataacccctttgaaacgattcaagaatatgctctgctagtttactgttgttaggatcacctccattcgttttgatcaaagggactgtttggtagagccttttagatccaaatccaataaagttgaagttctatcaaatgattgagatccatgcaaaaatggagcagagtgggttggataactcttacaagtcttacaagttgtacttgtggtttagaagttctttaaggaaattaacattgatatatattggttgtaaatttgaaacacatattcatgtcttataatcgtacatcaaaataaacgtaagtaataatcatatttatcctctcatctctttcatgatttctgaagatgatagtagcttgtaagtattggagttggatccccaaaaaaaaaaagtattggagttggatcatgaattaaggatttaggacaattacatatttacaaacacatgctaggatttaagaggttgcttggcaaatgggttaggaaaataatctcacctaccaaaaaaaatatatttttaaatcctagccatccattattccttcctcattgttttcctaaccctttatccattttgctatcccaacagtatcccgcttatctcattattatcccatcacaccctacgactgtcaacgcttccaaatgggccctagctgcacggcgaaaccaaacgcagccacgccggcacggcacgcgcgtgggcgtggtggccgtaggccgtagccgccgcgccgcgcgaataaattagcaggcgagatcggccgccatcgcagattcacgggtcgagacggggcacagaccagacggcgcggctcctccccattcgaaaaagccacgggcgcatcgcaccgcaccgcatccgcgcggcggaaacggaaagcactagccgagagggacgtccacccacccaccaggccaccacccccccaccccgatccgacacggcacacgcccacgcccacgcccacgcccccacgcccacgccgcgcgccgctccatctctcgcctcgcccccacgatgccgcggcgccgtgccgtgccaccactccctcgctgggccgccccacccaccaccaccaccaccgcgccgccacgcgacaaacccc

SEQ ID NO: 66327 - DNA, 14453 bp, Oryza sativa
caacagcttgtttatttcttcgaagcaaacagaatattccaaagtcagtgatggatggttatgaattgatgactgagcacttcaggaaattctcatacagagaattgaaggaggctacaggaaattttaaggaagagcttggaagaggtggttctggagttgtttatagaggcgtacttgacagaaagaaagttgtgacagtgaaaagattaacaaatgcaacagaagctgaagaggagtttcaatcagaaataagtgtgattggcaggataaatcatgttaatttggtaaggacttggggctattgctcagaaggcaaacataaactattggtttatgattatgtggagaatgagtcactggacaagcatctctttgagagcatagatgcaaaaaaattacttcgatggaaccagaggttcaccatcgcattgggaacagcaaggggcttggcatacctccaccatgagtgccttgagtgggttgttcattgtgatgtgaagccagaaaacatactcttgacccaggactttgaagttaaaatagcagactttggcctagcgaagctatccaaaagggattgctcttgtttgcaattatcccatatgagaggaacagtaggatacatggctcctgaatgggcgttgaatttgcccattaacgcaaaggttgatgtttttagctatggaattgtgcttcttgaaattgtgatgggagctaggatttctagtcagacaacaacagaaggggagaaactggatttgacacaaattgtggaagcactaaagcaagttgtagcttgtggagatgttacacacatagtggatgctaagctgcatggacaatttaaccatctccaggccatggaaatggtgaagatttccttatcatgcataggagaaaggacaaagaggccaacaatggatgaaattaccaaagctctgatggcatgtggtgatgaagacaagtatgctgactgcacagaatagtatgtaacacataaatgcaaaccagtctcatcgaattaatcaaatgttacttcaaaagtataaaggcgaagcaaaaggaccattcaagagtcagggatgtaaaaagtagcacaagccaacttacaacttgttcatgccaatgaatgctattactacctctgtttcaggtataagactttttagcattgcccacattcatatagatattaatgaatctaggcacacatatatatctagattcattaacatatatatgaatgtgggcaatgctagaaagtcttataatatgaaatggagaaagtagtatttacgaatgatgtatgtttgtagattaagaattctctttaattatctttttccagttagttcccaagttctatataattcacagcctgatggttcctctttctgttaccacaccacttgttttcagaaaaaaaaaagattcatttactatctttgtttcatattataagactttttagcattaaccacattcatatatatatgttaatgaatctaaacatatatgtgtgcatagattcattaacatctacatgaatgtgggcaatgctagaaagtcttataacctgaaacggaagtaagttatagcaaatcagttcttcatgttaccagatttccttgttctcagctatatgaaagtgattgggacagggagatttgctcaaatgtagaacaaaggtaatggtacagagaaaaggataattaactaaaaagagcttccctacacgttcctgtggcttttcaatgaactattaataacctatactcctatagattcaagattactgcattttatctaaaagttctcgtcccgatctcttagagcagggtaaatttgttatttcaatttctagtaaccaaagctgctaatgctgccctctcagtaaccaaatgcagcaatgatccagagcaaaaccacgcgtcggtcagagcattgcataacagcgaagagaaagagggaggcgtcacctcgacgaacaagagccagcgccgtcaacctggccggcgagacggtggccggctgggaccgcgaagggggtccaaactgctcatcccccattccccctgcgcccaagcctcgccggatggccagccccctctccgcctcttccgtcgccggtacagcgtgggggtcccgtctcgcctgccaagccctccaccaccacctgcctcgtcggcatgtcgcggaggtaggcaggggcggggattcacgcggaggcctctcgtagcgtagttggctagcggcagcagcaggccgcttctcgttcgcgcgccgccgctcggcggaggtcgccaccgtcattatcgggcgcagccgataattcgaggggttttatgggaataacaacatcccgcacctacgtttctaaatcaaagctaccaatatcagatcggacagttcaaagttagcaagccttgaaccgctaccattggttgcggaacaaaaaaaattggtggagccgggccgccgggggtgcaggcgtgcagcgcgcctcctccgtgctccctccgtctcagaaaaaaaaaggacttaattcttaggttttttatccaatgtttgaccgttcatcttatataaatttattttatgattagtatttttttttgttagatgataaaacataaataatacattatgtatgacttatcttcctgaacagagaacagtgaaggcggattagtgaggacgacgctttgtcaagtaggtgctacaaggtaatcaatatcaacatattagatatagtattttttttatttgtcatatcatataatcgagatacaatcataaaatcaggatactatcaaatttataaataacacattttatatataatcggtcgtggctgttctgatccaattgatgaatttcaagatgacttggtggtcacgaccgatcggagtggttcttttctggctgctcttctggttggaggcagtcatgttcttttctggctgctcttctggttggaggcagtcatcagttgcacctgttgtacccagtgagctttctttgatcatggaagaatgtatggaattcttggcaattaatgatatcacccggaggggggggggggtaaagtcatgtattatttttttgaaaaataataatgtcggtatttgtttgtcgattcttttctatggtgtcgcgtcttagagttgtctttgaagggaagtctagaattgactttttagcatggcttgagcgacattggtagacaaatgattattccttcttgaattcgatgttttggagggtgttatattcctagcgttctcctgattgtagttgaacacactgtcacagaaacaaatgatatgttaatttatgtgttcttttcttccttagttagtgtaagtggataggtcggatgatttcgttgttcagtttcattactaagaaaatattatgaaggtaaatatatttgtagttgcaaagccaggtagtttagtagtaattaactagtattgttaactaactcgtactcactggcacgtgcaattcacgtgtaggcgttgaccatataaaggaaaagggttgcgatattgtgggtggaagtatatccaatcaagataactaaggttacgtttagttctctttaaacttttaattttttcgtcacatcaaatgttttggacacatgtatggagtataaagctggacgaaaaaacaattgcacagtttgcatgtaaattacgagacgaatcttttgagcctaattacgccatgatttgacaatgtggtgctacagtaaatatttgctaatgatagattaattaggcttaatagatttgtaacgcagtttacagacataatctgtaatttattttgttattagtctacatttaatacttcaaatgtgtatccgtatacttaaaaaaaattaaaatggaactaacacggcctaacgctttgttctgctcattctcttccaagacttcacagttcacacccccacccgtagaaaaatgacttcctaccctccaacttgtcacgctagctgttgaaaaagacctccattgctgcgattggtgatacttctgcttctcttatgctacctccgttctaaattaaattaagtgtaaccatgggttttcgtatttagcatttaaccatccgtcttatttaaaagttttataaaaaaactattttaaaaattagtcacacataaaatattatttatattttatcatctaataataataaaaatattaatcataaaaaaatttcaattaaaatggacggtcaaacgttgaatataaacagtgcaaaactgtatttattttggacagaaggtagtatctctttggctacataaaataaaaaaaatagtttgaatttcaatttggacggagttcattaatcatccttgacgacataccctcgtttattctaacctgtcaaatataaatcaaatgcttaaaaaaaatctgaaatttttttttgctaagattgatacgacagtcgtttattattcctccaaaaagataattttgagctcaactgatctacaaattgataaacaaaataacaaactaacctttaagtttcacgagcactatccacggttagatttgtttcttcttaacttaatcgaattcaaacttccatgtatgtaaagtgatacatactccatctgtctcaaaaaaaaagacaaaacggggtttccgtgtctaacatttgactgtccgtcttatatgaaattttttttataattagtattttcattgttgttagatgataaaacatgattaataatttatgtgtaacttatctttttaattttttttatacttttcaaataagacgaacggtcaaacgttggacacggaaacctagggtttgccttttttgggacggagggagtatataccacaaagatctatgctgtgatatttcctaagattctttttactgtccaaatgattgcaaataatgaggagatattctcttaagaggcagaattgttttttttttttttgaaaggaatcagcacagactgtgctatatcattgaatagagaggtaaaaaagtactacccctatgggtgaaaggagaaaaaagaaactgtacaaggcgaaattaatctttgcactggccattgtccaagctcgtgcctcttcttttatttttgccattaggctggggccgtcatctctttgtgttcaaagattctcctgttacgctccttccgaccgcaggtcttttttgggcacttccttcttgttggctatcatttcccaccaatcctgaacaccctgattggggcagaattgtttttccattttgaacccaattttcacatcgatgtttcgtattagacccacttttagtttatactttcactttaattcattttcttcttttttatgttttaacaaaactgatataaaaatatttggtgattgataaatactactagcaaaagtggtttattgattaaaacaaagagagcaattcacttcgcccctaatgtagctcgagtttggctcgatactccctcgcacgattttagatgtactctgacgtcttttgtggaccaaaaccatgcgttctatcttcacgcaactctattttaaggctccttagaacaacagatttttaaacaaattttagaggaatttattcttatagaaactttttgtttgatcatttggattaaagaaatagctatccaaaaatcctatgaaatttctttgaattggctcaaaacatagaatttttgtaggaattctgacatgggcttcaacctctcgaaaaaaaatcctttgcatctgtctttattttgattcctaccttttctcttcatccaaacaaccatttctacagttttctcatgtttttcaaaatcatactcccttcgttaaaaaaagaaaatctaggactggatgtgacatattatattacaatgaatttggagagagatatgtccagattcgtggtaataagatacattatattcaatactagattaattttttatgggactaagggaataaaatgtaaagtattagcctgtctagattcgtaatgtagacaaattcatagtattagaacgtgtgccttatcatctaaaatcgaaagtatgacacatcgatccttatgtattactatgtattttggaaatccactaccacggactcttgctgtcactatcggacagaagatatcaaaacagtttatttcagcaagtggttatcagaaaggcgattcaacgcatccatctagtctacgcacgcatgcgttgcacgcatccgattttcacatcgatgtttcgtattagacccacttttagtttatactttcactttaattcattttcttcttttttatgttttaacaaaactgatataaaaatatttggtgattgataaatactgctagcaaaagtcgtttattgattaaaacaaagagagcaattcacttcgcccctaatgcagctcgagtttggctcgatactccctcgcacgattttagatgtactctgacgtcttctgtggaccaaaaccgtacgttctatcatcacgcaactctattttaaggctccttagaacaacagatttttaaacaaattatagaggaatttattcttatagaaactttttgtttgatcatttggattaaagaaatagctatccaaaaatcctatgaaatttctttgaattagctcaaaacagagaaattttgtaggaattttgacgtgagtttcaacctcttgaaaaaaaaatcctttgcatctatctttattttgattcctacttttttctctccatccaaacacatttgttaaatagtcccacattggttgtggaagggcaaatgacctaaaatataagtgggggagcccctcacctcaatggagcttttggggtgggaaaggccctttacgatcctacaattggtatcagagcctggctaggttaacatctctggcccgatggacacgtgtgaaggcctgatggaccgtgggtacctgcggggcccgtatacctgatggaccgtgggccggtggggtctatacacggtgaaggggcggtgaagggctgagggacaccaatgtgtgaagggggagattgttgaatagtcccacattagttgtggaagggcaaatgacctaagatataagtgggggagcccctcacctcaatgtctagcttttggggtgggaaaggccctttacgatcctacaccatttctacaatgttgtcgtgttttcaaaatcatactcccttcgtccaaagaaagatgaatttagaactggatatgacatattacattataatacaatgtatctggacaaagatatgtccagatttgtattactaagatgtgtcacatccaatattatatcggttttaaatttgacggagagagtaagattgaaggtgttagtctgtttaaattcgtagtactaaaatgtagacagattcgtagtatttgattatgtgtcttatcatctaaaatcgaaagtatgacttatcgatccttatgtactttggaaatccactaccacggactcttgctgtcactatcggacagaagatatcaaaacagtttattttaaagtaataataaaaaaagcaagtggttatcagaaaggcgattcaacgcatccatctaattcatagtctacgtacgcatgcgttgcaggacccccttgctgtaccaaataattgcaagcaagtgacagtcagaaccctcgagcgtcatcaatttctcatgtgcgatatgattatctaaactctatcgaacgtgccaacttccatgcttttttttttttgaaggaatacaacttccatgcttaattgaggagtagttttgtccggctaatttgctagtctcggccaacccacatacagctagccaccatattttaagagctttatcatgcatatatgcgatttgccaaccaattgattcgagtccaactcaagactcgtagacgaaatcgatcatgtacacaggaagtacccagctaaaagtgaaatcaaaaccagcgtgtgctctgggtcttgccaatggacaaatgttccttttgtgattattactcaagaggaatttcccttcacgaacgaaaacggtcatatcaaatcggcatagcactagtgacggccacgactagttgaggactgaagaccagcaataatgacaatcgtaaactgatgaaatatcaaagtgattgtcagacaaagcgccattatcctgtcgcttacggctgcgtatgtccaaatcaagaatactacccgtactttgatttgcataatgattgcgttgaacgttggttgcttgatcatcttttatacactttgtcccataattttctttgcctttgtagaccgtagttcaaccaatgaaccaaacagcgagctgaaacgatggctggattggtcatcggctgcctggccgtgcagctctcgctggcgtctctgctgctgtgctcgtccgcgtcgacggcgcagcacacgctcggcaccggctcctccctgtcggtggcggaccggtcgcggccgttcctggtgtcgccggacggcaccttctcctgcggcttcattcaggccggcgacgacggcgacaacgccttctccttctccgtatggttcaccgccgccagggacggcgccgtcgtctggacggccaaccccgacgcccccgtgaacggcaggggctcgacgatctcgttccgccacgacggcgagctggccctcgccgacaccaacgggaccacggtgtgggcgagccggacgggcggcggcgggcggggcctgaccgtctccctccgcgacaccgggaacctcgtcatcgaggacccgtcgaccggccgcgccgtgtggcagagcttcgactggccgacggacacgctgctcccgtcgcagcggttcaccaaggacaccaagctcgtcgccggctacttcagcctctactacgacaacgacaacgtgctgcgcatgctctacgatggcccggagatcgccagcatctactggccgttgccgggggtgagcattttcgacttcggccggacaaactacaacagctcgaggatcgccatcctcgacgacgccggcgtcttccgctcctccgacaggctgcaagcccaggcctccgacatgggcgtcggcgtcaagaggcggctcaccatcgagcaggacggcaacctgagaatatacagcctgaacgcgtccaccggaggttgggcggtgacatgggcggcgctcagccagccgtgccaagctcacgggctgtgcggcaagaacggcctctgcgtgtacctgccgagcctccggtgctcgtgcccgccagggtacgagatgatcgaccgccgggactggaggaaaggctgccagccgatgttctccgtcggcaactgcagccagccggcggcgcctgagcggttcaagtctgtggtggtgccccaaaccgatttctacggctacgacctgatgttcaacgggtcctcgataacattcgagctatgcaggaaccagtgcctgagcgattgccagtgcgtcgccttctcctacaggttcgacggcgtcggcagatgcttcacgaaaggcaggcttttcaacggctacacgtcggcgaatttcccggggaacatctacctcaaggtgtccatcgacttcgacgaatcgtcgccattggtcagcgcgcggagcgccgccggcctcacgtgcaatcccaacgtctccatcgtgacagtgcccgctgccgtgtacgggatggctccaagaaacagcgggaagtggacctacctgtttgtgttcgccggtgtgctcggtgtcctggacctcctcttcatcgcgacagggtggtggttcctgtccagcaagcagagcatccccagctcgctggaggcagggtacaggagggtgatgacgagccagttcaggcggttcacgtaccgggagctcaaggacgtgacggccaacttcaaggaggagctcggccgcggcggctccggcgtggtgtaccgcggcgtgctcgacggcggtaaggtggtggccgtgaagaggctggcggtcgacgtgacgatgcagggggacgaggagttctgggccgagatgacggtgctcgggcggatcaaccatatgaaccttgtgaggatttggggattctgctccgagcgcaagcacaagctgctggtgtacgagtacgtggagaaccagtcgctggaccggcacctgttcgacacggccgaaggcggcggcggcatgtcgacgacgacgctggcgtggaaagatcggtacaagatcgcgctgggcacggcgaggggcctcgcctacctccaccacgagtgcctcgagtgggtcatccactgcgacatgaagccggagaacatcctcctgacgagggacttcgacgccaagatcgccgacttcgggctggccaagctgtcgaagcgggacggcggcgccggcgtggagctcacccacatgagggggacgtcggggtacatggcgccggagtgggcgctgaacgtgcccatcaacgccaaggtggacgtgtacagcttcggcattgtgctgctggagatcgtggtcgggagccgggtggcggaccagaggacggaagccggcgagcggctgcagctgccgcagatcgcgcaggcgctgaggcatgtgctggacagtggcgatgtgaggtctctagttgatgccaggctgcaggggcagttcaaccctcgtcaggccatggagatggtgaggatttctctggcgtgtatggaggacaggaacagcaggccgaccatggacgacatcgccaaggctctcacggcgttcgatgacgaggacgaacaccccgcttaccggtcatgatcatcaccaggctaaccgttagcatagttcagcttagagcagcagtcagctgtgagtttaattcagcacttgaatttcaaatttaaggattatgaaattccgaaaaattgtagttaagacttcaaatcgagtatactcagtagaagtactatagtcagtattgagctcctccccaaatattaagcaatcagttgactgaaaaaaaaaagaaaaaaaaaagaaaagcactcccagaattctttgaaacaaaggtcccatcggttgcatacggctgattaaaaaccattacggcttattagtgataaaaaagatttatgagtaaaacttttatatatgtgtacttagcgtgtcggtgatatggctcggggtatgcgaagtgcgggggagttacctcctgatccagccacgtggccctacagcttggccctccccccgcgcctcggaagacccagaggcagccagggagcctcgggtgccacgtcacacccctcgggccctcgcgctgcctcgccctgaggccctcgctcaactgccatgtggcgaggggagcgagcggggaggagactcagactgaaccaccatcaatgcgcgccgccccaactgtccctcaccgcatttaatgcggtaagggcggacgtgcggtggggcccgtttgactcacgtcaatcaggcgtgaccaaactgtgactggcctgtcgccggtcacgtccgatcggacgggcggccgtgcccccacactcgcccctgtacccagcggagtggaggcaggtatgccccgtcccatcgaagtatcatccggagctccctccacgtgagaaggaccgccacaagtcttcatccatttaagacggaatgacacggctgtcccccgtgtcaggtggggggcggcgctgtgtcccactcaaggacggactgccgcttagcttccgggcgaagacacggatcgtggtccggtcaaggtaaagtggatccccctcccgtgaaagagtaggtagaagcggtgcatgtggtatccccttgaactataaaaggaggaccttgcccaccgagaaaagggacgacgctcagtaggcctgaactctaggaggagaagagcgagagtactctccggagtttaggaacctttgtaacactcaaccataaatcccacacacaggagtagggtattacgctccacaacggcccgaacctgtataatcttggcgcccgtacgcgatctagaaaccctcagggcggatacacgatctcgacaagcgagccttttcccccggccgaactcacaaaaggggatctcacgatctcccgctagagaggatcactcctcgacatagcgacttaaaagctaaagctaaaaaagaaaatctttgaaaaaacatcaaaatcaaatattaaaattcaaattttagcattggcttataactttatatgctataaggcaaacgatgaggctcaaacatcatcatataccttagcagaactgaattacaaatagtgtttttattccttcaaatttcagaacggtatggcatcccagcgcgctcacgctgccgatcgcgcccgtcgtgcctctctccatctctcatgcgcttcctcggtgcacgctaagccaattttgttatatatttgttgataagtgtttttctaaaaatttaacaaatgaaattatagtataatcgtaatataattacattggaacttgcatataaccgtaatataacctacacgtaactttcatataattttaaactattagatttgtttcaagattcatgtaagtgaggaaggaaaaaaatcacagcacacacatatgtgagaggattcagggtgtgttcggttgggcttttcaacttgcttttgcttttgtaaaagccaaaagccaaccaaatggtccaaaagtcacagctacttttgcccaaagtcagcttttggtatagtacaaatcaaaagcacctctactccctcattcatctgcttttgggggaaaaattagccacctcggccattacacaaaaaacgcttcacttcttctttcttttttctcccatccttccccccgtgcgtccctcctcctcacttcaccttcgccgtcgccgccgctcctcctcccccccgggcgccgccgctcctccttgccgtcgaggccgactccatcaccgttgaggccgactccgccgccgcatgcgtctacctcccctccgccgccgttgcacgttctgcctccccgccgccgccgtcgaggccagctccgacgccgccgaggtcgactcccgcgtctgcctcctgcgcgttcgattccgccgccgacaccgtcgaggcctcctccgccgccacgcgcgtctgccgccgccgaggccctcctccgcgacacgccgccaccgccgctgaggtctccttcgccgccgcgcgtgtctgtcgccgccaccgccgctaaggccgacgccgcgcacgttatgtgttttttctttcctcttttttttccttcattttcccctcttttccaatgggtgtatgacatgtggagcccgcttgtaagtgggactagttatttcaaaagtcacaactgttgaaccaaacgagcttttccaaaagccacaccaatattccacagctacttttcgaaaagccacagcccacagctattttttcaaaagccacagctcaaccaaacacacctcagtccccacaaccttcatttcatagaaataacatgttttggagaaaattttttaaagttgaagatacatttacattgtaattacataaaaattacaatctaattgtattgtgattgtactataattacacaataaaggtacaggcaatccccgttgagctagttggcctgatagactggagggtggggagcgtggggctgggtgctgaggattcaattggaccgataatgagaggagatatatcctaatgggctgcacactgattggatcagcccaatagatgcatatctttcatgatcgtttatattagaaataagttcactttaactcccttaaagtgacccgaatctaatccgtaaccctgaaccgtaaaaccagaaatcttgacccctaaactattaaaaccggtgcaattttgactccccgggtggtttggagggcggtttcgctgacatggcggtgttgacttagtctccgtccgacgtggtgttgacgtggcgtttgtatggcattagaattaaaaaaaatgcaggacccatttgttattcgccaaaagaaatattgtgggacccacatgtcagcatctctctttgaccccttcttcctccctctctcccccttttctctctccctctctcctcgacaggggcgcgccgttgcagccgcgggcggtgaaggcagccgtggactcggcgttggtgctcacggcaaggggacaattgaggcaaagccgcgccatcctactgcggcgccagcgggatgacgacagggagcggcactgaggagactacaggcgacgagcttcatggttggtgagttatgaggaggaaggagagcccggagcagggggcggcatcctcctcgcccgccgctccgccccacttcggtcgatgggacaggagtcggagacggcgacgtcggcagagaggtcaacaccgacgccgca

SEQ ID NO: 66328 - DNA, 9971 bp, Oryza sativa
cgtgctaaaaagtcaacggtgtcaaacattttgaaacggagggagtataatattagttcagccaaatcttgttcgattaatgcccaaaaggaagaagtcggagggattaatttcacatatccatagaagtggaataaattgaacctctttcaagggtccaacagggatttaccgaggaattgatccgcaaaaggtaggctatagttggccaagtttatatgaaaggattgtcgatagttatacttttaatgttttacagatatactaataaaaaacagtagtcaagtttttgattgcaacatttgaccactcgtcttattcaattttttttacaaatataaaaaacgaaaagttatgcttaaaatactgtagataataaagtaagtcacaaataaaataaataataatttcaaaaaaaaattgaataagacgagtggtgaaacgttgcaagcaaaaactcaaatcccttatattatgggacgggggagtacttaaatatgtgcatcaagattgtatcaataaagacctaaacaagaagtaaaaaagggtggggatgaaaaacgtagtactaaaaaacaagtcaatttaccggcaaattaagagaaattagaaatttggttgtaattggaacgatatgatggaaaagttgaaagtttatgtgtataggaaagttttgatgtgatggaaaaagttgaaagtttatgtgtgtaggaaagttttgatgtaatggaaaagttggaagtttgaagaaatattctggaactaaacacggcgaaaagtaggccatatcattttgctgttataaaattaaattgcattcttctactggttacacatacctgatacgcgtactgcctatagacgtgtagtagcacgtgcactgcatgctttctggacacggccaacttaactgtcgtgtcgtcaataggaacagacgaacgatgcggtttcattttcattagccgatcgatcgatatctcctgcctccgctacttgccaagttgcactaacatgcgttctcatttttattttgggtactgctaccttcgttccatattttttttaagtcgaatttatttagctttatcaatttttttaaaaaaacataacaaaattttcaacataaatcaaaataattataataatatattcaatgttatatttaataaaactaattcggtgctacgaatatatattactatatttttttcataaatttagtcgagcttttttaaaaatttaagtttagaaaagtcaatccagtgggagtaacttctaatacacggagggagtacaaatcattctaggaccatgatacagcccgcacatatgcatcttggtcggcaacgtgtgacaagaggtactatgccatgcatgtatcaacattgattcatatacaagtgattacccaattaaaatctaaattcatgtctaaatatttgtgtataagggttaggctcagcttgaaacgtattatagagctttttagaaattatttacttgattatgaggatatcaaatgctttaataaacaaatttaacaaatagttttaaacaaatgatataaggaatgaagcataagattttttttttagaaaatgcatttttccaagcgtgaaataaacaatccatttcaacattttgataaacaaaatctgaatagaaacacgcggatgttgagttgtacttactttataattttaattttaataaaaatggattacagcttggatcaagttttgttatcagagcttttttttgaattatctttttaccttggaccaattaactttatatttatttttcaatttaagatcattatctatcagaatttaaatcgtagtgacaaggtttcaatataatttgagtaaatttcataaaactacaggtattttgaccaaattttcacaaaactacagatttaaggagttgtatcacaaaactacatatttagcactaaatttatcacaaaactacagattttagattaagtatcataaaaatgcatatttaatattgagcttatcacaaaaataccacttttggagtttaaatccctagcaccattgttatggtggagctataaacatcattactttgtgattaaattgattctaaacatgtagttttgtgataatttagttactaatatgtagttttgtggcacttcatcttaaatgtgtagttttgtgataaatttggtgttaaatgtgtagttttgtgatacaccgagttaaatctgtagttttatgataatttggtcatagtatctgtagttttgtgaaatttactcatataattttaatgggacacgctgatcccgttcgtcaccataagcttgtctcatagacgtatccacgcgtatacgggtgttcgcggatcatctccatctcatatactccatctgtcaaaaaaaaaaaaaaagccaacctagtagattcaaacaccactatagactaggatgtgccatatcttagtgctaagttggctttttttttcaaccgagggagtgcatgtcttacaagacaaatttgtgcatatgtgagcgtggtgtgatgtgtcgtgggtttaagggacaaataagaaaagaagatgcttttcataatgttctaaaaaaagagatggttttcagaagcatcgcacgcaaggggcaatgtggctattagaacagtcactctccacccttagctacagctactacaagttgagacgacgttgatgttgatctcgtcgtcacaagtgagaccgggactagtactcggaccagagaagacaaacactacgacatgatagatgcggcctcctcctcccttcgtgcgcctcgaaccctccgcgaagccgccaacccccacccctctccccctttaaatcgctcgctcgcgcgccacactcctcgaaccaccaccaccaccaccacgtgttcgatcgcgtcctccaagccccagcacctacgcgtcgtcgcgccatggccggcttcggcttggaccagcacctcgacctcatccgcgcccacctcctcgaagacgcccaccaccacgtcctcgcgccatcgccgtcgccctcgccaccgggtactgggcgtgtcaggccggcgcccgtgtcgctgcccccgaggccgccgctcctgtgggcggcggcgtcggcggcgccgcggcagcaggaggagtgcttcgagctcggcggcggctacgcgggggagggggagggggaggaggaggacgacttccggcggtaccgcggggtgcggcagcggccgtggggcaagtacgcggcggagatccgggacccggcgaggaagggcgcgagggtgtggctcggcacctacgacaccgccgtcgaggccgcgcgcgcctacgaccgcgccgcgttccagctccgcgggtccaaggccatcctcaacttccccaacgaggtcgccgccgacgccgccgtcaagtgggcccctcccgtcgcccctatccccgccgccgccatgtccgccggaagaggcaagagggtgaggtcggaggagcagtactacttgagggaggtgaagaaggagaggctgatcatggcgccgccggagaactcctcctcgtcgtcgtcgtcggcggcggcggcagccggagacatctgggacgagctgaaggggatctgcagcctgccgccgctctcgccgctgtcgccgcacccgcacatggccttcccgcagctgttcgtaagctgatcgatcgctagctccggccatggacggcgccgtggcgagcttggagtgcagccatggcgcgcgcccggcgcggtacacgcatggctgccgcgtggtggtgtccgtgacgtcacgtgcgaaggatatggccttaatcctgaattagatagggtgttctttgattaattcgctaaacttcgtaatattaggtaatcgatttggctttcggccaaatattgaattctttcgttctattgctgctcaggtgatcgatgatcatagtagcttcattgcgatttgtcaatgaaatgatataaatatgtattaattacaagttgaagagtactaatgaagaacatcagaggctcagagcaattgagcgcacatctcgttaactccagtctccttttggaatgattggctagtagtacttgtaagacatcgaccgttgaagtcgtgatgtttgctttcttcttttcctttttagaacacgtgattttgcttttgactatgctatttgatgattaaacagagaagaaatattcgtcttacaagatcatatcaccgaaaagactagctaggcgcatggagtagtactggaaacaagctctgctaaggccctctttgtttaggcttaagcttattggactagacttttaagccagctgtggttaatctaggcccattttggaaaaaaaaacattagctgtaatttttctcgaagttatatatttcttgcactaaaaaattaaaaaattagagagataatttgagtttctaagatggattatttcattcatattttaaatagtaaaaacggaacactaaatctctatgattttattcccttcgttcaagtgtaaatgtcagttttaactttagattggcatattttgatcaacaatatttttcaaataatctagcatcaaaattgtatcattatatttgtactaagagctttactaatactctcttgcattcgaatatgtttggtttgacacgcttagaaataatggtcaaatttcatctacctctaataaaaaacggatgactagtaggagtagcattcagactattcaacgggaatcccatcccgggccaactgatggagtgtgccaccttccggcccagggatggtcaccctgggccggctaacaaggatacggcccagatggatgcgtggacctctggtagactagcagcagtgcggcccatgtacatcgcaggaatcccgtgtgagccgaaaagattgaccaaataagcattatgcttttttttagatgggagtagctatacaactattgatagtttttgggatgaaaaaatttcaaatataactactatataattacattgtaactactatataactactatataactaatatgtaactcgagtgtaactcaaaatagcctgatgggagaactggttaggggaacaaacctccaagttggaggtgttgggtttgatccctacagcacgcgtttgaattttttaagccgttttccctcactagcacaaatctcaaagcatattagacagcttaaaatttgaaagttttcaccccctgttaactgtcgccagttggttccctcactagcacaaatctcaaagcatattagacagcttaaaatttgaaagttttcacctcctgttaactgtcgccagttgtatagcaaatccgttttagaaacataggcattcacaacgccgcgcgcagacacaccatatctatatgatatctatatgagttcctcctaccactaaaagaataattagctgtaaatgcgagcactcgtgttaaatctaggatttgaactcggatgagctagttccaccacaagaaatctaaacagttaagctacgttcaactacggctgaattgttgtccacttgagagagttctggtcacaacaagtcagcaatcaggatattggcgagaagcctactcttcttcttcttgatgaatgttgccaatgtggtatgtgggcacaatttgcacaaaatgatgcttgtgggcaacaactttagctgcattagcgtcatctaattcagaacaaaacttgaaacttttcattttcctttttttgaaaggatctgaaggctgaatgaagcttgtaagcaaagtggaacacaaagcttagaagcgacttcactgatatgtgggccccttccctactgtaggtcccgcgccacgtcagctctcgacggcgctcctcctccaacttccaagtcgccggagcggcagttgggccagttggcctgggcccacttcaccccaaccgaaagccccccatcaaactgacatgtggggcccacccaaagcctactatctccgcgactaccggactggcagttgggccagttggcccgggcccacttcaccaccacccgaaagccacccatcacactgacatgtgggcccccacgaagtcacgccgcctccgtcttctacctccgcctcgtcgtcacaagtcacaagcacaagaggcgaaagcgcggcgccgtcgcggagaggagaggagggcgacgagggggaggcgattcccaaaccctagctaccctcaccgccgccgccgccagcagcgatgatggcctacgcgctgcgcggtgccgccctcgtcggcgtcctcctcctcgtcgtggcctccccggcgctcgtcccggtggcctccgccgtgcccttcatcgtcctgcacggttagggtttttttttttctctcgcttgtttgcccccctaggttttgtgctctgctggtgcttggatttcgtctgaggttttgctggtcgtgtgtacttgtctgtgtccgggcgcacgcagggatcggcgaccagtgcgagaacggtgggatggcgtccttcaccgaaatgcttggggaatggtccggctccaagggatactgcatgtaatggcgccttatctccccccatctctctctcccttgtgttctggaagtggagactgttcgagctgtgatatttgtgaattgtgatgttgccttttgttatgacgagaaattagttgctgtttcaagtgcaatactagtgctctggtttccattaatatatatgtacaggctattaattaattatttctttgtttttccatgtgaaattgttaatgcgaataaatatagatgcccaaattagatatggtagccttaattatatatccttggggttggggaggtttaaaaaggaatagattgaaatactccacacatatttagcaaatcacgaggataatgaagtatgatgagacgattactgtcaagttccatttgttaacttgtccctgcaattttgtgaggaggatctgggagtaacatatacagttttatacatttgcaaagtcaaccacagtttctgttatggtatgtacacccaatgtgtgatctcacaaccaaaccaattgatgtcccaacttcttttttgagagtttagcccatgctgcatttgtttcagtcaaccacaataactgtttctgttgttggatgcctggagattttatcgcgacattcacctctttcttacacgtttgggtattcacgtaatctgttgtttcagtatcttatttttcgtaccttaccatcctgctctctatttttagttaaatgtcaactgttgtatgaagccaagtttgggcaattcaatacatcttagaagtctcctgactttatgccatgttgaggaactaatatgttgtctgttccaattgcttttacattacttagtatggccttcctggctgttggaagtgaatttaacctgtcgcagtccatagtggggataatgaagattctgatatgcttcataattttgtatttgttcctgtggaatgggccttaacaaaatatgcagaaacaactattgttgaaaaattcatctagtattatggtatgtacaccctagtgggtgaccttacaaccaattgatgccacaactttgtttcttgagatgtgttacatcatatatcagtacaaattttaaaaagtttggcacatgctgcatttgtttgctagtttacttatggagattaaatgtattcctcctcagtgaaattggaagaggagcatgggactcttggctgatgccacttcaagagcaggttgatttcttgcccttgataatttcctttttttaaaaaaaaaatcaaatagactgttcttgtacaagtttctgagattatgtattcatctacaggcagacactgtttgcaagaaggtgattcagaacctccatcacttctatttatgtactgtatgctgaattctcaaggtactatatcattgctggaattgattttccaggtgaagaaaatgaaagaactccgtaaaggttacagcatagttggcctttctcaggtgtgttcatgctattatgctattttatgttcatgacaatagctttattgtaacatgcagatctgttctttgcttcttgtacctctatgcattgctgttcttttgttatgtcttcttttagtcctaagcctatttgatcagtcttggttaacccaaaaccaaaaaataataataaaataaaaataaaaataaatcaaacgaggcctgtgtggaaaaaaaaaaagtgattttcctctctttgtgctgctgccgaacgcaaccttaggcctgtgcggacatgtctcgcttttgttctatgtggacctcttgagtataaaacgtaggagtgtgctatgtgacccttcgatagatttttatttgggttattgacttagtgggagttttgttttcaatgccatgtatttcactagagaatcaccttattgtttcttgttgcatgtcaaaatttccctcatatgtaccctttttgttaccttttacaggggaacttaattggtcgggcagtaattgagtactgcgatggtggaccaccggtaggtgaatctagttcgcttcctgatgttacaataataatatattttatatggtttgttattaacataacaacaccaaggtgagaaatttgatgtacttgtggtttaccatatgcgtcccaacctttcttgatccaaatgatgccttggacctctcttatgtacagttatagtttatttgctgactgtaacaggtaaagaatttcatctcgattggtggtcctcatgctggtacggcatcagtaccactttgcggtgtaagctcactctatcctcccctggtctccttcttttgcatatgcgtatagaccagtatttaagagtagactgcttggtatgaatgactgaaggtttttcatgcatataaatttacacactcttaatgtttagtagccaatggttactaataagcaacaggtagctatttgtagaatgacctatagttaaaacattactccctctggtttaagatatatgttattttagctctatccaacactgaaaaaaaactaggaaaagctaatgtcatagatcttgacatagagcaaggaacgctaatgtgagggggaaaaagttatataaaaaagaagttttttcccaaagaaatctttgctagaatggcataaaaaaatggaccggagacacttattgatagaacatgaatatgtcatataacataaaattttcggggatgatctgtagcattggccaaaacatgttggatgcagtttatgcttgctaaccatccatttgcacagctatcttgactcactggagaaaaacagcaatgcattacaagtgaatagtgataacttctttcaatttgccagatttcaagggagggagaaagcatgctttgagtcctgtatgaatatgtttttgttcgtttctttgttaacctagatcactaattgactgtaatttcaaacagattgaggttgtatgttaatttgtaaattagcatgaggccttgagactgctcccttacttttgtgcattcatatgaatgagcatgcctccaagttttccgtggggtttacttcatgcaatgttttctctagtatctgaataatgtagtttctggtaaactcatcttctgtcatttatagctgcactaggaacttcaattctcaggctagtgacgttgctatctaacagttaaacaagtactgttgcgctactaaccctttcttcttttttttgcagtctggcatcgtttgtgttcttattgatgctctgattaaattggagatatattcaaactatgtacaggtgtttatgacttgtctttttttgccatgtcttaattggtagtatcactgttaggcattacacacatcatttctctttaagtaacttgaaattggtggtattgcaggcacaccttg

SEQ ID NO: 66329 - DNA, 12841 bp, Oryza sativa
gctatagcaaaattgtgtgatgtgcatggactgtgtggcgagaatggtatatgtgagttcttgccaagcttcaagtgttcttgtccccctggatatgagatgagagatccaacaaactggagcagaggttgtcgtccactattcagcaaaaactgcagcaaaatagaagaatatgagttcttcaagctcgctcaaaccgacttttatggcttcgatctaatcatcaaccaatccatctcacttaaagaatgtaaaaagacttgcttggacatctgctcctgctcagcagtcacgtataagacagggtctggaacttgttacatcaaatatgtactcttcaatggctacagctccacaaattttccgggtgataactacatcaaactacccaagaatatggtttccaaacagtccgatctctcatgcaacccaaccaaagagattgtactaggatcttcaagtatgtatggaatgaatgatgcaaataaaaattatgcaacctattatgtgtttgcagcagtattgggagctctagtgctaatcttcacaggtacaagctggtggtttctttacagcaagcacaacatacccatgtcaatggaggcaggctacaggatggtaacaagccaattcaggatgttcacgtaccgagaattaagggaggcaactggaaagttcaaggaagagattggaagaggagcctctggtattgtttacagaggagtacttgaagataagagagtgatagccgtgaagaggctaatgaatatttcacatggtgaggaggaattctgggcagaaatgagtattattggaaggatcaatcacatgaacttagttaggatgtggggtttttgctccgagggtcaacaaaaactactggtgtatgagtatgtggacaatgaatcactggacaagtatttatttggtgatgtaagtgctgagcgattgcttgcatggagccaacggttcaaaatagcgttgggtacagctagaggtttggcctatctccatcacgagtgcctagagtgggttgtccattgtgatgtaaaaccagagaacatacttctgaccagagattttgaagtgaagatagcagactttggactggccaaactctcaaagagagacagtaccagtttaaacttcacgcatatgaggggtacaatgggctacatggcaccagaatgggcgttgaactcaccaatcaatgcaaaggttgatgtctacagttatggtgttgttcttcttgagattgtaactggaagcaggatatcaagcgggataaaagtggatgggagggaggtggagctcagagattttgtgcaggtcatgaaacatattctggctactggggacgtcaaggatgtaattgatactagactgaatgggcatttcaattctgagcaagcaaaggtaatggtggaagttgctatatcttgtcttgaagaaagaaacagcaggcctacaatggatgaaattgcaaaagccttcctggcatgtgatgacgaagacaatcacccagcctactcatggtgacctgcaaagcaatagtgttttgatttgaaggatcaaaaactagttattcagtttagcatgcacaatacttgaagtaaacagttcttgttagagaaaataagtcagatacttctataaattcatttcagtatagtggcaggtttgtttattcaaatgtacatccaatagaaaaataagtgtgttggatcagtggaacgctgtaccaatgtttaaagttcttaactttgcacttctggtgagtctcctgagaatctcctcatactgacgtgtcattctccacgtatatatttccacgtagctaagaataatttgtagttgtgttgctggtgtagtcatctgttgggaaatacagcaacagcatccaacaactatttcttcacattttttcacccgttagagatctaaccaggaaagacccttccatcatgctttagacaacgagtagtgtctcacgatatgaccacaaataaatttacgaatttaagtatttgttgttccctggaatagtaaggttgaattaatatgctaggctgctagctgatttgcccagataatgtacaaagcttaaagagaatatagaatccaagaataaatagttgacttgagtatgacatcctgtaacttacctagtcatccatgatcatgtgtggtagttatgtaaacataatacaaatcaatgataatcagcacagtccgcagaatgtttgctaaaaattccctcaaggcactgagtatcagagattaaaatggcaaataggatttgagggtgcctcacctacgagtagttaatactatataatatggccattttgatcctaaacaagtgaattaagataatgatgaaaggtgctagactgctacacctatcgttggaaaatttgtaaggaccagaaaggaactctttccttgaaagaaccagctcactaataatgatttaaatactggaagttctcctagaatacaaccaccgcgataatcagacaacctactaatggtgaccaataacaacactaattttattttgcaagaagaagaattattataccatagagaaaagatcagttcgagcatgttatgaattcttcttagggcaataatatatcaacttgttcttaattgtaatgaatctgttgaatattctagtgtctgtatgaactcttgcatgaaactaagtaggttcatttagaaagaagtacgataccagtacctttatttgatggcaagctgcgttcagttattcagaagggcccaagtaaggatatgatatacacaatatcaatttagtgcacatttctcttgatcctttggcgcatgatttacactaccacagtaccatgtgatctcgtaagcagtaagcttactttccttaaaaaatatacacatacacaaagccataaaggatacgctctccgctatgcacagccgcattcagttctagggatggctcatcgcctcatctatctactgctgcgacatcacctgtggggtaccaattgacggcaaaaatgtcagttttctaataccatcacgagactagtaataacataaccgagccatcaagagggaggggcccgcgatatgtcctcaatcatccgagtcatccccgattccccattctcgtggttgccgccaaggtgttcgatagaattccgcaaagacaatagaggtctgcacggggcagggacaagggcggaggagggagggggggggggggggataacattcacctgcgcagagagcacgccggacgcggccggggacacggagagagctgcagatctgatggctccgctggtggcaagaggcccgaggcaacgtggttgaggcggagcgaaggcgagcgcagcggcagttcggcactcggcgcggctggttcgctggtgaagtggggagtggggagtggtgaagtggttcagtcgcagagtcgctcaagggccaaggcggtttgaaggatgtctagttcacctcttgaatcatctatcagcactaactagctttttcataacgaaattcgaagtgatggcgttctacatggtaatactccctccgtccaaaaaaaaaaactcaacctactacttcgatgggatataatctagtacaacaaatctagataggagtactaggttaagtttttttgggacgaaggaagtatgcggtaactttacatccaccgtagatctataaatttgaatatattaaatctggatatagatatatgtccatattcataattctaaaatacttctaatcttattctaaattactaatctatctatctatctatctatctattatattattaaaacagctcgaaaagaaggcatcacgttcgttgtggggctagaaattcccacattaatcgaagaaaaagaaaagaagagtccaaatagaaatataatttaaaaatagctgaaattcggaattataaataagcaatattgaaagaagagttcgtataagaatccaatacgagattaattaaaattcggaataaaaataaaataaaatctgaaattggaaaaagaagagtctatgtaggaatataatctagaaataattggaattcggaattaaaaataaagaatattaaaagaagagtccatataagaatccaatacgagattaattaaaattcggaataaaaataaaataaaatccgaaattagagaaataaaaaagatagtttgagtaggatgaaacaactataaaattgaaaataaaaaacattaaaaaataattcatataagacataatacgatattaaccaaaattctaaataaaaattaaaataaattccaaaaatagaaaaaggaaaaataatagttcacctaggaataaaatttataaataacttaaatttgtcataaaaaaataaaaactattgaaataagagaccatctagaacatatcacaagattaactaaaatttgaaataacaaaaaaataaattctgaaaatagaaaaataattataagagtttaagtaggaatataatttgtaaataaaaatatcggaatgaaaaatatggacttctaaaaaaaactccatctagaacacaaatgatgacaaacaacaataaagagggggagaagcaacaagtttataaagaagtagaacggtggcggttgacaggacatctaaaaacaattaacaaaacctcaaatagaatcccaatgatgattaaaaggagggacgacggatgggccgttaagcagccggtcatggcagttggcgggacttatagaaagtaaaatatgaatccaaataataattatgttcgatttttaaaatcccaatgacaataaagagaagaggcagtggataggccgaagagaagtacggtgacagggtttgatatgacttctaaaaattataaaaagatgacaaatgacaacaaatataggagaagcaacatgcatgtaaaggattagagtggtggcggttgatggaatatctaaaaactataaacaaaccccaaatagaatcccaatgatgattaaaaggagggacgatggacgggtcataaagtagcatggttacaacggttggcgggacttctaaaaagtaaaaaaaaaaacccaatgataatcatgttcgaattttaaaatctcaaagacaataaagagggaggcagcgggagagcagtacatgtgtacaatggtaaaggtgctgacagtttggtggaacttctagaaagtaaaaaaagaacccaaatggtaattacgtttgatttttaaaatcccaatgaaaataaagagaagaggcagtggatggaccgtagagtagtatggtggcagcatttgacgagacttctgaaaattataaaaacaaaacccaaacgagacaataaactctaaaaactataagtctaatttttagaggtttttagtgagaccaaattgtcggagatatgggcccgggggtatgtggagtaaaggagagctacttccctttccagccacgtggctctgcgagctggtcccacccacatacctcgtgagtcactaaggtgatggggagagcctcgggggtcgacgacatcccctcgggggtgacgtcaccccctcgggctctcccgtcgttttagcccgaggccctccctcggggggaagggtgagaggggagtctaggctgggcggccataaatgtgcagcgccccaaccgtccctcgctgcgttcaatgcggcgagggcagacgtgcggcgtgcccgaccgacccctgtcagtcggatacgaccggtctgtgaccagtctattgccggtcacggccgattgaatggatggtcgtgcccccacgtcgcctctgtctccgcggagtggcggtaggtacgccccgtcacatccggacgtcgttcgatatagggctgccgcaagtcctcactcatttatgagggaatgacagggctgccccccgtgtcaggcgggagacggcgctgggccccactcaaggaccgaccgatgcttagcttccagcaaaaggcacgggttgaaacccggtgggaagagggagaagggccccctcccctccctccgatggagggggagggtagaggcggtgcatgtggtatccccttaagctataaaaggaggaccttgcccaccggagagcggagaggagcaaggagaaccttgtaaaagtccactgataatcccaaacgcaggaggagggtattacgctccagagcggcctgaacctgggtaatcgaattgtgtgctatctaaacggggatcggagggacgaacacgcgacttcggagagacgagtctctgccctcggccgaactcacgaaaggggggtcacgcgacttcccgcgatcggggggtcttccctcgacagctggcgcgccaggtagggggcagttgcgcgtttgagaagaagtcgcttccttccgctccaagtcggaccaggccctagaccgccatggtcgaggtcctggaagcgggggaagcggtggcgtttacccccaccccgtctgggagtggggattcgggcgaaaaccgtgaccctcatcaccatcgccgtggctctcgaagtcctccccgccgcgagccttcgcggagggaggatccaacccgttcaagtggtacggccctctcccgcccccaggcggagggaggtcgcgacgcgtcggagcacgtcatcgtctcgactacggagacggtggttcgccccaaggcgcgcttcaggcggtgggcgcccttctgcggcatcccccggtgaacccggagccggagacccccgtacggcgctggctggacgacgtggccaacttggtcaccgctgcccagcggcagttggccacgggtggccaatccaccgccacaggtacatcaagtgccccggctaccctttcctcgtcggcgaggagaagggcccgtcgatcggccacaacctcgaggcgatccacggctccaacgacatcggaggtctcgggaaggcggaggcgtcacgatgacctctacggggcgcaggacgctcgggtcaacatcgagcgacgccgggacgagcgccgggctacccgcatgggggaaggcgcctcctcatctggagtgccacgctcttcttcgcgaggcggccctcccctcacgctcacccctgggggggcaggttgtagggctttcgttgcgagtctccggaatgtccggtggcccccgaagtttcgccccaacctcacggagaagtatgatggcagcatcaacccctccgagttcctccaaatctacaacacgatcatcgtggcggcagggggtgacgaccgggttatggcgaactactttcccatggcccttaagggtcaggcgcgtggctggttgatgacccagccccccgactccattcactcttgggaggatctgtgccagcagttcgtcacgaacttccaggggacatatccccgcccgggggaagaagcggacctgcatgctgtgcggcggaaggacgacgagtccctccgttcgtatatacagcgcttctgccaggtccgccacaccataccgtgcattccagcccacgcagtagtgtatgcattccggaacggcgtgcggcataaccgcatgctggagaagatcgcctccaaggagcccaagactaccgccgagctcttcgagctggcggacaaggtggcccggaaggaggaggcgtgggcctggaactctcctggcaccggtgcggcggctgcggctgcccccgagtctgccccccgctctaagcggcgagataggagaggcaagaggaaaccggcccgttccgacgacgagggccatgtccttgcggcagacgggcccacgcgggccccgcgcaaaggaaagattaccggcgataagccgagctccaccgccccctccggcgaaggccggtcggcggacaagtggtgttcggtgcacaacacttaccgccacagtctcgccgactgccgctcggtcaagaacttggccgagcggttccgaaaggccgatgaggaaaagcggcagggtcgacgggagggcaaggctcccgtgacctcaaccagtgaccagcgagaggaggccaagaacaaggcccctgctgacgatggcggaggtagtgaggatctggatttccagataccccaagggaccgtcgccacattcgatgggggggcttgcgctcgcatttctcgtcgagggttcaaggccatgaggcgggaacttctggccgctgttcccacccacgaggcgatccggaaggcgcgctagtcggaggtaaagctcaccttcgaccagagcgaccatccgacggtactcgctcggggagggaagttggccctggtggtctccccgactatccacaacgtcaagatgaagcgtgtgctggtggacggtggggccagtctgaacatcatctccccggctgcctttgacgcgctcaaggccccggggatgaagctccaaccgtcgctgccaatcattggcgttactctgggacacacgtggccgcttggtcacgtcgagctcccagtaaccttcggcgactccaccaatttctgcaccgagcggatcgacttcgatgtggcggatctcaatctgccctacaacgcggtcctgggcagacccgcgttggtgaagttcatggccgccacccattacgcctacctccagatgaagatgccaggtcctgccggtcccatcaccatctttggtgatgtcaaagtcgccctcgcctgtgcagaacagcgcgcggacaacttggcgatggccacggggccgcaggccccggaggcccccgcgtcccgcgcccccaagaagcgcctcaccttggccgacgaggttcccgtcaaggagattccccttggcgacgatccgtccaaaaccgctaagattggcggaaccttggacgccaaataggaaggcgcgctcgtctccttcctgcgggcgaattctgacgttttcgcatggaagccgtcggatatgcccagggtccccagggaggtgattgagcaccgcctcgccgtgcgaccggatgcgcgacctgtccggcaaaaagtgcggcgtcaagccccggagcgacaagccttcatcagggaggaggtggaggaggtggcgcggctcctggaggctgatttcatccgctaggtgattcatccggagtggctggcgaacccggtggtcgtcccgaaggccaacggcaagctgcggatgtgcatcgactacacagacctcaataaggcatgccctaaagatcccttccctctaccacgtatagatcagatagtcgactccactacggggtgcgaccttttgtgctttctagatgcatactctgggtaccatcagattggcatggctagggaagatgaagaaaaaactgccttcattactcctgtaggcaccttttgttatacaaccatgccttttgggttaaaaaatgccggtcctacctttcagcgcatgactcgaattactttaagtaatcagatagggcgcaatgtagaggcgtatgtcgatgacttagtggtaaaaacgcgccgccgggacacattgctgcaggacctggccgagactttcgatagtcttaggtccacgcgcgtaaagctgaaccccgataagtgtgtgttcggcgttccggcgggcaagcttctcggttttctagtctcttcccgaggcatagaagcaaatcccgagaaaatacgcgcgatagagaggatgcgccccccaacaagctcagggatgtgcaatgtgtcgctggatgcatggccgccctgggtcgatttatatcaagactggacgagagagtgctgcccctattcaagctcctcaagcgccccgggccgtttgtatggacggaggaagctgagcaagccctcaatcagctgaaagcttacctcacttctccccctatcctggtggccccggggccggaggagccattgctactctacttggctacgaccccccacgtggtgagtgccgccctagtagttgaacgcgaggagaccgagcgggaggtccctccggctcgtgatggcccctcgtcccccaaagcccccagcccccgggaggaccccgaggcccccggaggagaaggcgaggctttggcaggaggccccgagccctgtgatcccaagataatccggaatcccctggggcccccgagcaggcgcgccccgggtcatccgcccctaacaacacgaaccggccccgccgaacggtgcagcggcccgtctactttgtcagcgaggcgcttcgggatgcgaaaacccggtacccgcaggcccagaaaatgctttacgccgtattgatggcctcgaggaagttgcgccattacttccaagcacatcgggtttccgtggtaacatcgtaccctctcggccaaatcttgcacaaccgagagggcaccggacgggtggtaaaatgggccatcgagctagctgagttcgacctgcacttcgaaccgcggcacgcgatcaaaagtcaagtcctggctgacttcatcgcggaatgggccccagtggacgaccatgttccgtccgaacccccttcctcccccgaagagaaagaggacccaaacgctgacattcgtggcggacactggattatgcatttcgacggctccctcacccttcaaggcgcgggtgctggagtcacactaacctcgccaagcggagacgtcctcaaatacgtcgttcggctcgacttccgagccacgaacaacatggcagaatacgaagggctcctcgcagggttgagggcggtagccggaatggtcatccgccgtctcctggtcctaggtgactcccagctggtcgtaaatcaagtatccaaagagtatcaatgcaccgaccctcaaatggatgcatatgtccgcgaagtacggcgcatggaacgccacttcgacggaatcgagctccggcacgtgccccggcgcgacaacatgctcgctgatgagctgtcgcgtgttgcgtcggcgcgagccccacttcccccggggacctttgaagaaaggcttgtccaaccatcagcacgaccgaacccctcgaggggctccaacgacataccctccgccccgactcctgccgacccgcgccccccggagcccgagggggtcgaccccgaccctcctccgcgccccccggagcccgagggggtcgaccccgacccccctcgccaagtcgcatggatgactgacatccgggcgtatctcgacggcaatactcatcctgaggaccgcgcagaagctgaaaagcttgcgcgcatctctaagcggtacgtcctcgtagaagggaccctctaccggcgtgccgccaacgggatactcttgaagtgtgtttctcgagagcagggcatcgagctcatagccgacacccatcagggcgagtgcggggcccatccggcctcacgaactttagtcgggaaagccttccgtcaaggcttttattggccgactgcattacaagatgcccaagaatgggtccggcggtgtaaagcgtgccagttccacgccaagcagaaccaccagccggcccaagccttgcaggtcatccccctctcttggccttttgcggtctgggggctagacatccttggacctttcaaagcggctcgaggcgggtatcagcacctgtacgtcgccatcgacaagttcaccaagtggcccgaggcttaccctgtcgtcaagatcgacaagcattctgccctcaaattcatcaggggcatcacctctcggttcggagtgcccaaccgcattatcacagataacggcacccagttcaccagtgagctgttcggcgattactgtgacaacatgggcatcaagttatgctttgcctcgcccgcccaccccaagagcaacggccaagtcgagcgagccaatgccgaaatcctcaaaggcctaaaaaccaagacatacaacgtcttgaagaggcacggggattcatggctcgaggagttgcccgccgtgttgtgggcaaatcggaccaccccaagccgcgccaccggggaaacgccgttttttctggtgtacggcgccgaagcggtcctaccctccgagctctccctgggatcgcctcgcgtcgcactgtacagcgagaccaaccaggatgaccttcgccgcgatgatctcgattatcttgaggaacggagaaggcgagcggccttgcgtgccgcccgctaccagcagagcctgcgacgctaccatcagcgtaacgtccgggcccgatcactgcaaattggcgacctcgtcctacgccgcgttcagtcgcgcctagggctgagcaagctttcgccaatgtgggaaggcccatacaaagtgatcggcgtgccccggccaggctccgttcggttaatgtaacgccccgattttcgttcgggattaaaaatcattaataatacattttctagaaattaaataaaagataaatcaatttaatcaagtgaaataatgggagaattaaaattttcccttaaaaatcattggccgggaatattttgtaatattctttgtgccctaatgtactctccggaattttccgtgaattttcggagctcgagaaatagttttagagtcacaaagttcattaaactaatttaaataaaaagaaaacaaataaatttcccccttcctctctttgggccattttcggcccaagtcttcttttctttcccgggggccgcgcgcctttttcccttttcttggcccgctcgcaaaagtctgtttttgcgttccttctttttttccttttgccgacaggtgggaccagcgggcccacccgtcagctccttcttctacctatcgcgggccgacccaaccgccattgcggccacgttgtcgcaaaatacggggcccttc

SEQ ID NO: 66330 - DNA, 4206 bp, Oryza sativa
cgcgctaaagaaaagggtcattttttatataagttttggccacggttcatttgtaaaattagtttttgcaaagagtcaaattgtcaaaatttgtggtttttgcttaatatataagtccaaccaatctcatctacagctatgccgggacctagcttgcttcgttgtgcaaggtaaatccgtcgatgtcactgcacatacgggtttggtttgtattgacaattaatttcattttcatggattctattgaacttgtaataaatatttagatcgataaacatcccaaattaaaggacatggccctcttttttttttagataatggcgctctacatcatggatatagatatgttccctataacatattctttcacgagcaatagataactatatatattttttttaagataatgggtagcgcccggcctctgcatcataggtgaatgcacacggccaatagataactagataactagtaaaaatacaataatgtttgagttctgtggataatatgtgatggggttgagaggtctctggaaagaaaaaggcactgggatttggaggtttcgactccaaagaatgccggtgtagacgtgtagtagtctcggtgggaatttcccacaacatccaagtcgactgtgaatgcatgcgtgcgtccgtgtgcagtatactcagatgtccggggcttgcgggcgtgtggtgagtggcctttagaccaggcgtaggtgccatgtgggacatcgctactcagtgacatgttagtgtgaagtcctcatatcagtgccgatttgtgtttacgattagaacaacgaggtctagctcggagcaatcatcacatatgggttgaaagaatgtacctgtcagaagcaaaatccagtactcactccctcccaaaataagtgtagttttgcactatttatgttcaacgtttgaccgttcatcttatttaattttttttatgattactatttttattgttattacatgataaaatatgaatagtacttaatgtgtgactaaatattttcaaatttttcataaattttttaaataagacggatggtcaaatgttaggcacggatatccacggctgcacttattttgggatggagatagtagtattcatgtttggaattatataactggacgtcaatttaattatttgttgtatgaagaaagagcaacggtttgaggcgtccggccaagggcatgcagaatcatcttttgttcgacagcaaatcaacaagagagtgattctgacctttgccacacatcttagccagcagtagaccttacttttcctttggcttttgtggtagatgcggtgcccttaagaataacagctgttttttgggaaaaaaatctatttagaaagttttgaacatatctacaggaattataggtagagattttcaacataaagttaacgagtccctttagcaaaattttctacacagtgtcttatcagtggcactttccataagagttgataaaacggttggtgatacgccctataggcaattataaagatgattgtatcacatactatgtttacatatttattatattttgttcctcgtaatagatacctcgaaatagatagctcattactggttaatagatatatgattctttcatgagattatttatgttgtatgttactacttgtaaatgatccctggtcaaatatcatgtacggaacaaatatggttcaatgataagtatatgtattgatacatgatgatgtctcatggattatggtatggagataccaaattaataatgtggacatatgttgttggatagatccaacaagagacactacaagagctatatgtgtgatgtgctatcagtggtatcatttagtgttagtgtagaattcatagagttgagattatcttgagtcccgacatgtgtagtaactaggcagttattaaagtagtattcatgcattctatgaaacatgtagtggaatatgaataattaagacgggatttgccctcctccagggagatatttttggggccctcggtgttatacattatggaggtgcatgaccatgtcgaaagtgattgagtcaatccaagtcaaatgatctatcacatgatcgagtaaatgattgagctattaaaggatggtatatatctagccttgagcttaatcaatatcgtgaagcaaagtagttcaaacaagtataaactagaggttcagtcgatatgatctttatgtatttttggtaagtaaatatgttctgctaagggactctgttgacatgtggactggaaaagaagttttaatgttgcagccgagtatacatgaacctgtggggtcacacacttaatgggctagaataaaaaggattggatggagatcctgttgagttgtgacccaaattcatttgtacttactaaaggccagcttctgccggagcgaagcggatgcccgtcgccggaggcttgggccggagcgaagcaaaacccgggttccaccatatatatacctcttgtaagccgccgtacagcgttgtaacctcacatcgatatagtgaagatattttgctggctggcacccgtcgttttttctcttcttctttgggagggtttttcacgttaaatctcgtgttttttgtgattgatctattgttctttatcgttcatttgcctatcatttcctaacagatccaatatgtgctccagctgagagtccgcccgcgcgtggcgttccatccctgaacgtgtggatgtcggtcgagccacctctggtttgtggtgttgatcggcgtgggagcatggtgagacgaatgcacaaggaggagaaggtcgggctactgcgatcaaccacttcctctacatcgacgaacactacattgtcaattttcctttggcttcatagcacctacttccgttgcacagcgcatcgagtggtaatgattcacgatctacttgcatggttcctggttcacgcggtagataatttttatttattctaccgtagtctttgcgggatcatacttctattgaaagtgacttatttgaaatgcaagatcatacttttgaataacattctacaaaaaatcctgctagtcatttataaatctcaatttacattttagatcttaattaatagtcctattcaacacaaattcagaacaagaaatttctaaggacaatcgctagcccactcatgcaagcccatgctggctcagtatatagtatgttgagggaggcacaggaagtccaaccatagcaaattaaaaggctactgtaaggttgcactcgctgtggcctcatggcagtcaattatgatttctgtactaatctgatgtttgttcccttcatcaaatttgttggaactaatcttgttgtaaatgattatatggtgtcgtcttagtttagtttgatcaagtcatatgttgaaatagttgcatgagagctcatgcatgcatgtgtacttcctctgttcacaatgtaagtcattctaatgtttcctatattcatattgatattaatgaatttagatagatatatatatctagattcattagcatcaatatgaatgtgagaaatattagaatgacttacattgtaaaacggagggagtagctgggaacatgataggttcacgttgttcctggtttgcaaggttaggtagctactaggttaggcaatgcaagcatgtgttgcacgtaaagcgagtccgtacattgagccgataagcctcttgcgtcactactgcagaggtgattttccttgatgccaacccattttggttccaggcgggccaaaagtggcttcgtctggaaccaggcgaatgccggcccgggctgtaggtcgtacgggataatcgattatcctgtgcggcccacgtaaggcgaccgcttgcgatggtcggggggcatataagcccccagcccaaccgttaacagtatttctggcgttttctctctcttaaacatccgcaaattatggggggaaggttttcgacctcaaatctttgattgggttccatataaaaggtgtagagcttgttctcctccttcatttgcttctatttttgtcagttttcatcggtggaatacgaagaaacttgcacttttataaatggaatagtgtagacacctttttgttttttattttttttagcaaacacataatgattccattacatgtttataaaagtattcagtacctacattgaaaagttgggtttg

SEQ ID NO: 66331 - DNA, 851 bp, Oryza sativa
attttttttctctttcctctagacttttgttttgggtactgcttgtgctgctgtttcgagattggttctgggaattctggaagtatttggtccttttgatctgagattgtccttttctagattggtttgagcttaaagctatctcctttgttcctgtccttcctgttttaactatagatctatgatctccatgtgttaatatgttagaatttgggttgcagcgggaaaaaaagtctgaaagttaacgcgtccttcggccgcggattcagaattctgcgaatataagtacattacggtgggccgtgataccaatttgtaccgagcaattaattgaaggttagagtttgagcttataggagatgaagtgattggagctgaatcctgttgctgaaagcagcgatttcgtgtcaaaatttgatgcctttgcttggttcgagagctgtacatgcttgatactgttgcgatcctgcaatgtcccgaaggaatgccggggcaatgcagcgggaggggtcagtcaaggactgggaggaatttgacccctcgccgtctcccaagctggcgtactcgcagtcctatgttgcaatgagggggcttctgacatcggtggcctcgctggaccttgtcctgatgtcgagcagcctcaagtctgcttgggcagctatatcatcccacaagcatgcccggtccttggagaggtcaaggtccaagggaatgagcttgaagagggccatgctgcagttattagtgtgcttcatggttggtatcttcattgggttcacgccacccttttccgtggatctaccaggaaagatagcttctgaaaatgggaggcttccatttgatggggatgc

SEQ ID NO: 66332 - DNA, 16237 bp, Oryza sativa
tgtgggctgtgttcttgactcttgcatgagtccatgggcttaggaggtgtcgaggatttgagcatgagaaacagttgatgtggaaggatcaaacatcacgaactaagccaaccagaagaggggtgaatggttgtagtatccaaaaaccaaaatttttagcgaaaataaaagttacccttgaatcgacggattatggtttgaccgaagtagatcggccggtctgaccgcgcctatgtcaccggtctgaccggtatagattgaccggtccaaccgtcccgaagtcgcctctgcttcctgtcaccgtcgccagtctgaccgccgtgtacccgccggtctgactgctggtgtctcgccggttagaccgctgaacccgagcaaacacaaatcaaagaactcttgatgtagatgacaactttattacttatctctgtgtttagaaagtgcaacaacaacactcctaaagaaaatctctactaaactcgaaaccctagctattcttacaactcaatgctctctaaaatgataccgggaggcctcaccctccctctctatttatacatgaggtaggcagtctaaagccacgaaccaaacttatacaagaagtcctaatccacctagtataccttcctgtacatgaaaccaactttacaaactccaatcataccaaatttggactccttcaaaattcgaatccgcatcccatacacacacaatatctccatcgtatgccatatggaatcttcaccaaccacgtgcgttaatctttagcctaagtatctcgcatgatatctgaccgtctggacatcgccttatctacaagttgactcccgatccatcaccggcaatactcacccgaggcatcaagacacctacacttgaatcaaacaaaaaaaccatattccgagaccaagctatctccaacttgactcattgttagcaaacaatataaaatcaaaggtgtttttgattattattctgtgatgaacaattgggcattggagattattggttttgttatttggaatttattcacaaagtggttttggagatgattggatttacacgtgaatcgcaggatcgttatttcatgtgactggtcagaccgggcattgtgtaccggtcagaccggcggtgatcgagtggtcggaccgaccagcccgcggtttgaccggccgacactgtgtcggtttcggttttgggttgtttgtttcgatatccgagtttatttcatgattatggcttctaaatggatactatacgtatgtaatactattgtttgctgctaatgagtcaagttggagatagcttggtttcggaatatggtttctttgtttgttccatgtgtaggtgactcgatgtctcgggagagtatttgcggtgatggaccgggagtcggcttggggataagacgacgtccgtggtggtcagagatcatgcgggatacttaggctagagttgatgcacgtggttgatggagatttcatatggcatacgatggaggtattgtgtgcgtatgacatgcggagtcgaatttggaaggagtccaaatttggtacgattggttatataaagtttctttcttgtattagagggtttcctaaggtgtttaggactcgtagtatgagtttggttcgtggctttaggctggctacctcatgtataaatagagggggagcgtgaggcttcccggtatcgctttagagagcaattgagttgagttttgagttagggtttcgagtttagtcgaaatttttctaaggagtgctgttggtgcactttgtaaacatagagagaatcaataaagtcgtcatctactttaagagcgggtttcggcggtctaaccggtgatctaccggtggtcagactggcggcaagcggcggtcagaccggcgggagcacggcggtcagaccagcggcggcagcgacaggcgcggcaggctacttcggcggtcagaccggagattcaataccggtcagaccggcggcatctacccggttagaccaacaggacaacttcggtcagaccgcgatccgttgaattcgagggtaacttttatttccgctaaaagttttcggtttttgggtacaccaaccattcaccccccctctggttggcttagttcttgtgattcgatcctacaagtggatcagagcctgacgacggctgtggcctccggctatggccgtggcggcggcagcaaccgggtcgacagcggcagcggcagtggttatctggggtgttacaccatgtctgccataacatgaggagcttcgtagacaaggtgacattgctcgaccctgaggtgtctaattcaattgtttatacacacataggatgacaaatttacaagtatgtagactaacttggcgctgaacatgcatgaatttatttcaaggattccggaaatcaacttcgaaatcattagagaggagatagcacaattcatactagatgatatcttgtcaccaaaagggatgtttagagtgaagtcctaggtagctcatctcagaatggcagaacatttgcaatgcatacgcgataaacatttgatttttgtaaatattctttgtaatacaattaaattctttagagtaaagtcctaggtaacttgtctctttatatacttgcatttctaattacatataaaattgttccaatttataacttagttttgcaggttttgatgcatgtcggtggtttggagagaaaaatggatgtgaatgacatatacttcctccttttcacagtgtaagactttctagcattaccacattcatttagatgttaatgaatctagacatatgtatgtgtctagcttcattaacatctttatgtatgtggccaatgctaaaaagccttagattgtgaaacggagggagtatatgtgatgtgaatgcatgtgttgtgatggaatacaaatgtgaatgagttgtgaattggctgtgaatgcatgttttgtgatggaatgtaaatgctgtgatgctgggaatataaatgttgtgaattggctgtgaatattgtgatgctggaaatggggttgctgggaatgggactatatatatgtgcttctatcaatttttgcagcgggcatggctagcaaagtcctaaggctagccaaattataaaattttattttttttttccaaactcatccctgacgggcatattaataatgcccgaaagagatatgtcatccgtgacgggcttttagaataagcccgatagagctaagtcatccgtgatgggcttttagagtaagcccaatagagataagtcatctgaaccgggactcgtttgacttaacacgtgaggtcaaaccaattggtgtcgggctctatctaaatgcccgattgagatgactagttacccgtgacgggcttagtggtgtgcccgattgagattagtcatccgtgacgggctcctaactatgctggtttgactggtcatactcatctgtgacgggctttgttttcggcctgattgagataacatccatccgtgacgggcttttgcccgattgagatttttcctcacatcagtgacctttgtccagtgacgggggccttacccgatagtgatgaggcttttagcacgtcacagataagcgatcccgttctagtgggaggtggttcttcctccggggcgaggctaggaataagtctattttgcctccgtcaactcatgctctagttgaatcgcattccacaacccctaaaccgggtataacccgtccgctaactttcaaaaccattgcaaatcgactttccggacggtttcggataagaataagttcaccagccgtccctcaactttacagtgactggaaggtgcatgtagccatcccttccatggtcagaaaagaagcacggaaaacatcgttgccagggccatcttctgcttcaacgatcgatatgtaagcacatcactgacagttcgtaatcaaacttgagcagtgattgaaacaatttcagccaaagaaaaaggaaaaaagagttcgagcagaaaacggactctgtttatgacattctgcaatcttggatgcgtatgttcttgcattggtcgtcgggtgtagatctacagcggatgccaggggacagcacaggctggggtgggagggcgtgctgcgtgtgccgtcagaggcggaaggatctggcttcccgcccctcggaagcggcgacggctgagggggcgagcggcgcagcacgcggatccagtacaccgctagcagcaaccacccgtatggcatcccgccgccatcgccacaccagccccttctcccctcccccatctcccgccgactggccaccctctttagctagccgcgtcgggttgggacaaaaagagaagaaagaggaggatacctgtcatgtgggcccacacatacgttttgttattgttttgctgactaggatgccacgttagcgagaccatatatatatacagttatgagaccaaaattgcatggttttatataatttaggggtgaagattttcgatattggggattagggatgttatacaaacttgacgtaaagtcgagggatgacatgtaaacttatttctctcagaggcgattccgtcctacgtgggaccaaacagcccaacaagggaagtagcggcccacgagggcacgacgggcccaaatagccccaaactcctcagacgggcgggctcacaatgattcatgggtattcaaatgaaaacccaagattttttttaaaaaaatacatatatgaagtatatattccatatgtatatgacatgtgaacttatttctctcgagaaaaagtacatcgaaggtccatcatgttgtcatcgggttacaaaatcatcctccaaccacaaaccaggtatatcgcatccctaatcttacaacaccgggttactttaggtccctaggcggttttgactctggttttgatcaatgtggcagctgagtcagcatgggaccccacgtgggtcctacacgtcagcctcttcttcccctcccctctccacctctcttcctctctcctcatctctccacggccgacggctgacggagacgagctgtgcgcggcatgccgatgcggcgggagcgggcgcgggcgaaggccggcgggtgcaggcgaaggccggcaggcgcgagcggcggcggcggcgtcaccgagctcggccaagcatcagcgcgcaaagagagagcagtggcaacaatcccgcgtctgtatcagccttagtcccgacggcggggagcagctaaactatgggatggtcgacgtcacacccgcagcctctttccaccagacgcaccatcatcaccccaacctcaccggcgacgacaacgacaaactccctccaccattccccttacttccgccatcgccctccttcgcctctccccacctcgccggcgacgacgacaaccgtaacgacgcgagcgcaaggtatgtgagcacctcctttctcttcgccccaagcattgccaccatcgccaccacaaccgccggcagcagcctcagctcctcttcgtcggtgtcgctgttccctacatgctctgcgccaaccagctcctctccgtggagagctccacccgccaccgtcaccacggtgctcaaggtcctccccgagcgttgacttgtgcttccgccgctcagccgcatgctcctgcactccttcccgacgcgctccgctgctccttagccacccgcaacttccacgaactctttcacgcactgctcctgttcctcaacctttcttgtcagctccgccacggcctcgccatgcgccgcgtgccgttcccacgccgtggtgaagacggcgtgcatctgctgtcgcaaaccccttcctctcccgcagcgtgggctttatctgcggcgaccaccggcaccgccgcctcccgtcggtcactctcgtgcactggaaagagatgggggaagagaagggaaagaggaagaggagctgaggctgttgtcgatggctgtggtggagatggcgacgaaagagcgtcaggtgtcgccgtcactgttgccttcgctgggcaccccccgcctcgaaggtctcgcgcacggacagaaaggggaggaggagaaggaggaagtgcccaggtcgtggtcggtgacatcgccgccgccggccaccacccgtctttgccagcgagcgccgccgccaatggccgccacttgtctttgccagtgagcgtcgccgtcgcgccgcacccttgttgtcaatcaccaagaagaggactgcaggtcagaggaagagaggtagagagagtagtgcaaatagtcactgacaggtgggcccacatggggaccacgctaactcagatgccacatcatctaaaaccgaagacaataccgtcgaggaatctagtttgcactttgcactgttttgtaagttggaggatgtgtcatgtcgggttttgtggttcaagggcgattttttaattcaatgacaagatgagggaccttcggtgtactcatccaaaagaagcccaaacctatccctcccaccatcttcctctccccactttttaaggcccattggcccaatagcaaaaaaaaaaatggcccaaactctatcaaaccctatctcctcacctcccgttcccgatcccgccgcccgccgcccgcccgcgcccggccgcccgtcgcccccgcgccgtcgcgccgtggccgtctcgccgtcgccccgccgctccggtcagcccctccacgcagttacacgcgcgccgcccgcccggctcggcagccgccagcggcacgcgccccgcgcggccagggccagccgaccacgccacggcaccagcgcggcagcgcgccccggcgccccgatccctccagtagcaggcaagcttccgggctccagtccaccggccacacgccagcgacgccgcccggtcgtccgagtctcgaaggtaactcttccctagttcccttcatcccctgtcctgcgcccttgctgcccgtagatgtcatgtctgatgttgctcctgctaggtatgaggccatgctctgcttcatttttaccatgcccttgtgcagttcctgctccttaggtgcctcctaattcttggaatcacgcagataaatgacaaatttgcagtctagaaacctttagctgtatgtgctgaacttaaataggttgtagccgctgcttttggtgtgaaatctagttgagggagagggtcaagactgaacattttgtagtttttgcttgggttcaggacttcagatactaattgaaattaggaagcactccatgctcggagaccagggagttactaggcctttcagacttcagggaggaggagttgttttggaggagttgttttttattagaagatcctgtcagttgttaatgtatcttaaaaactgtacttatctttgttgatagaaaacgttggtctgaattttcatctgagcacctcaaaagtagtttcatggttgaatatagtatattgttgttttgtaggtttgaaacgtgaagagaaaaaacatgaatatagtatattgttgttttgcaggtttgaaattatgtttataccgttatatattatacaactattagtgggttggaaattttttttttatctcttctaatttcgaatacccaagttgaaaatcctgggcccgcctgtccccatggctggaggtgagccggttcccccaaattcgacaacctgttgcctcacgcgctgccgcccgcctccgtcccccgtcgccaacctgccgctgtaatcccagccgacgggccacctctaagtgaactgctcatctcgctcccatttaagcctgcagctagtgggttagctgtttgtcgttgtgcgtgtgttaatctactacgctgcgagaattgtatggtgttttcatttagtggtgcagattgtagcttgtagaatcgatcctccttgtgaataactttggtatttcaatgttgtgcgtgtagaaattcgtaggttgtgtagaggaagggaaccgttgcttcactattgattgcagtttttttttcccaaattccgaatttaattgttgattttagcctgtttttatacgagatgctattgctatatctatatctttttttttttagcaaattttgtaggtgtatattggatttatggtgtgataaaaatttggatttgtgggttgtgacaggcacaatcaacaaaaaaattacttgaaggagttctactgtacagtgagcattcgtcgacgatatggttcatttcaagaacaggtacatggtgatggaggtgttcatcgatacaccagtcaagggccagcccgaccctctcattctcacgcagatcaatatcaccaaagctatcaaagacagcatccagctcaactttggggagtgtggcctagcagcttgtcttgggtcgttgcaaggttggtgtttgttaggagtacatcgacaaccctcttacagttttcagacagcgtcatgaatgcttgcattttgagtcgttatttataggtgtttatgagctctgttcatctgcagtgaagtatgtaaatccgataacgaagctttgcgtgatccgagtttcccgtgaagatcaccagaaagtgtgggctgctatcaccatggtgaggaacattgggaaaatcccagtttcattcaacctgcgggatatgagtggtaagtggataacttcctatatatacatggtggaagaaagcaaattttagttttaggtttacatctggagtaagtttatttcactgtctggtgcccaagtttgggaaatcaattccctgcaataaaactgtctgtctaaccatgttgctttatttactcagcccacagccttgaattcatgcaacttaaatacattgttatcctgattccttgctttgatgcgaccaacttaacgaggactttgaattgctcgctgtacactattagtctattatgacaacaaattctttcacatttacattttttaaagctgcatactaattgaaacctcttggattatagtgttttcgctccataaacgatttcttcctagtgcgtgtgttgaattagtgacttagtgggcttaaatatttcaatgaaaactttagctgaacatctcactacaaatttggattagtagtggttggggaatggattgtgaaactaaagcagttttatcattatgcacgataattgatttctggcaacatgtatcttttcttcttcttctttttttgtacagacatgaatttatttctgattttctgtattcagggcaatcctgattttcagtgtaaggtgaagttcagatgctatcagcgctgctaaatgcattctctttaaattccgatgacatgaatactacagtttgttaaaacatcttcaaacaatatattgtatggtgttttcatgcattttaactctagcatgatggagtctcaacttttccatttgactcctcatgtattttgacatgctgactcgttctgcgtgtttatatattgcattccctaagtgaaatgtttgcaaggccatcgtacaacccggagcagagctaattcatcaatatccttttaacttcattcaggaagtatcagggcctgcaagaaggctgcgttggagtgtgaagaagctaagttcgagtattacaaactggctgctggtgatcgtatcacgcccaagtttgtggagaccatggagagctgctttgccaagattaaaggattagagagctaatgcatcctcgtgtatcatacatttgtttcctgacactttagtggattattaatctgtagggaatcaagtaaacaaaaattttgtttgtctgatcaactaatcactgagcctattttttcgaatgtgcaagaatgacgcatatcgattaagagaaattttgtttgtcttgaattctgtatgtatattttacttgagaagcaaaaccacaagctgacggagtcccaattttcttgattacacaaaacagaaatattaactccgggatgcaatacaacatgaaccatcagattcacgacaaggcagaattgcatcttcagatcaagcaagagaagcaaaaacctgtcatgggcacagttgtcacccacgcagggtcgcatcttcagatcacacacggttgcatcttcagatcagattttagtcacagttcaggatgcaattattatcgcgaagaaaatggcacggtttgaaaattaagggtaaactgaaacatacattggcagttgccaccctcaaaaccagtccctgtgttctttacaccttctgttacatctgaattcaaacatacggaaacacaattcctgcagttccctagaatggttcagcggctgctgaaaagatatatattcattttcccaaaaatataacggcaatttttaccaacacatcaccagatggaagcttcacaataagcgacggttccggctttccaggagttgacaagctccaggacatgctagtcattctgcctctgcttacacaaaccgaatctagtctctgctaacacaagctaaatacaggcaaccttgaaattacgtactgctgttgattaaactgacaaatgacaaccaacttcagagctattaatgaattgttcactattgttatgttgtcaatgaacaaaaatggtttgcatgactgcatttcaacttaataattgcatccacaaatgtctgaaatttgatttctggcatagtgactaatgaccacagtatagcatgttttatgaactaatgaaacatcttccagtggataaaaggtatgctgatttggggtaagatattcaatcatcatcacataatacactgctatcaatgtgaatacaatacaactaccaacccacaatataaaaataaagaacaagaggatatttgatgcgatggaatggtgacaataacaacaggagcaatactaaatacatctcaagagaattacacacgaccagcaataaagtcagctatacgttacaaggtttctctcttgcaaatgccacaaaagaaaagctagcacagcatccacagtcgcaacacaaaaacaaacaaaagtatcatttcacctattgttttggcagttggcagtacagaagaagcaattcttcccttgaaattacaacttcgcgcattgctacggagctccacgataagttgactgcaaccaagcacaccaagatcagtaatgaaataaacaagcataccaaattgaccaatgaaaatatgtttcgtatatatgtagctgtgtgtaattgtaggtttgatgaatttaatcaaagaggcttccaatttctacagtggtgaacaccaaatcagtgttcctagcttctcatcactgttagttccaaacaaacaaaatgcatggcagctcaaatctttagaaaatggtgcttgctaacataatggagttgccaactgatttcattcattagaaagtggaaagctaccacagaagcataatttcgcctaaatcaacctcaccaaattaatcagtagcaataatcagtgaagatagacaccaggtctcaccaattcgtacctatccaatccgaaatatttaatggccatggccgtccgaggacgaggagcagcatccaccgccgccgccgcttgtcccctcgccggcgtccccgggcgggctccggcggccgccgtcggggtcgtcgtcgctgcaatcctcgtcgaaggggacgtccttgtggaagatgcagcacttcttggagctcttgcggccgagggactcgttgtccaccgtcccctccttccacgtcaccttcttcttcgcccgccgcttcagccgcagcaccaccgtctccgccgccggcgggggcgccgacgaggccggcgcggaggaggacggggtggggtccaccgtcacggtcgcggacccggtcgccggcgcgcgcgttgccatcggcggcgaatcttggtcgtctccgactcccgtttcttctcacctgttttttttttcctttttttcgatttttagtttcttttttagtcagcgctagtgttacgacgaattttatttcccataagccaaaacaggaaataaaaattaaataaataatcctttcaagtcatatctacgacgctagaatttttctatcatttggatggtgtaaaccattactacagcctctaacaccaatagagtccgatcttcgttgacctccatctaataagtgcaagccagacaaaggctaggtagtaaaggattgcacgctaataaaaatagagaagattttagtgttgtaaatatggacatatggcctatataggactattttctttaatttatttcatgttttggcttatggaaaaaaaatttaggcgttaagaagtggaaatgccaatttaaacttaaattgaactatatccatgagagttttattttttaaaaacagtgtctgggagttgacatgggaactcctcggtttttttttacggtactagtgggacttgacaagaagaatggatttgtattaccaattagttagttcagaattttttatttacattttatataggaaaagttcaaggttgcatagtattcttttcacttaataaacgatcgtacttacgagttacccgttgttaattttgttgctagcacacacctaaacctatattcaacatcaaattttttcgattttcattatttagaattatttaaacaataaaatatatttagactatatcttagcgtagaaaataatctaatcctcgtaaactaaactttgacaagagttcagtcaattttattgacctgagattatttattggttataggagttaccttgcactttatttggagtattttggaatttttttatctcccgccactgctgggaaaccctctttaatcccggtttgcaacccctatattcccgggttgtaaaccgggagtaagaatcaggtattaaagatcgctatctttaatccggttaaaatactcgggagtaaagatgcattattagtcccggttggtaacacaaatcgaaagtaatgtttttttctttttttcctccttcgttttttttctcctttttcattcatagcacatcacaaatttattcacagaaaaattcacaaatcaacatcaacaaatcatctaaaaaaatcaagaaaaactgaaacaaatcaaaatcccatcgtgccacctggccaccagccaccgaccggcctcccttcccgccgccggccggccacccttcccatcgcctcccctccgaccggatatggcggagggggcggtgtcagacccctctactatcgagactaaaaatctatttttagttccatcttaacacaacaaacgggggaaaaagcctgagccacgcgcgtccagctctctctcccatccttgctccatcctaatcacgcgtccggccggccggcctccatctcgccgccccgcgctgggttgctatcggccggccttccatcacgccgcctgtcggagggaggggaggaggggaggagaggggagggggccggaagaggggggaggaggatgggtgagagaagaaggaaacggaggatgagagaatgggaggagagaaggagattaggatggagcaaggatgggagagagagctggacgcgcgtggctcaggctttttcccccgtttgttgtgttaagatggaactaaaaatagatttttagtctcgatagtagagggatctgacaccgcctaccatatattgaaccgggcctaataatgatttttagtaccagccagtcaggcagcactatcaggttgtgattgccacctctcctatcatgctatctagcctgagaattagttagcaatagcatatactcgctccttcaaataattatatctaagtacatcttatatgtcatactggtttttttattttgttagtatgtgttacatcccgaaatagatttgtttattttgttatgaaagcagtttgaatttttttttgaaaaaaagacaatcactatcgtgactcctacttacggtgatatggagttaccaatcacttcgatctagtcaaaagctaaatcaagatgagttttgtaagactaaaccagctagcaaaatcgatttagatggaacaaaggataaacacccatttcataggcaaatggtaggtttacgagacaaacctgcaaaagggataatcatactctcatagctaagatggacggctttcagtataaaccggtgaagttggacaaaactaggctaaaactagttaaaaagtaaatgcgatattgaaaagcgattgtgttgaaagtagattgtgtgtccaattaaaccggtcttgtctcttataaaaggattagtcttgcctcctacataaccttttccacatcaaattatggtagagataaattagaatttgaaaaatatctccccatgcaagaaaactcgaaacccggcgaaattcgcttcaaacttggaaaatacctccccatgtctctgccgccaatgaaaatctcttttcaccaccaacgaaaacagtttttctagtagcgcttgtttgtttctcactgtgctctgcaaatatgggctggacatataggacgtttaacaagaacatatgggctggacattctagcatctatcacggtacagtacgttgatcctcagaggaacaattgcttttctaccgcaatgagattgcgtagacgaagctcgacaatctcatccaaagtaacccaatgttgtgaccgctcactagtggaaaaaccatctttgatccgtcggccgaaatccacgatagtcccggatccatttaaaaccaggactaaagatgatctttagtcctggttggtggctacaacgggcatatttgatctagtctcggttgtagagatgtcagacgttgtcagggccccgggatctttagtcccggttggtaaacaccaaccgggactaacgatcctaactttagtcccggttggtgttaccaatcggggctaaagatccaccgggaccaaagatccccctttatatatgccttcttcctctttcagcccaagagcaagcttcaaaatttctctaaaaaagaggggaggtcatgccaaaatttcttgtgaaatttttttagtgattatatacaaatcggagatgtctaaaaggttagtaatttcatcctccaattttttttttgttgttatattacttttggagctatgtttcacacatttttttttgtctccaaaactttgttgtaagttgatgagagagaaaatttgtgtggggaagaagaatatatagaaaatttattctcatagtttaaaatttgatgaaaattaatcttaaaaaatataaaacaaactaaattgaaaattaagagaagtacaacattaatattagtttagaacttcaaaaattattaataagaattgcttgtcgaaagagtttttaattattttatcattactgtttgactgtcattattgtacgaaaatttatttatgtacgattttttttatttcatgtagatggatcgacaatggatgtacgctgaccggtgatccaaaaagtttatcgagggcgtgcattatttttttgagagtggccgaagctaacaagcgtaacggttttatttgttgtctatgcaataagtgtaagaaccagaagtagtattctgcatccaggactattcatttccatctgtttgagtcggggttcatgccaagctataattattggacatcccacggtgagcaaggggttgaaatggaagaagatgaagcggaggacgagaacattcccgactgggctcagtacgctggatttgaaggaaatcaaacgggcgaggtggacagggatgttggcgataacaacgcttcggatgatcttggtcagatgttgcagaacgcaaaggaggattgtgaaagtgaaaaggaggcccgtaaattggagcagatgttagaggaccacagaacgtcgttgtacccaggttgcgagcagatgcacaaaaagttggataccactctggagttcttgcaacggaaggcaaaatatagtgttagtgacaaggcatttggcgatttattgaaactcgtcaagaacattcttctggagggaaacaaattgtccaagacaacgtacgaggctaagaagatagtctgccctctaggactggaagttcagaagattcatgcatgtccgaatgattgtatcctatatcgtggtgaggagtccgagaacctagaagcatgccctgtttgcaaagcactacgatacaagattagacgagaggatccaggtgaagttgacgggcagccaacaaagaagagaat

SEQ ID NO: 66333 - DNA, 1835 bp, Oryza sativa
gtagaagcagcagcctcacccctcacacgatcgatcgatctccagagagtgaaaccgaacaacattttttttttttttgacaaggcctgttcgctcgttggccggctggtaccccgtccttgttagagtttggtatccgcgactacttggcgtagtggtacgtgaacaagatttgtgccgttgccaggtcccctttcacatgcagtctcgatcgatcgatcgatcgatcgaatgcgtactactcgcgagcagtagtagactagtagtagtgcatggctaccaaacaccccctggcccccggcgtgctagctttttctatcgacaacattgtccttttctaccacctaaccacggctgcgttctcgctcgttctcccacgccgcaaggcaacacgggcgccacgaatgtgcgaaaccgccgtatgcatgcgcgcacagagcgtgtgctgcgtgttagcgtgtatagcgacgaaccaaatgcaacttacctgggtggcatgataatgaatgcacgatgatgctttcttttgtcactgttaagcacttatacccgcgataccgtggaacagagatagagccttccatggggtacttccgcgactgctgtactccacacgtcaacaaacattatgctgtactttgagtctttgacaattagtgcgtgatgaaaaaaacgtaaataaaagcatatgtcgaatgcacaacatctttattttggggaaaaaaatgccgagtgtggttaaacttttttacaaacgttaaatgaaaaagaaagggtcggcatgcttgctaattagatactcactccattccagattataagatgttttgaactttggtcaaagtcaaattgttttaagtttgactaagtttgaaaaaaaataacattatcaacctaagataaatttattatgaaaatatattcaattattgatttaataaaactaatttggtattataaatattactatatttgtttataaacttagaaaacttgaagtaacttgaactagtttgactttgattaaaatcaaaacatcttataaacggatggagtctagcgtgtgtttggttgaagggttttcctgggtcgggttgggtcgaacccatttacataggtgtttggttagagtgctagctgggatgggttaggtcaaaaaggaatatacccctcatatacgggttgacctgatccgtgaaaaatcgctcggacggcgccgacccacttcgccagcgctgcaatcgcgtgatcctcacgcgctcctcgcagtgacattatcccttacccgtggtgagggtgtgtttagttcacactaaaattagaagtttgattgaaattagaatgatgtgacggaaaagttggaagtttgtgtgtgtagaaaagttttgatgtgatggaaaagttgtattctctccgtttcacagtgtaagtcattctagcatttcccacatttatattgatgttaatgaatctagacatatatatatttatccaaattcgttaacatcaatatgaatgtgggaaatgttagaatgacttacattgtgaaacggaggaagtaagtttgaagaaaaagtttaaaagtaaacaagactggctctgttcttttggttgagttgggaacccatccctccggtacggaaaacgaagcagtccattagcacgtgattaattaattatttgctaatttttttttcaaaaatggatcaatataatttttttaagcaactttcgtatataaactttttacaaaaaacacaccgtttagcagtttgaaaagcgtgcgcgtggaaaatgagatggggagtcgggaactccaggaaacgaacagagcc

SEQ ID NO: 66334 - DNA, 2917 bp, Oryza sativa
gatcatgatgtgcatgtattataccggttgagattgattagatatctatagtaatggaaactatctagagaaattaatcctactcagacttggtaaaaaaaactttgctactctacacaacaaaacataaattatgatggaattatgtccggacactcaatcggacagggtctttctatatagtatacatttttcttaataatatctatagtacacgtatacagacaccacgtacaacagtaacacaaggcctcatcagtatatacatttatggataaatatatatggtggactgaggatatatattattagtttggttgattgatggctgataaagggcatcaaagttggcaagtacatgcagcctgttactgcccagacagaaacaaaataaatctaaaaataaaataaattctgaataacaaatagaataaatttagaaaacaaataaataattataggagttcaagtagcaaaataatttataaataaaaatatcgaaagaaaaatatggaattttcaaaaaaaaatcatctagaacacagataataaatgacaataaagatgggataagtaataggcctgtaaaggagtacagtggtgatggttgatgggacatctaaaaagtattaacaaaaccccaaattgaattccaaagactattaaaaggagggacggtggacatgttgttaagcaatatggtcatgacggttggcgggacttctaaaaagtaaaaggtaaacccccaatgataatcatgtctgattttaaaatcttaatgccagtaaagaggggaagcagcggatgagctgtaaaggagtatagtggcaaagccccagatggtttggcgggacttctagaaagtaaaaaattgacccacacgatagttatgtttggtttttaaaatcccagtgacaataaagagaggaggcaacagacggaccgtagagaagtatagtgtcagggtttgatgggacttctaataattataaaaatgaaacccaacgagacatgaattgaaacattgacacgatatgctaccctgccataaaactttcatgtccaaatttaatttaatcattgagaaacaaaaggtacaaatatgtagtactccggagtatgtgaatggaataaaaccaagttggctccggtgtaagaaactttagatggccacatccatactttgggtcgtgttttttttatttctgcagtttttaccaacgggccctgactgttgaaggatacaaggtgatcctgtgcataagtgagatagtagtacaacagttcatctcatcaaatatctttataaaatacggccatttatatgattaaatctctaaagaaagaaacaatgatactccgtctctttatagagctttagctctatttctcctgaagcttgaagccagagctcgacccaagaaaacgaggcggacctaagagctctcacaaaataaactagataattaaaatagggtttaggctgcttcataatttctatacgaactcagcttttgaagttaaatttagaaacctacccctccgtcaaaaaaagttaaatactagctacaaatcttaacccacacgtatccagatttatagctagagtttgtctttttttaggaagagtattaaaaaccgacacagcatgactatagcttataaaaagttaaaaactcacttcgctgtgagatccgaggaacgcgatcataattaggagtacacaagttaaacaacagtacacttaaaccttgctagtagtggccaaaccaaaatgggccaggaggagttgacttggagttgagcagagccacgccgtagcagagcccgctgtcccgcgctagctagccgctagtagctgcagtcccaacaacacacacgcacaggcaggcggtcactgccactgctcgctgtttacgcaggggcgccgggccgagggcgtggccatggaagaagaaaaagcccagtagacatgggcaccttttggtcatattctcacgtacacgtacgggggcagagaggcaggcagctgctgcccccaccgcaagaagcaaacaaacaacaatcgctggctcttgctcggctttaaacttccctttaccgtacgtctccctgcgcagtggcgccggggagacgggggacacggccgggcgcccggccgcgcttgggagagagggagaacgctgggagagtggaaaaaggagccgagatgaaaggagctcatcatgacccatggcccatgcctcctgcggtagtcctgccccgtcgtcgcacggctcctgccactctctggccccgtcagtcccatctataccttcctgacacggctaaaaatcctgtagaagctcggacatatcccctccgtccaaaaaaaaaaaagacaaacctgatttctgtattaatcatgttttattatctaacaacaataaaaataataattataaaaaaatttcatataaaacggacagtcaaacgttggcacagaaaccaggatttgcctttttttaggacggagggagtagagtatggagcacgctcgctcggttgcattgttgcgccttaattcagccgtgcaaagctacttgaccggttaaggggtatttagattcagggattcagggatatatcggatattatatagttattgtataggttgtttgagcactataaaaaaattaattatagaatccatcagtaaaccgcgagataaatttattaagcctaaataatctatcattagcatatgttactgtagcaccacattattaaatcatagagcaattaggcttaaaagattcgtctcgcaaattagtcgcaatctatataattagttattttttaaatatgtatttaatactttatgcatgtgtttaaacggggaaattttacgtgggaactgaacattcatgatacacca

SEQ ID NO: 66335 - DNA, 2542 bp, Oryza sativa
cccccttggctatgcatgaagaggaaatacataatgatgccgattattattcaaggccccaagcaatctggtaacaacattgatgtgtacccaagacaactagtcgaagattttaaactattgtggaaaaaggatggtgtcccagtgtgggacgaggacaaacaggaggagtttaacctacgagcgctgctgttcgtaaccatcaacgattggcctgcactaagcaacctttccgggcagtccaacaaggggtacaaggcttacactcgctgtatggaaagttgtgtacatgggtcatcgccgattccttgttgcaaaccacccggtacggaagaaaggcaagcactttgaacataaggtggaccaccatacgaagcctaaacatcacagcgggaaaacaatgtttgctatgattaaagatcttaaagtagtgtttggaaaggggcctggaagccagcctatagagagcgaagatggtcacgcggtgatctggaaaaagaacactatattttgggagttaccctattgggaattcctggacgtccgccacgcaatcgacatgatgcacctcactaagaacctttgcgtaaaccttcttggctacctaggtgtatatggaaagttaaaagatacacttgaagcacgtaatgatttgaagcatatggaacaacgcgacgaccttaacccggaaccaacggagaaaggaagccattacttgagtccagctagctacactcttaacaaggcagagaagaaaagtatgtttgaatgcttggagagcataaagttaccgtctagatactccagaatataaagcgaataataagcacgaaggagaagaagtctcatgactatcacgtgttgatgacacaactgctaccagttgtaataaggggtatccttccagacaatgttcgggaaataataacaaagctatgtgctttcatgaacgcaatttcgcagaaggtcatcgatccggatagattagaagcccttcagaatgatgtggtgcaatgtcttgtcagttttgagttgatatttccaccttcatttttcaatataatgacggatctgctttgtcaccctatcaaagagatcagtattctcgggcctgtgtacctacacaacatgtttccgttcgagaggtacatgggcgttctgaagtagtatgttcgtaaccgtgctcgtctagaggcaagcttcgccaaggggtatggaacagaggaggtcatcgaattctgcgtagaatttattgaagacctttgcccaatcggggtacctgaatcactccataaagggagactacgggacaggggactctcggaaggaaagcaataatgacggtagacaacaatttattccgtaaagcccatttcacggttttgcaacaatcttcattggtggctccttacatcgaggagtacttggctctaggtctcgccagaaacatcggtaagttcgatgcatagattacacagcatcacattgatactttccccgcgtggctacgacaacatgtaatgggtaacgagacgattaaccaacaactggccttcctggcgaggggaccatctggctcgatcgcgacattttagggatatgagatcaatgggtacacattctacacgagagcccaagacatgaaaagcacgaaccaaaacagcgatgttcgtatcaatgccatgagacatgatggaacaactggcacgtattacggtgccatcgaggacatatgggaacttgactatggtcctctcaaggtccctctgttccggtgtcaatgggttaggttgactggtgaaggcataacgattgatgacagtgggatgacaacggtagaccttaacaaggttggatactcggacgttccttttgtccttgccaatgatgtaacacaagtcttttacgtgaaggacatgtctagcaaaggaaagaagggcaaagggcctgacgggccaaagcgccacgtggttctcccaggcaaaagaaaaatcatcggagtagaggacaagactgacgaggattacaatcagttggatgggcatcctcctatcaaatgaagacaccccttactcacgtagcgaacacaaggagggaacaatagtgaggagaaagtacgtgcggtcaaccgtcaccgccgatgtattgccgtaattattgtgtacacgatgtaaactattttggatgtattgattatccatataaatcaatcgttgtatggcttatgttaattatgtatgattattagaattttgaacaattttaaatcgtgcatatgctagtaatatgtgataattagaattttaaaagttttaaatcatgcatttggcatttacatatgttaattagagtttttaacaattttaaatcatgcatatgctaattatatatgattattagaatttttattaattttaaatcatgcatgtggtatgtacatatgttaattagaatttttaacaatttaatatcatgcatatgctaattatatatgattattagaatttttaacaagtttaaaacatatatttgcttattacgt

SEQ ID NO: 66336 - DNA, 2283 bp, Oryza sativa
tgttggagcagggcttaagtactgttagaccatgccctacgcgtgatcttaaaactgtggttctagcctccaactaagctcatatggcatggtgaaggttcgggaagagttttatttgtgtcacagtactatgtagatgccgcagtgatttaagaaagaaaaagagtgatccaagcccggatcgagatccatccaaagaaaccctttctctgtcgggaggaccccactaccacggagcttgctgaccacgccggagtagggggaggagagtggggacgccactaatgatatatccacgctaagctcgccaccagatccgtgcttgttgccaggatttcgttgatcacatcgtcgtcgagggctcgccctcccgacggcttacgtggtctcccaacaaggaggggatgtcgtccgccttgatatgccacgcataatcatcattgtgctttctggagaggaggggaggcccgccgcctcgatcaatcgatggggttgaaaggctcacgagcaccacgaccgaagaaggggaaacgagagtcgagagagtagcagatggggagtgggagagaggcgggtggtgcttagacgaggaagagaggtggcgttgcggctgcggtgcttagacgaggaagagaagcgacgatgcatttggttgggaggggggagagaaaggcgaatcaatgagaaagaaggaagggtggtgaaaaaaaattataagagtgactggcatgtgggtctatatttgttaatggtacacatgtatttatcttatagttgttatacggtacaaaatataacagtttcagtgggatttgataacaattagtatttcaataattgacataagggttgaaacacaaaatagttggatgtgacctcaattgtgagagttgtaacctatgtgaggtatcagtccatataacctactcactatgtcccataaaaaactaacctagtatcgaatgtgacgtatgtatgtccagattcatagtattagcatatgtcacatccgatactggattggttttttatgggatggagggaaaatctaagaacacttttacatggggtctccattatacgtggctttaggacaaggccaatgtttatgactcgatgagcgataggggtgtgacccgctaaaaggagccacaactatagcgatccgtacaatgctatgtctatcagtctatgtaaaaaaaaggtgagccttattcagttgcggatctaggaagaaatagcaagcggtttgaataaactagacaaaactacaatctcctcccccatgtatagatagcaaaaaaaaaaaagtcgggactttcatgtacctcgcgtcagtagtggatgcttgagactctaccgtctccatgctagattcgctcttagggctactttggattgatgccaaaatgtgccatgccaatttttttggtagtttgaatagtaaatatgatggtttggtttgaagccaaatgaatggtactgcccatgcttaatttggtataattctagaattttcttcaccataatataaattttggcttccaattggtattaatccaaacacattacttagaattctaccctaccaaattattggtagtgtcaaaacatgcttaagttttagcactaccaatgtttttgtatggccttaaaccaaacaagctagcccttagccccattggttccccaaatgaaagaaaatttcaattgtcccacgtagcagactagcgggatttgaaaccaaagaggattgaagattaaatcggtgcacgtaaaactaaaatgtcattagcgaataattaattaagttttaattattacaaaattaataaatgaatatacttgacattttaaaataacttttatataaaaattttttcgcacgaaatataccgtttagtagtttatgttttattagtatgattttttttgtgttcatactttataagtttaaggtgtattttgatttggtaatgattatgatatcaaatgtttaatgctactacttttacaaaaacattgtggataccatacacgatgacttaccgatccgaagctacagaacatgacccaaccacccacccacccggcgatgcacgctgtcttgccgcctcctgccgttatgcgcgtaaaacatcggtgatgcgcgtagggacagccagaacaggtaattaatgtgagtggttttgtggatcatatagtccgatactccgatgggttgtgccgggcgggtgctctagccgcgtccaggcgagcaaggacagtgacacggcccgggac

SEQ ID NO: 66337 - DNA, 1477 bp, Oryza sativa
cccgccgatgccgaccccgacctcgatgcggccgccaccgccgacgacgtcgcgccggcactgccgatgacgccgacgccactgctacgccgccgcgccacgccgctgggccgcgcctcgctgccgccgcgcaacgccgcagctgcgctgccacgccaccgccgcgccacgccgctgctccgctgccgccacgtgaacgaaacgtgaacataacgagaacgaacgtgaacgaacaaacgtacgtggacaaaacgtgaacttaacgagaacgcgaacgtgaacgaaacgtgaacttaacgagaacgcgaacgtgaatgaacgtgaacgaaacgtgaatgaacatgaacgaacgtgaatgaaacgttaacgaacgtgaatgaaacgtgaacggtcgccttatacgacactacgtgaaatacaatatatgttactttgcgtttagactaatacatttttttgtatgttgcagaaaagacgtcgtcatcgtcgtccctcaagccggagtggtagctagccctcgaaggaattcgcgcaggtacgtgatgtaaagatatgattgttagatttctaatataatataagactattagatttaatatacgacacttagacatagcatatatcattatctagggttctaatgtacgacacttagacatagcatatatgattatttgagttctaatatacgacacttagacttagcatatatgattgttagagttttaatataagattattagatttgtaatataggactaataatataagactattagatttaatatacaacacttagacatagcatatatgattatctagggttctaatgtacgacacttagacttagcatatatgattatttgagttctaatatacgacagttagacttagcatatatgattgttagagttttaatataagattattagatttgtaatataggactaataatataagactattagatttaatacacaacacttagacatagcatacataattatctaggactaattatataagactattagatttttaatataaaattattagagttttaatacaagattattagagttttaatataagattattagatttgtaattagacttagcatatatgattatctagggttctaatatacgacacttgaacgaggaagggaacgtggagagggatgcggaggggaaccaggagggaaacgtggagagggatgcggaggggaacgaggaggaggaggctagtgaaagtcaaccctccgctggacagaagagagcccacggacaacgaggtgccgcgaagaagctagagggtcgacacatcataacagaaatggacgaagacggctgtcacgccctgaagttcccctttccagctttaaaattgtaaaataaatcgtccgaagaaattgttctttttaacctagagctaattcctcaaattaataaatccaaataataatcggaatgggca

SEQ ID NO: 66338 - DNA, 43306 bp, Oryza sativa
  unsure (1)..(43306): unsure at all n locations
cacaaaaaaaaaatgtttggacattgatagtctctacaaaatacaacttttacaactattgtccaaaacatatctttgactatgattttctattataatacatgcaaaaagtaagtaaatatttaattttattaaagtactttctaagactaatctatacatcatgttctatagtcttcaaactaaatattttaaaagttattgataatccaacgtcaagaatcatggaaccggagggagtgatttctactactacaatatacttatggaacccaacaatattacaatattatgaagaaagtacttttgtaacaaatctacacatatgaatttcatttgtctaattcgaacacacatgctcaaagttttgaaagtttgacctatattttttttctttggatgcagggagtcaccaaaaaggtatcttcaataacattgtgcttaaggcactgaaacaaactaccgccagacatcgtaaagtaggcaggccaccaataagaatcataatgatcatgtagagttcaattcttggaactgttacctaagaaagccatcagttggttcaatgaagggctcccatgaattatacttgtcattataagatcttgccgcaaatgacaaacccacagtagcatttagatgttgaggaccaccatgataactaaaccccacactattaaatgatattccaaataatggtaccatctgcaaaacgaaaaggttggaaacttaatatggctaacacaaacataagtaaattaatccgcatgggatgaatagttataacaccgaacataaatggcatagccctgaaacctcaaataaattgaggaacttgctaaagtacagtagcacaagacttaccattcctccataatcatcaaatgaaactgcagaaaatgatttgatttcagcatcaataattatgctatctgaactgctggatgtaggtggaccagcaagcttcagggcaagtcttcttggaggttttctaaatccacttctaacaagaaatgtaccaacatcattatcaacggtccataagctaaaactttcagatgttctagcaccagatgagtcccacacgctttcctccgaaaattggcctcccttcaccatgtcacttctaatacatcttaagaaatgcaagtcctctttcgctggtgaacttttagatgcaacacatcctaaagcaacaaaacctggtggagcttgaggaaaccaaaacgatacaccctcagtacccctgtgcttcttaattctaccaacaagctgataaccttcaggagctctgagaaaggtatcatcgccagaatttcgaagtacaacagctgaatttggtggctcatacctacaaccaaaaagtattttaatttgaataccatagaaagtttagccagaagatcagaaagttgactgtaaaatatttacccgttaacagcaatgtcaccaaagtaaaacattccttcagacaacattggacgccatatagatagtttctttggtgaagacatgccattattagaccaaattagtttaaagcttgctactgcttcaaatagccgacctgaggtcaatgctgatctctctatctgcgaagcatcattgtgactatcttgccctatagagctagtcttggaagagtccgcatcattgaacagcatatggcgaagatcatatgcatttccatctacacgcatatgtgctggatctccgggtaaaaaggaaccaaaagcattatcaacccgccagaatgacatattggcattaccgctgaaaaatataaattgaaaaatataatggatgtagagttttgtagtcgcacaagaaacttaagctcaaaggtaatgttcataatacctcagtggaatgcaatcccttaggccacatgaagaaaccaaggaagcagacaaacaaaaaactgacgataaaggtggttcagcagttccagttgaagaaacacaacccaatgcaacatagcccacaggtgctacaggtaaccaaactgagcagaaccggtcaacattagaaggcttgttcttcaaatctttctcactgtgttgatcctccatttgtttgtggaggtccagatcgccaaactagtttgtatgacaaaggccttttgacccttacaatgtttgtgttcaaagcaagaactcctttagtaggagagtcattcctaacatggaatatgataaccaaggttaaaaacatttcataaaaaacaaggagagagataatatagttaagtaaccaaatacattggtgtgaggaaatcgccaaaaatggcatatccagatggagcacgcggtcgccaaaaagagtatacttgatcgctcgcaccacctagaaaaaagaatcaatctccttaaaacttgaggcatctgaaattagtaaccacaaattaggagcatccaacaacaaaataacttctaccataccctgcatagtcacaactttatcaaattgagagcacaccagtgacattttcttagatgacatcctgagaaatgctgaaatttcttcctcaacagctaaaaacagcctcagaatactgaaggagaaattcatataaatctcagaaaccagcagatgcaaatttgtcttcccagatgcgtttgaatatttcacagacatgtcaaacggttctataactctgatgccattactctccatctttaaaccgagtatgtttccactcatctccatactgtcacccttcattataagcctgtcacatgaataagaataacaactaacaatcaatgacctgaactgctattaacatacatagtacggtaagacaagtacattagttaatgcattgacaaaagatgaatatacctccctctacaaaaaatcgtgttttttctggcatgacacaaatataagatgaactggaatacatcattgtatggtcagatatgtcatttagaagttagaagaaaattgatggggaacaaaatatatgcacgaaaatattcatagtttttctcctatgaaatatctttttgccatttcaagacttcaagacaaagatatattttatgttattaaaaaggaccaaccatcggtactttgtgaaaagcgtttgaacatgatctcaacatcaaatttcatctgtactgcacagtgacaaaaagagtattgcatctaaatcatgcattaccgatattttatgccactgaaattttgcaggcacgatattacagtacaaaaccatttatttttggcatacttctggaatagcacaatggaaaatggtaacaaaaaaaaaatcctcacaaacttcttacagaaactgatgtggcatgttatgtgtgcgtcttgctttttcataaccaccaatggattagattcaacggttgagatatttgtttgtaagaattgttagtacatatatcactgctcttcaaaaattcttatgttgaatattttagagtggttttaagatagaaactgtgagaactactttatccaaagggtaatagagagccaacctgcaaaatgcatctgtacgggcatgaataaccttagttgatagtgctaaattttcaccagaatttcttgatgtgctgtagaaagtaagctctggtccaatagcctgggataacaatattcaagcgtacaatcaacaaatgggaataatgcaatgcagattcaaaaatcacaacacgcaggataaaacaataacattagtggtatcctggttgtgttcagaaagattccaccaggcaagtattcattgtcagctggaactgttttaaaaacattgcagatttagatgtgattatattagagttctaagttagtctttgaactattgctgatacacatagctggtttgtggaaatgttactagtagattgatattcagaacatgtcacttgttttttatctgcacaaatggcttaaataatgacttcctcacaaagtaaaacctgcatgcacaatgaaatataaatagtaactttaagcatttaaacgtaagcaaaaatgagctaggtgcccacactcgaggtgcgcctcagagagactgtccaacaattgagttgtaacagatttatccccagaatctacaaaaattcaggtgtgtggtaggggctgcactcatgggtgcactcgtgtctaacatgtaaactgtagcctaaaataacagagcaaggtggtggccaactggccatgatattgtttccaaatacaaactgcattcacaaagaaaaaagaggaatccggactgaattcagcactatgaaaatccagtgcgtatttccttattcacaacagtaaccatctggaaccaatatttaactttctttttaggagaaaccagtaatgaactagaactgtcgagagggattattctagttccaaaatcaagggtctgatcagggcaagaaaacagaacacacataaagccatctccatctctcgtttcaacttttacaactgacttagaatcaagtttatctgattctagcctacagcacaatggccaagattaagtacctcaggtatagctagatgttcagagcaatacctgtatttcaattatgaattctgttgatctattggcactaatattttttacaacatcttcagtaatttcctcactgtgagtagatagaaggccttcattttcgcttactaagtagacatgatcattttctgatgctgaataccagcaattactgccgagagatatacacgagtccaaatactcaccattctgcagcaagatattgtgttgtcaagccaaagaaatatattgtaaattactactccctctgtttttttaaaaaaaaaattttgatgttggtagaaagaaatgtcaagtaaaagaaaatggagagcaaacaataaatattgaaagtgtagagcataccactatcgtgacattccgaaattgcaaccccttaccacagagcacatgaatgaatctttcagcactagggcctgacagaatttttccctccctatcccgcaaatatattttgccaccttttccgtcatatatatagtagtcgaacttctcattatcaacaatcagaggtttctgaggtgaaatactcatagtggaacgctcctgatagtaaacttgatcactgaataccagtggagaagtcatgtgcagaaggtccttatcttcatcattagataacagactacgagcagatggcacaaagaactcgacaattgctagcaagaaatcaagtgccacaagaaacttgggacgctgaacacacacagacacagttgacgaagattttcgcaggatagcatcaaaaatgagcattgaggggattggctcaaggcctagatctttttgtattcttcgttcacctgaatcaagttcattaggattatcatagccatcagcagatgatgtgtctctaactgttgctgatttcccaatggcaagccttaactcatcttttgttccttcacggtcatcaaaaacagaaaagcctttgagagtagcaaaaagaaagctctcctccctcgtatttgatttatacagaagccatgcgccacttgcctgagtacagaagattgcatgacaatgtaagagtatactctacttgaatcaacttaacatgaaagaatcctagtatatatagtatcaatgcgattccaaagcatattactcttgaaactttacctgcatgctagccataggtgagtcccttgtcgatcctgaatgaagagaaagctcaaccagatttatcgaaacagatattttattagttatccatgtctccgcatcttgagacaaatcttgaatactttcagatgaagaagatgaagatacatgagattcagctgtagtagttccatatcgaggatcatcaagagcaggcacaacatgtggtgtctcggagaagtttgacaatgcacattcagatataatttcatattctcgattggataacgctgctttcagaacatccacctaagagacattggacatgaaaatggatttcccaatgacacaaaaagacaaatgataaattgttgcttactgtactgaatctaaccagggagctttcattaaaaatgcacttagagaaaatgatctaccttaattgaagcctccaccgctggtaactgatgcatcaggtcacgtaatgatctatggatctcgaaggagagaccttccacatcttgaattatagtttcaccacacaccatattcataccaatagttagatttatgtcctttacctgcaaaggtaagtatgtaaccacagttataaaaacaatttgaaggtccatggcagaaagttccatttctccaaggaaaacaatactaagaaatataagttattttctccccacaagtgctcctatgtttcaagttgggttaatttccaaattccaatgcctccaaaattaacaaagctctcatgtccactggctgaaaattatgcaggaaaataacaatatactttcttgtccaaaaaatatatgttctcaacagatataaggaatacagcgtaatcatcataaggaagtacaattcccagaatcccacttatttttctgctctgttcttatcacccaacaaggaacagcaagtaatgaacacatcgacacattttgatgtagttctcaagctcaaaaactaacataaacctgaaaaggaatatgctacaacatgtaaagcttctgaaatctccattccaatggcatcagactaattatatggtgtaagtcatttctcaatggctaggctatctccatctgttgcccatgttcctcttttttctttttcttttttttaccatgtacggttttttaggtgtcaattaaagttttcagtagggctctcccctcaacctccccatccaaacagggaaataaataaacatgttgacacaatgaacttaccgtaaccgttaaaatttctagatgaatagcgctcatctcattcttgtcaccaccgatccattggaatttattttggatctttatgtatagaacatcaagctccaagaaactgcaaaccaaagcaaggctctttaaaatatcataaagatatgtgcatactatcagtacatgtccacagacccatccttactcagaactattagtttcacgaggcataacaattataggcctactgaaagagacatccaatttgagagcaggtgatccttccatatcagttttgctaacccacttctctgagttagttacattgtcttttagctttacaacactatcagagctcttaggaacaaggcccatgaaataattgataatctgcacacagagtatgtatgagaaaagagaacacttaaatcaatggcagaagagggaaaattagatgagcactaaacagcatacctcttgaacaaaacggttgagataaacaattctaacttctgaaagctgcgctgatagactatagtcatacccactatagtcttcgtcatcaacattgtatgaactaaagtcaatctgcacaaagaattaaaatgttgtttgttttctttcaagccagaagtagatagaaaatgtaagcataagcagttattcctcaacaaaaatgcataagcagttacagcatacaactagggagtccattgagttaatcaaatggtagtacctccacaaaagaacttcctcctggattacgcatatcacaaacccaaaagtagggatgattgcaagaaagactgtcatcgcttattttaaggtttccaagtgcagcctctatactgaacgacgatgtgaacaccttaaaatgccaagatagtcatgtattaggaaaatcaaatcaagatcaatcatatccattagagatagatgataatcatacctttatatcagttgagaggttattttgtgataaagtagcaagccggtcaccattttcattcattaataatatttgtgcctctgccatgcttgatgttagatgaaaaactgttctgcttttacctttagccagtaatctttttatgactggtcctgcttccagatcagacttaggttcctcaaccatattatgttctacaggatccgatgttgtatctttatttttatcagcatcagggacatttgcaaggttgatggcattcataaattccatgattgcaataacagttggtcgatgacagaaaaaggtcagagtagcaacacttatcacaacctggtaaaaacaacaaaaaatccgtctgtcacacaattgggagaaatagtactatccatataaatttcgaagtatgtacccctttatgcaataaagaattgctagatactgtcatactgagatatttaccctgttatccaagttgttgtattgaggggactgctgatcataaatcacaatctgagctttcacaaaactttcaaaagtaatgtcccctgaagtgaatccggcagattgaagctcaatatctggcagcaaaccaggaattcgactgaatgcaggtggctgcaaagaagggaggctagtaggcaaaaagttctgtgtgctgaaataatctgatatactcctctcatgcagcataggtgtttcaaattcatcaaaatcatctgatgcttcaaaaaacctttcttcactgtcacttttcttcagtgcagtacctctaggtcctgcactattctttcgactaggagttgggacttcgttggtttgcacgctattgataaaggatctcgccaaataccttggtacaggactaccagggtagttatactgatcttcaatttccagagatcgcaagatagtaccgattagtagattgccacccttcattgagagttcaacctgtttgtttccacaaaaaaaaaacgtagcttaatgaatcagtcatataacaaggacaaaaggtaatttcttactccctccatcccggaataagttcattttttgcccctctcatttgtcccaaaaataagttcatttttaagcaatcgtggtatcgtggtatcggagtttatagaaataggggatgaatgcattgggagtagaaagtgctgaataattgcgttgggatttgataaagttggggtattttagtctttttggttttgtattggtatgtgtgggatgggtgaaaatgaacttattttgggatggagggagaagggaataaagagttacctggccaccaactgcccgaaattcaaacaagctgctctccttagctagcagaacttttttgagtttgtggttgctctacagaaaagatagtcacaccattgattcagatgcaagtttacaaggaaaattgggtaagaggcacacctcatagccacatgagaagcagatctttagctcatcaagaatgccagcaacgaacaatttttcaatgctaacatcttgaaagctgcccttgaaggaatgggtctctgatgggaatgcaacttcaggaaagctggaaagtgcggcagaaccctgcaaacagactaaattacctggatagcaataggatataacaaaattgaacatatgaaaaaggaccaaaaagtaccgatgcacggtatatagcaccctgcaagcggttctgccatatccttcgtgcttcctcattgtcaaacaacataatcaaagcgccagtgtcttcaagaatctgtacaaaataaagttaattggaagtttagaactatcaactatgtcacagggattcatgttccatatctacattagcccacacttgcttactgtgtcaattctggcttgccattactgacggagtaaattatgatacaacatgactgattgtagtctaataaaagaagtaatttacagaatataatgaactcagctacttgaccgttccttgggattaacttggccagaatcatgaagtgccaggatattctgcacaccacttgtaagctccataggaacctgatggacttgtttattacgtaagctgtgattcaacacaaaagattaaagtcaaaataatatatccacctgcataaaactagcataaagattataagccatttacaaggttagatcaaagctattctcatcaccatagatgaaaatgcaataaattattgtatcttcatggaaacattgaagacatcaagccatgtcaaaatattgttgttctttcaaggaaatattaacagtgttcactccctaaatagtaaataagtaatatatggtaggaaatcaccagcacaacaccatgatacctgagaaacatctaagactaacctaccaagaatcttgaaaggcaacttactaaaagttgcgataaagatcctctccgcaaatatacgctgaaaactactagtggctcataacaaaaacattcatagatattaacagttttactgaaacgaaaccataagtgattaacttaaggtgtagtatttatagcacttccagacaaatctatttggaattaaaaatgcatataggtgcactcaactgtatattaagatacaaaagtccaagagaaaataaagcacagcgaaagtgtacaacctggaccattgcttgtatgttgtcgatgtcggattatcaaatacataaagaaatggtcccaccaggcgcaggtacctacgttgccaagtagcttctctgtttccaacaccctgattaaggtaacagggcaaataaaagtattagcaatgtaagtatagattgattaaggtgagagagcaactagcaattttgttctctccaacatccactttaaaataatatactccatgtatgccacatttcatttgatggtatcacccaacaacagtgtttctttgccatggtcaattcaaagcacagctttcaactgtcagaacatgtgtagggctgcccgggaaaatgaagaatgaggtaataactaacaaagggttgtccagggaactagaaaatgaggcaacacagagaagcaaagatgttcggaggtgatggcctgtggctaaagaacctgattcagagtggcattcggctaaacgaaatgttaggaccagcactcatctaaacgtcaattttgagttggcaccaacaaaatttaagaatgcaatcattaagatcagaataccacgggcaacatcaggaaaatccagttgctttgaagtctatataacaagtactgtattatatttctttaaggaatgacaaccatgtcatcataaaattgcatctcagaaacctaagcaaaaaaagttcatcacaagcaccaggtgaatgcacatatgcattacaggtgaattatgattaaaagcagagtaaagcatgtgtcaatttcagtatggtgttagtctcctatcaaataaatgaaaaaacgacaatcaaattaagttggatgtaccggtttaattgaactccactcagtgagttcgtatgttgacctcttaaaatcatcttttctcaaagatgtacagatcatatggccaattggccattgttcatttttgcaaaataaggtcatgcaaagtttactgtgtctacccctaatcccttatgcccccagttcatgatacatgcaacacagattacaaatccagttcaagagaacagaaaagtgcaaccttccatgtgagaagagatgaccatccctcaaagtcagcctgatcccacaaatgtgcaagatctgaactgtttttgtcgctatcattatcttgaaaaatcttgaaaatttccattaacctatgataacgtgctggagagaaatgaaaacccagggatggaacccgtactgccattcttgtagaagggtatagtgcactttctaactggatctgaacaaaggaataaaaatttattaatgtcctgttgattatatgtactgttatcatattaactgttttgagtaaatgaacactagtcgtttacctgctgaagctttaaagcaattccacacttgtcgataactgacaataaatttacttcattggatctttcattccaatggtaatcaccatccactaaaaatgcagatacatcacttagcactagattgaaattcagatacatatcctgctcttctgaagcacgggaatcccatatctcctgaagcaacaaataaaatcagtggcacattacccccaaccatgggcatataaaatccaactttcagagagtgcacgtgacctccgtccgaagaattaaattccctaggtcaagcaaaagcttggtttcatgtatgtcatctgggcggaactttgtcggaacagtaattttgggggcagcaatatccagattcagtgaaaatctaccaagggtattgtgcatcagtcaccattcaagaagggtttgacaggtaaaatataactaaatattaactatactaattagcatagaagagacacgtaagaaatggaagagacaacagcataggaaaatgcaaatcaatttcccttgctaacaaacatagaaacaacaaacagctaaatcccagtttgaaaatgtattaatcaggctagtatccatttaaactatagtttctaatgtccacatcaaaagaaatttgtcagtgtaagaacactaacctggactgatcttttagaacccgtgacatttgctgttgagcagtgcgcttcacttcatctaatgtcatcttcataaattaaaaaaatacggaagaattaaatatctgatcataggaataagtattttacaaatgaatgttgaatatacctgcacagcagcagcagtctctatcgccagagtctggctaatggtagggctactcttgaagaatgcaacgatttgatcaatagaatccttcaaatactgccacagaacaggaactttaaacatataatggtagaataaacaaatacacattaaaggttcaaaatggatagctcacagttatgtaacaaggagaagctttagccgtgaaactccagtccagttgctcatcgaaaggtttgtaggagaaaatgccaataagagaatcggtaacacttgcactctgtcaattcatatagatagcggcatgtttgagtaactttgctgtcaaatgaatttcaattttcaggtaaaagcacctaaaacaaaaattagagaaccagatgggcaaacctcagcaagcagaccatacggagataaaagcttgtaggaaccaagcttcaggtcaaaaatttttgcctctggatacattttcaagttacaacagaaatcttcacatgacagatcagcaagatactctgagttatcgatgataagcttcgatgcattatgcttcatgcgtatttcaaaatagaactgcatcaatttcatatcctgttgaacaggaatatagtcatcattttctttgtagccaataatcctattcaatctttcccaatcttcatcactaaaactctttgagtctccctcatcctttgaagagccagtcctgcacacaaaagatgaattaatttctacaccttccacaagcataaagcgcgaggtttgtatccgaactaaccatccaaatgaccaccaggactgctgcttattttgttgagcatattgatgtgtttctgctgactgctctacaaacttgtgggccaacatcctgcacaaatgatagtaaaaaaaacatcaaaaaactatatactaaactaaatgcattgagcaatgaagaaatggtataagaacatgcacatgaaacaaggcctggagcagaagtttagtttaactccatgtgttagtgcatggataattacggacaaccttcgttctattctctatggctcaaatgatcatgaagttgaacaggacactcatctattcattgtacttgtacatgtaaaagcataacaaagctatgaatcatatactaagtattattcataggactaaaaagggccatgatgtgtgcattgaattcaatataaggaaattttaaacagcaagaataacatacataatcaacaggaatattctgcaacaattgcacaaaagacaggcatgtaacatgagtagtcgttgtgtcaaacaaaaaggaatgctgagaagagccaatggagtacacacttttacattaatcaagcatttcagtgtactaaaaacaaaatggtgtacgacaaagcaggtgaataggaatatgtaatcagctccttgatgttccctgggaacagggaagtcatcgaactacaagcacatcaggaaataaatcagccactgcaatatgatgaacttcttgcactgaccaatgatcaacattcagtatgtgttacataatgaaattgaaaatatgtcaatctcaccaacttcttgctttcacatttgtgtggatagctggaacagatcttatggggcatcactaccagtttttcacttatttactatctcagggcaacatcagggagatggtaattctcttggtgcataacacagaaagcagaagtagcaacaataactagaaaaagaagaaagaattacctccattgtaaaatgacttctatatctagttcacgatcaagtttctttatatcctcgttatcatcaacaaccaatcggctcatgtcagatttcaataaggatgcatatacagatacatatgtctttctaagtcttgcatttttcagtagttgctcccatgatagatttccactgcatccattaggaatatcaacataaaataattgataaagtcatacgtacagggggagaacaccatgaaaaagtacaaaagttaaaacaatgcccacagccatatgtgattaattaataacatgctttgggtataatcagaaataggaaaagattgagagagtgatttacagtacaacaaataaatgcatcaaatctattgtctaggctctccaaattggtgctgcttgattgccttgttactgcccaactcctttctaatctacaaaaatgtttgcagcagcacagcatgtacagtttcataaaaccaattaaccaggcatttacagcaaaagactaatgctagaaatcatgaaatgtcaaaaaaggaagacatgagtctgagaatgagtaaaatagatgtcggaatgcatgcaagatttcttgttaaacatccttacagcaaactgttaaacataatcctgtttcatgcttataaacaacttcgcatgatcactatcattaaaccttgattggtaataccaactacagaattaacatcgaatgagagtaccttcaaatataatctagcggtaccatcatattccaataaacatatatttatccacaaggaatttctatctgtacaccatgtggaagccagagaaagatatgcagaaaatacacaccttgctttctttgtttcatgaaccaccaccttgtatgcatacttccaccaagaccttgggtcagatttgactggcaaagatggccggtagtgagcatatttgagacgttgattaaaagaagaaaaattatcagccatcttcaagacgtccctgtagccatcctgatataaagaacaaggcgtacacattcaacagtgccattggcacagagggagagagagagagggagagtacagaccttagacaaagacaaagtaacgtcatccaaatcaacagctgcattttgcaaagcctgtccggttttctttgcttcatcaagttgtatcttcgtatatttggctttgccagagataggtcgtaaaatgtaagtgtgtgtttttgaaggaggattagaactgtcctgctttctgaactcaaaaatctgaaatacaatttatgaagcagcaagaatttgtcaagtggaataaaattattggatgtaaacagtgatattggcatgacccagcttacgaaacctcactgcaacccagtgtcaggaaatctaggcacagtttatggctgttcagttagttaatgaaaaatggacgactgtatatgtgcagaagtatacagtaatgatcgatggtatgttttgttattaacaccgccaaagtgccaaaattatggatggggaacaagaggtgagattaagagatagggatgaaaatttgcttagtcctctcaaaagataacatttcctttatataagacctccctaacaatctcagttgggtaactaatagattagatgtacagctaaagctaattatgattgttgcagctaacttgccaacttcctgaacaagctaggtgacatcctgctgtatgcctgccttcttgaatcacttaaatggtcccatgcaacaggacaggcagtcatggcctcgtgcataatatatatgctcaaacatcaatttttttattagcaattgactacagatggaaattacctgactccattctgaaggtaatagatcttcccaggacttatccacactccaaggactgctatcagaatcaaaatacaatgccaggctctcaagttcgactgactgcaaaccatttgcaaataaactataaaaaatcaagatccattggtatgaaaattatgaaagattgtcacaaggaaaagaaaatggacaagtacattacgccaaagattcttaatcaaaatacattcgcatcaactagagatgtttcttgtgttccctactgttctagagttcaaccttctgtttcttgaatatcataaaatacatcatatgcgctttaagctgttcgatacaactatacatccatagtgctctcctccatcactctagaatttgcatcaacaaagttcactactaggctgcggatggctttgtgtcatgataatagtgtgttttggcacctattgttgtccaaattaagatttgtattccttaaacgaaggatatttgaattgcacgccccttttttgagaacggaatgtgtcttatcgaccaaatggcattgaaattggtgtccatgccctaactttactttccagaaggtttagtagtgagttgcatagagataccggtatccaaaaagtaaccagagctattaaggattatcaaattagtgagcaccaaaacaatataccttcttaactcggtccaaatccccgcctgtggcaaaagtctcctttccacgatcatccacagtaaatgctgaaagctttgagagtgccaaacctgctgcaaaagggtggcctggattgctatagagaacaagttattatcattctatatgcatttttaaggagaaattcagtaaacgggatttaagtacctctctgtgtcctcatatctgatatgaatattgctaattgacaacttaatatttccaattacagtgctaatgaaagacccaagccatgacgaattcttcaagaacaaaagtgccagtaagaaataaatgaagtgttccaaaaataatgaatgttaaacacacaacatcaatcgaaacaaaggtagccagattgactatctggccaactaggtgatccattatcatcagtacataaacacatcagcgaaaaactaaaagggctaaataccagttcagatttcagctgttgttggctctccaataacttcatttccatttcctgagtgaataaccacagatcatcaatgcatatggcactggcattgtttccataactcactttaaaaggtcacaaagtaattaccctgactctacttctttttgcctcttgaacggcatcctcactgcaaccttcaacttgtgttgctggttcagctaatataaatattcgatcaagataaaccaaaactggctcttgaccaagcctgctccacgggacctaataatcattcacacattcattctttagctcagcacttcatatcttaaggcaaaagtaaatgcactgagctgaagcaattacagcaaaccttgagcttcactgaaccaagaaaaccagctttcaccctcacaggtaactttaatgaattgagagcctcaggcttcaactgcatgttcgtgagttctacatcacctgaaatagtatttcaaaaaaatgtaatagcattaagcagcaaaaatggatatatttcattgataaacagggtcaatagctagcaaaaggaaaaacaagtgggtttacaagttccttctggtatttgaccaagttctaggaacaacacattgtgttctactctaaatataataaatgcatgccattgtctgttctgcaacgaatacatgccactatttagatgaaacagcttaatatcatagaatattctataggtggcctgaggagttcccagcccatccgtccatgatgccacatgatggaattgccatctgatgcctactgtcatatgcttctcgtgataaatagcatcgtgcaagttgaacaaaatcctgtgcatactttcatgaactattgaaatccattccatatacaatgtgaatttacctacaatcgtcgtaacatgcaaaccacggatacattcgtttgatttgtctatgcaatcactcaaacaacaatttccctcaaaacatcttgatgctcttactgccaaccatcaacacatgttttggttgattggcaccatggaaagcatatacctagtatatgtatgaatagaccatccaactttacaattcttcacagaactggtaacagagaaggaccaacttcatatactttatgcgctcaagctacaggatctacaagtgaacaccaccctactcttgttttcttgcatctttatctagtttatccgaaaggaatggtcgtctagacagtcagaccaagaaaatcatacatagtgatagtactactactattccaatgatcaccttgcatatttttagccatacaccacattccaggcttccaggccataactgtcagtgataagcagaagtaaattgtccaaaccgataaattccctaaattctgaattacagttgcaactctgagcgctatgctcttgtagtgtcgagtaacagcatcaagatgtgtctgttagccagagaattcaagcggtttctggatttcacctagaggacatactggtggcatgtctaacatttgccctcaatcttcttacatggctgcagctcttgaatggtattcgtccatgttaaacatcccagataaccgtgacatctccacccttctctgacaaacagcttcctaattcaatactctgagcacctattaacactccacgatttgacagcaaccacaactcacactctcacagtcgccaaaaagcacttgtatgaactgctgaggtgctgataccagcacagcttgacaagatactttcgatctgcaaagcacttcccagtcactgctccgcattatcgacattgtcactgcttgtaccaacacttgcattcacgaagtttatgttccaattgtggtccacgcatcaatgccagtcagtttagttcagaaaaccaatgcgtacacacaccgatggtccaatcctacattgctaccaacgaaatcagcttccacatgaagcagcatcttatgcagacgccagccatttccgatggcacaaacgaatccaacaatcacaaactacacactcagattgaacttcctaaaactcccaaaccatacgaaatcgctgctccatagcgattcgctacctaccactgtttctgctgcaaccgccactactcagaaaacaaagcagagccgcagcaaaagtagagagtagccgactaaagccgcacgaactaatcatcatcgacggaagcagagcgagaggaggatagggaaaggggggggggagtgcgaatgaggtcgtcacctctccacacgctgatcttgagggcctccttgctgagcccccggacatagttgccgaggtacttctgcagcaggaaggcgacctggtcctccaacatctccgccgccgccgccgccgccggcgatcggcgccgcccgccgacgccgcgagagcgaagaggcgagcagagattggggcgagatgcctcgcgcctcctcctcccgaccttccctccgcgcgcgagagatgagagaatcaatcgagggcactggactagaactcagtggaagcaggcagtccaccacgggtagtttctgtgtcgaggtaggaaaggagatcgctagaaggaggaggagaagaagaaggcgcgaaaattacggagatgccctcgcggtcgcggctgggatgagacgggtggcgtggcgtcgggcgatgtacgtggtgcgtgctggttagttaccggctcggtctgagtcgtgtggtagtgtccagagaaaatacacctggatttgttaattagtaaattaaataattaattgcttaattgcgatcaaaccgaagggcgagaagtaattagaaccttttttaatcgcgcaagctggatggatggtcgagcaaagtcataatcacggtagcaagtgactaccaaaccagcttattgtcgttgatgaaagattaggaaaaaggaaagggaagagaaaagaagaacgcggcgtggcacgcaaagtgcttaaccaaagcaggcaaatgtcgacgggggatgtggacgacgctgacgccggatgcctcgtgtgcggggcgcgcgtgacgactcgagcgagcacgcaaagctacctctgcggcgttgtgctgccggcgtggccacgcagcccaaggcgcagccaacgacgacgcgttcgtcgcatcgcccccggcacgagcgcgacacctgcccctctctctgccaccgcacctgccaatacgtgagccgcccgtggataggggcaaccgaaacaggataacaactgaggctgggtttaggttacacgctaaaattgaaagtttgaagaaattaaaacgatgtgacggaaaagttgaaagtttgtctgtatgaaagttcgatatgatgaaaaaaattgaaagtttgaagaaaaaagttagaatctaaactaggcctcaaagggtattttcctcgtcatccactctttcgggcgtgtttgtactttggaggagtataatgtacgtgtgtatatttataaggtgagcgtgtacgtgttacatacgtttgcgtttataatgtgtttcaaaaaaaaaaaagccgcaatgctacacacacagcacatcggtacatcacaggagtatgcaagtaacattggttagactgaatgactgagtgccaactactgtcagtcggtcagatgctatactgatgctaatgcaaaaggatcaatcaaaggaaaagaggaggaacaaaagtcacctcgaagaacaactcctttggatgccggtacgctagcttggaagctcgatggcattggccaaggctgtcttcttttcgagcttattcctttcttctaccacactctgctagttacttacaagaatggtgatctgttctgatgggaaattcccgctttaccagcccatctggaaagaagcccgtcaagagcatttctgctcttccattttggagtcagcccagcccgttaagagtaagctacactagcatttggcccacgtatcattctactgtcatgaccgactaggcctaaaaattaagcccactagaactgttcggagttcggcccaaaaatcacccttatacataaaaatggtttattctctgggatcaaatgctttcggtcattggatttggagatttggagtttttcaaatgaaacggaaaaaaatgctttggtcattggattggcactaccaacgtccagccaatgaggtcattaggcaaatgtcagtgtttatcttgcctttgatcctatagaaaccaaaaacggatgatgacaccatttctagaacatgtctttttttttaagtacgtgtttgaccattcgtcttattcaaaaaatttaaataattatttattcttttcatatcatttgattcattattaaataaattttcatgtacacatatatttttacatatttcataattttttttataagacgaacggtcaaacatgtgctaaaaagtcaacggtgtcaaacattttaaaacagagggagtatttgtcaagcttgctttctcttccaagccactcgtattgccatgcgattgcaaaaactttattccttctgcggttctgcctattatctttatcgtatatgccaacctttttttcttctttcctccccagaacgcctatctcatttgactagtttgcacctgacaactacctcattccccatcagacaacaagacatatagacccatacaaagttgcaaactataattcagatacggcaagtagcaacagaacaagatgagacaacagcgttacggttagaatatcacacaggtggcaaattggcactgatccatctgaaatgtgacgcccattttctgtgtgcaaacatgctcgaataggagtgtgtgcaccttgtttatggtagccaagatcgagagagaagcaaaagcatccatccctctatttatctgtatgtcagagctaagctcaaataatttctcctgcctctgatgaattttcaggcatttataaacagacaaaaatggtaacatcattcaacactcatggatcttcatgctcttagaaaaagataataatacctctaattctcagacgtgatgcacgtgatcacctgtttacatgcatcttgatgatgcggattaccagtccaatgtaatcaaacaggcgtgtttaattttgtgtagtacgggagatcaatcaattcaagattgacatgcaacatgcatggatcgagatcgcagtggcggtaatcaatgggttgattgggttgggtacatatctgtcctactggttgggagaatacggattacagtacgtccttggtgtatgttcagaaagaaattggagtactggtggtagtaattaagaggagcactgtatgagaatggagtacagataagtataattaactggtagagagtaaagaaagattgttgggcacatgatccttgcctgcccaagaaccgaaagcatgaaagaggcggcagaaaagattcagagaagtggatatcccctgaaagaagcctccagataaaatagccttattccaagcaaaactgatcaggtgacctcccctgaaagaagcctccagataaaatagccttttgagaaagcttagccagcaaaaagtaaacgatcagttactagtgttaatcaactgcaatgatcagtgctttgcctaccttggcctacaaatcaaagtactccatccgtccaaataaaaagacaaaccctagattttcgtgtccaaatttgactgtccgtcttgtataaatttttttataattcgtattttcattattgttagatgataaaacataattaatattttatgcgtgacttatctttctatatttttttcatattttttttaaataagacggacggtaaaatgttggacacgaaaatcagagttgtcttttttttttttggacagagagagtatctatctaggttagcatgctctgagctggactcaagtagtgtagtcaagtagtcgtatctgtcaagctgtgtgcagaaagccaagccaatcttcaccctgatcaagtgatgcacacaggtgaaaactcaaccttgtcgattatcttgatgcccattataaaagctgacttgtcctagagtgattatgaatggcctgaagcgataacgtacaccagttaatgtgtgctagtaaaggttttgttggattaattgccgatcgatcgattggtgattataaattcagaactgcagttaacagcaagcagggttgcatcgatcgattgccttatcatctcgcaaagcgatatgcatgatcgatccatcgatctactttggatttcacgctaatgtacatgcatgcatgtggacagacacacatgacatacagagtacagtttggcacctttcgtcgctgccggatcgaattgatgaactaacaaacattccggacagagtagaagagaaggaacaaatcaaaatcgatcgaagctgcgtacgcaagcgccgatgatcgagtgagtgacaaggatggcaaaccagactcagcagatgatggttgagatcagcctcgatgatctatctatctatctatctgctcgtgcactgcgctacaggccagcagctaaaattcgacacgaaacttagggggtgtttagatggggctaaaactttttagcccatgtcacatcggatgtttggacgctaatttagagtattaaacatagactaataaaaaaactaatttcataaataagagctaatccgcgagacgaattttttaagcctaattaatctataattataaaaagtttactgtagcatcacattgtcaaaatcatgacataattagactcaaaagattcgtctcgtgaattagtccaaggatatggaatgtgttttgtaattagtgtatgtttaatactccaaattagtatccaaacacccgatgtgacatggacttggaataagtcactggaaaccaaacaaggcccttatcgatcgagagctagctagctagatagcgtcgacctgatcgatcgtggtatatactctctccattctaaaatatttaacgccgttaattttttaaaaaatgtttggccgttcatattttttgaaaaaatttaagtaattattaattttttttctatcatttgatttattgttaaatatatttttatgtatacatatagttttacatattttacagaatttttttaataaaacaaactattaaatatatttaaaagtcaacggcgttaaatatttaaggaacgagagagtatcatcttgatcgactgaatcatccttaacgctaaaaagacgtctacgactgaactcgagatgggcgagatcggtgcatctggttgcattggatggatagatcactcgattgatgtagttgagaggaaaaggcgatcgagatcgatgcaagatcgtccacgtagccgtcgaacatgtcctgtcaggttaggaccaagctgacctggcagccactagcctcgagtctgcatgcacacgcatcaccaatgtgtctaacaaactatacgaagcaagatgagccctagcgaaaaaagtagtacatccattctaaaataattataaatatagattgtttagtatatatttaaaaagaaaaactacgataactcttattaaatagtgtgtagataaaaggctcccatcggatggcttaataagccaaagaaaaagccaaattttgagattgattttgaaatattttcaacgtagtttctttatcaacattgtcttttaaatcaccaagaatacatttataaaaattttatctacaaatttatttttatttcgtaataagccgttttggcttattgggaaataagccaaacgatgggaaccaaaattgagatgaaagttgagagtaacatagaaaaaaaaaattaagtatattatggatgctctaagtttattgcaggatgcacatgacgggacatggcactacgtagggactgcttagcacaactccagctgtacctcagctaaacagtttcagctccacctaaaatgagagcgaaggtgggttgagctctctcacaaaatgaacaagaggtagagttgggtttaggcagctccactccatgtctaactcctggagataaatttagaagttacggctcgactgatcattgtagctactagatgggctggcgatttgggcccacgagctagctagtctccttgacccacctgtcagatgccacccagcagcaaggaacaaagttgcagcaaatcgagcgctcgatcgtggcagatcgaactttggcatatatacacgtaggagtagtttatatgtacccagtcgtgatggatatcgagtcgtttaaattgatttcttccatgtgtgtttgggcttcttaacttcttttgcgtgctgtatagtatattgcattatgatcgagtacaagtacacgtactcctacactgtgccggacgcaagtttgctcgttgttgagtgtgtgcaccgatcttgatcaatgatactctgcttagccactattactacacgtgtattaagtctagaataaattggtctcgcttgtacacacttgaaacattataaacatgctactatgtttttttataagcatatttgaatataatttaatagtatgtatgtttggtgttgaaaatattactatatttttttataagcatgattgaactttaaataattttaactttagaaaggttaaattatcctacgatataaaacggagctgtatacactaacttctttgcaaactgaacaataaaccaaaataccactgcatgcatgcatgtgtgcatttcattgtggactgctcctttcacggtgcatataccgtgtcctcctgcagcagctgatggagatggatatcaacggacacgtctggagtagcaattaactcctcctgtgactttttcagaagatgtagctcatgacacaagtacgtaccgtgttgacaaaccatacaagaaaatcggagttttttttttttgtctctctacacgccgtgctggtcggtcgacctgttctccacccgccagcaattaacctgcactcgatacaaccaacatgggccacgaattgaacactaccgtctaccgtacccctccgattttttatagaaaagggccttaattttttttacattcgatttacttcaagaatcaatataaatataaaaatataaatcacgtataaagcatctttaatagtagtaaatcaaataactgcagaataaatatttttaagtaagacgaatgtttaaagatatgttaataagtaaattaactgtgttttcttaaaaaaggaggaaaaatagagagcattgttcgctccccactctattgctgaaatgaactggcatttcattactgaaatacaactggtagagtaaggttttgtctctacgcatcacactggtgtgacggtgtcatcgcaccgcgatgcaccgaacaaaaaacaactgctacagcagtgttatgcagtatactaaaaatcagagatattggtatttagcagcagcatcaaacatgtggctgctatctatacgtagtatcagtctgtttagcgttgcttgatgtatccttggttagtacgcaaccaacaagtacacgaggaaaaaaaagaaacttgacaagggcagggcatgcaaccaatatccgtaccaattccagtacatccctggaaattcagaattcaggcggttccgtttcaagctgacgcttcaattcagacttgagacgcaacatttttcttctcttcaaaaaaatcttcagagaagcaacaataccacacctacaacatttctaccacctactccacagtgcacagtcttggtgggcccaattctggacagcggggcccatctctactacgactgggcccacgtgttaggaactcccaacgattatctctcaggaactggaattaatcacgaattgcgcatacaagatttctcaaccccgaaggatcgagccgccgccgcctacgcgcgcatattccagttcttagcccccatctccttgttcttcgtttgcgtttatattacatagtttcggctgatctctctctctcagacagctcatgccagctggttgtttactggacccattggtcacccttgtagcgtggattgggcctccttgctcttggcccaagctggactggtacttgcttcttcttggtcttgaagtctggttttcctccttgttcctgggcatctgcttccttgtcgtcaggctccagcacctcttcctcttctgctccttcttgtatcatctcttctgtatcttctcttgctcttggtggagatggaggcctgacaccacggcccaacaaagcctcctccactcctccgctattgattcgctgctgcgttttgcatcgcgacgcgcgcccatccggccgcccggcgaacaaccgacagcgccgccgcgacccactcccggccgctcgatcgcgatcggacggccgcgcgcgccctcacgtgatccccgcgcatctcccgccactacgcccccctcgcctttaactgcaaatcgccaaccgcgctggtgtctggtggtacacatctcgcagcactttttactgcagcaactgtacaacggaccaaatcacacaacacaacgcagtaaaaagaagaaaaaaattgcactctagatcgatagcgatccagtgtcagtgactgtgattaaccctctgaaatagtatatgatcttgactaataatgatacaaccgagcagaaagatgccaattatcatttggtcttgactaatatgatctgataacagagagatcgaattgattaagcaatgcaaaaaaaaaaaaagaaactaatactaataaaactttacaatttttcattcattgttcagagtttggctttcaatggccatgcatgtcccgaggaggaggggagcaaaaaaaaaaaaaaaaaaggcgaggcatttctgtaccaatcgttttcttttttttcacgagatgaagacctgcacggtgccggtgaccgcgccgcggcacgtggggcaggcggcggcgatggcggtggagacggcgggctcgcacgcctcgcacacgcagaggtggcggcaggggaggaggacgacggaggacggcctcgcccggcacgtccggcacggccgcgacggcggcggcggcggggtcacctcctccactctgtccgggtcgacgaaccccgactcggcgtcgtccgcggcggcggcgttggggttgatgttgtcgtcgtcctccggcgacttgctgcccctcgcctgcgccgcggccgccgccgcctgctggagctgcgcgtggagcgccgcggcggtggactggtcggcgagcgccttcgcctgccacgccgccgcctccgcccgcagccgcgcgacgcgctcctccagctcggcgccgcgccgcgccgcattcgaggcctccgcctccttctccctcatccggcgcgccgccgccgcctccgccgcgccgagcagcgaccggtagtgccgccgcctcacctcgcccagcgcgcggcgcagcctctccgtctgcaacaagcaaaagcgacgccaccaccatcatcagaaaacacatcgccgaacaccaccagcggcaagcaacgaatcaaaacgatcgacatcgacgatcctcacatgatcctggaacatacgcgccatctcgttcttgcaccggtcgaactgcgtggcgagctcgtcggagaggagagacgacgcggaggaggtggtcgtcgtcgacacgtgctccgacccgccgtcgtcgaagtcgaggcggagccccgtcgacgccggcggccgcttgttgtgcagctgcgccaggctcaccaccttgtgcccctgcgcctgcgcctgcggctgcagcgacaacatctgcggcggcggcgcagcaaccatggccgccgccgcatccgcctctcgcggccgcttcctcgagttgcccccatctgcaaaaaacaccatccatctcaatctaatccaagaaccggggaaaaaacacgcagatcaagaatcaaaggcgatcagttacctccatctccatgcgagaagtccaagaagaggggaggctgctgatgctgctggtagtgatactccatgcccgccggcctggtggtctccggcgagacgacgacgcctctgctcaagaaatccaaaccaagaacaccagaatcaatcaccccatccatcgtaactcttccccgatcaagagcagcgacggtgagtacctggcgaggaagagaggaggaggctgatgctgctgctggtggtgatggtggtggtggtaatgcgcctgaactgccattggtccgcggcaattgcaagcaaggtgggggaagaaaaagaaggggggaaggaagaggaggaatgaatcgaggcgcgcgccaagtgtgtgaggaggcaccccgggggcggtggtggtaggagagagttgcgggcagcgcgagcgaactggtcctctcctcctctcctctcctctcctctcttcttttaatcacggcttcatctctctctcgctgtttcttttctctctcacggtctcacctcacacgcatcgcctggcatcgcgcatgcagacgcagcagcagagagaacacgaggaggcggtgacccgctgttgctgctgatcgactaggacgtatttattcctccctcctccccgaattggagatccattacgattgattcgcatttgcgttacgtgaaaacaaaactggagtttttgaatctacgcatttaaattgcaccgtgttcacactttttttccccgtatggctagacaaggaagtaattaacccatgttctttttagcgtatattcaccgaattattgaaatgagatctaggttttaaaaaacaatcctattaaattgcttagacctttcatattactccctccgatttttaatatattgcgccgttgattttctaagatatgtttcaccattctcttatttaaaaaatgtaattaccatttattttattatgacttgatttattctcaaatgttctctaagcgtgacttattttttttatatttgcataaaaaattaaataagacaaatgattaaacatttgtcaaaaagtcaacaacatcatataatgtattaaaaaatggaggtagtatttattaagtttattttttaatttatctctataattaaattgataatttaaatgaaacggggccttaatgtgctgatgatttgtattgttggtgagtataattagccttttcctttttgatagattttttcctttccgtggagctaactacaataattggtgacgatatactactaattttatcatggggaaaacgggcacgaaaaacgctttgtttttttttttttgcaaacggtgggctttgggttggtgttgtgacttgtgacatactatcagatcatgtcacggaactatcttgagatttctttcccttttgtaatcaaatctctttctgtgaacgatgatgaaagctgttgaaataccccaagctctcttgattgcggaataaatctgcaagatatccaaaagttcattgcaacctccaagggctctaaaatgtctggcgtgcatttatcaatttcgcgcatggcaaccaataaaacaaggttaaagaaagtgccattgccagctatatattgcgaattaatattctgatattttttaaaagcatgacatgtttttcttgtttcagagtccaaaatattctagccataaagttcgttacgaactgtttgtgcacccagctgcatatgccctggctctccgaatttgagcggcaatagctatggctttctttcaccgataatcacgatctgaaaatttcataaatattggaccattctatgattcttttattattttctcctaatcctacggttccagaaaacaatcataatcctgtcaccttctcgtatgcatgaaaatgtttaattccagccgtgcaatcaaaattcacacttttcacattgccatgtcagcgtggtgccgttttgtacgctccaaacacattcgtgatgtctgaatttttgaatggtgaatgtgttgtcacttagcatcttgtgttcttggcagagcgaataggtcagtgtccgtgttcagtttcagacgagcagattggtagattttgagttttagacggacagattagccggctttaaacagggtcgtcctcacgtttatattcagagtcctgactagataaacgaggcctgaaagtctgaaacacatgcgacgtagctttcgttgctttggtcaagcacaaagccatggtttgatggtttccatcgtcaagatcgattgttacccactagcatgtccagtagtaccactatgatttgaactgctgacagcttgctcattttcgtagcaaatgtcttgtttttctttctaatttcaaggtatagctagacgggcgtcttctgaataaatacagactacagaaaagcttgcgcctgagaattttactcctatacaagttcagagccgacaaattaatccgagctaatagtatactatagatataagtacttatataggactatgctagacgtttttattgtaaccttggggaagtagatggaaataaaatattctatccgttttgaaatgtttgacactgttaaccttttacactttttagcatttgtttgaccgttcgttttatttaaattttttgtgaaatatataaaattatatgcctatataaaaatatattcaacaatgaatcaaatgataggaaaagaattaataattacttaaattttttaaataagatgaacggagggagtactaagttagcttttgtttgtttttgttttgtttggtcaagctgtaggttaactaggggctgcacagcaccaaggaaaaatgaggtggtagtggctgcgttaccattcaagacgaggcgatgggaaagagacgttgcattgcatactcgcagtcgcatgcacacgcacgactgactgccgccccgcactgtggtctggcctggttgactcgccgaacaaaattacaaaaaaacctgaaagaaatcaaagcagaaaccgcggatgcgtccgtttggcggaagcgatgatgccgatacgatgcgattgcaacgccaccaacacggcaacggcgataggaaaggcaccgcagcagcagctgcagcctgcagcgcgacgcgtcgtgtgcgttgcgttgccagtgccagtgccaccggggcacgcgtaccaaaccgtgcagttatggcggttatcatgtaagataatgtttctgaaaccaccatatatatcatgatagtcgtcaaactacaaggttgaatgtggccctaactttagacacatgcatggagcattaaacatggacggaaaaaaattacatagtttgcatgtaaattgcgagacgaatcttttgatcataattacgttatgatttgacaatgtggtgattaattaagtttaatagattcatctcgtagtttacaggcggaatctataatttgttttgttattagtctacgtttaatatttcaaatatgtgtttgtactaatttttttttatcaaaatcaactaaacacggcctctattccaaatggtttggtaaacatggttctgcactcgcgtggcgtccaccgtccagcggcgtaggctgaacgcgaagggcacgaccgacagacagacacggcgccggatgccgatgcgcggcgtcgacggcgacggcggcgacgacacggccgcgtttcgtggacggcggggcgctcttcttttttttacctatggtctcgagctctgcatctgcacggagcactgtgctgtgctgtccgtacgatgttcttggcaggtctctctcctcctcgatcgaaatggcagcaggcctccgctccgctgatgttaaaatttgtggacacatctctcatgttttcacgcgaaaaaggttgcgagagacagtgcaatccaaccccatttattactgctttcttcttctgttcatcgggtattggagttactagcagtctagcactactctgcgttgcggatttaccggtagtaaaaaaaggacaagcatatgctttcccgaaagcaaagccacgctgatgcatagtaggaggaggaggagttacgccaatggcagtcaaaccaaacgtcgtcatctttctcatgctgataggagtacgagtgctccttttttttcttttgtttttcatttgtttatatcgatctagaagtataagctcagtgcatcgagcagtgctgcaagcagaaacctgagattaataaattagcaacaacagcagcagcagcgatgctccactccactccaacaacaaaaatgaacggcttagctaagctctattacgagtagctaattaaccccggttgttagtgcatctaccactaattgacctgttaccacttaccactaccctaccctatggcatgcattgcaattcgcaagcaccataattaagcatcatatcggggaaaggggtaaatgcaatagaaacggaagaattgagtatgaagtgcattgatgcgtaccatgcatgcacacgatgcatgatatgatttccctttgcaagtgtaacaagcaagcagcgaatcaatggcccggagaggtactatgacagtgaagaaaaggcaccaacatgcaacatgcctgcactgatgcacttcctagctcatcttggaattcgcatgcatccatgcatgttgcttgctaaatcagcaggaattaatacttcaaccactatggaggatcgatctatcggtcgtagcactgccgaaaggagctacatgagaatagaccttttttttttttttttgacacagctcgcttcagctgcatcttttttaaagctgaagctcagacaaacagttttagactctgtttagatgagactaaaactttgaagtccctatcacatcggatgtttggacactaattagaaatattaaacgtagactattaataaaacccatccataatcttagactaattcgcgagacaaatatattaagtctaattaatccatgattaacctatgtgatgctacagtaaacattctctaattatagattaattaggcttaaaaaatttgtctcgcaaattagatttcgtttatgtaattagtttggtatgtagtatatatttaatactctaaattagtgtctaaatacagatactaaagttaagtctctggatctaaacaccaccttaccttcacctaaaatatagtagcggaactaggtgaagctcttacaaaataaattacagatgtggagcagagtttaggctgctaaatttaggagttgaaactctacttaaatagaccctaaccctagttaggagtaatttaattacttactaacacacgatgcgtaatcgctagggaggtcggcaggcaacagcagctgtggcatatgcatgaaaggtgcttgccaattgccatgcgtaatgggatgcaatggatggatggaccctcacgccgacggtggccgacgtgtgtgttatcgatccacatcgtgatcgtgatcccaagtcttcaacagccggcgtacgtccgtacgagttgcctgcgctacatgaaatgcaggttcaggtagctaatcaaacttcttcactgcaaaagaaaaaatgaattaccccctccctccgttcaaaaaaaatctaatcctagttacgaacctaaacatatactccctatgttcttaaaaaaaaccaattcctgactataaatctggatgaggaattgattctttttgggatggagggagtacatatctagacttgtagttagggtttatctttttttttttacagtctagtacttcctaactcgatccctctccaaatgttcacgtgcatgcatatagtctgaattgtatatatttagaacatgttctttttaagctattttactagattattgaaacatattatttgcggatcatgacctagaaaaagctagtaatatgaagttgttgctttttgtctttgagcaattatcgggtcttaagataaatttccataaaattgaattatattgctttggtgaagcgaaagattttgaaaacgaatacatggaactctttggttgttccactggtcaatttccatttcggtatctgggtatccctattcattacaggagattaagaaatgccgattggaaggaggttgtagaacgctttgaaaagcgtctaatcagttggaaaggaaaactcctatctaccggaggacggctaacattgattaattcggtgctaagtagcctcccgttgtatatgatgtccttctttgccataccaagagggatacttacaaagcttgactactttcgctccaggttttaatggcaaagtgatggtcaaaaaaaagtatcgtcttgctaaatggaacatactgtgccgccccaaggaacaagggggattaggaattcatgatttggaaattaagaatatggctctacttagtaagtggttattcaagttgctctccacggaaggggtttagcaacagttgatgcgtaataagtatctcggtgataaacctcttcctcaagctcaatggaaggcaggggactcacacttttggtctagcctcatgaaggtgaaatgggactttctccgttttggatcctttataattaaagatggctcccaaattaggttttgggaagacaaatggttgggcaattcaaccttgaaagaacattatccttgcctttacaacatagttaggcataagcacgctacagttgcacaagtcttcgaaaacaatcctccatctttttcatggcgaagagaccttataggatcaaaactagcagcgtggaataatttattaccgcgcatcactggttttcatttaactcaggagcaagatgagtttcattggaacttaacctcaaatggggagttctcggtgaagtctcattatctagctctaattcacagcaatgttcccaacattaataaccgtctttggaaattaaagatacccctaaaagttaagatttttctttggtacttgcgccgtggagtggtgttaacgaaggacaatttgataaaaaggaaatggcaaggcaataagaactgttgtttttgttgcaatgacgagacaattagacatcttttcttcgaatgccattttgccctttctgtttggtccatcatctaaacaacatctggacttcctccaccatattgtgtagcgcatatgtttgggagctggcttgatggaattcataataatttgaaatcacatgttctgttaggagcagctgctacttgttggtcgctttggctatgcaagaataatgtgatttttgataaaaaaaagtcatatcttcaatttgcaggttttatattctcttatccattggcttcgtacatgggctatcctacagaagcttggttcgcgggatatggtagttgtggcatgtcaacattcggagaaggtggtcaaggagttttttacccagagatatgggtggtgatctagtcttagaattggtggtccttaaaactctgtgcttttggaggagatgaccaaggagttgttcatgagtggcaatttagtcgttagattgatggtcctcaatactccatgtcattcttttttcctttcgagtgtggttttgtttgttcagctgtgtgcatcttagttatgtagaggccggaagtgtgctcaggataattgtatcaccttgatgtaattgactgagttcaataaaagctttcattatcttaaaaaaaaatatttgctttatgttttaagaaacatgtttctcttttagctatgcactcaacttaggggtttaattgaaaagttgatgggtctccacgctatggatcaaatagagacatgtaccatgaatattatagtagttagaaattcaacaattatcatattataaaacctagcaattcgctcaagattatgataaaattcggaaatggtggatatagcaataaaatcattttcatgctcacattattttcactatttttctttatttttgtcggttactattttcacactgggtcggtaaaagttagaaacgaaacgttgggtcagggattttccgtgaccacattctcctccataatgcacggggccagcctcgttttgttttctggccctctttacatttcaacttttttttaacttttaactttttcgtcctattgaacttttttagggcatcatcaatgtatatagggcaagtaatttatatagatgggacccacataaatagactttaactatagcaatctctacaatgtatatagatacaaagtagcattaggagatgagagagagatagagatagatagtattatttattccatatgggtagtccataagcttatggatacctttttattattttctcaatatggactagttgcacaatggtaataggtagctgaatgaaatataatattgcttatggactacttttatttcacattgtggatgcccttatatacataaacttccaactttttcgttacatcgttttcatattgttttggttacatagttttaatttctttaaacttttaattttggcgtggaactagacagttgcgttgttttcttttctgttgcgttgcatctccagtgatctgtgcgtctgtgtgggggcaacgtgatgttactactgttgctgtaagagtgcaggagtggaagctgtcgagtcatcgagatacgcgaaaagaaaggaggaaagctagcaatagcatagcagctcggtccacgaccacaaggcaaactgcaaagcaagcaaccaggcaggcaggaaaaccaaaaccaaaaccgaaagggattggatttcattcactgatgattcctttttccccttgcaggattcgattcgatcatctcactgcagttgcttgctgctgcattgcgcttgcaggcagcacaaacacactagcaacactagcaggagtacacgatacgctgatacgctccgtctaataaacatctgatttgatgactctctactcgtgatccacggcaaaactattgacagctgaaagagacttctcctgctgccgttgcttgcttttcatgagtattacacaatgccgttgtcactactacctgtacttgacagcagctatatactgtaggttgctccatcgatctgtgctgacaacatggattggttccactagctaccaatggttggtctttagaggtttttttaaaataatgaaagctttattaagacttagttaaatacatcaagataatacattccaactgagtccacccccggcctctacatagaatgcacacagccaaaaaactggacctaagaacacttcctcatcacaaaacacagaaactagtggctatcaatccgtagactagatcgccacccatgctcctgggtaaaaaactcctatgccacctggtccaaacgttacgataccacctgatctttagaggtttggcggatcaaacgacgatggatgcagtaacatgaaagaagaaatgcgtgttttgttactagtagtgcaataataacaagaaaaatatatactatatgggtaaaaagaagagcactgcgtgggtgagtgcgtgaggtttatagtgctcgtgatctgaatatctgatccgatgctgctagctgctgctggtcgattgcaactataacgaccatttgaggtggggcggctcagctcagctcgctgctgcgccagaatttacgctactcctcctactacctgctctctatatacaacctacgagtatgactatgactcacccatccactctaccgatcgatgcatctatgcgaagattgaacagccacagtgctcgccaccatcgacgctgatatcgattccatgcatcttcccgtccaaagattgaacaaccacaccgcatctatgcgatgctagtacagtactacgcagagatttggttcttaactatcattgccacaattcacttcagacattgtagtttacatattgtaagctatacttgtagctaaaaagctaggcaaatgatcgtgtatatgacatgtgggacaaggtactaagaaagtatcgtaatcacaactataacaatcaatctaacacaaggttaagaattagtgatactccaatgtgtattgtgataagttaaagcattgaaccaaacgctctccgcatgcaccaaagcaacactagtacattgaaatgaaagaaagagtgtactgctggtgacgcagagctgccgacgagatctgaagctctgaattgatatctctctgaatctctggaaattggtgatcactgctcaccgtcctacaccgagtcatcatcgcccattatctctcattcgcagcaacaagaactgaacgaaacgagggcaaaaaagaaagataaaattcatgagcccgatgtcgcagtcgcgtttccttttcagacctcggagctagcacggcgcgccacaaagcttcgctttaaggcaaaatgattcattgattaattcccagtttctcaccacaaatctggttgcatcttcccttcctctccttccgcttgaaatcttccttccttctttttctgaagtgacaccaaaattcgtttttaagagtagtttctttcatgacaatacaactttcagtacaaggatctaatttatgatcctgcttttacaagaaatatactcccatatgttaggacaggtccacttcaagcaagagcactcggttcggatccagcaggtgccacagcttattccagcatttcaatttctaaggaatggaacgatggattaatgcgcaagctcaccgtcactgaacttctgaacggtgttttttattaaaaaaaagttgtgtatatgaattccttagaatattgttttaactccatttgtaactttgaacaattatcacaaatttttcagccattcatccattcggcaaaaaaagggggggggggtttagatttataaccaccccatatgtttgtcaatagaatgcttatttggttttactactactcatactttacaggagaaggggaacaaaatgagaaatcaaagatagcagctactacctccgtcccatgaaaaatcaatttagtattgaatgggacgtttcctaatacaattaatctgaattcaaggttgagcgggagtacagcaaaaatgtgaccaggtgatagccaatccaaccgcaagcaaagcagccagctgacagacgcagaacaggctctcgtgaagcatcagaaaagggttgagatgtcaccgatctccagaaatttaagaagcaaccataaactgttcttgagcgacaaataaggctttcgccttaggattataaaatggacatgcatgcatgtgctttcaagaaaatgctgctagtactagcactgttccttccacaagctaccatcacaggcaggcaggccactaattagattcagcagttgcgtgaaagattatctgtcccagaatccagacctcacaaccacaaggatgacaacaactggcaccactaattcccaagcatcttggcaacatcacaatcaaattggagtatacaataaatggatggtgaactgtaagaaattagccccctttttaggtcatctgttactacaagtcttggcagatatattacttacacgaaaagcacacacagaggattctgatttttactgtactatagctaattataagccgtaatgcttattaacgacaaaacatatttgtgagtagaacttttgtgtgtgtgtttttagcgacttgaaaaccaacactgcaagataaaactatataaaagaaatcaaaatcaactcaaatgtgaaatcatcaaattcaaattttgttgctgtcaatgaagaacagcaagtgtactgttccatccaagcatagtcaaacattagcagttgtggaacgttctctctcctgtgtagatcgcactcgtacgtgcatctgatcaaataatattggctgtcatgctcatcaagcgcgcacacacactactgttgttccaacagttgtttgcatgattcatttgcaattatctttcaaactagctagcctgcctgctcaacaattattgatcatcacactggacacaatgctcaatgcatgtcaaagatcaaaggttagcaaactgtactccttgtcgatggaggatggccatcaagaggtgaaatgcatcatcactaaataaaagcattggtagtactcttagtagatgatggccttgatgaatgatgattatggtgacaggtgtttggagggccttaataccagcactgagtgactacatgttcatatctctgaatgtgagcctcacaaagtcacaagggagggaggagggatcaagatctagctagaggccggcccacaaacaaaattgaggtttataaagcattaaaggggaggaaaccatgggtgttggggaatcaaagtgagactttgacatatatatgcatcatgggtgaatgaatgagaaatccgagatctaaagccaccaggagtgctcaccaaagttgagctcaacctttcatcagaataattctcattctttttttattgtggagttatcagttaccactagtatgttttcaggagtcttgatctttgtggtgatacactcatgcaaagtagtgcacaaacaccagaatcaacaaaggtaggtagctagctagcttgcacaagcacaattttgagggcaaggcagcggctgtttttttcatgaaagggagtggacttgaagcaaatcagatgcaaggacaaaatctttattagtgacgctaggcactgctattcaccattgctttactggcaattcaagtcgtaactgaaatattctgattccccttgtaatttgttggttataagaatgttatcgtttcgagatggcgaaacacggtccaatctgaattcatagatatgtattttgatccctgcgaaccagatttatataattttccgaagaagggtgtgtcttgttctgttagcatgtggtctgaaatctgaatctgaatgtgatcggtaaatttgtgcaaacaacacaaatgcatcatacttggtcaaattgcatcatcaggataatatggtgtcgtaaaaaaaacaattagaaatgctctgcattttggttaccttcttgtctctttgaagaaaagtgagaaaagatagaaattaggggatcggagaattaaactccgaactttcctacatgcaaataacttttgatcccaatctcctattatcccatccatggagtagaagtagtaacacagatgctacacgagaaatgttctgatgagaccttcgtcgttcacgtaggctggccctccgccgtcaacctcggtactgttactgttagagttgtgctgggctgctgactagtactacttttatggcccagtaagcttttagctgagagcgaaataaataggaataagttcatctgaggtcccttaacttatctacgaatccgattttcgtccttcaaccggaaaactagatacaataggttcctcaactctcaaaaccagtgcagatgaggtccctcggtggtttntnnnncntnncccacccggccaaaagcttctaaagctaaagaattaacttttctaggtagaaaacaacggttctgtactttatttggcgagctgcccatgaaccaccggcttttgcatattttctaccgtgttcccaagctgaactagggatttcgggacgcctaacagtgcatgttggggaaaattggattcaaagggcataaacaacttttctgaccccctcgtcctgcgatcttagcggtctaagtccattaattcccgttattctgttgggttcactggagggtacggtctgtctgctgcttgggtcatgttataattttccttactcttttgccttacatctccttttcccatctttttcctactttaagatgtcctatcggtcattgttcttctctgggtgccattttcattatctcatatttacactttatttgggtttagtcaatattctatttctaatccccttctctgttcatcttttttattcattcggataccaactctaccc

SEQ ID NO: 66339 - DNA, 26645 bp, Oryza sativa
taccccaccccctccccactttcccccactccatttccctcctcctcccctcttccctctcaaccgcgccgccgctctcgtgccactgcgccgccgccctcgtgccgccgcgctgccgccctggtgccgccgcaccgcgccgtgtgccgtgccgagcgtcgcctcgccttgcgccgctgtcgccgccgccgccgtcggtaagccgccgccccttccctcgttccgccgccgtcgccgccccgggtaacttgagtcgagagagagaggaagggagaagccgggagggagaaggaaaaagaaaagaaagaaagaggaaagaaaaagagaaggaaaaggaagaaaagaaaagagaaaagaaaaaaaagaagagagagagaaaggaaaagaaaagagagagagaggaaggagaagagagggtagagtgggccccacctgtcagtcactatagctgtggataaggttgtattataaataaatgaattagggacagtaccatttcgcaattattagaattaattcaaatttgaatctttacgctagcataacttattcatttcagctccgatttgagtgaaacttgaacctaaattcatctaatttcataagctttccaatgatatataattcactattggataaaatatatttataaaaattaaataattaatatcaagatgatgcataatagtcaacttaaaaatatgctaataaataaaattagtattgtacagcagaataattatctttaatatgttctgtcactgtagcaaccacataaattaagtataatcgatgtttgaagttaatggatatataggaaaatattagtgccatttattaatctatgtccaaatataattaaaacccacgacttattagttatttaaatagagttagccttataattattaggtaagtaaaatatagatacacatagatcggtcctaagcttgtttatggcaaataataacagagctagtgtgattaaatcacctatatgaaattaatcaacgacatatcccatataatagcatatagtgggagaggtgagcaacccttagttaaccaagcagtaaatagaaattattcaaataaatgattcaatatactaagatattgtgcacacatatattgtacatcccattatagatatatggtatcgtattaatttgcttgttgcgtatattaatttagagggagtatatgacaaacatgaatattagataaatactagttatacatcttgtcctcgtataattacagatcaactgtaaatttggattattcattgtaaaattatgtgatgggataatccgtaaccataatatgattaacctaaacaattctaacatacaaagcatgggtaattgttaaccttttataatttattttgacaagtgaaatatgtacataattaaaataaagcctccattaataaaataataatacaaatgattcacagtaattatttgaccgatccaaaatccatccggcaacagaacctctagtgtataaccgtgctatgtagataaatgcatgcctagccataatccttccatagccatttgatagactaaaccaccgattagccaaatatatatgtatcctataaatgctatgttggttaactcctaaataggccacgttgacaatagaaagattaagaaaccttagcccctagcgagattggaatccattagcagacatgagtagtatattttgttgtgcatatttggttgttatttgaatattggtttttcttgcgtattatagaatttatgtatcggttagtcgtgaggcaacgtcaacaacttccaggaggtgaaggttaatcaagaattacatcaagaataaggactatcctgagcaaggcaagtcatcactattctttgaacatgttgatcccaattgcgaaattgttttgtttacaaataaaattgcatgcaattatgaacatcctacttgtgattataccatgccttgattattgttcacctttaaatctttgtaaccatagatacgtacgagtctctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctggaggacttgggtggtgtccggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtggggcagccattggtaggaccgcgaggcgggtgtctacagtggtgtcgccatcggtaggactgccatgtgagaatctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgaattttatgctgatggagccacatcccgagaggagggaaggtggacatcctcagaaaaccatgacgattcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaatacccgctatcatatgcattgttgttgtggtggcttgctgagtacggttagtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctgttgttctctgatagttgttggcctacctggccctaatgtaagtatttaactcttttagcctaaattcattcgtgatatgttgtgatccaactatgtatgtgtgtaccaactactgatccagggattggtacggataaacacagaagatttccgatttccaaaatcgggggtctacactagtgtatcctgggactggtactatatcacaggtaatgcataacaccctggtgtgatttagctgtgttaaaggctaatgaatgtcggggcgttacagcaacggataggccgtagagaagtatattggcagcttttaacatgacttctaaaaataaaaaaaatgaaacccaatgagataataaactcaaaaactataagatccaatttttaaaggttacaaggagaatgaacataagccatggtagatcgagaaaacaaataaagaaagggtgaaaaaaaaagtaaagggtagcaattgatgtgacttttataaaagttataaaattagaaacatgggatgatatggtttggtctttcaaaatcttaagacaatgagatatctattgaataaattataagtaaaatcatattaaaaatagataattttgtatgggtgctaaccgcgcaattgcacgggccacccagctagttttttataaatatcccgatcctctgcgtcggcctccctttgccccatagctgatctttaggatttttgccgtagctgatccttgcacacgcatgaaggtatttaattcattttctcggtaggcattaccatggacaatatgcattggagaagattacgtctaaatgggtatttgttgccctctctcttctctatacactacctatggatattctgggttgggactgtctaaaacaaattagtagtaaggagaaattacgtactgtagtgcaccttagtaatactcttgattgtattttctaggctccaaataaatacgtatgtcttaactccgttgaccataagatgaaacaaaaattttgtgggccaaattttgaacgatatttttttgtggaaacaagtggaccaagacttaactctgttcacgccttcacgggactgttaatttggagttttggactaagaaatatccacatgtttggactctgcggttgccctcggacagaagagacatcaacagttcaattcattagaaagtgatccatttttctcctaacatcagaaaggcgattcaacgcaccccggaagttcagtcgacgtatgcatgcgggcatatgccggcacagcctgtggaaaattgcacacgagctagagaacaaccctcgaccgacatcattcgcatttcgtgcattataataatatattttttcgaacgactcgcacgagacggtgcgaagttctattgatagagcaggaaaaaattacaagattataaccctggagggtcataaccagtaaaaggaaaaagaaaaaatataccaccccccacacaccgacagtgccaacacacacgaccaggaggaggctagcaccggaccggccgccgctaaaccaacaaaggaacacagacgagatcgccctacagctagggggtgccaaaacgacgtcttcaagaagagaagcgacggaaaaaccgccgccgccgtccatccgggctcaaaggagccaggactgggctttcgcccggcaaccacccttgaggggtgagacagcacgacaacgccctcaggagggggaattaaccatcgttgtcggcccggcatggccggactgggttttcacccgccgcacaccacctgcgaatccacggctaacgcaccgatgctccaccaccacacaacctctaccgacatgtgggacccccgcaccggcgccccccgccggccagccttcgagcgccgaaaatcgtgccacgcccaccggcatctcctcctcgcaccagggtcgcctcttcctctgccggccgcgcatctcgcgccgaaccggcctcctccaccggacgcgcctctcgcgccaatccggcctccctccctcggccgcgcctctcgcgccaagccggcctccatctccgccgcccgcgcctctcgcgccgagccggcctccgctgccatcggctgcgcctctctgcgccaaaccgatctccgacccctcctccgtactctcccgcgccggctagatgcagccgtcggccacgtcctcggctagccgaccgaggccaccatgccacctcccaccaccaccagggccgctgctgccgacggccacctcgccgccagccagccgcagccccatcgacgtcgtccagccgctaccgcaaccgtcgccacgagttccgcgtcgctgcctccgtcgcgagagccccaatgccacagcagccaacaaccgccaatgccgtcgaccagccaccgtgctgtcgccgccgacaagccgctgctgccaccatcgccatggaatccgcgccgtttccaccgccgccgtcgccccgtggtcccgtgctgttgccgccgccgacgtcgcccgcgagctccgcggtgccgccaccgccacgagcttgccccgcgtcgccatcctcgccggcctccgggcactcacacgcgcccgaccgcgtcgcccgcgacctcagctgcaccgccaccgcctcttccccgccgccagcatgcctgcttccccgccgcccgccgtcgcccggcgtcagccccgccagatccggccaaaacggcgcggatttgggcgggggtttccgccgccgccggcccggtacgccgccaccacgcaccgccagtcgccaccgccaccactccgccccgccaccaagcgccaccccgccggatccggccgggcgggtgcggatccggacggtttgccaccgtcgccgcccggacagctccccgggccgccgagcgcgcgctgaggcgaagccccgccgccaccatccccgcggccgcgcggctttgccagcgcccgctcaggcggcggcgaggcagagaaggaggggggaggaggaagacgacggcggcggcgtcgcctctcgtgtcgcccgtggggagggcgacgcgagagctggtcgtgaccaggaaacctccattataataatataaagcggtaaattgaacaataccatgagttacgacaccatcgtatatgtatgagccttccgaacattatagaatggaataaatactagaatcctataacaccaagcatataaacactaccattaccgtttcatcggttgccaatattctctaataaatctttttaacttgttattagaaaataaaaataaatttagaggtaaaacttttatatatgattttaatgacttaaaagtcaatactgagaaataaactacgttgaaaatatcttcaaatcaattttaaaatttgttttagattattagagcaaccagtggctcttaatcctcatttatgagaaacaagaatggctgtagagagcacggctagcattccaagtcgcatgggggacgatgggaagttggtcatgggacccctgccggcttaggccccaggccgtcacacagcccgcctagattcagagccaacccttgtagtttatataaataaatccaattttgctatatatttatcgataaattttctcctaaaaatttaacggatgtaattacagtacaatcgtagtgtaattacactataacttgcatgtaattacactgtaactataaatataacttgtatgtaactttcaaaaatatctccgtaaaatgttattttcggtacaatggaggtcgtgggaacaaatcctttcacatatgtgtgtgctgtgatttttttctcttccttaccaaaacaaatcttgtaatagatctaacgattcaaaattacgttaaacttacatacaagttatattgtatttacatgcaagttacagtgtaattactctacgattgtactataattacatccgtcaaatttttaggagaaaatttgtcgacaaatgtataggtggtcccaaataaatccgttagttgtaactccgtgtaatttgtagcaaatacacagtaccagggtagaattgccttgtcgtgcaaatccggcccaaaatgcagcttgggtctagctctacattccctttcgcgatttcagacgtacgtgccaagtgtccaagtggacgatcgaaaaccctgcatatgttcaagcgactcttaaagtttggactaagataagaaattccctagaccacgaccacatatatactctctttaattgctggcactctcggacaaatgagacactatcaatagtttaataattcagcaagtggttcgtttttttttctctcataacatcagaaacgggtattcaacgcatccgagaattacagtctatgtgccggccctgccgattgcgccaaattgttcacgagcgagaaactcgatcgagacttcatgcgcattttgtgcataattaatccgaactaaacgcgtcacacttaattaattagctttgttttttttttcctaatttgctagttgagtagttgacccccctcaaaaaaacaactaaacaaatttctagcagttggcattggccaacgccttcatccaagctttgtgccattttttaaagagcttatcatacatatgtcatcccagtttgatatagatgatgcttgttgaaactcagtttgtgtaacaattatacacaaacgaataattaaatattagaaagctcaaaagtccatgtgctgccaatgttcggatggtggtttcggattggctaacagagcatggcggcagggttgcagagggttccaagcgaaaacttagcccaatgatttattgggtcaactacgcttttgggcgtggtaatcatcctgaggacgctgttgggatacccctcctccaacagtaaggagctctgagtgaaaacctgtctagttctttggacggatgacaacggcgtctttcggcaccacaaccttcgtgagggcgtcgttttttagagtctccgcttcgtggtggtgttgtaaacccggtggtgaccggtctctcgtagcgacggtcggcttggtgctccgcttccctctctgtaacatgtgtctgtgcggttggcacatggttcggggcgtgtgctctagttcatattctttctcgacagtcagttgtcgatgaaaaatttttttgcaacatttttttcatctatcttaataacatttggataaccttctttggtcatcccggtaagaaaaaaaggaaaagctcaaaagtaaattaaaaaacttttataaggaatgccaatgaaaaaaaaaaggacatcgctccaacttgcaatgtcttttctaaattactgtttagtcgatgactcgatgtaatacattgtattcgcattgttatttttattttatcaccctgcttagagtttcgcccggagccatgaaattttctgggatggccttgatataattatcctcttccgcagaccatgtaagaggaaaacagaaccttcgcggacgaacagtttgatctctttttttattactcgacataaattccctgtatgaacagcaatttattttgcatggcattggtgatcgtactgtctgtgcgagtagttaaaaaaaaagtgatcgtactgtcacgacgagtcgacgaacgaagaccagcaacaaccgagatcagaattgaagctagcaaatgcacgcgtccacacaaaaccttgcgaaaaacgatccacgaccctcacaagaaatcttgacctcagctcactaattaactaacacagggagtacgaaaacaaaaataaaacgtagagaggtgcttactcctaatcatcatcaaacgaagcatcgtttcctgtggcacacgcctcacggcgtatgtccaagtcatcaataattagacttttcaacacatgactgcattggctgcttgatatcgccttatatgcgctcataatttctttgccctatgtagtacaagtgtacaaccaattgccaaactgctatagttgaaacgatggctggattggtcatcggctacctggccgtgcagctctcgctgatgtctctgctgctctgcccgtcctcgtcgacggcgcagcacacgctgggcagatcctccatgtcggtggaagaccacgcgcggccgttcctggtgtcgacggacggcagcttctcctgcggcttcctcgaggccggcgacaacgccttcaccttctccgtctggttcaccgccgacccgaacaggaccgccgtctggtcggccaaccgcgacgcccccgtgaacggcaggggctccagggtctcgttcagccgcgacggcgagctggccctcgccgacaccaacgggaccacggtgtggtcgagcaaaacgacggctggcaccgggaacagaaggggcctgaccgtctccctccgcgacaccgggaacctcgtcgtcggggacccgtcgaccggcctcgccgtgtggcagagcttcgagtggccgacggacacgctgctcccgtcgcagcggttcaccaagcagaccaagctcgtcgccggctacttcagcctctacttcgacaacgacaacgtgctgcgcatgctctacgacggcccggagatcgccagcatctactggccgctgccggggttgaccgtgttcgaaaacggccggacgaactacaacagcacgaggatcgccatcctcgacgacgccggcgtgttcctgtcctccgaccagacgaaagccgaggccaccgatctgggcctcggcatcaagaggcggataaccatcgaacaggacggcaacctgagaatgtacagcctgaacgcgtccaccggaggctgggcggtgacatggtcggcgctcaagcagccatgccaagctcacgggctgtgcggcaaaaacggcctctgcgagtacctgccgagtctccggtgctcgtgcctacctgggtacgagatggtcgaccgccgggactggaggagaggctgcaagccgacgttcccagtcggcaactgcagccagggatcggcgccgccgccgtcgccggcgacggcgccgccgcagttcaagttcatcgaggtggcccagactgattttttcggcttcgacctggggtacaccgagtccatcacgttcaagcagtgcagggaccagtgcatgaacaactgccagtgcaccgccttctcgtacaggctcgacggccggggaaaatgctacccgaaaggcacgctgttcaacggcttcacgtcggcgaatttccccgggagcatctacctcaaggtgcccctcgacttcaacgcctcgtcgccgcgggtctccgcgcagcgcgccgccggcctcgcctgcggtgccaacgtcaccgtcgtgaccgtgtccgctgacgtgtacgggatggcgccaggaagcaacgggcagtggacctacttcttcgtcttcgccggcgtgctcggagtcctggacatcctcttcatcgcgacgggctggtggttcctctccagcaagcagagcatccccagctcgctgcaggcagggtacaagatggtgatgacgagccagttcaggcggttcacgtaccgggagctcaagggcgcgacggccaacttcaaggaggagctcggccgcggcggctccggcgcggtgtaccgcggcgtgctcgacggcggtaaggtggtggcggtgaagaggctggcggtcgacgtgacgatgcagggggacgaggagttctggtcggagatgacggtgctcgggcggatcaaccacatcaatcttgtcaggatctggggattctgctccgagcgcaagcacaagctgctggtgtacgagtacgtggagaaccagtcgctggaccggcacctgttcgacgcgtccgacggcagcggcggcaaggcgacgacgctggcgtggagcgatcggtacaagatcgcgctgggcacggcgaggggcctcgcctacctccaccacgagtgcctcgagtgggtcatccactgcgacgtgaagccggagaacatcctcttgacgcgagagtttgaagccaagatcgccgacttcgggctggcgaagctgtccaagcgggacggcggcgccggcgtggagctcacccacatgagagggacgtcggggtacatggcgccggagtgggcgctgaacctgccgatcaatgctaaggtggacgtgtacagcttcggcattgtgctactggagatggtggtaggaagcagggtcgcggaccagaggacggaggccggcgagccgctgcagctgccgcagatcacgcaggcgctgaggcatgtggtggacagcggcgatgtgatgtccctagtggatgccaggctgcaggggcagttcaaccctcggcaggccatggaaatggtgaggatttctctggcgtgtatggaggagaggagctgcaggccgaccatggacgacattgccaagtctctcaccgcgttcgacgacgaggacgaacaccctgcctaccactcttgatcagtactcatgaccaccaggcaaatggcacgctggattaactatagaagtacatccgtacttagttcagagttcagagttcagaatttctttttaagctcctcagagcatactaattttgtatgaagtttttgaaaagaaaaacttcattttatctctcaactcaaataaaagatagaactgcgccaaatctttttaatgctagacaaattagttctcttagtacaatgctacaatccaatatatgttattttcttgaaacaggaatccaatatatggttttggttaaattgccacatgttttgcctctctttgcctagggctgaaactccatccgttctcaaatataagggacataagcatttaaaatttatttcaaaatataaaatatttatgtacaatttgtccaatcaatcatcttaccattcaaattttcttttcactttccgaataacattttcactcaccatataatggggggtgttatagtctttatctttattattaatttatacaagaaaacctataattccttgtacgtatttaggaactgagggaatatctatctttccctcgttggtagagccaaggaagtcaagtcacagctacaatggccgatcattgagctcaatattgtggtgactacggtcatagcatattggaattttctccagggaattctattggacatggatcctctctgcagtacaacacatgcattagcagatccgatctcatatgtcagtagtagctattagaggtgtaatactacagacaattcgtactgaaatatatttgtctcgagaggacatttatttgttttgtgcaagtcgcgtaaaaagtcataaaaaataagatagatcaatatgtggcacaaacatacaaatcaaatttaacctatataagcataaaaaaaaacaaatttgaatgtgaatagtgtagttgattatttgctccatgcctctaaaaatactccccattggtacataagtataattttagctagtcgaagacatattaagtaaagaattaaaatattactatgcccttcattattatgcaaagaaaacatggatggggagtaaactagaaggatgagatatttatattggttcaatggctaaaaaggagaagtaaaagatgaagtagtattagaaagttctagtggaccactcaaaaactaaaattatttacagacaaatcttttaattaaaactacacttatttaaggatggcaggggtattttctgtatattgtttagatcacttattttgtgttgtttgttcagtttttaaaatttttaaatcatctctatatataacgaagtagataattcattaaaaaaaatgtagggccttggagcacaggaaacatctagaacaatgacgggtggttttcggtaaggaatatggataatagttggataatagccaaacagtgccatcatcgtgtgtagggagaaaaagaaacaaaggaataaaatggcaaggaatgacgtgcgggatgatctttctttccttgtttttttttttactattttgctactatctctgttttaatatgtaactagcatggtggcccgtgcagattgtacggttagcatcattatattttctcttatataatagcatatatgttttctcattatattattcaaatatattaaaatgacaacataattttaaattttgcaataactttacaaaactactaatgtgtaatatttatattatattttatatacgtgttagttattaattatttttaatatcaaattttagttatttgtaaattatatatattcctatatggactctagactcatctttaatatttttttaattctgaattttctgaaaattgtatttctatatagagtactctatgctcttcttccaatattatttattttatatctgaatttttattatttctaattgtatttctatgtcgactctaaattcatctttcaatattctttaatttttcatttcaaattttgaatttcagttacttcgtaagttgtatttctatatagactctatgctcttcttccaatattatttatttttctttctaaatttttattatttctaattgtatttctggactctaaactcatctttcaatattctttaatttttaatttcgaatttcgaatttcatttacttcgtaaattgtatttctatatagactctatgctcttcttccaatattatttatttttctttctaaatttttattatttctaattgtatttctggactctaaactcatctttcaatattctttaatttttaatttcgaatttcagttacttctaaattgtattcctatattgactttgaactcttcttcccatgtttttcttaatttcgaattttagttatttgtaaattgtatttttatacggactataaactctacttttaattttattatgtttattccaaattttagttagttttaaatttctatatagactctacactctacttataatattccttactttttaattccgaatttctattttttttcttaattgtttttatatatggactctatactctacttctaatatttcttatttttaattccgaatttcagttattttctaattgtatttctatatgaactctatactctacttctaatattccttatttttaattccgaatttcagttatttcttaattgtatttctatatggactctagtctcctattctaatattccttattttttaattccgaattttaactatttctaaattgtatttctatatggactctagtctcctcttctaatattccttattttttaattccgaatttcagctatttctaaattgtatttctatatggactctgttttttctttttctccgattaatgtgagaatttctaggccatgagagcaaacgtggaggctcctttttatattcctttaataatataataactagctgggtggcctgcgcaattgcgcggctagcaccgatataaaattatctaatttttaatatagttttacttaaaattttgttaaatagatatctcgttgtcttaagactttgaaaaaccaaaccttatcatccctgtgtttctaattttatttttttaaaagttatgtcagttgctactcctaaattctttgtcacctgtcatttatttgctttctcgatctaccactacgtctatttgtgtcgagggaagaccccctgatcgcgggtcgcgtgacccccctttcgtgagttcggccgagggcagagactcgtctctccgaagtcgcgtgttcgtccctccgatccccgtttagatagcacacaattcgattacccaggttcaagccgctttggagcgtaataccctcctcctgcgtttgggattatcagtggatttttacaaggttctccttgctcctctccgctctccggtgggcaaggtcctccttttatagcttaaggggataccacatgcgccgcctctaccctccccctccatcggagggaggggagggggcccttctccctcttcccaccgggtttcaacctgtgccttttgctggaagctaagcatcggtcggtccttgagtggggcccagcgccgtctcccgcctgacacggggggcagccctgtcattccctcataaatgagtgaggacttgcggcagccctgcatcgaacgacgtccggatgtgacggggcgtacctaccgccactccgcggagacagaggcgacgtgggggcacgaccacccgttcaatcggccgtgaccggcaatagactggtcacagaccggtcgcatccgactgacaggggtcggtcgggcacgccgcacgtctgccctcgccgcattgaatgcggcgagggacggttggggcgctgcacatttatggccgcccagcctagactctcctctcacccttccccccgagggagggcctcgggctaaaacgacgggagagcccgagggggtgacgtcacccccgaggggatgtcgtcgacccccgaggctctccccatcaccttagtgactcacgaggtatgtgggtgggaccagctcgcagagccacgtggctggaaagggaagtagctctcctttactccacatacccccgggcccatatctccgacagtagcccccggcgccatgtcagacgcgggcttcctgggatcggtctgacatggtgcctcacgacctccctagctggggttgtgggcccggcggggagtttaaaggagtattgccgagcggccagattagcgggccagccatagcggcggttcggtcgcctctgatcgcgctaaagacgaggatgcttgggacgcgataatcgggggatcggttagaccacgcctcgattacctcgcccgctattcctacggcggttgtggtgacggttcactcagcttgcgcttatagccgttgcgcattccacctcgagtgcgccgctgataggcgcactaaaggtgggacgcggacacgacgggcgacgtggtgaacgggcgcgggaaacggagagacaactgcggacgtgggggcaattatgagggtgcgaaacgaggaggcgagcgcggatgagacaagaattaaaagggagtggaggcagggacctctcctccttcctttcgccaaccgccgactcgtcctctcgcctctcgaaccctaacactctcgccactccacgcagctttgcgcgccacgccttctgccactgcctcgccggccaccatggctcaagacaccggcgacacagtgctcccttctccccgcatctcggcagacagacaccttagcctcccccgcaaaatcatgccggacggcgccgtcgtgagggcgggggagtcacggccgcggccgcgatatccggagcggtccgtgcacctcttgtccttcgccatggcgggattgattccgcctttctcccgatttttccacgaggttctggatttctacgaaatccatgccttgcatctcgcgcccaacgccgtgatgacaatgagcatctttgcgcacctgtgcgagatgttcatcgaggtgcgaccgacgatgcggttgttccaggccttcttcgtcccgcagctgctacagggtgcggtggtggggggatgttacttccagccccgaccaggcacggcggggcagtacatcgagagccacctccgcaagaaatgggaggactggaagaaagactggttctacaccgcgctgccggatcacccacgacttcgagttcccgccggtcctcccgagagatccgccgcatggctgacggcttcggagctgggcgaggaatatgacgcggtgtgggatcgtctcaggggcctgcgaagcttgggcctcacaggagcaatggtcttcggcgactactttcgccgccgtatcgcccctctccaggaacgatcccgtggcgcgtgggagtataccggccccaacgaccccatgcgcaagcacgcgggcgagcgctgggactggggcgaggaggacgccaagatggtgattcggcgggtgctgggcctggactccgccgagcaaacactgatcccggatgggatcctccccctctgctgcgaccgcgaccgggagagcatcttggccgtgatgtcggtcgtcggcgccggcaggggccggcctggccgagggggcgccagcggtagcgccgccagcgccggtggtggcggcgcgtccgtgggcgggagccggccaagcggtccgggcggtggtggcgactcacgggcgcccggctcgggcccggagacgacccagcaagtgacccgaaggggaagcggaaggcggccaaatcttggccgccctctcccccgcgtggaaggggtgcagagcgcgcgacagaccttccaccggcgggtcacaagcgacctgccgggcccgaggccggtcggaagaagaaacggcttcggaaaatagggcaaacggagccgtgccgagggagcttcatcgagcccccgaagtggaccttcaaccatcctccccgcaggtacaaacgctggcgcccacttcggtgctcttacctagctcggcctcttgttccctccctttctttttcttttgttaacgcgatctgggttcccttgtagcgatattccttctcaggggacctcggggtcggacccctcgcggaggacgaaatccgcacaaccggagcggtccgggcctggccaatccaaggccacggggtcttcgcaacctcgcggtggggtccacaggacacgtaccgggcccgaggttgaggtcgaggctgggggcggtcctgagcccgaggccgaggccgaatccacccgaggactgggagcgggggacgaaaagaacagccgctcccccttgcgtttggggcaccctcggggctggcctcgcagaaggggggccgagagcaggccccgtctcgcggggggtccagcagcactccgtcgtcccgggggcgaaccgcgggcttttcttccccatccccggcgagcatggagccacttctgcaggtgctcgccgccgccgactccactgtccgggaggggctcaacacccaagttcaagccctggcggaagagcggacggccctggatgccgaatgggctcagcttgtggcggaccgcgcgcgagtcgacgaggggcaccgtgccgtggaggacatggtgagggtggggcgcaaaaaacaccaagcccacctagctaaaatccaggcgcgcgaggaggtgctggactccgtcatgcgggaggcggaggaggagcggcaggcggcgctgatcgcctcgagcgccctggacgaagcgctgggcgatattcgcctttagtacgaggcccatgccgaggacctggcggagagggtcaggaatgcgcgtggcaccctcgacgcagccgctgcccacgagcggcgagcagcggaggccgacacctcgttgcaggcccggactgcggcactcgaggctgaacgcaaggccttggacgatcgtgcccgctccgtgcaggagtttgaagccacgatccgtcggcggattgaggtccttgatcggagccagcgcgaacaaaacgcgcgcggccaggaacaggcgcagcgggcccaggagctggaggagcaagcacgcctgctggatcagcgggagtccaccttggccgcccatgagagaacggcggcggaaacggaggcctcccttcaccttcgtgaagaggccgcggctgagcacgaccggatcactctcgccgcggaagcttccgcgggccgccgcgcggaagagctacggctgcgggaggaggcgtgccgggaacgggacgccgcactcgccgagcgcgaagccgaggtaaaccgccgcgaggtagccttgcgccggctgggcgagcagcttgcgaagcgcgaggaggctgctgctgggcgcgaggcccggcatctggagagcgcttgcgctgagcgcgcggcgatagcggcgagggcttccgaactggaggcccgggagaagcacctggcagccggcgggccgcccggcggcgcggggttggcgagcgagctcgctaaggctcagagtacccttgccgacctggggcgcctggtgcaagatcaggctggggagatcgcggcccttcgcctcaccaacgaactcgggcccgggcagctctccgacgccgtcgctcggctggagcgcgcggcgcgccgagtcggcgttcccatgcgccagcatagccaacttccgcccacacaaccagcgctcgcgttccggttggacgggctagcggcgggcctggagagactggaagaggaggtcggcgagaccataaagtcctcgtcagcttctttggcacgggccgcggtggagctggttcttgcaagccaccaagcgcgcgaccccgacttcatgccgtggtgcgcacttgaagattttcccccaggaactgaagcgagggcccgggagcaagttcgggaggcagccgacgcgattttctcgggcttcgagggatcggccccccgcttcacctccgggctcgcctcggacgaagaaagcgggagcgggggtgacgatagcgacgaagactaggacgacatcgtcagcggcgccggcctcggagggccgggcaccccgtgactatccgcgccttcaattccctcttgttgtgcgcccgtagcgggcacctcttgtatttaggccgtcgtgccatcctgccttgttttgcaattgaaacttgcttagctccttttcccctttcgcttcttctattcattgctccttccactgaatgtctttgaaacagagagaacaacaaacaaaaaacaagggaaaaaggggataatcagtccgtgatcgagacgccgctttgaccccaccccccctcgggcttgttctagcgagatggtgaatccgcgtttggtccagggcacctaagtggtgatggacaaacccaccgctccgagggagccgcctagcgggactggccagaccgaggccgcgtcgaccgggggtcggggacggccgtgtgtaggcccttccgatcctccggggttcggcgcaacccagggcacggcccgcgttcgtgctccctttcggggtttctaggccgcctcacagcacttaggattcagagcaaacgcagattaccccttaaaccaggacaagccagaggaagggaaaaaagaaacggtctttgggtaaaagtacacaagaattcattgcttgtaagaggaaaaaaggatacacagtggtagcccccggccaggcgcgcacaaaccgaggggttgtgcgggggctggcccgagctccaagaaagcaaaaaagtctcgatattatggatagaagcgatggaggtgttcgatattccaggggttaggcaattctgtgccgtcctccgtggttaactgtcacgcccagaaatttagcccaaatttccagactattttgtgtattaaatccctgtccaggaccagccagggtacacaaaacgacaaataatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaacagttgagtaattaaagtaacattaaatctccactgatcaacgctacaccacgttgaacaggcccaaccaacccacctggactacagtgtattgggtcgatttattaagatgggactaatcacggtgaatctggtcgaccgcccataaccgcgggcacggctattcgaatagttttactctgatcagaggtgtacaactgtacccacaaaacacagccccacgacacgtttccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccattcagttgcattttagttggataattacgaccatgaagcatggccagatgtctcgagcacgcagctcattctgatactaaaaggtctaatactgtaattatcccatcaactgagctagtagtaattaagcatggctaagcatatagttctagctaggtcacataagtaacctgagctagtcgattcattacccaaggttgacaaagaacagatatcaagtaaacatggcacaagcgagcagataggtaatacccagatcccatgtaattagcaaaacatgcatatttatttgtaaacggtaaaacatttataaattgggatcaacatgctcaaggggaatgtgtgacttgccttgcttcttcaaaacaatcttccgaactcttttccttgcgaccgcagacttccgaaacaacggattctacacgctggcacgcaaaacgaggaaaaactctaataaaaaccaaggaaatagtacataaaaagtaaacaaacatgtagagctcaattttagatgaattttgcaagttgaatggctcaattcggagttcgaatgaattagatatgaattttagaaggttttgagccattttaatgaatttctagaattattcacgaattattgcgcaattattatttattttctcaaaggaaaaggctgtgctgaggtcatcaaaggggaggggcggcgccggcaagcgggccccaccggtcagcggcacaaaggcgccggtccaccgtggaccgggaccaccgaggcggtccaccgccggtccacgggatccgacggcccggatcggcccaaagccgatcggacggccacgaggcggcgcggctggggcacgggcacggcatgaagccggctcggccgagacatggcgcggcggcggcaagggggaggcggcaagggggcaagggggaggcggcaaccggctgcagcagccggcgacgtggaacggcggcgggtggccggaggacagcggcgcgcacggggacggcgacgcaccccaagaggcggcggtcggcaagaaaggggaccggaaaaaaaggaagggaggagagatcctcaccggaagcggcggccgacgcggaggaagaggacggcgacgacgattgcccaatggcggcttgcgaggacggagggcggacggggtcgcccttgaccttccgaaggagaagagggagttagggagaggaggaccgatgcggggtgactggaaacgaagaccgatggcgatgacaagaggtagagctcaccggcgaccgaggaaggaggagctccggcggatttccggcgaagaggggcggcggccgaggtcctcctcgtccttgcggagctgagggaggcaacggcgcgagtcgacgtcgaccgaagcggcggcgcgacgcggctggaggcggtgaaaggggcggcggcctcgggtgtgcggtgggagtggtgctcgaggggtggagagggggaaataagaggcggccggacttccccttgcggtggcgaagctggcggtggtggtgctcggcgcggcgacggctgtggcggcgggaaacggcgaccggagctcgccggagtgtggcagcgcgtgggtgcggcgtggggagagcgagggagagtatgccgggctcgggaaaaatggggaaacggacgaggggagcacggggatgctttttatgggctcggggaggagaaatcgtggccggacgagcggcaacggccggcggagtggggaggtgaagtggagctcgtggggaggtcaaaccggcgctgtttcttgcggggtgagtgggggaaaaggtggaggacgtggagggggttgtgtccacgtggttggatgtgagctcgggtgcgggagggcgccggattttgcggcgacgtggacggcaatggcggttggggtcggccggcgagaggtaggaggaggagctgacgggtgggaccgctggtcccacctgtcggcgaagggagagaaggagggacgcaaaatagacttttgcgagcgggccaagagagaggggagaaggcgcgcgggccgcgggagaggaaagaagacttgggccgaaaatggcccaaagagaggaagggggaaatttatttgttttctttttatttaaattagtttaatgaactttgtgactttaaaactatttctcgagctccgaaaattcacggaaaattccggagagtacattagggcacaaagaatattacaaaatattcccggccaatgatttttaagggaaaattttaattctcccattatttcacttgattaaattgatttatcttttatttaatttctagaaaatgtattattaatgatttttaatcccgaacgaaaatcggggcgttacaaatctaccccccttacaggaatctcgtcccgagattctgggatggctagaaagaaagctggtgctggtgggcggtttgactgatctgcacattgaactgccacattctgcttcgaactgattgattgactggttgatcaaacctgcacgattgaactggctggattcaacctttctgttcctttgttttgccaaaactggaccgactggttatgcttgaactgacctaggccagaactgtggatgctcctgaaacttacttatcttggactgaactgttgagattggcaattttggtaacctgagaattcaccacgctggctataagaggatgaaaatggaatctggcatttgtaaatcatttaccctatgtccgcttggactggtcccaactcaaatgacaagtaattccaggaaaacctgcttgacctgtctttcgtctgtactacaactgtcctcgctgttgcttctctaagctgaactgttgacatgcttcacaggtgtaccttagaatcgaacctgtcgacctgagattggggtgactctgctaatggttcgcaactgactcctttaattacgaaccaatttgccgcaccgggttgaacctacaactgaaacggcaacgaggttagccaaaactcatctgtgagacctaccccccttacagtgggtagtcttactttcgcctgactgagaacctttgaactgttgtccttgaaaaaatgaccaacatttctcggatttacagatgccctgactttgaagactgaaacttcatcggtccatcaaattgaagcaatggcgatgcactttcatcccgacaagatttggaacttaagccttagttgatgataggaaattccacataaaggtgactctcatttagctcatggacacattgactcttgactaactttcccataagttctaactactggcatgactgtcctgcttctagcttgacttcggtgtcgagttgcatagttgattcctcaaaactgaactgaccgactctgcattggaactgacacaacttgaggagttggggtgtcactaacaaagctcttgatgtgatgacgctgacgccttactgtggaacaaccctctgagaggtgccctgtcgtacatcttccatggatagttggacactttgcaaaaactgctcttgaaaaccataaccactgtaggtagcatttgttgcctctgggattggtggtgacttagctgtgctggtctgctgaagacttggtggcgtactgtctgaggttgcaggtgcttcctctttgaaaacaaactggctttggctctgatcctaattccagcttgcatctaggcttgtgcatgttgttggagacactgttgttgcatctgctgcatcggactctgcggttgctacatcaatatctggcacatccatcttccaatcttggctaaccagagcaaggtgctctgactcagctggtagcttgttgtcttgaactgatccactgactctgactgcaacacactactgttggagttatttccgctacatttgaccaggtatcgaacctgcatctcccacatcgaatacacccatcttctgatcttggacaccaaaagttgatcatgagcagggttcatctggcattggggcaccttgcagctttcaactaaaccattgatctgtggctttaatacaccgtcgttgctcttctctctgacactgaccatctgccgccagaacggaagagaggtggaagagaggggttgctaaagataaggtactaaaccacttgcctattgatctgttgtgagtagatttttatggtttaagttgcttaagcaaacaacctagtatggtcgcatccccaccaatgatgcaaaccatacccctacacacaagcaaacaacacacgatctagaaagctaacggaactactcttctgggaaagattgggtttaggtcatctccgagaaaactccacttgatcttcgcagaacgacgactctgaactgatcttctcgctccttgcacgaagcttgaggcttgacttgacttgactcccgaacagacacaaagctgacggtttatcctccacgttttaacaactataagaattggagggacagggaggagaattttgaaaaactgtttcgcaaagaaaagccgaagggcgaggggagacatttttcaaatagggttttcagaaagcttgtccttagggtttgaccgtttggctcaacctacagtcaacctggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacacttctgaaaagggggaataatagcaaggctgagtacaaccaccatactcagcaagccacaccaacgatgcagacgtgcaaggggaacacaaggacggtttgtg

SEQ ID NO: 66340 - DNA, 51616 bp, Oryza sativa
cctccaccaccaaaccctagctcccaccgccgccgacgatgtcgtcctcctcctccccgccgcccaacccggacgcgctctcctccccggacctccccccgctggccgcccccgcggcggcggccgcggcagccgccgccgcggtgtcatctggtggcgcggggggctccgggcggaggctgcccccgccgtgctggacgcacgaggagacgctggcgctcatcgaggcctaccgcgataggtgggaggggctccgcaaggggaacctcagagcctccgactgggacgacgtcgccggcgccgtcaccgcccgctgcgggaggttccccacggcgacgcacaagtccggcgtccagtgccgccacaagatcgagaagctccggaagcggtaccgcgccgagagggcgcgcgccgccggccgctccaagggccccaagtggcccttcttcccgctcctccacgacctcgccggcggcggggcgcccgaccctagccccaaccccatcatcaagatcaaatccaagggccccgccgccgcggccgcctccccctcaccggcgtccccttctcccgtctcctccccttcctccgaggaggatgaggaggaggaggcggcggcggacgcggggcggagcaggagccttcacggcctcatctccaacggcgggagcgggagcggcctgcgcttcaccatccccaaggcctcccgctccaagcctgtggcgcagcgagaacaacccaccgccatcaaggtggagaagagcgaggaggacgccgaggcggaggccatggccgaggtggcctcggcgctgcgcgccgtcggcgacaagttcctccgcatggaggagcggaggctggagatctctctccagatagagaaggagcggatggagtctgagatgaagcgcacccagacgctgctcgacgcccagcagctgttcgtcgaggccttcctcggcaagcagcagcaccaccaccaccaccacaagaaggccaaggtgatctccgccgccgctgccgcagcaacagccgccatggatgaggattgatctactccatgttgttggtatggcctactatgtgtttagtaatgtttacttctcattgttaactgctggtgttgacttgtgataattctactagctgttgtttgtgtttgggagggtgattaaagtagtcaggtgtaggatatggagtgggggagtgaggaggaggattaggagtgagtgctcagttaagctgcctgtaatcagttcagtgatcttgtgcttgagttgctgctgctgaagctgccttgtccaaatacttctgtagtagcatattattgtcaggtttttactcaatcagtgtcctgtgtcatgttctatgttttgatgatcctaagccttggagtatgtgacagtaacttgaagaagccttgcactgtagtaacatgtttttctccatgaatcaaattaatggctggtttaagggtactatgatagcttatcagttgtcatggacatctggacagctgaaaacaacactctggatgcatcaaagagggtatagcgaaatgtgccggtttcttcgcgcttcttgctcttttgcactcagaacaagactgaagagtatcctgcacttaagcttctaatttattcttttgttagtcaagtcttcttgaaaacaaaaaggaacttcgactagccttctgtcaaagttaaatacaaaacgaagcagaagagagtgctgacatcggtcctattattttaattgttcaaatgaaataaagaatgacaacaatctagtaggactatgtttcattaagccaacgaaattctgaggtaaggcaatgtttcattaagctgttttatttatatgctttccaactaataaatggtgtccttttgtgcgaaatcaaataaatctgtttttcaagtttaatatgtatgttttgggaccgaagtaatgagcctgatcggcacacaaatgcccgcattcagcatggggtcatagtgcgtgtggtaatgacagatctgcaagtgaattcctcagttcgcactgcaaatgtactcagacactaatggtcagttcaccaaaccatatgagcagagcaatcgtagtaaaggccaaaaacggagtcctcactagtgaaactcaatgcttgctcgtacctatggaaaatgaaggcactcatgagatgtccagaattcagccgttgtaatgatggggcaccgtctggttttcatatattataaaggatgattgtcaatatatttttactggaaactggattatccctagatacaatttgccatgtcaccatgattatacaaagggtctgatgtagacaaaccatctgtgttgaatcaggaccagacaaaagagcgcgcacgtcctgtcagtagtttggaaaataaacattccagttcttaagaaaaaaccactaacaaagtgcaaattttttcgctgaaaactaattgcaaaaggtctagcacttgataatagacgcagacttgcaacgtatcaacgtataattgttcaaacttgcatattagatatacatgcggcactccaatgaggctccaaaatcagcttcaaatttaaggttgaaaattcaaattttggccgataagtataagcataaaaaaaaaaaaaagatgccagaggccttttattattcatacattgatcatgtggtcagtttggttgtctcagaagtaagaatacatggacctgtggagagatgtgttacgaatttatgatccatttttcttcaagaaaccttgatataagatcgtcccaggtgtggaacaaatagaaatgagcattacaaaaatgataaagcaatcacacagtgcacaaccttcatcgagttaactcattcccgctgtggcacaacgaacattctgcaaaacaatatctcgaaagacagcttgacacacaactcacaaatcacagcgcaaacagaacatgtagagtaaaccagaataacagaacagcatccagccttgtaaacaaataaacagaaagaaaaacaaggaatgaagtccagcgccagccaatcaacttgctacctctgagcacaagattggcatcagttctatcaggccccgaaggcttcttttgtgatgcaagaaatcacatcttccatgttcttttgtgatgcaagaaatcacatcttccatgttcttttgtgatgcaagaaatcgcatcctacataacatgattgactgccaatatgataatgtagtaatgcgatgggaaaaaatgatacgatgagaattacttcctccgtttcacaatgtaagtcattctagcatttcccacattcatattaatgttgtctagattcattatcatcaatatgaatgtgaaaaatgctagaatgacttacattgtgaaacagatggagtaaagtttatctgacagtctgaccacccaggggtgcgactactaatcgaggcagctttgttcgaaatcaacctatcataagctcctctatggcgtacagtaagtttcaagacattttcaaaatcaagcaagatgtgccaaggtagttgttgccaaatatcaagcattgctccagcttacacaacaagcagcaatgagtatttataaatttggcccctcaaaaactacacaccagccaaaagctacataaaccataagatattggaatatcacctaacttcaagtgtctcgccatcaaagtcaaaacggagctaaggtcaatgacatatcccataacatatctcaatcttcaaacttatttaaaccagaatattagtggtgcaaaaaaaatagtaagcagcattcccacactagctgagcaaaatttccagacctaccagtgaagtgtatgtaagcatgaggcactgaattaggacatcctaattatacttattttttgtgagtagaacaccatgtggtactatctcagatttctacaaggatcatagggtaggcaaccattggttggaacaactaaaagaatgaaaacattacttatgaatgtcctattgcattcctttattcaaatccaacaatgtatacacataatcagctatccgcctgaaccttaatactagaagcatcacataatccatccatccagacaggctcatcttgcacaccttggcaccaacaaagcaatgagccaatcactaataaaacactaatcagggaatttagcgcaagcaatcgacatcaaattcaaactataactaagacaagaaaatgaaccataaccagtgaaaaattgacacagaacgtctcccaatatgcttctttaatagatccatactactaaacatccacacccacacaagcaggcagtagtaccattacatcagggtgattgagattaatttagaaaatccaaaaccattcattggctgctactcagaaagcgaaaagctttagaaaaagagaaaaaggatgagatggccgtgcaccagtaccatcccatcgccgccgccgccgccgcaggagagagctcagaagcggagcttggtgaagaaccacctgttcttgccggtcttgaagcggtcctcgaggcgcgccttggcggacttgcaggcggcgaccttcttgtccctggtggcgagcgcgtcgggccccgcggcgacctccttgaggtcgacgtcgagggtgtagcgggtgggcatgaggtgggtgaagttgacgagcttgaggaagcacttgacgcgcgacttcttcgccgtcttcttcgccgagtccttgcggatcaccttcttggggtacttggcgaggccggcgacgaggcagtggccgtaggggcggtcgcgggtgccctcctcgaacacccgcacgatcaccgccttccgccccgcgaacctcccctgcagcaggatcaccgccttcccgggcttgagaaacttcaccatggctgatatcctctgctgcgccgccgccggggaagatggagttagggttcggggagaggagaggctttttttaagctcttttatagtcgggttgcggagaggatggtttagggtttggggtggggatagaatgacgtgtttacccctaggatgcggtccgttagatgcgaatcgggcgggtttaattgatgggtagtggtggtggggccaatgtgtcagtggtaagataggtgggcgagcgtaggggcaaaatgggaagagtgggagctgggctgagatgggctttgcgctcgtgagtgccatgtaggcccagttatcagacggccggcacagcatctggcccacgtcgagacttaatgtacagaggatcacaggaattttgcatgatgttcagagatgtttttttgttttctgaatgttcttaggttttttagacttcagaacaaggcttaagataatgcatgcggcacatacaccatttagctcctaattattcttttgatagtcaagtcgtcttattgaagaaaagaaacttcgacaaagttaactactagtgaagaaatgaagcagaagagagtactgacgtcgccacgccggctctattttttttattattcaaagggaaaaaaaaagaatgaactactccaagctagatactatctcttcttgtagggccaaaattccgagctagatatcttaagctaccgccctgtacaccaacctattccaagccctgtctcgtttcttccttagcctgtcagcaatggcgaaagccagttcaagcgactgcgatgcattcagcctggggtcgcagtgcgtgcggtagcgagagctgagatcatcaagggtcaccgtcttggatccaccaatgcactctgtaacgttctgccctgtcatctccaggtgaatccctccagggtagcttccctcttgctcatggacatcgaagaaagccctcagctcgcactgcacatgtacaagaataaacacaaatggtgtcaatatgtcaaatattcatgtgtaataagtcagttgttcatcaaaccatgaatggtgaagtctcagggcttgttcagattgatgtcattttaaaccatacaattttttttactaaagttgtcaaatatgtacatccatttagtttcttgccaaactctagtaaataaataagaaaccatgctaaaacttggcaatattgtcaaattgccaaaattttggcaatgccaaaagttggtaaggtttatttttactacaatctgaacatgccctcagttcttaccctgatcgcgtcgaatgatcttgtcttgagaccacatggtgcgctgatggtgttcccatgcatgggatcactgacccaagtgacaatcaacccagcttggcggactgctctgatcatatgtgggagcttaacgcgcgtgttctcagcacccattcttgtgatgattgtcagtcttccgggcttgttgtgaggattcaaaatctcacacaatttaacaagctctgaaggttcgagcttgtcactcacctttttaacacagaaaaaattaactatgtgcatagacaactcgttttgtataacaaataacaataaccataaagtcatggctactgtacttatatttgcgatggcatggtaaacatgatatacaatgttttttttctggcggtctttcaaaaaataaatattttccccgacaaattagcatttacatctaaggctaaacagcataagaccgatgactgatgatgaactatggtactactagtaaatattgttacttgtcatttgagatggagcttaagtacctctagtagtccaatgctgatacatagtttgagagtttcagtagatatattacatattgaagatattggctgaaagtcttatacaaataagccaactttgaagaggtggattggttacctttacacctagagggttggaaataccacgaaggaattcaacatgagcaccatccagttgtcgagtcctctccccaacccaaagcatatgagcagagcaatcgtagtaaagcccagaaatggagtccaccctagtcaatgcttgctcatatggcaaatgaaggcactcatgagatgtccagaattcagccgtcgtcatgatgggatgctgaggagtcagaccagcagcaaccataaatccgatggcatcgtgaaccctctcggacagctccatatacctgctcacagaaaaaaacaaaagaggacatgatcttggtttccattgtataaaggattattatcaatgatacttactagaaatccctagctactatttgccacgtcaccatgattatattaagggtctgatgcgtacatgccatctgtactaaataatgcaattcctatgtctgttgtttggaaaataaacatttgcattcatatgaaacaaccactaatatgcgtaaagagttttgaataaaactaattgcaaaatgtctagcacttgagctaagctaacaactacctgtccccttgcgtgctgtccctcaagaagtcaagattccactgggtgactctctgcagatctgcataccctccatgagcaaatcctctcagaagattcagggtgctcgcggactggctgtaggctctaattaacctttcaggatctggtgcacgcgacttctcatcaaaaccatcgctgttaataatatcacctcgataggaaggaagtgtcactccatctatagtctcagttgggtttgatcttggctttgcaaattggccagccatccttccaacctgaaatatacattgtcaatcagtcaatctctccacctgtctatcagcacttgaatcattaaatgttaagccatcaatggtttgaagaacataaacctcaaaaagaaaactgcaaatacacttttgtttgtcaatctagattccagaatagactaagatactgaatctagcttgtcttttaaacaatatgaatgcttatggtttcatgtgtgcactggtggccacgtctgatccctgtctttcttgctgctgtaccttgtctgtcaaatattggggatggaaattggcgattgacttgttgatccgttaacttaagactcatagcatatataactgctaacaatcaaccatctatgcgactatgcctttcagggggaaaaaacagaaaactgaatggatgaatccgcgctgtgccataatttataaattataaagcctgatctttcagaacttgacagcgaagtcgacacgattatgtctacatcgaccgatcgccatctcaaagagagattgtgaagatgacagctgggaccctgcaacagcttaagcccgagtgatcagccacatcacatatattcgttctatctgaatgcgccaaaatcccaaacagtgcagcgtgtggcggacaggaaacagataattttcgatctcgaattccaatcgggtataaaatggaggaagtggattttgatctcttgaggagatatctcctcgttgcttgcttgcatgttactcaaatggttatgaaaaaatttgagaagatgtattaacgtgtgtaatatatcactccacaaattcaaattcagcttctatatctggcaacaaaattaattgtgaatatatgttaactagctgcggttctacatctcgcaacaaaattaattgtgaatatacgtaaactagctgcggtttaattaatttaatttttttacgagatcgttagggatggattggagaaggagaaatggtgagaagatgaagccatgggagtaggcgaggaggaccttgatggtgggcatctggccgccaaaggtgaggacgacggccatctggagcatgaggcgaaaggtgtcgcggatgttgttggcggcgaactctttgaagctctcggcgcagtcgccgccctgcaggaggaaggcccgccccatggcggcgtccccgagccgctcctccagcttccgcgcctccccggcgaacaccagcggcgggaacgacgccagctcgcgctccgcgccctccagcgccgccgcgtccgggtactccgggatttgcctcgccggccgcgccctccagctgcccggctcccacccgctcgtcgccgccgccgccgcgcgcaccgtgatcatcccccgccgccgccgccgacggccggtggaccgggcgtcctcgagacgcgtggtggcatggacgatcgccgcgtgcccaacggtgagagccgccatggcagagtgacacgtcatcgagtggatccgcagccggaggcaaatcactgggtatttatatgtagagccgccgtataatactccagtcactacgtataatagtcacaatttttttagactaaccaaaacgaagcaactacaaatcggccgcatgaaaaatgcagaagttgtttcatcactagacttaaaaaagtgttttaaacaattacaatatcgtctaaatttacttgaaacatttttcaatcatgcggtaaacaacaaagatacattgattgaaacattaaaaaaaatcgtgaaaatctacatgtttcaaacaaatgcaacaccattttaccccaagttgaaatatttttctagcacgtatgaaacatcaaaaatccaaaaatataccggtctagatctagcttccgcctcttaggtggtcgaatctttagcttcttctgagccgaccaaaattcgaacaaaaacatctccatggaaaagataatgggaactaaaaacccgattagtacaccaacatataatagtcacaatggtgtacacacactgaagttgtactgtacgtctatacaataaccattttatgaacatggtacaaatatgtatacgttcataagtaacaacgcacatactcatctccatatgcatacacacacattatctatagcatatccgaataactggataacgaaaccgacaaatctcgctgtttctaattgagctacactcacctcactacggtaacctcaaagctttagggcctttttaaatcacagtaatgaaaaaacggaggaatatgaaaaacataggattctgacaggaatgaaagtgtaaaacaaaggattgcaaaacgcaggaaaaagaatgaccgtttgattggaccacaggaaaaacacagaaatttgaggagagataaaagactcaaaggatttcttccatgagattctatctcttgttaaaattcctctaaaacttgtatggaaagaggcatttcataggaatttcatagggttcattcctttaattcaaaatgctttgtaggaaaaatttctataggaataaaatcctctaaaattcctatgaatttcctttcaatcaaagggggccttaaagttttatttgattagaatattgaacagattatcgttttgattatagagagaataaattatttaagaaataaatttaacaaatatcttaaaatagaaaaatattttgagaagcgcaaataatatgtttaaataatccaaagacaaggaagtgtagcacaaataatccaattacataattcaatgaataaactgggaaaatgaccatgcaaactgaatagtccttgccaaatgatcacacgaaactgcaaacaaataattattttttttctttattatttacgctgcaggaaaatccggtgcagagtatacacggcagaaaatgcatcagaatacgcatatcatttggtctggcgatcacgtatattccggatcatatttacagctgcagcacaacgaccatggatgcatatggatcatggatggtcagtaggtgtcatactcatcggcggcctcctcttcgtcgtcgctcttcagctcggcgagctccgcgagcagcgccgggtcggcggcggccatgtcgccggggaccttggcctcctggatgatccgcatgatctcctcgacggcctgcgtcggaggggcggcgtccgtgtccttgtagtcggccttctccctctccgatatctcctttggcagattcttcagaaaccacgtgtgcttctttatctcagggatcgtgatcctctgaacatcaaaagttcagggatgcaaaaactcgagttagttaaattcagagggaatccatctcgttaattaattagagacatagtttgagcattagaacatataattgagatcatataggccgcattacaatgagtaagattacaggtagaatctgagtatgatttaaggttaattttcccttcggagtaatctaaagtttggtctagtttggcaacttgggatctcacttaaactgggaggtaaagtgtgtgaaattaagtacctttgaaggatcggcaacaaatatttgagatagaaggcgcctgcagtcggaagacaccctcacgtagtccgggatggagtattgcacgccaagaattctctgtcaagtggaacaaggcatgcatattcagagtttcagactcaccattgaagcaaggtgtagaaaaggcttggatgatgaacagagggaaatggagcacttacgctgatcgttttgcggaaattcctcggatcacctggatcttcaaacgggtatgaaccgacaagcatcacgtacagtgtcacaccacaggaccaaacgtctgctacctgggtaaggagacgcattacctcagatcatgcagagatgcaattctatgatgcgatgttccaggaacttcagtagcgtcctaacattactgaaaacgtaaagcttatgctgttcggtttgttttgcactcaatgtaagtatttcagctgcaatggatcacttttagctaacgtctaaatgctcaattgctacggttccatgatgctagaaaagaaaaaacaatagtgatagatactgctatctatctttactttacagccaaattcagattgcaaaacatagaaatgagaaataacttgccttgccatcatattcttttcttgaaagaacttctggcgctatgtatgctggagtaccaactgtagacttcggcttcgaatgcagcaaagcagactgaaaatcaaagaagccaagttgttcagtactccagtttgattctaccaagaaggcaagaacaattcaatctatttctagtaaagtactctgagatgtagaacagaactagtagcatccatgttagcacctttgagtaaccaaagtcacaaatcttcacacgaggtgttgggcttccatccaggagggtgttctcaagtttaagatcacggtggcaaatttcctgcattttgcagaagcagttaatgaccacttaacttaatgagcttacgatgtgcctgttacgtctgcagaatttcaacaagcaaaacataccagagaatgacagtagctgacacctgatattagctgctggaagaagtaccttgcctattgacatgaatcaattattgagcacagatggtttgcaaaacgggaagattagctcacaagaagacaagtagggcctgaaagcaacctcgtcttcgctgaatcgccctgcggtgcagatttgttcaaagagttctccaccagcagcatactccatgacaatggctaggtgtgtgggtgtcaaacaaacctgctcttgatcgacacacaaaacaagaaatcgttatagcagttgaatttacttcgatcttaagacgatacactacttactaattgtatggtaagtaatcagccagggtaagctttgtgcttgatagatgtataaacccaaaaccttatcattttactttctacagtagcagtggagatcagctccatctagtttgactgtttgactgactgataatcagtgaagctgccgaacgaactgatgagtgaaaagaaaatctgaattacctccttaaaccgaatgatattgggatgccggagcgacctatgattgatgatctccctctgcacattttcatcaatctgcacacagagcaaaccaaccatccatgcatcatcaatcaatcaaactaaaagctaagactcgtcatgcatctggaacaacgagttgctgaaaacatcaactcgcacacaccatcaaattatcaatcagtccgacgcaagaaactgcgaaataaatcacaaaaggagagaagagaagacagagacagaggcagcatcagaccttcttgcccctctcgatgtacttgacggcgacgagctccttgctcctcttgtccctgaccagcctggccaccccgaagttgccggccccgagctccttcaacgcctcgtacctctcctccattggccccctcgaaacccaaacccaaagaggagaagtcgccgcggttcgagaccgaagccgaccacccaaccaacccaatcagaggcgagctaacctccaaccaaaccagaccaaatccgaagaagggaggcggcgaggtggagggatatgaaattctcttcgtcgccgtcaccggaaagcgacgagggtctcttggtcggacttgaagccgaagcgaagcagcgacggcgacggcgaggtgcgcgacacgtggcccccacgagtgccgtcgcttgtcacgtgggccccacgcgtcagctcagctaatcggcgggcggggtaggagtggggcccgtggattaggtggcgtgtcctgtgaatacgacgtggccgtttcgtcgctccgggttgccacgtggctccatgtacgtattatatggaggcccacgctcagaagagggcggtgtccagaaacatggagctgggcttttcttttccaaagatgctgggccggttttctaaagtgcaaaccatgggctgcacgataaattaattgattaatcagttttagctagtaatcgttagcaaagacgttggttaacttggttttcttgctagtttcgtagggatttcaaatggttatgagcagtcgttcaaaaaaaaaagatgattatgagccaagcaaaccatgggactactatcaattcgaagcatccgctcgagaatcttccatcgaagatttggaacaatgttgaatttcttcgatgtgacataaacaatctgcctggtcgtggttcactactgtggtagtagtactattagattactctaattattgcgcgtggctgaggtaaaccatgacacattagtgctggaattgttgcatgtgaccgagaggtaagattagcgcaagttggcttgcaatttctttgcgaaatcgtatgatctgctaatattccgtgtggctctgccccttctcgctgattggagttgcgcttagccgtcgtaatagtcattttctttttcttggtttttttttgtcttttcttctttttcttggcataagccagtctgtctgattgcgttatgtaaacaaatatttttttttaatatattgacttaattgttttgcgcgttcggaaaaaaaaatctgcgaatattcccagctgaccaaaatgggaatggacgacgacgacgaggtcctcccttcttcgcttcttccaatccatgggccgcaagtccgcaagggccgcgcgcacgtgggcgcggtgcgggtcttctttcccaaaagaagtcgggggaaagcgaggcgcaacggactcggggcccacctatcgcgtaggtagtaggactaggaggaggcatagcccgtctcgtctcgacacccctccgaccccgacgcgtcgcgcaccaaacccccccgcccccaaccccgacctcctcccgtgctccgcgctccgatccgccgccgccgccgcgcgcgcgccgccgggggagtgcgccggcgtgtggtggtgggtgtgtaagggtaggtggaggggtgggtgatgcgagatcggccgcggcggcggtagagggggtgtgtgtgctcggctactccggtgggtcgggtctgggcggggtgcgcgtggggatggggtgcttccagtcgacggcgaggcgtccgcgcccggggtacgaggaccccgtcggcctcgcctccgagaccgcctgtgagttgttgttgctgtacttgccacttgaggagtactctacagtactgtatttcatttcatttcatcaagtagttcatctgatttatgcaatcgatgggcgtactggaaattctgagttagttgttttggatgtgtagttagcgtaagtgaggtggaggctttgttcgagctgttcaagagcattagtggttctgtgatcgacgatgggctcatcaataaggtgaacatctaactgtttcttgggggtatctcaccatattggcatcatggcatgtgtgattatgagcatcctgatacatttactaatctgcttttatagcttgttgtggaattacaaaattagaccttgccgcattcgaatatatctactgttccgtctttcatcaccatattggcatcatgtcatgtgtgattatgagcatcctgatacatttactatctgcttttgtagcttgttgtggaatgacaaaattaaaccttgccacatttgaatatatctccatgtactgttccgtctttcgctggatatgagaggaggtgctctcatatcggaatttattaagaggggagtgaggctcgaacctgggtcggctagcccacaacttgtggtgctagccagaagacccccacgcctttctcactgttccgtctttcaggtttcagctgcacaaattatgtggtggatgccattttctgtgaatcgttttgctatgctggcagttctattcattcatctttgaagtgagcatgaatctttgttgtacacaccccgatcctttattcctcttgtaccgctcattgtattatgtgtttgccttctaaattgttgaattttctgtgtatcaaaatgtgatttttttcctcaaagtttaataggaaaaaacttgttcctgatataaaccatctggctactatcacagtataacaacacaatgatagttcaaagtttgagtcactttcttcctgccttgtcaatattgatttgccgtgctataaagctagacataatgcgtttctcttgcatcttcacttttgttttttgcatcttcttgttgcgtcttgcgtggcgaagaagttcattaactgctatctgagaagccatacaggttcatgcacatctgctagttctcatgaactataatcttgacgtcatcagtagctaaattcacggtatgaaattagggactacctatctaacgttcgacataaaatccccccaaaaatatgccgtaactacaacacaataatagtgtaattgctgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgccgccatgtactcggcctcgcagctggacagggccaccacctgctgcttgattgactgccagctaacgaggcactcgccgaggaagaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgacgagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgctgcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcaaagtggaggtgcccgaagcgctcgtgccactgccacgcctcgtcgtcccgacgagcggcgaggcaaactggatgtgcgacttgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccgactcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgtttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttttgctgcggcgagctcggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttttggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaaggcaccacaagaccaagaccaaccagccaagacttattcctacaattgcaacgtaaccagcatgtaattacaatataactagggtgtaagtggtatgtaaatacaccatagctcagtggggaagtgcgcacgcatgatatccttgcgcctggggttcgatacccagcagctacagcatgcggaattttttcccccttcctagcacgaatctcagagcacatcgtacgaccccaaaactgacagatttgtccaaaaaaatatgtcgaaagttattttgcgattccgatgaaattattataattaatacctgacatcattttgctatgcaggaagagttccaacttgcattgtttaaaaacaaaaggaaggaaaatcttttcgctaatcgggtatccatctccttatcaaccattctcacttaggttctgttagtaaatattctgagtgctttcaggcacaaccttattctatcacttgaaatttacacagaatggaccttgcagatatttgacctttttgatgtgaagaaaaggggggtcatcgactttggtgactttgttcgagctttaaatgtatttcatccaaacatcccaatggaagagaaaattgattgtaagttattgccattctgttttatctcaacttcgttgataccataatttcacttcctaaatgattgaccccttggacagtttccttcaagctatatgatatggacaacactgggtttattgaacgaaaggaggtaatgtcttactatttctgggcctatgattctgcatatgccaactgttttctgattcggaatttaataaaatggttatgccaaagatatgtattggtggtaatccagtggtttgtaagcaaacttctttacctctgaagtaacatatttacgacatgctttaacatacatcctattgttcgttggtaactaaaatttctattcttattctcttgtacaggtaaaacagatgttgattgctcttctaggtgaatcagaaatgagattatctgatgagattattgagacaatccttgacaaggtttggacatttgattaaaaaaatgtagttaaaatgtacgtaattctggtgtcttatgacagagttaagacttacaatgacttatgtggttaatggcagacgttttcagatgctgatactaatcaggatgggagaatagatagaacagagtgggagaattttgtctcaaggaatccctctttattgaagataatgactcttccgtacctcaagtgagtataacagagaatagaaatatggacacattttactgctactatgtttatcttccatgctctaagaaattagtggtgctgttccaatttccaaagcttaggcctatgccatctaagaaaagataagatagactgaacttttgtaagctacgacactcacacctcaagtgagtattgcagagaatacttatatggaagcggtttactgctactatctttatctcccatattcaaagaagttaatggtgtcattctaatttccaaagcttgactgaggtctgtgccatctaagataagatagacaaatgaactttcgcgatctatgactctttcgttcctcaagcgagtatgacagaaaatagaaatatgtatgtgttttactgctgctatgtttatctccaatactatagaaattattggtgccactccgattaccaaagactttagcctatgctagctaaaaaaagataagatagacaaagaactttcacaatctaggcatgtgtggaattagaggagggttgggtggggcgtaaattgggtaaggtatgcataattcatcaacttctaaatgtgactcatgttaaatagtgctatatagttgccatgagacatttatttatcgcagtaataaattgtttgacctatatttctatttcagtcatctaaaacttgcaaaaagagatcaactatgtaaatctctgtagatatttggtttcagtgtggtagattgctagactacttacaaacattcttgcactttccatgaacatttgacatgctgcagataacatcatttctaaacattgttgcttgcatttttcagggacataacaaccacatttcccagttttgtattcaattctgaggttgatgatctcgtcacatgatcgtgtttctgttaccggtgtacagttaacaaaaacaaaaggagttgatttatgagtgaaagaggcagaacattcgcaggtgctattatcatacaaggaatataattgcgcagcagcttggaagcgtataacttcattgatgatgtcgtcgcacaggatattagcgttgttgttttagtgttgttgattagattcggaatgtaacatttgtatgtttgggtttgcagttttcaggtctttgccaactataacatcttatccttgtccccgtagagatatacagtatttacctagttttccaaacatgagtggaaaatcttctgtctatctggaaccaccctttgtgttgttctgtatagtactgtctcttttttgttttaaccatgatgatggcttctcgtagagtgttgcggaaagttaaaaaagggggaaaaggtaaaaaaaatgcatggtagttgggctttcttggcccatgaagcaaagtatgtgggcctaacctgagcccagcaggagcagccgacaccgaccgggaggaaatcccgaaaacacccccggcctccacgacagaaagaggcggggttaaaaatatctgcgccgagttggggcgtcatttttgcgggaaacccccgggctcttttcgtaattacagcggccgcccacccacctcacgcacgcacacgggctccctctctcgctctcgctgtcctcctcttccccgcctcgtcaccactccgatctcttcacctcgatcctgcgccaaaccctagccccgcccgcgagcgccgccctcgccggctcgccctcagggggttgcgagagagcggaggctgtggcaggggcgcgccgccgtaggtagggtatgagcggcgcgtacagggatcgggggttcggcggcgcggcggcggagatggaccggaagcgcatcaaggacgtgctcgagaagcacctggacaggtcgtccccgtccacatccaggggggcggcggtggccaaggagagggaccgcctcgccgccgcaggggggaagctgcccgcgccgctcggcaaggccgggaaggtctccgatggtggtaaggatctggtggtttgtttgttccgcgcgaggggttgtgtgctgtttgttttgacggtggttggggttggtggcgtctggtgctacattgcctcaggtctttgcctgctttggttagatgatgatgcagcttctgtttgtttctcgggtagaatcttagggtgaaatttggtgcgctgtcgtgataacgtaggcttctgtatactttctccgatggatgaaatgggatgtaagagtctggatgttcaccgcattaactggagctgaagtaagcgaagttctacatttctgtttgaacttcacgtgaataccatcccacgtactgcattaattgatgttatgacttaaatatgttcacgaaacatcggttagttctaaacaatgttttaaaaagcggtatgtagttttgtgcggtcaccccatattgtagcacttatgcggcatagtcagacgcttatgcggtataatcgaccacttgtacggctaagcggtacaaggttggggcacctgttccttgtatgtggcgaccttctttttagatgctggttctagaagcagtaacaattactaaataaataaacgtgcactggaagtttatgagaagccggtcaaagtagggtcttaatgcagtcaaagcatgcaatggtgaaagaatcagatgacagaagctacaataaacgtaggcaagtatgggttagggcaccttatgatatagaattcttaggcaagttggtttttgcgaggcattagggtaactggccacatggaatggaattttggactggtagttattctaccatggcagtggctgtttaattaggtatgcatgagacacaattagagcaatgtatttttgttgcagtggcaattaatgcgatgagttaaagaggtagcgaagagtttgagacgcgtgaatgccattttgcatacagtcgtcttaacaggataatattgaatttatcgaatgtttagcagccccctttatatgttgatgtactgtaacataggactgaactggcaacggcatccatatgtagccctaacaaatctcagaagagaaaactaacatgtccaattgaaggaccttctatatgagatgacccaatgtcttgaatagtttcagtcatattgtattgtttgtttgtctttggggccagtggagatctgaagaatttctctatctgtgagactaacatgatattgaaggcaaagagcaattgctaaaagcattaacatgatgtcatgatgttatattagtgccttgataggttactgctttatgaggaactcgtttggcatgaaaaatcctccatttgcttccttactttattggtttttgtctctgtagaacatttattttgctttcagatgtcaattactctattggaattttgggcatgtcattagctgtaatatatacagtgttgaaataactttcagctgtgtagtgacaaatgataaaaactcgacccaaggggagagacatcccgaaggcattacacttaaggtcgaagaaaaggccctgaaagccggctcttgcttgtacaagggctccattgccacaagccgtatcttaacccatactttagggaccacacaccgagggtccttttgtttgtgagaaccagggttgaaaccctggttgacaacttcacaactggaggacttgctgccgtgctataagcatgttctcaaaaacttgaccaacctagggggaactaggtgccttttttatttaagaagaaataggcacctgaattcgcttcgatgaggacttgaacttgggcggtctgggcatcaatgtcctcgaccaactgataatgtctttatacatttcacagctcatgttgaaccaaaaaaggggcataattgcaagcttacagttatatctgtagccagtgggcagcggtaattaattgtagtttttgagtgatcagtttccataataagaaccgggaggaaccaaatgtgatggcatagcacttggggagttggggtataggcagcattgattgatctcaactcttttgtttccatttgtgtcatacattccagtttgaccgatgtttgcacgtgtagagccgtcatgatctgatcacacaggaagactctctttttgtttgaattgaaaagggaactattccagtgcctccactgatgactcactgaacatgctgcttcactttgaccattttgtttgtcaatttcgcttgatatgcaaccagggcggtaacacacctattgtgtggttgatgtgaacagaaactggtacatcataatagcaccaaaagaagaggatagattgcacaatagataagtagagcaccagcaagcagaagattgaacctaggactagcatcttagtactccaacaacaccttctttaatgagttatgaaggagggggtaggaggttactttgacttggaaaccatagaaactcttggggatgttatatcaaactacactgaacttagttttacagtgatatgaatgtttgtgcagtgatatgaatgtttctttaatttctctgtgcatcgatatgaatgtttgtggtttttcaatctgtaagaaaactgcttgcttttattatacacttgaaattcataatattgtttggcagggtattacttgtgactattgctttactgcagtaactgcaattattaatatgtaattttttaatcatcattaggtgcctctaatcccttttttcttttgggtgcagcagaagaatttgaaactgacagtgaagattcagatgtcagtggttctgagggagaggacacatcttggatttcatggttctgcagtttgcgcggcaatgagttcttctgtgagatcgatgatgattatatacaggatgatttcaacctttgtggtctgagcaatcaggtgccatattatgactatgcacttgatcttatcttagacatcgagtcttctaatggtgagattatttttctcttaagaaagctactaattcattatttgcagtaaaatacactgttcatataccatttatgaatgtcactagctgcaacctatatttttcataccactttgtatcctaacatacttttttatgttcatcaatctcattttctaaaggagccatttccaataacctatttataaacattccacagttcaaagtctgaaacatgtattgtatacacatacaccttctaagtcagaccatttgtatacaggtgatgtgttcactgaggagcaaaatgaattaattgagtcatctgcagagatgctgtatggattaattcatgcaagatatatcttaaccagcaagggtctggctgcaatggtaatctgctagcagtttgaccatatttgataggctatgcttgcttccttgactacttgaatactaaattattctgcttttgccttctgcagttggagaagttcaagaactatgactttggaagatgcccccgggtatactgttgtggccaaccctgtcttcctgcagggcaatcagatattcctaggtctagcacagtgaagatatactgtccaaaatgtgaagatttacattatccaagatccaagtaccaaggcagtatccttttgattgtttgtcttagatgtgttttatatgaactgctttttttcttaataaattgtactcatatatggagttaaaaacgaggtgatatctgatagggcataaattagaaattgtgatttcctaagcagaatcagacttattattcgcaacagctaaagcaaagcacaacacgaacataggcagaattatgaatacatgacccatttgtgctgctctctaaaacacatcctttaaaaaatcaaactactgagtttttatgccacctgtaatggatttcaccactctcagtttctccaagttataggttggtttttaggcagcacttgaaaaggggctctgtgtagaggattctcattcaaacatggttttcctttattttttttatgcgactcatacaatttgattagatttgtttggaacataaccatgggtaaacaaacattgattttgtgctatcatgaatattgtgttactatttttcttgcacttgtatctcctttactttgctaagacattgacggagcgtactttgggacaacattcccacatctcttcctgatgacatatccacacttgaagccacaaaagccatctcagcagtatgttccaaaagtttttggcttcaaacttcacaagcagtcatgacaaacttgtacggtaagctgctgcttgtttttacctagtttttagggagagaacattgtggcccgaaattattgcggtctgttgatgtgagaacatgtgagcttgaatctcgctgtaattgccgagcaactgtatctgtttttgtactgttaattctgtgatcctaggttgtctcactgtatcaaattatgttaatccgcatgcttttcgggttatattatatggattttccccccagacttcggactttactctcactgggtaacatcgtgacactagtaagcaaaaaattattcggtatttgcttaatgattgatcgcttcttgggttgcttcttcttgcaaccttttttttctcaaagttttgtctactgggcattcttttattcatccagtatattttcataaccatggcatctacatttgtctactatttgttcccgtgccttttgtttcacacgtgttgccatcaacttgttcttcgatttttctgggttattattaccaccttagttttagtcatactgctatatggtgccttcttttgttagcactggaatatactgtaactaaaatattctgattcctgacaccctgaaagcttgaatattaatcattaatcattaaacacacgtaggatcatgtcgttgttgtggtcatgtggataagcatgccgatctgaatcgacttatcagcatctcgcggcgtttttccccccctgcgtctctgtcgagccgacgacgagattacacatttcatgcgtgcatacatgcgccatgtcctttgttttgacgtggtgacgctcccagtatggcagtgtgcaccgaattttcacccaaattgtctgtagattatttagatcgcggtcagcaacacaatcatttgagagtgagagaatgcccaagaatatccttgggaagaacatgtggatatttgtatgatacaattcgatcagttttctgcgaaattttattgtgccttgtagaactttgaaagacctttttttggaattgaacaaggtctagatcaaaatgatgaggatcaactacttgggaaaagtggtcaaggacccacttttctagggtctaattctaactctggccattagtccttggttttccttgttgctgcacagagagagagagagagagagagagagagagagagagagagattagacagacagatccaaggtaagcagagccgcaagcgaagcacacggaaataggaggggaggcggctgcttgcaacttgtagctgcctgtcgtcgtcctcgtctacttccgatccttgtgctggtcctctccgcacaccactcttcatgcactgcttatgtatctataaaccacaagcaaaaagaaaaaaaaagttctaacaatactttgttagctgctgagtgccattattagagtgttaaaacatactattactaactgtggaatggtgggcgcccaagattgctagtgtgtgccttatcctcttggtcgttccttttgattataaaaaaaatgtacatatttcaggactgttcgatatgttgccaaaatcaaccttgttaaaacgccaaattttgatatatgttgacgttacatttttttttgcagtgttggatgtgttggtttatagcttcgtcatattttaatagagtagcatgggtagtatgtttagtttattatcctatatacccacctctctcatctttcaatgtttattgactccaagcatttggtctctctctcaaggttatattaccttgtttatgcaagcaaaagtaaataaattactagttaacttagttatatcttcatttgatcctattttaatgcttatgaacgttaaagctataaaactacacgagcaaaataataaatttgctcattaatcagcaaaaacaacaaatgacattaaattagagctaagggcgacaactacaactacaagtggagcaagacaaagacatttaaacaagaaaaaaacatttaattttcctagtcacccttatttaaataacttcaagaagacgacatgtcgtatagtgctactctacacaaatgattgttccaatttaaataatcattttcttttttagggtaaaataatcattttctatcacaggtttaaacagaatcaacttgttgtgggaaattcaaattcaaattcaatttgaattatgttaaaagctagaacaaagggggaaaaaatcacaatcaattcgtagttttcagaggagaattgaatttgaataaattcgtttaaaaaacatcgaacaagaggggaaaaagaaccagcgggaactcagggaggaggagaacaaacaagagaggaaaaaaaaagaaaaaaagagagagagagagagagacccggaaaaatcggtgcagaaaagagagaaaagcgcgaggcggctgcccccacccccacccacgcctccgcctcgccacgcacccccaccccatgtcgccttctccctcgccggcgaagcaacccccaatcccggccgaattgatcccaattagatgcaccaccaccaccacctccccgtcgtcgcccccgccgccgcatcaccggacgcggccgccgccgaccctcccccctcctcggatcccaaccacctcgggccccctcccgccctccgcatccacatcccctccagcccccaccatgcgctcccctccacccctcacaagcgccccgtcatgacctcctcctcggcctcgtccaccccgaccaggccgtccccgtcgccgtcgccgttcgcgccgccgcggcaccgccggaaggtcgcccccgccgcggcgtcgcccgcgcccgccgcggcggcggcggcggcgaggcacctcctccgctgcctccacctccgcctccgcctcctcctcctcctctccctcccgaccctctacttcctctccccatccccggccatcctcccgcgctccctcctcgccgacttcctctccgccgccgccttctcctgcgcgctcctcctcctcctctgcctctccctcccgcgcctccccttcccgctccccttccccctcccgctccgccgcccgcgccgatcccccatcctctggtccatcggctcctcgccctccgcctccgcctccgcccccaccaccggccatttcgtccaggtctacagcaacggcgatgtctacgagggccagttcaaccgcggccgctgcaccggcagcggcgtctactactactacatgagtggcaggtacgagggggactggatcgacggcaagtacgacggctatggcgtcgagacctgggccaggggaagccggtacaggggccagtaccggcaagggcttaggcacgggcacggcgtatacaggttctacaccggggatgtgtacgccggagaatggtccaatgggcagagccatgggtatggcgtgcacacctgcgaggatggcagccgctacattggggaattcaagaggggtgtcaagcatggacttggccactaccatttcaggtgtgggactgaacttatatatttcatttgctgctgcctgctagagaatttgtcattgttgtgaaattagctgttgcaactagttaagagcatgtttatgatccatcattggtcagtcaaatagatatggatgttgcaaaatgtttagtggtaatgtcaaattaggcaaatgcatgattgtttaaccacagtatatgataagagtgaaattagcatggttttggtgttttgcaccagcgattgctaaattattcccatccttgtggatttgtgtatccaaacaagtatcttgtaattggttataacttataacacagttttatcttcgaaccttatctgcttataccagtaagttaggtgttgcttaaattttagatcttgtgaagttgagcagaacgttagattctctattatctatgtagttgtctactatgttgctttatatgcactgaattttagagcttttcctaaccctagtagataatgtattaaatgtgaatgcttcatttgatcaaagggaatgacttccattagcttattgtttacaagggagagatgaaatgttgggctggtagtggtaccttcttctgaaagatccaacttggaatttacttttgccatttatggtagattctgaaaaagttgtaattatcactagggtatagcctccaacgaccctgtatttttttaccctctgccctgctcatgaatcagaatataaggtgttcctttatgttctcagcctatatcattaggtaggaaatcaatttggtgaagcagagcagattaccaactatagagataaaagttagagctgtagggaaaactgatacttttaccacctcagtctactaatacacatcattttttgttatcacttatcagaaagcaagcttttttttacacttaatgcatgcctatattcttctagaagacgtttttaaagttaaaacaagtgatgatttgcctgtttatgctagtctagctgtgttttgtgagcatgcttagctgtcctcctgttccatttcttcctggattgttgatatgctgttagaagctgatctcgtgcaaatttgcactggtcaagctgagcactagttatttcacatgtggaatactggatgtctaatttgatccattgcattttgcttattccattagtttccatttttggttctttccagccatatatctctcatctctctgttgtattatatctgtcttgattgtttgacttcctaccataatcccatgtgtatccaagtagtgaattagtgataatctgaaatggaaaacagggtcctctcctctgttggtttagcttctggcatatagctcttctaaagctaaatctgtttctcgttgttggggatcattctgtatttgttgattagggtaattgttggttcattcttagttgtagcttcaatctaaatatctaatgcaagcagtcttttggtatcgctaatactaatatgattgatgttctcttttatttatgctgcatcgtttaaccgtgcgggatttggccatccattctctgttattagttatctagatttatgtccgtaatgcttattgatttatgtctgattggttacgagctatattagtcatcgttgacagtgtcatgtcatgacgggctgtttggatttggaaatcctactttgttgtcctgtgtcagggacgaatattaaaaatccatatatatactatacctagtcttttcacttccatctaccaaattaaaacttgatggtgtattcatttttttttttgcaaagtttatgagatagcatgatatattgtgtgtgatgtatgttagttgtaccagtctactacatatttgagcaccactatctgtttgtatatttccttatctttcccttgtttacagtttcccgtgtgaaactttgttcttctctacggattcattttaataaaagctgtatgtttagatttccacatagcccataggccatagatgcattgttgcagtttagcctgattcactagtgctctatatatctatttatacgatgcagcatcctgtacaagtttattgggttgacctttgaactaacattttgttaacttgtgtcaaggaatggcgatacctatgctggggagtactttgctgatagaatgcatggcttcggagtctacagttttgccaatggtcacagatacgagggagcttggcatgagggtagaaggcaaggattaggcatgtatactttcaggaatggagagacacaagcaggccattggcaaaatggagttcttgacaccttgagcacccaaaacattatccctgggtcccctatagctgtgaaccattccaaggtcctcaatgcagtgcaggtaatgttcctgaacactattacgccattagctgtcagaaagtttctctggccatttttgcttagtacaattctactctctaagttctgattatgttgcactatcaggaggcgagaagagctgcagagagggcctatgacgtcccaagagtcgacgataaggtgaacagggccgttgcttcagcaaataaagcagccaatgcagccagggtggctgctgtgaaggctgcacaaaagcgcatgccaaataatggcaatgatctaccgttgtcagtagtgtgagaaggaaagccaacataaggttggcacgaagctgcttcgcgatgtcatcgcgttgttaccaattcgcccgacacaaccttccgcttccctacagggggaagttgctccaccccatcgggccgtggcgataccctgagtgactgccgttgcagcagagcttcggaaccagagttttccgccattccctccatacatcttttgtggtgtcttttgcgacgcagcagaactcctgcgcagagagagagagcttcctgttgtcgaaggcaactgatcgaggtcagtagggttctcgtgctttcttttttttctcttcttcagtgtaatactcatcctatgtttagagatacgatgatgtacacacccccaacatcaggagacaaaatctctgttgccttttgtctcttggctttaagcatgtatagaacctacatattccacggtgccggccgtgctggttggaggaaccgcatgccgcccccgccattgtctgtactactttgtacctgaacgcataaagataaccatgaccttgaatgaatggaatgcctcctgttgttttcgtggttgatgtgtaactgcacattggattatactattaccattagtaggtataggaatatatgccaaaatccattatcatttgtggggactggaaacacgagctaccaaataattgtggattgatcaacaagcatttgcatcttgaaggaaattattggcgcacccaaagcacaattcatagcatacgatgctgcttgctgtttaattaaagcatacaaactgaaccgaatagtgattactccaagaataaattggcattacaaattcaaaccaaatgctgctcagctaagtaacaattagaaaaatcagagatgagaaacggcgatgataccggattactcagccgtccgtcaggagtcaaatgccgcgttcaaaaatttacgtaagcgatctgtatcatcagcgacagctttggtacagttcaatcagagccgtcgatgactcgatcgacggtaggatgccgcgtccttcccgaagaaggcttcacctgccgcgtcttgcgggctcgcaaatacacgacgcgtctcaacgactccaccacgagccgagccgagccaacgaagaaatcgttgccaaccaaatccacccgccgattcgcctcccccctcctcgccggcggcggcgaccccgcggcggcggagagatgatgatgctgatcgactgctcgggctgccggacgccgctgcagctgccgcacggggcgccctgcatccgctgcgccatctgcggggccgtcacctacgtcgccgccgccgcgccgccaccggcccacggcgaccccgcccgcggcgccgcggggccgggggcggtggcgccccagcaccaggcgccggggtgggggccgcctcccccgcccgcgcacgggcggaagcgcgccgtgatctgcgggatctcctacaagttctcgcgccacgagctcaagggttgcatcaacgacgccaagtgcatgcgccacctcctcacgacgcgcttccacttccccgacgactccatcatcatgctcaccggtaactacccgatattacctccctattggttgaattctggttcgggtatcctcaatttcggggtttgattgatcccccaccccaccaatagtggcctgcgtgtgaagagattgttctggagcgaatttcagggctagggtatgatcgaatcaaggagctgtgggtggctttgcattttgatgaattttctgctcgctttttattttactgttgcgatgaataggcaggggcaaatgatgaggaattgagaactgtatttttttcgttggcgatatcaaaatgtaatttaaatttattcctgcctcaataaactacgtatggtttcaatttgaagataaagctggtttggtttgatccatcacactctttagggctgatataagctaatgttgttgtgagtcatgggctcatgttttcgcaaattatggttttactaactaaatggaatctagtaggatgcaaatgctagactgaaaacatttaagacaggaaaagggcaaagtatttttttgtcttatattatctttctggtatatgaaatttgttttctgatgatctgttgaaactgatcataacccaatactattggtttatttcttgtcttgcagaagaacaaactgacccttacaagattccaacaaagcacaacataaggatggccatgtattggcttgtacaaggttgccagcctggagactcattggtattccattattctggtcacggagcacaacaaagaaactacagcggagatgaagttgatggaatggatgaaaccctctgcccattggattttgagacacagggaatgattgtggatgatgaaataaatactgctcttgtcagaccacttactcctggagttaaacttcatgcactgatagatgcttgtcacagtgggactgcacttgatttgcctttcctctgcagaatgaacaggttcgcttatcttgtgcaagctcttttttttttggcacttgaatgataagtacatggacttaacctaatggcaatcttattatcctatcttcactacaaactatgtttgcaagaaagatgctatttacttctgaaccaatttgatttgaatgccatgtttgtctgattatgtttcagctgatgatgatatgattttggagcttgctcaaatattctattgaaatgcagtttgaggacagcattcaattattttttttgtctcatgatgattatattctgtcatcctgctcaaatatttttactggaatgtaatttgagggtagagccagtgaactatgtttcttagtcaattatgtcaatacaagtagttaccctcttgggactgtcatttgttggaaacagttttggtgtggtactgttcaccatccgtttattttcacaacttactgctaatttgcccatagtatgtccatcaaaatgttgtttatcctaggacaggaatgtgctgtttagagactatgctgttttattcagttggttttgttttggattccttggttgtagtgtttactttacaaacatagatctgtagatcttatgatggaaatatgttcagctaatatccctggtcttctttggtacaggagtgggcaatatgtatgggaagatcatcgacctcgatctggtgtctggaagggcactagtggcggcgagtgtatttcatttagtggttgtgacgatgatcagacatctgcagatacttcagtaaatttttgaattcattccttctctgttagcatcctaggctgtcattccttattctcttcgaagttaatatatgcttaaaagatagctttggcaaggactctgattgcagatcatgcctgttctgttactgttctattggtcagttgtgttctattctgtttaacccaatttataggtattaacatttgattcatttgcacttgttccaatcaggctttgtcaaagatcacttcaactggcgctatgacattttgctttatccaagcaattgagcgtgggcagggcaccacctatgggagtatcctgacctccatgcgttcgacaatacgcagtacaggtgattcaatgggcagcggaggtggtgctgtaacatcgctaatcacaatgcttcttacaggaggcagcgttagtagtggcggcttgaagcaggtaaattctggagtttgacatattcctctctatctagtgattatttaaatcctatttccgtgggtacaatacaaaaacacacagaacatgttcttttggttgtatacaatttccattcccttttcagattgtcaacaatactaactgcttttctctaatctgcaggatccacagctaactgcaaacgagccattcgatgtgtatgcgaagcccttttctctatgacacgatcctggtattctccaccgcgtctatgattatatcactagtccccgtataaattatcatgatgtaaatttcactgttgaaagggctccatttcataaatagagctaacatgttgcatgtattgttgctcattacattgttcacgccctttggaatgtgatttgtaccttggtcacattgttccttgatcaagaccatattatgctcagtgcaatatgcacgggttaatgagattgtagcatatgtgtttctttctttctttctttcttttcgttctccttttcttctctcttgtccttagatttgaaaagtccggatgcaggttttggctgttgcgtcctgcttatatatgtcgtagtttgactctgtaaagtacgcgtgaaaggttgatttttcagggaaaagaagaaaaaaatccgcaggtttgatttggtcgccgtctgccggcccaatgtatccaacataaacctgcataaagttcaaacacaaaagttcaaaaacgtcggcccaatccttaccttattatctgctactttgaacaaatagaacccaaattgtttgctgctgcaaacgagctatttccttgcaaagttgcaaaattattctcagctaacaaagcttattacatggtgggcagtttacacataaaaagctgccaaattggagtacagtgctttgaaatatgacaaaaaaaacttatatggcctaaatatgaactagacatgatgcctgctcagttgctgactataaaactctgcaacctgcagactccccgcataatcatatatacacttccctttcccggtgcacgtagcaccgtacctatacacaataatggcggcgccacgaagctcgcctccatactacacgacggcggcggcggcggccgcctcggcctccggcgccgccctcttctcgaggaacccgacgtagaggtccgactgctcggtgtcgcagctgggcagcgccgcccgctcgccgccgtcggccatggccctgacgaacgacacgaactggcgccagttgtcgccgtcgaacagcttcttgttcatgcgcaggtacgtgaacgcgcccagcccggcgctcgccgcggtggccaccacctgcgcgaacgccgcctcgtcgtaccgctccagcgcgttctcgccggcgagccccacgcgcgccgcgcgcgccgcggaccgcacctgccgcaccagctgctccggcgagcacccggcgtgctccggctgctgctcgtcccgcatctccatgcacgtgaagttgagcaccgcgccgcgccgcgccagcatcgccgcgacgggcgcgtacccgtcgcggcgccgcgtgttgtagtaccccgccgtgagctccgcggcgtgcgaccgcgtccggtagtgccagtggatgccggcgaccttggccgagagcgcggcgccggtgccgcggaagacggcctcggcggcggccaggacgcggtcgccgtgctccagcagcatcccggagtaccacccgaggaagaagtcgccgtactcggtgcaccacgtgccgtctcgccggaagaaccccgtctcctccgggaactgcttgtactcgccggcgtcgtgcggcccgcccctcccccactcctcgtgccccgccgccgccgccgcctgctgcagcgacgccctcatgtactgcacaccaatcaaccaaaccattcaccgttaatcccactcacaaatcacatttcacccataatttgataatacttttgcgcgttcgcgaaaaaataatttggtaattccaatcacaaatcacatttcaccgataatttgataggttaacgtaaagaaagagtaccttgtcatagcattggaactcgccgatgccagggaaacgccatgttccattggcctcaggatacgaaggatacctcagctcaccacaaggccccaatcctacttggatctcctgcaatttttcacaacgaaatcaagatcaaacaaattgcttggatcgattaagcaaggatgtggatggagatcgatgcagggttaatggttaatcatattaccaattcgaaatcgctaaaaaaaactgtcgcaagtttttttttttgacaaaacaatttcaaatgcaactatagtatagttgtagtgtaattacaatgtaattaccacaatgtaattaccacgatggtgttgccgaggtagccgcagaatgtgtcgcggaagctgcgcatgtagtcggagtagacctggatgggcgtcctgcccttgagcaccggcagcgtgtcgcagccgagcgagatgtactccggattccgacgacccgacctgtccgtgtacacgatgtccgggttcgacttcatctcctccaacacccatcccggcaacgggatactgcatcaacatcagcaaaatcacatatgagcataaaccataaaacactaatcataattaatccaatgaaactgtcacagaaatcatatgaactgttagaactcgattttgatctctttgttgagttgattttggaattaattagtggtggcaaaagcaggtgtttgttggttagcagtagcccggttgcagttgggaggaatcttttgatccttttccttcttccaactcctgtgacagcttcgtatctgttgtgttctttagctatcgcttttacgctttttcccccttcctacttggataattttgattgcttattgcttcagaaaaatacacgtatattctttgcgtgcaagagaccaacaaagaatgaaaaacccctaaaataaaacattttttttctaatcaaataaaatctgaaccatttcctcaagataagcagatcatttggctatatatagaacatagaatagaaccaaactaaaaagtttttcctaatcaaataagctttcccttaagctaagcaaatacaatacaatctgaaacattttttttaagctaaccagatggatcatggattggctagaacagagaacaacagttgcagttgcagagcactctaggttaaatacgtgatccaaattttaagcccacagtatattctgattagttttctagtaggactcagtgtctttcttttattttctatatatacttttgtaagttgtacgagaaggtgtgaagttctcattgttcttcctctacgtttataatcaacgactctacggtaaacattgccggtcggcacctatggtttttttaccgaaagagttttccacgtaaaattcatgtctccgttgtacatctatttttataacactccgagtccaagaaattaagaacaaaaaaaatggaggaaattagtttaggaggtgaggttgggtaggcttacttgcaggagtcgccgacgttgccgccgcactggtggaaggacatgaccatctggaggcggaggccggcgcgctccaccatgcggacgagctcgccgtagccctcccagtcgtaccgccggggcccctcccgctccaccaccccccaccacacgtccaccatcaccccctccaccccgccgctccgcagcgccgccaggctcgccgccagcgcccgcgcccgcgccaccttcccccccgcccccaccgtctccagcggcagcatcacgtacaccgccgtccccttcccccgccgctgcccctgcccgcccccgcccccgtggtgcagcagcgtcgccgcctccggtgacgccatctcctccatcgtcgcgtgctccaccggcgccgccctggcgagccgcagcctgccgccgctccccggcgccggcatggggacgacgcagcacggcggcgcgtcctcgcgcttggaggacgggtcgagcggcgacaggaacgacgtggatgaacgcagcgtcaacgccatggacttgatctcgagctcgagcttctccggagaggaagataattaagtagataagaggtgcttaacaactaaccaagattgattcgatcggagatgaggaattgaattgaattgaattcaagaagagaagctttgatttctttcttgcttggatttgaagagaatgaaatgaatttgggagggaagagtcgctgcgggtatatatagaggaaatctcaactatgcgtgtgatggcgacgtgcttatcgtcacttaaccaagtgatcaatgctgattaggattgtaaagctaaactaataatctttcctcctctggcactctcacaagtaaagcaagtagtagcattgcatcagtatgcatgtgatttttgtatatatttttttctctctagtgtgcatgcttcctggttggagattatgggggaggattagatcagcagcaatggccttatccattatttttggaactaaaaagtaataaagatttcaattaatttttcgtcgttttgagcaggcacaagcagctgatcgttgagtgttgtatacgcttccattgctctgttgtactgagtactgtcaagtgacacctgttcaattacaagctacttctagataggtgggtaattatagaatcaaactaaggcgataatctctactaatccacgtagttagccagatggatcgagctgggtgagacggcgacaacgtagcggtcaaatcaaaggggtgcagtggaagaagattcagtacacgtacgcgtacgcttttacacttggctgcgaagagagagaagggagaacggataagtcttacgggtgaaacggggcgtgtaaacggaacggatatgtggacggcacgtcagcgaggatggaccaacgtgaggtgctgacgtggcaagcattgccatggaggacagtgcgcttgtgaggctgctggtgggccatggctgatgttggtgacatgacatgtgtgtgctagtagcgttttctagatcgagactccacaagaaatttgtgtggtctccgcttgttgctgggtttggtccgtcggaatttggagttggacaaaaatgcagtaaaaatgcgaggaatttaatttactgtggtggtatcatcttccggggtagttggtgtttggtgcgtggtcggtgtggagggtttgcgacttgtcggctaaaatccaaacttgggtgactcactgcggtgtctgcatttctcgtcgagatgggcgaatcagccgtcgtacacggatcgatcggcatccacccatgagaatcacgcacgctcctgtcggttaaccacacatcgatctgtcgtacttggtagtgtaacgtcctacttcctccatttcataatataaaactttctagcattatctatgttcgtatagatgatgttagcattttaacattataaaacagagggagtactgtagtagtagtatagtactccgtatatcgctaacgctaattatatattccgtcacttgcgaatctcgtgcttaacgcacggtcaactttcaatacgtacgattctcctttgcctgcatgacaatcaaacgggataaattactgacatatcctatgtggagcagcgtcacctcacgcgtgttaacatacggagtggtatggtagtaaacatgcaacgcatggtttaattagctaaatcgactgtacatagccttgtttagttccaaactttttcttcaaacttttaacttttccatcacataaaaattttcctacacataaattttaacttttccatcacatcgtttcaatttcaatcaaacttttaattttagcgtggattaaacacacccatagatagacaagtagaggagaatggtgtagcaaggtgaggtggtggtgacgcggccgcgtgtaggcaccaagtgaaacgcgtggacggcgtgccgcgcttatccgtctcgtccccagcatcatagtctccgccccacgttcacgggacgggacccagccgtgcgctttttcttggctgcttcttctaccgcgcacaggcacagcgcaggtggtgacctttttgctttttgggtccctcctccttccaagtttgtggctctcctttgcacgctctggctacttttgttgccatgtgtgatgtgtttgcctagtgcctattggtttggtttggtttctctcgtccctttcctcttgtgtcgtgtcgtgatgccgtgatggtttgttgttgtgcctgttgagaataaattgaagagaagaaaatcgatcaatgctcgctcgcccacaaattcgtcaagcatatgcttttgtgcgtgacagataaatagataattcggagcaattttgctacatattccctccattttataatgtaagttattctagcattgcccatatatagatgttgtatatgaatgtaggtaatgctagaacgacttacattataaaacggaggaagtatttatcaataaattttctcacaaaaatttgacatatgtaattatatatttataacaatgtagtgtaattgcattataatttgcatgtaactacttcctccgtcccacaatataagggattttgagtttttccgtcccacaatataagggattttgagtttttaattgtaacgtttgaccactcgtcttattcaaattttttttgtaaatataaaaaacgaaaagttgtgcttaaagtactgtaaataataaagtaaatcacaaataaaataaataataatttcaaaaaaattgaataagacgagtggtcaaacgttgcaaacaaaaactcaaaatcccttatattatgggacgaagggagtacaatgtaactttcatatagatttgaaccgttagatttatttcaagattcgtgcatgtgaggaaggaaaaaaaatcacaacgcatgcatatgtgatagcattcggtcaaactacctctatttcgaggaaatagcgtgttacggagagaattttaaaagttacattgttatatgcaaattatattataattatacaacgattatattataattacgtctgtcaaatttttaaaagaaaaattatcaacaacggtatagatagtcttctgcaacgtgaactctactgttgccaacgtatttgatatcgaagtaaagaacaggaacttgagctcagattttttttactctaaaagttcaggtgctgcaaattagaccttccaataggataaggacccattgattacctacgattgattataaactgtaacggtttattaataatagaaaataatttataaataaaacttatatatacttgttcttagataatattaaaagctaatgctaaaaaaaccctacgttaaagaaatatcaaaaccaacttcaaaattaaaatttaaaattcaaatttggacaacaacttataaatcataggaaaaaaaaccgtcggaacctgaaccgtccagctgtcccaagaaaaaggccttccatcctcagctcctcttgccttttttttttcagaaatatctctctcgcaataccctatattatttgatatttcctccttctgtatgaagtattcatacgcagcaatgcgtacagatgcagagcaccggtcggctttcagtttcagggaagtagccttggccttcacgggaccgcgagtatatatcgccatctttggcctttggtgttcttggcttcatctccctctcctccatagtaagtggaccaccggccggttgccggctacggagacgcatggatcgatccatcgaaacagcgagacgatgatatgtgtgatcgatcgatggatgcgtcttccaggagtggatcagcggatcgatctatctgatcctgaaatgttaattcctaatccatccacgtagctaggggtgcaagactgcaagttagggaacgacggtgaatgatggatggatggataaactacagataggaacacttggctgtcaagatcagacggcgtgtgcgtgcttatccaggtgaggttttgcttaaaaaaaatctagcttggtccaggggagagcaacatggtaacatggcatgtgatggaatctaccattttcttgtagtaccaaactgttccagaacacattgaaacaacccatctgcttgtaagagacaggtggagctgaattttgcccggccaagattttctgaagtgccccgcaaaaaaataaagattttctgaagtgcctagacgaactggttttcagttgtggagatcgatgatgtttcataaatgcgagtccacttagtactcaactaccgactttgaaatgcgaaacaattctttcattcaggctgtgtttgttccattcaaactttcaaaaattctatcacatcaaatgattagacatatgcatgaagtattaattatagacaaaaaaaatccaactacacagtttatatgtaaattacgagactgtcgagggaagtccctcgatagcgggaggtcgtgagacccttgaacggctgcccgttcaatcggatgtgaccggtaacaggccggtcacagactggtcacgtccgattgacgtgggtcagctaggcagcactgcacgtctgcccttaccgcattaaatgcggtgagggacagttggggcgctgcgcattgatggctgttcagcctgggcccccttcccactcactccccccgccacatggcagctgggcgagggcctcagggcaaggtagcgggagagcccgaggggcacgacgtggcaccccaaggccccccggccgcttctgtgactcacgatgtgcgggagtagggccaggctgtagagccacgcggctagatggaaaggtaactttccctcacttcgcataccccgggcccatatctccgacaaagacgaatattttgtgcctaattacgccatgatttaataagacgatgctatagtaaacatttgctaatgacaaattaattaggcttaatagatttgtctcgtagtttacatacaaaatctgtaatttattttgttattagtctatatttaatactttaaatgtatgtccgtatacttcaaaatttttttttgaaaaggagctaaacacggcctcagtcagactaaactgaacacaaataaaagaaaagacaactcatctattcattcaacgaaaaaatatgtcagtccaagtaagtcaatgaaaaagcttctcactccaatcagttagttaatctgttagttaatcttactaactagtaaatacaaggagctaaaaaccctacccctcttgattgaccaccatggtctgcagctcccagctcgtgtctttctttacccttccactttccttcatcctagtgatgaacgagcaatataaaactagctggaatcttcgaaagttatgtattggaaaagaagggagcacataccgtaggaacaagccttaagaaaaaaaaaacatgtaccaattttacaatttcattagtgcggacggttccttaagaaaacaaccagaatgacatttattcagtgctgcagaaccaggctatgcgcccaaccgcttacatgctttttatttagtgctgaataaaagtacaaccgattttacatgtacaaaatttacaaccccttttctgctggttgacaagcagacggattgtttggtacaagtgctcgacgtacaagctttgaccccaagggtctgacaaaggtagaagcagaatgatggattacaaatgggagcaaatgtaaacctgaaactctcatttcggacacatcttgcacgaaaatgctggatctgtcctgctcctgactcctttcttacacgcatgtatacgcacctatgttatgtacatcactttacatgtgtctagtgtctacactaatgcatggcatgtttgcctctcatctcaggacctctccaatgcttgctgggcataagactctgataccttcttaggttttagctcacactcttcttttggccgccgcatcgccatgaattgcagtgacttgctctgaacttggtaaacatagcatccccatgggtaggcatctgacgaagcccatacaatttgctcctcgtatactgcatcttccgcaaatctctcactaacacagaaggcagagtcgagagggggctcctcaaaagcagatacagccacgcatccgagagctacgtatccttcaggtggccgtggaaaccatattgatacaggattcctgtaatcctcaccacagtttctccaaacctattatgccaggaaaacaatgaacagaagtgcacatcccaactctagaaaatctatatgtaattaaataaaagagaccatataacattataatagctccctttttaaaatatatgacgtcgttaacacaaacgtttgacaatttgtcttgtttattttttttgatttgacgataaatcaagttacaataaaataaatgataattaaatactttttagttaagacgactggatctcaaaaggttaatggcgtcatatattataaacagagagagtatatttttctttgtttagaaatatatttttagcggaagctcaaaattaaataaagtaacaagggagaaaatatctcattaaacactgaccaggtcatagccaagtggcagagcgaaatttccacccacatttttgtagacagcagcaacatgtggtggatgaatgccaacatgagcaatatctccgattgagacatacctaaaattaagttgttaaatatttgcagcaatcatcaaaataggataactttattcgaaggaaagcataaaaacaggtaaattagagggacataagtctcatttcaacatttcatacccactagggcagagaggcctccagatactaaacacccttccatcatctgcaacctggaaccaaaaccacggtttattttaaacaacacatatcatgaatatagaagaacaaaagatcaggaagattatcttttaatcataaggtaaaagtagctaatttacctgctttgaaagtagtttgcatctgcttcgaatttcttgttcactgctccacatgttctggaagttaactgtatcgttaatgagtcgctcctcaacattacttgctgctccccttgggcttagcaaaggcctagcaaaactgtggaactccctcatatcttcatcaaatgcgaaatatacatcgtgctggcccccaggaacctattttggtttggatcagaagtatgagttcagttgtttttgttttttgtttttttgcaaaagcgcgcgcacgtgcgtgtgtgtgtgtgtgtgagagagagagaggaccttcaagggtacaactttcatatctgcctggtgagatctccacatctttcgaattgaagaacaaagtagaagagcctgaggttcatgctcctcatcaacgttgcactttataagccttacaaagttttcagatctcctaaaattcttcagatgtatgattacgtgagaaggcctttgatacccagcttttgccagctccaatgcaagcacatcttcccaaggaacgtcccaaagtattttcgaaggcttcttatccattttatctagatccacgcactacacaaaaagaacactgggatttagtaaaataaatagaagcagtttactatgagaatcagacagaaagaggcctcacctgaagcagtatcactcgtttgtttgttaccaaagcaaccttctgattttgtacgataaaatgatcttcatagtaatctgaccatgcatactttgaaggttcccgaaataaatctgtgcatgcaaaatatctgctagcctctgctaggtaaagggccatctggacaattgaatgctcaaattaagtgtatagcatcaacaatattcattgactgaagtaaaaccagtactatgaaacaaaaactatcgctccttgaaacagttatcagaaggctagcacataatgttaaccatcattttctactgcagcatacttgcagaacctactatgcaactgtttatcaagaaaaacaaatacatctgtcgtgggtggaggctacaggcctagtcggaactgttatgggctggcctaattcgcactatcatgtgctgcagccactcaataaggcggaaatgccactcacatggcaaaaagaaagacagaagtgatgtagcataaaggctactgttagatataaacatttaggagttgcattgtagacaactagaaggaatttgtactagagataagaagcacaatctactgcttaaaagttgttaagaggtagaagccagccttaaaaaggctgctggccagactaagaataacgaaacatgggatataaagttcttttaggtctcgtcttcccttaatgtctcttacatatctttttctcctccctaccaagcaccctcattctgatatatccataacaatatttttttgcgaggatttacataacacaattgacggtgaaaggaaactattttgaggtagaggtatttttagagcatcattttcaggaatagctgtaagtttcagcagaacagggtgttcaacatacttaagtggcaactctattactctgtgcaccatttcgcaaattttacatatctataatacaatttcttaaaaacaaataagggaaa

SEQ ID NO: 66341 - DNA, 17904 bp, Oryza sativa
  unsure (1)..(17904): unsure at all n locations
catggtagagtcagagagcaagttggagaagtgattgcatccttgaagtctttgtgcattttcatacccatctgttgaaaaagtgtggtaaaatgtcaaactccaacataattccgattctctcggatcgaagtactgcctccgtttttcaacatgacggagctagctatagatggtgagacttgccctacaagttaaattaaatagtattagtagcagtggagtacctgattagattacactacttaccaacgacgcatatacctctccaactaatcgacgacgcgtatatttgttgtagtctaacgcaaagattgtcacagtcgaacaatagggagacgcttgcatgtcaagatacatatggaccagttatttttaactcttcgagggagaagcagatacgtgcacactttgtgctttttatatgccctcctgagaagcacaatgagattatatactcagattaaacttttttttcttcaaccaaatatgcatggagaaaatacatgtgaaaaataatattattggtgtgtagaaataggttgcaaatctcgttgaagaaaacgaataatatacctcaactgttcttttttttggttttttttgggggggttgaggaaagggtgttaaattattttttcgtaggctgtatattattttctaaaaagtattaaagtttaaactttgaccattaagtaaaacatattcaaggtactttttctgaaactaaagcaattcaaggtactttttaatacactaaatgcacgaatctggctaattattgatcaaaccatacaacattaaactttcaaaataaaatatacattctcccatctattgccccatctggtgtactaatttgacacatgtcgactatgctaaaaggtagcctaaccatgtactcatctacatctatctatctatctatctatctatctatctatctattctttactaattagacactttgagagagaagtctaatgacccctcgcaaacaccctacttctatttttttccgctcacacggttttatttttttcttaattaagtttatatacacaaggtatatatatagaaacttttaaagtagaaacatcctttaaaagacatttaaatctgagtgatcatacatttaacataatatttgaatttcaatcttaaaataccagtaattatagtccatataatatcctcaagggttggcgactaacacgttgtaatcagcctgaagttatgcttgtggttgtttgggtcactcccttattttgccaaacttcaccaccctttctaggatataccacttccgtcccataattaatatagcaatctagtgtcagatatgacgcattctataactatgaatttggataggggcgtgctggatgtgacacatcttataactacgaatctggacatgcccctgtccagattcgtagttttaggatgtctcatccagtacaaaattgccatatatggtacatatggagtatatttgtttcactatcaaagttatggcataccatagtttttcaattcaaaggcccacatgtcttacacccatcttttagccaaaccttgtctaagaggtgtggccatcaatttatgaccacacctttggctaggttttgtaaggaggtgtggcaatgtttgggagtataatgctataccttaaatacccttgttaattctcacctacttcatttgtttcacattataagatgtttggattttgaatatagttatgcatggatccatatatgtgcttcatatatgtgtccaaattcgtatagatgttagtggatctaaacgagcgatggaaatgccaaaacgtcttataatatactccctctattcccaattgatcatcatctaacttttttggggttattcccaagtgatcatcatattattatcattacataagtctattcgttatctgtgtatgggagtaaataatattggtgcatgtatccctgcacataatattttacaaccaaagtgatgtcttggtttgttattagttagaaaatagtgagaattgtccacatgcatcgagtttgttaccaaagtaaatataagtatatgagagttatggatttttctttttttttttgatcttggtgcgctcctataatacgatgattaattggaaacggagggagtagtgcctagtactacttatactccctccatactcataaaggaagtcttttagaacaatgtttaagtcaaaccttgaaaatataaattatgaataactcttaagttgttgagtttaaaaatgtaaaaattatatatatagatttgtcttgaaaaatactttcataaaagtatacatatatcacttttcaataaatatttttatagaaataagaagtcaaagttgtattttggaaaccgtgtcactgtctttacgagtatggagggagtattatacttaattaactaatctctgattcctgtcaatctgatccaggggcatgacgtatcgcttagctcatcgcgaccggccggaccgatacgccgaagatcaatggtcccaaatccacgccctcaaacttagatcgaccggtccaaatcccgcaggtgcgcatgttcacgcacgccacgacgcatctgcacatggcccccaaacgcccagatcgatcaacgtacgggacggatcaatacacgcgcggacgcgcctcgtctcgaccggtggatcgacgacgtacgcgcgcgcccccccggctcggtcgttcaggagtccttttgtcgctgggggctgggctctatacactactatcatcatttctctcttccaagacactctacggtgacctcatatctaaaagtccctctctctcccaaatccatccccatctcacgcggtcacgcacgcgcgcgcacaccgcagccagcccagccgccaccccccgcgactcgatccatccgcgagagacgactgactgacaggcgatcaatcgtgctgccaagtagtagggtgttgtgcgtgttgcaggtggggcggtgtggtgtggtgtggtgtggtgggacgtcctcgcgatcgaatcaggttgccccatctccactccaccctcctcctcctcctccccctcctccacacgtacgcttttggccagccggtctaattccctctctctcatgcatctagctacctcctctctgtccctcctttgccttttcccccaaccctctcctctctcatctgtattctattgcgaaatagcttagggtattcgcaatcccccagtttgatagagttatatcgatcgaacgtcatacacaccataaatcacagatcgaatggaataatattaatcaaagtgtacgtgtatagtttgtttaccaactgattggatagctatagagctagctaaccgtgttgaaacgatgaacagtggttagtatatgtgtgcgtatacgtatttcgcagcggctacctgcacgtacatgcacgcacgcacaccctgcgcgcaccgtaccagccggggtctcgcgcgcgcggaggagaatgtaggtcatcctgccgcctttaatttaaaccccagccaaagtacacgcatttcgcgcaaccttctcctcgaccaatcgcttcgtcatgcatttcatatgcgtttggtgtacgggtcttccggttaatcgcaagtgtaggtgctttcttgcaacgcaagcctttggccatggactatactatagtagtagtacgtacgaccagcgctatagcagcagctaagctatattaacaccggccggtgtcatttctgacgtgtaaatgttaaccgtcaaattggtgtggtgtgtacgtgtggtggccggacgtccatatctcgatcgggagatgtacacgcagcaactcgcgcgcagagaatccggcgcctggtttgcggctcacgtatacggtttgcattagcaagcccagacttgagggccaagcaacaccgcatcattcgcccggatcgatcccctgcgttctatgattcgctctcgctgttcgcctagcttaattagctatggagtttgattgattgatttattgtcagtttatcatccgcgcgtgttgccgcacacctcgcgacgacgacacacatgacacatatccgtccatgcccatagctgtcaaacgctcattgttcagcctgttaatcgatcgctttagcctttcattttgatctcctagctagctgttgcacgtacgtcccctatagctagctcgatctctctctaatcctagtctcttgctccttttgtggagtgttctttctgtagttgttgcctgcactacacagctgatgcactgccggttctgcctctgcctgcctcgccagagagagagagagagagagagagagagagagagagagagagagagagagagatcagctcgtggcgatcttcctgggaagcgccaaccgaaaagttggtgtgagaattgatgtattctcctccggaaacacttttaatcacctaggtagatacacccatttgttgtatgtcaactaaatgtgtatgaaaaaaattcaaaaaaatttgacaagatagattcatatgtaatatatcaccccacaaatatgcaagttcaaattcaacttctataagttgtaacaaaaataacaaatcaaactctgattagtgtttagaatccaccttcattctcctccttggtctgtaccagatggagatagaaaatcagtagccgcgcgcagcagctgggccgggaaggcaggcagggaggattaggcgattagcagctagtaggagtagcttttaacagggacaagcttcctatagctcccctctcttttctctttgttctccctctcgtcgatcaggccgctttgttccctcctctcctcctttctctctccctcctcccgcgcgcggggtctcgccttaacgtttgccgcatatgggggcgacgagcaaagcgtaggccggagggagggacagggagagagagagagagaggctttctggctcgctctctctgcacgatctctcgtcttgttggattatacagccatgacatggtgcaacagcttcaacgacgtgcgcgccgtggagaacaacctggccaccgccgccgccgtggccgcggccaagaagcagcagcagcagcagcaggtctcccagcacgtcaacctcatcaagacctgcccctcctgcggccaccgcgcgcagtatgagcaggtagctagctagagcttcctccctgctcgatcgatcgatcggtctcctgtgtacatgttggatggcattgagcatggtgtagagtcagttgcaggcagcggcggcggcgacgatccaggacctgccggggctgccggccggggtgaagttcgacccgacggaccaggagctgctggagcacctggaagggaaggcgaggcctgacgcgcggaagctccaccccctcatcgacgagttcatccccaccatcgagggcgagaacggcatctgctacacccatcccgagaggcttccaggcacgtataatatacttacatgcatgcttttcctacgactcatcgacatatatcgaatcagttttagtttcatcagttcatgatctacataagtgcatttgtctcgatcagctagcttgcatgcttaattacattgtgccatcagctatagcaattgcaaagatgatcagatctggacgggacgtggaaactataggtgctgtccgtcacggaagtactcctgacaaaacattttcttgcttggttgattctcagtttaaaattccctattttgatataaagttttactggtcgtttccaatttgatgaccttgcttcatatatgtcaatcatgcgtagccgcttagtatttgtaacatccacactagggtatatacatgtcgatcgtccttgcgtttttcattaatttcgtgtatgtccgatcgtgtgttgttgcatttgagcacgataccgtataaatattgctaaagtttgcctttgaagtaattgcttctcctacttgcataaaagtttatttcacattgaaaacgagtgattgtgacagcacagtgcatcaaaggtccacgtcatgcaggatacacgcaacatcagatcaaagggagaataaactttgaaaagacttgttgcaatatgaactggtttttcccttatccttttatattcctagtatttaatttgcctatatataatggtgtatttgcatgggtaggatagtcattgtatatttgtgcaataaggctatgtttagtttgtgtgccaaattttttttgaactatacggacacacatttaaagtattaacgaagactaataacaaaacaaattacatttgaagtattaacgaagactaataacaaaacaaattacagattccgtctataaactgcgagacaattttattaagcctaattaattcattattagcaaatgtttactgtagcatcacattgttaaatcatggcataattaggctcaaaagattcgtctcgttatttacatgcaaactgtgaattggttttttttcatccacatttaatgctacatggatgtgtctaaacatttgatgtgacggaaaagttggaagtttaaagaaaaatttttgaatctaaacatggcctaagaataactgacagatactttaaattattatgagtgcctttcctgcttttggaaatataatattatattcttcaggggggttgcattccattccacaggataacttgtactattttctaccatagtgatagaaatattgcaccaagagacattatagtgcactgatcatattattttcatggaactctattttcatataagcagttatcaataataaaccacgtgtcaccattgtactatatattaatccagtagaaaatgatatattacaaatacttttatctagcaagaattaattatgattaaaaaaccaatgcaagtggctctttatgtcgtttacaacgcaaacattttttttctttgttggtgctggagctagcggccgttcgtggggtattctcatgggaatattggtgtggtagtctgttagacatatgcgtgttgagctggaaaacaatgtgcatgcaggggatgctccttccatggtacaaagtaattttctttacatttcatagattacagctgacctaaattaattctatctgtaagaaaataattaagccgacaaataaaaatgtgttatttagttcnnnnnnnnnnnnnnnnnnnnnatatacattttatttatattacaccaaatttacctagattcagtggctgagccaagatcaagatccacctcgcgcgaaatgcaaatattttttttactaatagtacttgattgcaaaaattctatcggggttaattgaccttacagggtcacagcatggctccactactatctacattatattataagtactccataatgtggataaggattttctgaagtttatcggtgagtaattctttaaattcaaagatagtttcacccttcagcgccatatctccactaaaccactttaaattcagtccgttgtataaaaagtaatctatttttgatagtttatggttaaataatgtatgaagattctaggattgtctatcacacttttataaaagtttaaggttgtagttaacatgcataatcttttcctttttttacaacctgggaaatttcatttctatgttaagagatgcaaaacacaaatacgcccccacctcctctttaaatataattttattcggtgaaactttaaagtttaaccatcaacatctctcaaatatgtatttaatttgaaaataaaaatcaaaagagcagtttttttaagtacttttacaatactaaatttttgttacacattattgttatactaatagaaaaaaaatagtcaaagctatacgaacgaataaagttggtagtgtaatactccctacctcagaataagtttatttttgtctctcccatttattttaaaataaatttatttttgaacactcattgcactagagtttgtgaaagtaaataatagatgcactggaatgtaggtaaaatgaggaataattgcattaagatttgataaagtgagggtatgtctttttgttttatattggtacatatgggatgagtgtaaaataaatttatttttggaacagagagaatatgtattgaaacaccgagcaagtatttttcttatgatggaaaggacgcaaaaaataactaaacaataacagttcagggggagagagatagaatcagagaattgctggagtcggcccaaaaccatcattaactgggcccattcgtcatatagtttgactgaatggtcttatgctgcgtcagccgtcagccgtcaggacattggaactggtcaactggatactacgattacgaagccactcttgttgtgttgctgacctgctgttgcatgcatgcacgtaatataattgattacatttgcatctcttaactcattcgtgagagcagtggcagtgtggcactctaccatattaaccgtactgttctctttctgccgctgttaatttcaggagtcggcaaggacggcctgatccggcacttcttccaccgcccgtcgaaggcgtacacgacggggacgcggaagcggcggaaggtgcacaccgacgagcagggcggcgagacgcggtggcacaagaccggcaagacgcggccggtgttcaccggcggcaagctgaaggggtacaagaagatcctggtgctctacaccaactacggcaagcagcgcaagccggagaagaccaactgggtgatgcaccagtaccacctgggctccgacgaggaggagaaggacggcgagctcgtcgtgtccaaggtgttctaccagacgcagccgaggcagtgcggcggcggctcggcagcgacggccaaggacctctccgtcgacctcgtcgccggtaacaacatcaaggctagcaatgctgctgctgaacaccaccataacgacggcgtcggcggcggcggccacggtggcaacaacagcagcatgctgaaggaagctgcaggcattgtagatttctacaacccagcggcggcgctaatcggctacagccaggcggctcctaacaacagggcggctgcttctgctcatttgacgatgcctaactttgaggtgcacacaggaggtgcaggctttggcccctgatggatggaagaaaacaaagcaaattaaacatatttgactgatgatatatataggttagatggagagggcagggcaggtatatgatggcaaatgtgcatcatgcatgctagcatggtgtaatttgcatcgagtgaaaaaaaaggagtttactaaaccgtctacgtacgtattactggacaataaggagtgtgtcgagtgagttgctgcacagatgttgaagcgtaggggggtcgatattcttacagtgttcattattgttacatgtgtacacatatataacttgacattctcaatttttttgtttaatgatatatatatatatatatatatatatatatatatatatatatatatatatatatatatatgttgttctatacaaaaataatgttggaattcaatattgtacattgatcgcttaaatataaggacttgctttttcataaatataaaaaaaatgttatgcatgtgtaaagtatcatttttcttattatttagctagacaactagtaagaatatcccagcccaaacaataattctctattgaatttttttcttagtttgacaatctatgtataggtataggaagtaatattttagtatctagtttattaagaaacaaattaacccacaaattcaagacgataaaaagatccacattcttccacctgacagttaaaaccaacatttcccaccagccaagtgagcccaggtgagctaggctcatgatcagagtagtcactgtgggagtgtgttgcaatcggtctcatcgtctttctcgtttgtaccaacaacatcgccctcactgtcagagtcatcgtttcgatcgctagtttccgtcccctgacttagctagaggaccaggttatcttcctcttgttccgtaagctgtgggagcaaagtttcttggaataaatgaggtatcgtgccatcgtcgtgttctgttccctccatattagaatataataagcattttagagttagacacggttattaaaaaaatatatagaattgaatggtggagggttgtgattggttgagtagtggaggtaggtgagaaaagtgaatatagaagagtgttgtgattggttgggaatagaatgatggtggagaagagggctaaaagttgttatattttagaatggagggagtagattttatggtgaccatgtagaaccctccccagtaaatcattattactttgtacttatattgcatttgcatcctcaagcatttattttgcatcctcctcaagcaacactagtttctatgaaaaaggtttttatgtataaaatttctatgccaacttttatgtataaagttcctattgtatactgaatgttgctattaagaagtttcatgtaccaagttttttaatttttagctgggctaaatgtcaaatgagctcagaactctgcgtacgcactcttgtaacccgttgtgggcctaataggcttgaagtgaggccggcacatgggctagacacgtttgcaggccattgacacaacatcccctgccgtatctgcctctcgctcccacgtcttgaacacggcgctaaacttgatccagccttcgatgacaagtggaccaccaaatatatcaaaagagtaaattgcgttggcggtacaaaaacttggcaggtgggtacgattaggtgcaaaaacttgaaaaccaaacgtatactactagaaaaacgatttttcatggcgtcgccctataattttcgctggtggccgtacgcgaaaaccgccagcaaaaatgtaacgagtgatggggggctacggaccgccagcaaaagtatattttccctggcggccacgctaagagatccgccataaaaaaactctatttttcgaggcggagcacttaagcgtccgccaagaaaaatcgtgttttcactagcggctactaacacctccgccagaaaaatcgtgtcttatctccacccactgcgtctcctctgtccttgtcacgccccgaactagtcccgaccggaactagcccgtgacgctccaaattaacctgttaatcgataccagtcccaggaaacagtgctggtatcacagggagacagagtatcacagcaacagaggtctctttattaaagagtagaagtatagtcatgttgggctgcggacagatcccgagctcacaactgcattacaaaaggaaagcggaagccaggacttggaccaatcatcacaggcacgacttgggaactaggccgaaaccctaaaactcatcgtagccgacttgctcctggaagaactcctcgtcagcaggatccacttcatcttcttcagcaactggggggggattatttatatagagcaagggtgagtacgggagtactcagcaagccaggggaaataagtgtttaatgcaggcttcaaggaaaggctgttatttttgcaatttattttatttgaactcttttctaaaatgattaggtgagtgcttctcaaacgactcggatgagacagtgcgtctcgtccggtcggagtatgtgcaatgtgtcactctttaggattgcaacaaggttggcacccggccaacagcttttcaaacggccacccgggccaacaacttttcaaacggccacccgggccaacaacttttcaaacggccacccgggcctagctgatcccgtcagctgctgatttttcaaacatcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcattttgaaagccgatacaggtttaccatatgccaacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttatcttatgtttggatgaaattccaaggaaatcggtccttaagtgcgagagcgggaaaccgtacacccggtacgttccccggtccgcggttctggaaattcatttagttcgcaagcaccgacccaggtgtcgggttttccaaatctttcgtaaaacccaagttttacccaagttgttattcagattataagtttgaaggcgtccgtcgatactcgcacaggatgcacgaatatcaagacgcaactaggtggttacaaggggacatgctgtaacaattaacaaggaaaggatcaaatgcaacaatttaggtaggtccgccaatctgccttgcagacggaacaatagattaagtgcgatcctatcaatgcataatattttgcaagcaatataattagatttcaaatataggctcaagatgttcaaaggtggcttgccttgctcgagatctggagcttgatcctcgaaatcctcgcactgcgggtcttcgggctccggaactacacgcgaaacggaacaactcaacaaacggcgaaaataaagccctattaatgacctctaagcgtgccattagatagatctcgagatttgaggaattttggaagttgaacggagtcaaacggatttacgggtgggaagatattgaatttctaagattattggatttttggtctaacggaaaaaggatttaattaaatcctttttggaaaagaaaaagaaaagaaaggagggagggaatatagacttttctcgggtggctagggtgcggcccaagagatttggggcagctcggccgagcttaacggaccggccggcccaagacggcccaagcgcgcgcgcgcgggagggaggagagagagggagccggtggaccgggctcaccacgcgtggtcccgggtgggacccgcttgtcagcggctcggctcaccgtgcggagggtgcgcacggcgcacgcgcgcgggcggggttgggacgcggtgcacgcgcgcggctcgcggtggacgcggatgcggcgggcccacgcgcagcctcacggctcgcggtggaacgcgcgcacggggagggaccgaccggggtgggctcgacccggtctaggctgagctggcgccgacgtggcgcctacgtggctgccacgcgggccggcgggaggtagacgacgacccggccgcgaatggacggcgggtggcggcggcgagcagcggagcgaaccacggtgatacaggcaaaagcgagcacaccgggcggctgcacgtgacaaggggagacgagccaacggctcggattcgtcggaggttgctcgacggcggcggattgcggcggcggcaaccggcggcgggagaagagggaaacggcgacgaggtcacgagaggtcgattcccggcggtgagagcatctacgcggcgtcgggaactcgacgctagcgtcggattgggcggaactacgccgagcgaggccggcgacgagcgggtgctacggagctcgggcggcgacggcggcgagcacacggcgagcgacggcaacagtcggggcggcgccggctaactacggggaggctactcgagctactaccgaaatctaaggggaggagatggagcgaggaggaagaacggagggaggcactaccgtgcgggacggggcgctgtgacgagaggccgacggcgcgggagtaatctctccggcctcgggccggggaagaggaaggagagggcgcggccggagtcctcttccgcgtccttgctcgtgccggctcctccgacacgcgcaacgacgatcggcgacggcgaaacagagggcggcaatggcgcggaggcgaaaatgagagagtttggagggggagggcttgggcttaaatgggcggcaatgtcggtttgggcgagggaaaccgacattgaacggtcaaggcgcgagctggcgctcggcgcttgcagccaaagcggcggcaggaggatgacgccggcgaggaggaaaaagggaaaaaggagggggagaaaggggcttgcccctttgccgattcgggaaaaaggggaaggggagcgggagcgtcgcggcagagggaggaggggcgcggctccgtcccttggcggcttgcgcgcggagtggcgggggccgggcgatgacgacgacgatgacggggggacggcttggagcggagcggcgacattggcgacaggcgcgtgcagaggctgacggcggcggcgaccgggcggtcgaccattcggcacgcgcgcgcggcttgcaacgggcggcgtccgcgcgggcgcgcgcacgcgaacacggcgcgcgggaagcggcagcgagggagcggtgagggaggacttggctcggcgcgggcggcttacgcgtgctggctcgcggggccgagcggaggggcgcagggcgcggctctcgcgctcgcgcgcggcgcgcgagggaggggcgctcggcgcggcgacacgcgctcgcgcgcgcggcgcggggcggagcggagggagagagggagagagcgggggcgcgccggggaaagcgagagagagagccgggagagagaggggaagatgggccgagggaaaatcggcccatcgaccctgggggaggcaaaatggacttttgcggaggaatttgatttggagggattggattcggaattgaactcgacgatagatcggggattgagatcttgagatggcacggacactagacaacaagcaaagaaacaaatttcgcaattagggtttttaagagataattttcccgctaggcgccacgacggaacgggcgctacagtcctctccacccacctctccctctcctcttctctccacccacctctccctctcctcccccttcactccccactagcagcggcgacgagcccagcagcagcagcacgcggatcgaggcggcgcccgtgcgtcgcgatgcggcggcgctcgtgcagctcacggcggcggtgcccgaggcggctcgcggcggatccggcgacgggaccagatccggagcggaggagcacacggatcgaggcggcgcacctcccaggtctctctctgccaccaccacacactctctctctcagatctggcgcacgggccacgatggaggctgcggcacggctctgtagcggcggtggcgaggtggaggcggtggattttttttaagaacaacggatgaatttttttggtattttattgtgatttgtgaatggatgtgttaatttgtggtgattttgtgatttgtgaattaatctgttgaatgtattatgagatttggggtgaatttgtgatgtgtgaatggattgggatggttgatgccatactgtagccacgtgctaatgattcaaatttttgtgatgctcatgcttgggtggatggagctttgatggaggtggaggcggacggagcgttcgctccgttcgtcgttttttcttataaacttggtcagtattttctctggcggctggtatagtgtaaccgtcagaaaaaaaaacattttcgctggctgccgtcttaaaccagtcgccagcgaaaatggatttttgctgacggctggcttaaggcggccgccagcgaaaatgttttttcgcttgtggtcgataaccgctagcgaagatcttgattttcactggcctttgctttgtggcggctccaaattccgccagcgaaaacccaaaatagccaccacgaaagatggttttcgtagtagtggtagcggtacaataacttggctggctaggtgggtgcactcatggtgcaaaagtagccacgtaaaagaaattgccaccttactattccaccttagcaaaattgccacatcagctttgacatgaaagaactatctcatttcatagaaaacccctaatagcttttttttttccaatcacattcctttttaactcaataaacaaaacaaacgtatgcatatcttcttccatctttcttgacgtgatcctaattgagaggtagctgcggtggtggcggtggcggtggccgcgacagcaacgacaacgagcgaaaccattacatcgcggtggcgatgagggctccgtgtgtcacattagttcaatccctaaaccaataaccaaaccaattcaagtcgataaattgctgctgtcgacgtgatcgccgcaagctttgggatagctccgactcgacgagtttttggagcatatgctcctagcttgttatggtaaatcacttgctgatggttgtagacttctattttttgttcatttgatggatgattgcaaagtaaaggtttcattgatctatacaatggctgtattttttttgggttttcacttgaatatcatattatttgttattacaattcaatgaagtgatctaatggtactagccacgagattggttgcactaaaattattggtgtttcctgtagctgtatacgatataagagtaacattggcaatgagaaattcttgctagatgtgttgtaccattatcagcagcatatagttagttggataatctgcaaataatcttagtgtattattttccttatgcggtatatcacatcaaccaattattttgtagtgcaggccatgagaaagaagaattcacaattgaactgcatcatggtgggtttttctttttttggagttggcagtagtagaatttatttggatgagaagatggactggtttgatcattgcgacacgaggaaaacagatacatctaaaaaagaagtaattgaaatataaaagttactagggacttttctgtaaaatgataaggtcaatgctcatgtgtcactttcgctgaggtggaacaatggcgtggcaacttttgcaccatgagcgcacccacctagccaagttattgtactgctatactcggcttttaagtttttgcacctaattgtatccacctgccaagttcttatacagccaacgcaaattactcatatcaaaatgtgcgtgggaagtgtccgactccggtccaatccatgatgcatgaggtagatgagtgcgtatgtcacacaaattaggggctagttggccacataatcacatatccgaagcgcgaaatgcacacgctttatccgatatcaaaccaactgtaacagatggcagaggatttgcttcctagttcccaactcccaagtggccaacacgaaacatctttgaaggagaacttcagaaaaactccccgcgtcgctctcgcgcgggcggctcggggggccaaaaaccctagccgcccacgcctccactccttccccctcacctcgccgctgccggagctcgccggcggcgtgtaaggaaggcggcggcgaggcttctctccttcgtggtgttcccctcctcggcgcgacgtggacggggcaccatccctcaccagcgcggtcagaggcggtggcgcggctcgggcgaggcggccacggcggcgaggcgtggggaggcggcggatccggcgcccccaaggccgaatccggccacccctcgcctagatctggcgcgccggcggcgcgacgcggcttgaggcggcgcggcggcgtgcggctacagctcggtcggcctggctcgagcgcggaggcggagggcaactgcggctcaccggcggtggctctgcagggacggcccgagcgcggaggcggcgggcgcctggggcagcgtggtgcggctagcccgggcgcggaggcggcgggca

SEQ ID NO: 66342 - DNA, 9292 bp, Oryza sativa
gggaggcgctcgctggccatctgcgcgtggggaggggctcgccggccgtccgcgagcgggggagaggctcgccggccgtccgcgcgtggggagaggttcgccgaccatctgcccgcgggggaggggctcgccaaccgtctgcgcgcgggggaggggctggagctcgccggtggtagggagcggcggcgaaggggaagaagggaagagaaagagagagaagggagtgagggaggaggaaggaggactgacatgtgggccccacatgtcaatgggcccatatttctttttgtgtgaatgactaataggtcccacgtatattttttatttctaccgtcacgtagatgccacgtcaacgccacgtgtaacaaagactcggtcaatattaccacgtaggcgccacgtggcgccacgtcagcaaaaccatctcccaaaaccgctcagggagtcaaattgcaccggttttagaagtttgggggttgagatatctggttttgtagtttagaatcatggtttagatttcaattatatttgagggtcatggagtgaacttattccccgcctgatagctcgcgtcgcgtgtcccgaggcacgcgcgtgcgcaccgccgcacagggcctgtttctcagatgtgcgcgaggaggagcggtgctgtgtacttgtgtgtgctgatcgcgattatattgcgttgaaagaattgttagaagaggataacactactactacagtagtcaatcgtggtagtcatgcactacactgaagtgactgatcactgttgcttgcatgattggattgactatttagatgccgagtagtaattcggatatctcatcgaaccaggttacaaaatgcatgagagcaagttgtttaatagtatagccaaatactggctccaaatcaactgtagtcaatttaatagtcaatttatacaatagtaatatataaacatatacacaatagtaatatataaacgtataccacactattagtttatggtcccacatgtcatacatatatttcgtcttggagcccgtgctgcaactggctacaaatctgtagcccactgctcatctctatcttctttcatctactcgatatgtgtttatagctggcatatagcctactattgtatctgctcactaccacacttgagaactaccctgtgggctgttatattttctatgggttccgcaaccaacccacaggaatatgtatttttgtgatggttctacttatccctacagaataattcatttttctggcggtgcggccctacaggtaaatgagactaaggagaagagagagataaccctaacattcgcccatcccccagaagacttcggcattttcttccccaccgctgccaccctcccatcctccgccccctcactggatctcgcccacgacggcctccgctcgctgactcaagggagcatccaccttcgccgcacctcctcgccctaacgccagggagcagcgtcggccacctccccgcgcctcgtcgccccgacgtaaggaagaagcgccgacacctctcttgcccttgtcaggtgaggagcaccatccccgcgcggccgcgcccctcgtcgtctggctttggccggatccactctcccttcatcttatgtccgttcgggcgggcaagcgtgaacccaccgagtatgcggcgcagctcggacgcatcagatctggcagcccctggcacaggcggtgccagatccgtctacgagggccgaggagagtgggcgatgcctccttccccctcctcgatgtccattgcctcatcctcatcttgaaagataagcttttttttttctccaaattcttgttatcctgccatggcttcagatccgtgctccccaccgtagtggctacagattgggaataggctttccgatctagtgactagagatattgggttcgacttgctaagatccggtgatgcctttgctttattataactagccgggtggcccgcgcaattgcgcggctagcacccaaacaaatcatatattttttaatatgattttacttataatttattaaatagccatctcattgtcttaagactttgaaagaccaaatcttatcatccccgtgtttctaattatatagttttttaaaagtcacaccagttgctaccccttatgtcatcttcttctttatttgcttgctcgatctaccactatttctattcattctccttggaacctttaaaaattggatcttatagtttttagagtttattatcacgttgggtttcgtttttataatttctagacatccagttaaacattgccattatactcctctatggctcgtccactgtctcttctatttattgtcattgagatttttaaaatcgaatataattatcgtttagattcatttttactttctagaagtcccgccaaaccgtcagcggctttgccattgtacttctctacggctcgcccgttgcctcccttttttattgtcattgagattttaaaatcgaacatgattatcattattttttttactttttagaagttctgaacctttaaaaattgaacattatagtttttagagtttattgtcttgttgggttttattttttataatttttagaagtctcgtcaaacgatgccactatgctcctctatggcatgtccgccgtctactctttattgtcattgtgattctaaaaatcgaacataactatcgttgggattcattttttattttctagaagtctcatcaaccatcggcggctttgtaactatactcctatataccccacccgctgcttctcctttttattgtcattgagattttaaaaattaaatatgattatcgatggggtttattttttttactttttggaagtcccgtcaaccgccttactcgtttgcttcacggcctgcctgtcgtccctccttttaatcatcattaggattttatttggtgttttattaacagtttttatatgtcgtatcaaccaccaccacgctactcctttataggcctgttacttaatttatctcgtcatgtgttttagatggtcttttctttcaatagtctttatttttatcacaaatttttgttatttataaattgtattcctaactgaaatcttatttttctttttctaattcagaatttatttttttcaaattttaattaatatcgtattgtgttcttttaatttttttattttttattttcaatttcagttgttttaaaattttattcctacttgaactctcttttagtttttctaattttagatattattatatttttttattctgaattttaattaatctcgtattgggttcttatatggattcttcttttaatattgcttatttttaatttcaaattttagctaattttaaattgtattcctacttgaactcttcttttttttcctaatttcgggttttatttttatttttatcctcaattttaattaatctcgtattgggttcttatatggactcttcttttaatattccttatttttaattccgaatttcacctatttaaaaattgtattcctatttggactatccttttcttttttaaattttagattttattttatttttattttgaattttgattaatctcgtattgggttcttatgttgaaacttcttatgtggtgtctcctttcaaagttgttttaataatatcatagattttagtagtcaaagctttgtcattaaaattatgcattagttcctatatctccttatttctcatcttatttttcgtggctaatttattgtctgtagctagttgcacaaatatctcctcgtttaagtctggttagtgtccagcacaagttgctcatttttctcgattggttgaagcatctacttgagtcgaatgttgcattaaactagttagtttgctcataaccgatttgttgtgcaattttgagatggaatctgaagtgatttggggtttgaggggagtacaacgtaggtgatacatatgcttgactttgtcttgtggacttatttaactactgcaaactatttttttttcacttggcatgctcttttttgccaatttgctaacgccattgctgtccttgaaggtccttagcgtgagcaggcttggcgtggcctaagcctttattcctcttctgacagaatcacaaactgaggtaaatcacaaattaattcatggtacattctacttgtatactgcatcattgctaatcaattaggaaaaagaacagaagtggttgatcctaatgacaatgcagttactgaagctgttgtgaaatatggcattaaactagttaatttgctcatgaactgattttttgtgaaatgttgagatggagtctgaagtccaatgttggggttcaagggttgttctatgtactggtgaagtggtgacacatatgcttggccttatcttgtggacttatttaactactgcaacagattttttttctcttgccatgctattttttgccaatttactaacgtcactgctatctatagtatgcactgaactgaagctgttgatgcaccatatattaatgtactgcttgtttctagaggtagcacagtgtacttcaatgtttttgtgactcgggaaaatttatgcatgtcagaattgtcttcagaatttctcaattgacacatcctaaaatacttaatgccttatttttcttgttcctctgaatatgtcagtgaaggatatatagtttgtgcaaagcctgttgcttaaaagccccctcctcaatatgtagcatttcaaagacatacaaaagatgataaaatagctagagcttaaatgcttggaagagggataagttatctgcatttgctgtttcatctacttgtattattggtactggaagttgtaactcccataactcgtaacttacagtggtgataaaagattcttgttgaatgtaaattggttataaacttataagttacagggctgaaagtttgcttgtattttgatggatgaatttgtgtgcatgtgaattgctgtgtatatatatataggaaacaactccattgctataatgtgttgagaaagtattgttcagtaatccatattgacatatgaactgcattgttggttttttttttctgccttgaagttaatttttctgacggttctacctttgtttttctgacggttccacgtcaaaattatggggacaaaaacgtgacggcagtggattttttctgtgttcctccatcagaaaaatacccacagaaattgtttttctgtagggaaaccgtcaggaaaatggaatttttccgtggtgatttttctgtcggcaatttctgtcgattcacccacaggaaaataatttctgacgggaaaactatttttctgacggtttcgctcctacagggtaggtcccaaatctggtagtggctctgataccgctatattcgaagggcgtacccagccttagctaaatcttatgctacttggagttctagaacaaacagaaaaggtgctgaaattaatttgaagagagagtggcacagcgcaaaaagcctgaaaggccaaaatgatagccacattcgctgcatggccaacttaattggttagggccacgtaatcagcttgggaaccactgaaacccatttgacagggcaccagtcattacggtctcctggttttcctctcttccctatctccctaggacgacggcggtagacatagagaaggacgacggccaacggtagaggagctaggcaatggcggtgggcctcgatggcatctcggagaggggcgatgtggagggagctcaacttggacctcttatcacgtctggtgagagatgactcagagtaagccctcttcagcaactagagggtaaaaaaaagaggaggaaacaacgagcagccggcggcaaagtacatccgttgcgctccccatcgccgttgccgccactgcgaactttgatttcccaagtccctctgccctgatcctcctttgcgccctctcgagctcgtcgccatctcactcatagccgttagtggcgccaacagtctttcaagcggatcttagcagacgaagcgcatgcagatgacgactgaccatccccattgattccccttatcgttgtcagcatgcaacctcctcacgcgcggctagatgaggttgctcacgagctgcgatgtgactcccaaccccgcgtgacggcataacatccgatgaacacccagacaacgagaaggccaccatggctagttcgttacgctctatcgccgcaacagtccatgtcctcccttttcatccccttcccctacctcctcctttatgatatcctttcctttttttggcgccgttgtccctgagccttccctatagccactgccctggagagatggtgaagaaatggggaagaatgtaagggccctgacataggtttcatgtggtctcacggccattttgactacagtcaactcaccatgtgagtgaaaatcggtcaaaatactgtcctgcgacctcgggtactctggttgtaagttgtgggatatgttatatctggtattaccattcaattacacgatgcaaactcgaagttaaaatgagggaccaaaagtgcacttattccgctgaagtgctgaacattggaccgatctcctttgtgcgtcctaaccgatccaacggctgcccacgcacacgtacgagtaacccagttttatttcggcccaactggtgcccaagtgcccgaccgcgcgtaggtttgctattgccgccgcggatagctctcgtggccgccacggaacgaggtccgcgcgctcgcgattgggctggcagatggatgcctggaagcgttggaagtgggctcatatattaggagaggaacatacaagtcaatagtggtaggcatgcacactgaagactgaactgactgatctgaactgttgcttgcatgattggattggttgtttagataggagtacttggataccttaatcaaatcatactacaacatgcatatggtactagagttctagagtactctctgtatttattttgcgatggagggagtagaaagcaaaggtgttgagattttctttagaagagagagtgccacaacaatgtcttactttttttttcagattattcattggattatcaaaacggattatttggtatatacttttaaaaagaatatgttttctacaaactttttctactatattgcttagatcactcgttttaacttttaaactctttttaatttatttttaaaaatattttggttaccccttaaaacccatcgcaataagctgcaaaataatctgaaaagtacggggtgggtttgaaagtttatactttggaatggcaaccacattgctgcatggccatcttgaggagagataaagactcaaagtattctttccatgaggttctacctcatgttaaatttcctctaatattcacatgggaagaggcatttcataggattccataggatttattcttttgattcaaaaggctatataggaaaaaaaaatcatataggaatgaaattccctaaaatttttatgaatttcctttcaatcaaaaggggtctaagtttgctagccaacaatgagatggctagctactcatagacttactttgtacggcaaacataaccaaaaataccataattagaaccatctcgatctaagctctagcgagctacttcaaacctttcgccactagcgcgcagcatgtcgttcttgttgctttcctttcgtagcccttgggctacggtttactttcccgggttatacggctcatcagagttagcagtggggcataatccacaaactgccttgttgatcgtcgaaatcacaaagaaacacgcaaaattctggcgtggcggccgcggggaaccgtactgcatgccggcaatacggcgaagaagcaccggccccagtaccgtgtggatgcacggcatcatacggtacgaccgaccccgccgggggctgcgctgatgaaagatgcgcttaaaccgggggggagcagtatcagcatcagcagaacgtgacaccccggtcccgcgcgtcatagtcgatccaaaagccccccatgatcctctcgccagagcctggcaccgggccccacatatatcgcccgcccaatcgagcggggccccgaaaagtatcaggcacaggagacgcgatgcgttcgctgatctgaaaaagataaaaaggaccaacgtacgcatgcaaccgcgcggaggagaggaggcgagcgtgcagcggggcagagctaaacacgaacgaaagcccggtggtggcgagttggcgactgagcgcccgtgtacgtcgctggattccccgacttgtcaccgttgcaggcttgatgtcccccgctgcgttcgcccgacggcgggggccgtccgcacattaaccgcttgtgtaagtgagctttatgcgcggtcgtcggaagctagctagcaaacaatgccttgactgttgggggcgctttgggagcagctggcgcgcgcgtggggtcttctccggcgaagcagagcggacaacgtgtggagttcccaggagagatcgagcgagacgccgagacggacacggtcacgcagctttgctgctgatgtgggggcttcgttcactgcgtgcactcggtccgtggaacagtggattagataagaggctccgacgcgagctgatcggacaacggcgtccggctctccgaaaggccggctggagtggagtggagtacaggagggttcagcacagcgccaggccggcttaaacatgaattctgtgagaaaattttgtcatcgatcttcatctcatctctttaaacgtgtattaagagtagttatacctacgggtgtttgctgcacaggcaatgaggtgtatgtgtgtgcatctttctcgaaaaatataaatgtactcgtgctgattttaaatataccatgtaagttgtttagacttgtgttgtgtatatgaattgagaaaacaacttgcttactccttgtttttacatttctgagatttacgagggggatactaacatagtaacatttagagtatatttcattttgaaccacttttaataaccactggtagagaaaccatctttggtcggtcgacctatatccacaatagtcccggttccattaaaaaccgggactaaaaatgatttttagtcccggttaataagaggaagatctttagtcccggttgttgttaccaaccgggactaaaaatcatctttactcccggttgattccatgtcaggctgtgtcagggccctatgatctttagtcccggttagtaacaccaaccgggact

SEQ ID NO: 66343 - DNA, 702 bp, Oryza sativa
aaaattcagtactgatcttaatgcaaatgaagggtctaaattacatctacttattgcataatttttcaaagagtaaacttctcattttctttcccttgcattaatttattgggctaggcatatgatgtgttaatctgttacctgccccaatgttcgggctgaccattttgagacattattctgtactgaacttcaaaccgagctctgcacattattagttttgatagcattgaccataaacaaatgtaggggacattggatgaactatgaacgtagcttagatttaatgattttcccaaactaatatccacaacctgaggccataacaggataaaccccgccaggaggatactagggaagagatgtagatttagactagggaagaagaacattgagggagagcttagattaactttgattcattattcattgcttaaccctgaatcaggatacaattcatccgcatatagatagagggaaggaccagtctaacatttaatccatgtacctatctaacagtctctaaccaactgagctacattacggttataagttatgggttgaattaccgtattactgttacaggtgaggtgaggatagggttactcgaccggtactggttgttatcctttgagccttagcctctcggcccaatgacactaatcactaattttgattcaagattacagaccttctatattg

SEQ ID NO: 66344 - DNA, 598 bp, Oryza sativa
attcctgcagcccaaaagaaattaagtaaatcaagacatgcctgagggacaacatctagaaagaggtctgtcatatacatagaagccgattgatggaataggtgcagtttccattcaccccaccatctgtcaaatgctttgctcctgaaggttgctagctctatgttgtcaatgctgcctagagggggtccttggagattaagcagccgatccatcattaaggttgatgaaatttcccctcggcactggatcttatcggcaaagaataagccgattgggagttggcccattcctagttgtctgattgtgctcattgggtgataaaactcataagaaacctggatgtttcttccttgatgaatgccaacagggaggatacatggactgattacagctgagaagatttctctgggtttctgatatctttcgtgattgatattttcgaacctaaagtccaatggattctccagaagtgttgaatcttcgtagaggaaccaaactcgagtgtctttttggaaaccctcataaaaactacagaaccagtccttgagcagctcggccgataactttgctcctgcatcggctggtgtggaggcat

SEQ ID NO: 66345 - DNA, 2930 bp, Oryza sativa
tgtctccaaggcttcggctacgaactgccagttggttgtagggccacagcttgatccacaaaagaggaatttttctagccacattagcagaaaagctacatgttctcgaggagtgacagaaccttggcccatatatgctgctacatagcctgaccaaccgcctatgctcttggtcctgaagtcatattggttcttcgtgttcaagctcatagggttagccgatgaggtgatgtccagacccgtaatcattatgatatctataagagttggagtcatcggcccttgattgaacaagaaggcattgatggtgttggaccaaaaataggaggcagctgccattaggggctcgtctttagctgagttgcctatggtgagatcaagtgcttggccgattccgatttcatcccaatgaactcttttgctagccaacatgcgcttgaaccatgtgatccaacttttctcaggtgaggttttctcgagagatggccaggatttgaaagtgtttctccagtgacctaaatctgggttggtcagtctgaaaggaatcctataggtttcaccaataacgaactcggtgggatcagggttgccaactgggccgagaaagtactaattttcgtgcgacaggttgggaattgcaactaggttggaaagatgctgcaaatccaaaagaaccaagaaggggaaaacaagatgaggtgttggaagatcggtctgatgctgagaaaggggatctagtcgatgggaacttacctagcgtactcagctgacggtgcggcagacgagctggcggaagaagacatcgtcgcgggtggagatctagccggagatgaagtcgcctggggatcgccttgtgcatcggagaaatcgccggagaagaagaggacaaggttggctttggcggtgaaaacggaagtaacgggataaagatttttcagggcggcggttagtatttaaagcattgaggataatggtcggaaaacggcggagtgcgaaacttgctcggagtcgatatgaggcaaatccgaaacattaccgaatattctggacttggggggcatgtgttaacgaccaaatttggtaatatcagtatcggagatgaagattagattgaagcggggtcgaagatgaagattgtcgcgaaaacagagtaagaatcggctgaagtccggattggctatgattggatcggctgagttggagtcagacttggttaggtgatgtacccgattccaacaatacgacttggtgtacgacatcgggttgggttgaggtgcttcaagatgattgccacgcatggatagagtcctgggaaggcaattgtatctattaattaggacattttatgtaatttccttaaagatatgtttgggcaaaagtctgccgtaaagacttgtggtatcttagagtttgttagagataatagtcgtgtccggtatggacatatcttataattctcgggtataaatagaccccgagccctatgtaattaaacacacacacgttcaatacaatttcagcgcatcgccacctttttgctttagttttatttcgacgagttcttgctttcgggttgagctgcatcagtttcgatcttcaacaagaggtaaaacttgttatgatggcttgtgttatcgggattagtgcttccatctttatgatactctaatcttgtttacgtaattcgtcgagttatcatatatcgtacataatctctggcaatatcactatctaacctacaatcggctaacatatgttagtagagggcagccgattaggttagattttgatgttgatttagattatataagatatccaccactctatgaaacttccagcggcttgattgtctagatattgttcttcctttcatacttaatgctgcatcagttgagtttgatctattaagtcgtgcttagaatatcaatctctagcctgccttctggttgccgattagggtagtatcggagtttcagccgatcttatctgatttaaccatattcgctctatatgcttcagtgacatgttaaatccgccatttatgtcaagatcttattgcatttaagtatattaagcttttgtttgatatattatacttgttttaatatcctgatatatagtagtatcggagtattagccgatacatgctcgatctatatgatcggctatgctataaacatatatagtcctgttattaatatatatttcgatccaagtgatttatactgtctcggcacggcgaccgatctatcccaatcacttgatttaaatatatatcgatataagaactatatattggtaatatctacagccgattgagtaggtttagttctttattatctatttatagtcgccgatcgattcacatatgacatcggctcaaagataaatgatatgtcatcggcacttagccgatcggctatcatttatatatttaactgcgatctctttgtttctattttttgttgattgcaggatcaaattaactggcacgttaacacacccgaaggcgagctttagacctgcactggagttaagcagatctcccaagcctcatgttttacgtcaacaccggtcagccgcaaccgcacacactcatcgtgcaccgctaggtacaccacaatccctggcatcaacttctcattgatgccctttgcagcctcgtagatgtccctgcgcaccagcacccttgtatcctgaggggctcatagatggagacgccgcaaaatgagctctacttcaccatatgtattcgttcagtttaagctcttcttcttcttcttcttcttcttcgtcttcttcttctctctctctctctctcttcttcttcttcttcttcttcttcttcttcttcttcttcttcttcttcttctttttcttcttcttcttcttcttcttcttaatatgttcaagagctcgagaagaagaat

SEQ ID NO: 66346 - DNA, 1866 bp, Oryza sativa
cttacacgtggcctccatgtgtttttttttaatttcgttgatgattacgctgctacatggataccatgtcagtgaaaaccactctcaaacacagtgaaaggagtcattttacatggctttaatggttgaaggataggaattagatttgaccaatagtttaagaagtccaatggatcagctcatgtgctggccgtttccccttcccccttgttaagatgtttgcagcctgttttccccttctgccttgttaacatgtgcgcagcgtggtggctaattggcgcgtgcgccacctggcaccacctcccccgcgcaattttttcgctttttcttttttttttgcaatttttttcgatttccttttttgcttttttctgattttttttaatcttcagcacacgtgtcttcaaatgttttgagttgaaagtttttaaatcttgactagaaagttttcaaatcttaacttaaaaattttcacatctggacttgaaagttttcaatctcaactttaaagttttcaaatctcgagttgaaagtttttcaaatatcgagttaaattttttcaaacctaagttgaaagtttttaaaatttgtcttacaaattttaaaattcgagttgaaaattttcaatgtttgagttgaaagttttcaaaattttatttcaaagtttaaatcttaagtcgaaagtttttaaatctaacatggaagttttcaatatgtcagtaaaaaagaatcttacaagaaaagagaattcttaacttaattaccatcattatctaaaactaatttagttagttaggccaaaatgctcccggaaactggtgacgcgcgcgaaaaaaaagagaggaaaatcgagagagaaaaaacgtacatgaaaaagagacatacgcgatacggacatgggtaccgtcatcctaagatgagtgccaactacttcctctatcctataaaagaacaacatctggctatatgtacagatttgtagctagatgttagcttttttttttttttgacagagggacaaattagttctgtcggtgtttatatgccttcattttggaccgtttgaagtcaacctcaatcattttcgagcccagcaagtaacattggggaaaaatattttaactgtacgcgtagaaactttatacatgtaaaaatattccgtgtataattttttacgagcaagataggtatttctgtccagcaagaaattctgggccgacacgtggtaaacctctttatggtatgtccagcaagataggtattaggtatttctcagctctgggccggtttaatgaaagtcaaagagcaatttcttaggtttggttcttttagatgtggcaatgggacaaacataagattttgggaagacacgtggttgggatcgcgtgctttcaaagatcaataccctacattatataatgtggctcgaaagaagcagtctactgtggcagaggtcatgagcacaacgctgctaaatatctcttttagaagagctattgttggccaaaagctaatcgagtggaacgatttgatcctcaggctagctaatataagtctatcaaatgaaaaggactgttttgtatagtcgctccataaaaatggtcaattttccgtcaaatctatgtatgctgcgatcatgaattgtaatgttcggatcaaaaagagaattctgtgggacttgaaaattccactaaagatcaaggtctttatgtggtttcttcacaggaaagtaattctaacgaaagataacctggctaaaagaaaatgggggggcaaacattgttctttctgctatgcacaagagacaatccaacatcttttctttgagcgtcatgtcgctcagtttgtttggagatgtgtgttttt

SEQ ID NO: 66347 - DNA, 1541 bp, Oryza sativa
attcctgcagccctgattctaattggagctagcgctgtatattggtcaatttgacgttgtcgcaatgataaagtttttaatggtaaacaattatctaaccctatgcaggttatcttcatgtcttcctactggctccacttctagtctacaatgctaccacaggaggagcaggatactatacgcaatggtgctacacttttggaatcggtagccaatggtctcttattccactatgggtggcgtagttctataagaattgctagctaaaatattttatgtgatttaacgctagtcaataataaaggggagttgaggatttgtcccatcaccttatttctcattttgatttacttttatcttacatttttattactattaaacttatggctgtgtgtcttatgacagaagccagagatataattcatttccattattaaaaaataaacttttatgagccagcgctaataatagaaaggagtcgtgccatataactcacctgattcacaagccaaaactagaaaaggaaatcaaaaagtgctcccaaccaattcagtcagatacatcgcgtacctttcacattataagatgttttgggtaaatagattcatatatatatatacacacacacttactttgtatatgtgtccaaattcgtatttatattagtgaatctagactaaagatgaaggaattttatagtatggaatggaggagccaaaacgtaatggaaaaaaaatacttttttccaatccaaggattcaaaagctctagaaaaaactcatggaaaagctaaattcatcgagattgctagtaataggccgtattgacgctactggcgcatacttttttttaagtccattagtaaatttgtcaattgggacctccagaaaatttggttggtagattccatatgctagaaaattaggaaaattctatactactggttattctacttctggagataccaatctcagagtacttctggaggcccagcacatcttacttctagaacggtcggcccagcccatcagagacaccaatcccggcacggactccgactccgactccaattcgcactccgaaactgacgccgcttcgtcgtctcccagccagcgcttgcgtaattagtacgtctcggctccgtttacgagccgagcccaactcggactcgggatttctacgcgtgaccgcgccccatataaacgcggccatcccccgcccggagtctttcaccattcttaccccgacgcggcgtctcctcccctctcctctccccttccctccatcgcatctcctcccgctccttcgatcccaaatcggccgccgccgccgctccgccatgtccccctcccgccccgacgaggcggaccccgccgccgacttcggctcccaccccaccgaccaagagctcgtcaccaaatacctacgccgccacgtcgactccggcgggaacccgtggcggtacgtccacgaggccgacgtgtacgccgccgatcccgacgacctcaccggcaagtactccccggccgtcgccagcgacg

SEQ ID NO: 66348 - DNA, 1337 bp, Oryza sativa
gccccacctcccaccgccacgaaatccaagacggaggaggctacaccacctcccgatgacgtgaaaccggtggtggcggctgcgcagactcccgacaccaaaatactcagggcggcgaaggaggcggccgcgactggatgcaagaggaaggccgacgtgaagagctctggtgcaagaaggggcaagcggctctgctcccgctgccgggcggagacatcggaatcggacagcgagacggcggtacttgacaggtcgccgtccatcgaagacgaaacggcggactcttcagaaatccatggaagcagtgatggcaaattcatcaggttcttgtgatttagttcgatctggagccccgagggtgctagcctagattggaatcagcgtgtaccaacaaaatggatagagctgctgtagttctcattttgagttcttaagccctagtataatgcctaccccaaatcatgcgttacccgcaaatttcagcatgatacagacaaggtaagcatttattttcagtatcagttgcaccgtatggtgcacttgtagatagaagttactacagcatggagaaatttggagattaacatatagacattagacattttctttcatgtaatatagtagtagaacacacaagaggttcaagcttgaatgattagaaaagcttcttgccatattatccaccatcagttcatgtgtcatgatggataatttttgaactgactaggatttagagaaataagcggacaagagcccgacttgaccttcaatgcaaagaaaagagggggcaacgcacaattgcacgatctgaaaggaacaaattacagacatacaatgcacaggtctgatgaacacattaaactacacagacattgagatatttgggatacttgcgatgaacaattccaaagctgctagatcagttgcctttctcgtccggacgaaggttaatcttatctgctctgccctgactgctctattgatcttggagctgcaaacagatggatgtatttcagatcaaaagcacaactgctagccaaaggtacttcttaatgaagtacacacacatgctgttcaaaatcaggcaaattcattgcgagtggtgtaaagtgttatttgcagagggactccagctaccatcacaataattggcttagatttatgcttcactaagtcagacaagagctaaattatccatacatgaaagcatcatctgagctatataatgtggtactagaaagcagatcttgggctccatccattacagctaacactgatttcttagtttgcgaattaaatttccagtgaagcattcagttcaattgcaggcatattcc

SEQ ID NO: 66349 - DNA, 1701 bp, Oryza sativa
attcctgcagccctaagcaaccacgcactaatgcatttatatacagaaaactgcataacacttgggtcaataatgcttcagttcagctgcttaaatctgcctttaaaacttatggtttatgtacatacctctggttcaaagagtggcaatgtgatgctaggattatgtgtgtaatgtggggcaccatagatagtactgctgcttggtgatctggttgcaatataatgcaatgggaaaatattcagtattaattagagctcggtcacaaaaaacataatgcaaatgaattgtaataatatatcttgtaaggttactgaaactgatctagctgatcatatatgtgtgtgctacctcatgatgggagtttggaattcaccgtatcgtacgtctcctcgttctccatatgccatctacacatgataaagtcggcataacataagagatttttctcagcatgaagttcacacgcatggaaatggaacactgattggtagttatatatataattcatacagtactagctagtgactactactgctagtagacggcaagcacccaaccagatgatttttgaaaaaaaatcatcacgtatactggttcttataattgaaatagtaggaaacgttttcttgagaaactttacagacaaaaagagaacatgatgatggacaagtaacaaataacaaataatgaagaggaaaaattatacatgcgcgtatatgtagagctaacgaaaacagtgcagcaaagatcaaacataaacatgtttttcagggaaaacaaaaacaaaacaaaattaacgagggctaattttctcgcactagtaacttcttatgtagttgagcccaaaaataaaatctcctgtttttactgaacaaattaagaagaaacaattttctcccatgtgtggcacatagttattagtacatgaaaccgcaagtcatccaaagaaaaattcactaaaactttcgctcatatgtgatagctatctctcaattttttagatgccaaattcttcctgaaacaattagtatacatgcagaactcagagaagtttgtccatgtaccgcaagatttggatggattgggaacggagacgagctaacggcggtagcatggaagggagacgatggggacgacgacagcgaggatgtggacgcccgtgcatcctcctgctcgatcgatccatgccaaaaaccacaagaaattagaaacgcctaattctctctagaatggccacacaggaaagacgaaatagatgcatatactctatgttagcagcatatgtatatgcatcgatcccttgacttaccaagttaaggctgccggttctgtggatcaagcttcccggctggccaagagggttgaagtactcggccatttcgctctgtaacctgatcttctccagctgcgccaccccgagccctcgttgcggctgcttcggcttatccgcgccgccactgccgccgcctctcttgcccttcctggaggagccggccggcgacgacctcccgctgttgccccatcccatgctgtctccaaagttgctcccactcatgtccaagaagaagaagacctagctagcttgccaggaggaagacttggaaggacaagatgaacaagctagaaggggaggacaaggaagggaagagagagagagagagagagagagagagagagagagagagagaggagagtgat

SEQ ID NO: 66350 - DNA, 11241 bp, Oryza sativa
tggaatttttttttctcactggatcattcgaatcggccgtggtcggaagcaccgcctttttcctccacgctagatgcttagtgcgcgaggaagtccaacagctggcatcaaccatgctcaatctaacagctccgtgctccaggccatctcgcctccacgggaccatggttccgcccttgtctctttctccctgagatcgaactccactactgccgccctccaacatgctcctgcagccaccctcgagttcgctcccgcagccacaatagaccgtgccagctgccgctgctgagttcatcgactacaccatcctacacctcgcctaccgctgtgccatggaggatgaagaagacgtaggggcaagggggaataagtgacggaagttctaacggagtgttaaaagaagtaacggagatcacttttgatgctattgaagtgaaccacaaactttcgatgctataaaaacaaaaacaagaactttcgatgctatagaaccaattttaccttatttatatgattcatgttatgacagtatgatacttgtgtgtttgtcagtatatctgattgtctgtacagatgcatggatcacatacatattattttgcctttgacccttgatacctctttcatttatcagctttgcacctcaatatcacggctgatgttgtttcacttccttgtagatgttgacactgctggaagccgcaataaaacgggaccacctatcttcagaatttgaaacaacatctgagttgcttaacttgaacacacaagataatccatcccagaatcatgttggattgtctggatctgctgctgtacttccatgggttcctgacactactgctgcgattgcactacgaatgttagacctagactcagcagtatcatacatgcaaaatcaaaagatggagagaaatggtggagatttcatggtaagttttcatgttagacctcaaagtttctgtgctctggtaatcatatgtactagatgttgtagtttgtctgttaacttctccggctactgcatttatacaattaaaccatgaaatgttgtcatatgttagagattatgatttatttgtacattctgcactttgttgtttgtaatgctaccatcagtttcctttcagtttgtaaattgtttcctctgtttgtgcagaagcctccatcaaggtttgtggctgttaagaatgcacaagaattagatccactggaaacaaccggtttagacctttttgatggaaggtgggctactggtagtggccgtaggggtcgtggacgaggaagtagagggggtagcaggggaggcagaggccgaagtcgaggtggaagggtcccaagaggtattagcatctcatctaggattggatttaaggatgaaaatgaagcctcaaggaagaacactcgtcgagggcgtactcgtggccgtggtcgtgggcgaggacgtcgaactgttaggtcacggcaaccatctgagggcaaaggcagatcaattcccaaggaaaatttgttggggagctttagcatgcttagcaatgcaaaggctgccactgttgaggagtctccaaggagctcaggtgctgatgaatggggcttggagaacagaaggccatatattgatggtgatgagaacagttctggatctcagttagatcaatcagaagataatgaggaaaatggccaacccatggatgaggaatatgatgagcaggttccagattattctagaggctattctggtggctcaggccccatggcatgatagatgatgatgtgagcgaagaagaggatgaagatgtggagggcgatgatgatggggaggaagatgatgcggaccgtgcagttgatgatgttgatgctgagatggacgaggatgatgatataggtgatgatggtgaggatggtggtgacggtggtgacggtgtggaggcgaatgctgatgaagatgaaggcggttcctcgtattcatcggagtacagcgactaagattggccagtagaggccttagcgtcctatgccgttatccctaaatttccaatagatgtctgaatcaagtactgttagtgggcattacttgcccttgtggttaaaatgctagacgcggaccagaggtctgtgtgatagataggcatgtagtactgatgttcagtactgcatgcttcttttgattttcggcgtagccgagctgcccaaacaaccgggtagtgtgaagctgtactttgctggtttaaggtgttgggattgatgcgtacaatgtgccaaggcaaagtaccaagtttacctgaatggttgcctttacatattgttacaaaatctcttgcttcgttacatctattattatatgctttaggtactggactgctgggtatacgcttggagaagcctacggctacgcgcatcatgcgaagtcatgtgatggaggaagattttgcctgtaattaagtgaaggtagggaggcgcgaaggcgaagctaatgatttagcaatcaataggttgtgcaagaaatgaaattttagtcatctgttattcttttacgggtggcaatggtgcaatcatttgttctgtcgatacgaggttagatgctggacgtacagattttttttttctgtgcttaatttgtctgcatttctgcattggacaaatccagctggagtagcgttgacaggaaaatcaatgaagaaatgtgttgggaggagaggcaaccagttccctgcgacgtcggatatatagactggagtttctaggcatgtacctaaggaatatatttagaaaatactcatacatgatatgctttgaagtatgcacatgtaatgtaaaaaaaaaaccctaatccatcggatatataggtagggtttgtctatttttaggacatagtagtacctaattatcctagtgtcgatggaaaaaaacaagcactgggagttctgcttagctccagtgcaggtccaaagaattgctttcgagttttgagcgtgctatttggtttgatcctgcaaccaacaagaaaccaaagatgaaacaaagttaaatctataaacaacagccgatcggctgggttgccgatgacgtatcgttcagtattaagccgatgtaacgtgccgtcagaaaaaaccatgggattagattgaacgatttaaaggtgctgataacgtggattaatatggagcaagctttataggagtaaatactctagtgggtaccaactatataggaaataggaaggagggataagtgactaaaaaaaggttcttttataatccacgagaccacgatgatgattcggtgaaaaagctgaaaagaatctgaaaacatatttgtttatttcttgtgagaaaaatgttttcaatgtagtactatatatatacctccacattactttttactaggaaaacatatttgtttatttcttatgagaaaaaagttttcaatgtactatatatatacctccacattactatttactagtaaaaaaacgtgaatattaggaaatgacctagtatcaaataattagaagggaggaggctttaaacccagaccgactagcccaccaccttgtggagctagaacaaagacccctagacgtttctctactatttactagtacatacttaaaaaatgatcacttattttgaaatgaattttgaatgcaagttattttgtaatggagagagtgcttgacaccattgatatatgttgttttaactttgactataaaaatcatatttgatgtacacaaatcaggtggttacatttagcatgtaacgtaccttagtggttaatttattaaaaaatttgatagatttgttgcagtactataaataaatatatccgtcaaaatctgaatagaaataacagctggtggcaaatgtttgggaacaaaggtgctactaagcaaaagcaacttctgttgcccaatgatgacgagaattagagctactcctgcacaaccacccgtacaacgattgatgcgtttcatcatacaacaactattataggacaaagaccgttttgagtcgtcatattaatataataatccaatctggtaaggttgaacccatcagattagggtagctgaaaaatcgatcaagtcaaggtcctgtccagagaagaagttattcaaacgctctaagcaacctttaatcctttttaagtaataccctgcgcgtcgtttgcgcataccggccaacctgctcggctcaatttggttgttggctctctctcgaaccaaaagcttaacgaattctcgcgtttcggatcggatgccgccgcgacgaaccggccttctaaaaaccgtgccgtgttacgtcccacggcggcgccagcgacacaagcaggtgaaggacgacagaggacagacgccacgcagaaaaacgcgcgtttgcggccatttcccgtggatttctcccgtgcgccgcgggggtcccgcgcggccgccccactgaccgaccccacgcccccccacccaaagtacccaaccggccagccaacccccctcgcccgccgtccgctcgaccgaatcgccgcgccgagccgtcgtttccacaccaaaaaagaaacgaaagggctcccccacgcgaggcaatcggggcacggctccacctccaccccaaccccgcaagcgcaagcgatcccccccacgaaccgaaaccaaccacacgcgcaacgcgcacccgcacccgcccgcacggccgcgcccgcgtcaccaccgctaccgcccgcgcgtccctccaccccacccacgcggtttcccgcgggacgcgatcaccgcgacacgcacgacgtccaccgacaaccggggcccgcgcgcgcgcgtgccccacccgtcattggcgtggcgtgtggtatgggaggagaggccggagcccgcctgccgtttggtggcacgcccggcgctgactcggacggcggccggtggagcgaaaagagagagaaaaaaaaaggaaaggaaaaataaaaaaaatcccacggcgcgcaccatttcttcccacccgctgctgcttcctcgcctttccgataagaagcttcgccgtctcctcctcctctttcccttcctccgccgctccatcaaaaaatctccacaaggcttaagcagagggagggtgagggattagaaacaaacaacccttcggagaaaatcacgagaggcttcccgagggcaaagtctccgattcattcaggtccgactcgatcggcgatccgacgaagctcgagcaggtgagggagacggactcggactcggagcacggaaccggtatattagggaggctgaagagggagcttgagagggggtctagccttaagctcgaacgcggggtggtggttgtaccagcagcagcagggaatcatggactcggagcactggatctcgagcctcgccgccgccaagcggttctacgcggcgcagctcggtcacgtcgacggtatgcggccatctcgacttttccctcgaatctttgtttggctttctgctgttgctgttgctgatttgtgatttgattcgttggattgggcgcgcagatatggcggggattggaatggaggaggtggagatggagatggaggatgatggcgagggcatggagctggagctggagatgcagctggaggaggcgacgtggccggacgtggcctgcccctactgctacgaggaccacgacatcgcgtccctctgcgcccacctcgaggaggaccacccctacgagccccacacctcggtgagctcctcgccgccatgccctgcgccgcagggctccttgctctgacgctctgatgacatgacgcacaaagtctggcaaagctgctccttttgttcgattagtaggaacgctgtagctttaggggttgacttggcgaatgaactcaatatttgggctacttgtggagttgcggtagtagcaaacttgcggggtatcttcttgaaatagccaaaattcttgagatgatagtattatgcaaagctcctctagccttgagttcttgcctctctatggcttggcttgcaatagtttgtgagcaaagaggtagaatctttggtatctgtatagtatcagtcaactacggagcataagcttatggattcagaacttggctgaaaacactagcgatttggaccgggaaattgtgattttgtgattcgtaggtagggaagttgtgttgtagttttaagggcaaggataattatatatttcttataagaactgtagattatgcttgactgaaggttttaaatcagtagccagcattgttcacttctgtagttgactgctctagcttgtagttgtgtgttctatttcaaggcctacttctgtaaacaaggtagctaatttcctttttatttgattgccactatagtacttatgtcactgcgccgactgtgcaccctactcttggtggacagctgctcagttgtcataaactaaatgttcatgaataccatgacttaaaaacgtaatcctctgttattcatctaacttcagcaacaggagttgattttgcaatggcacaaaataacctagaaaagttaatgatggtaatgtgatttagatttaaaagactcgaactgttgtgtggggtccatttttaagatttggattcattttattctagtgaaacagaggtgtttgagaatgccatatatatacttttaatgttataatctcgtctgaagttcgagatgttaactgcagaaatcctagaatctgaaataaccattgtgcttatttgaatctttcgctaagtttagtatcaaataagcacattgggttcaaagtatattaaatcagcaccttatgttcatatattgtgcatataaaatgtgcattgtgttcttctcctgatttatttgctttgctttgctttcagccctgtcccatctgcttcgaaaagattacaagagatatgttaaatcatatcaccatgcaacatggttacttgttcaaggttaatctccttccatacctattctgttgcacaagcatatgctaattctttgataaattttcttaattatttaggaatgttctgattcctttttcaaaattatttgtgatgtacagagtggtcgcaggatgcgcagattcgatattcccgagagccaggcactttctttactgagccgagatctgcgggatgctcagttacaggcacttctaggaggtggtcatcgtcagcgaagaagcaacactactgccacaaacatttctgctgatcctctgctttcttcgtttggcctgggcttctcaacattggattcagaggaacgatcaaaagcaccagttcctattcctgatgatacatcaattcataaggatactcctgctcagccatgggaatcaaggtatatatatttacactgctcagccgaatcacattagtggcctgatattcttccacctaaaaccccactactaacagcattacttcaagaatcatcctagtttgtctggaaagcatagcaaacactattgagtattagccaattagttcccatgtcctgccatgctctatgatttatttttcagctagcactttcacaaactgttcacagttaccttcttgtctgagacaggtactgtcaattttgttacatatgtcagaaagactatcaaccaccagttaaacagttgtgtccttgtgattttttagactgttcactagctgtacgcttttacatttgatgaaaacagtccatattatgtcaatgaattgttaagtagctctaagattgaccatattcacaactataaaggtctacataatacttgccgtttcccctagcattcagatggtcagaccaattaggtaaagtagagcattcaggtctatatatgtgctcagttagtatgtttcaaaccagcagcttataaactccttaagagatatgcaaatatgaaatatttattttttccatggcaggatcgactcatcgctcacgagtgaggaaagggaacaaaagcggaaacaagccactgacagagcaacctttgtgcaaggcctggtgctctccactttatttgaagactgactgttcaagtagccctagtttttcttgctagatgcatgtttcctctcgctggttcccataaaagcgcaatgttccacctgatttggtgaatctgatttcgtcaacagtgagatggatgtgcttctggtgccccgttgttctttcgcttcagtaaagcgcgaagttgatttgggcatgatacacaccttaatttatgtcagctgccctgtaccattgctttttatgaattaacgggtagccacaccttgactgtaactcgttgttgtacctctccatactgtctaggaacattggtttgtacaaacataaaagctgttacatgttgtacaatgcaaaggcaaatgcagaagcaccgtttatatcgaatcaactcagcaaaaatgtctccagggttagcaattgggcagatactgatgtgaaacacacaaaaatgctgtgcttggagtcttgggaccgagtctctactttcttttcatgatctgcccttgcgattccgcaatagcgttgctctttgtgtggacgacggctgccgcggaattccgcgctgactgacccggcctgcaacgtggatgaccaaggatatgcgcatatcgtactcagatcacatctcgtactttatagagtaggcaaaatcatcgaagtgccaaattgtcttggttatctgcatctgcatctcaagtgcttagaggtaaaattccattcgagaactgtaaccttatcacttgtgagtgcacctgtgagagctaatgccgttacctgtgtcaaaaggctcagtttagctccgtgggcgccctcaggttcaagttcaaccctgcgaaggtagcataaaataacagagatcgctggattgcattattgtgcttcgagggttagtggatagcaaatgatgtcgatgggcagaaggaaattataacttccgctgtcaatcgttgcagcggcggatagcctcaatcagtacgaaatttaaaatagcacgaaataactaaaaaaactcgttccagtggtgaaacgagcatcttaccaatctagttgctgaaaaacgaggaaaatataaggcaatgacttgagaagaggaaacgacagctccgcacacgcataattgtgaacacgagcggcggggcaagcccaagatttagttatacgtgtcactgtcagaaaaccgcggttttcgggattttgaggttttaacccggcttattgacaaaatttatccaaatttcaccagtttttcatgaaaaccgacaaaatacctcggaagaggtttacgataacggtacgttgtataaaacctgcgcagcatagccatcagcgggaacaaaacacattgaccagatagatgtagaaccattcggattcagcatgctgatgctcgaacgagccaacaaatggcatttctaatgacagttgggagtacaaaattactatctcaccacaatgaaggtgtatgtgcaggtatgcgcaaacagcaaacaataaactttacaacaaaaagggcagccacctcaagagatctacgcacggcataagcaggtgcattcacgataaagtttgtacagctctgtttcgctacaaaatttctaataagctaccaaatctcgaaccatgaatataaaccaaattgacaacccattcgatcgactgtatcatctctaccatagaaatccatgtgtaaattgagttaagaagaatcaagataaagagtcctgtacatagaactagcatccatctaatctaaactgggaagcctgtatgaacctgcggagcaatctcaattttagtttaagtttaaacagcatttggtaaaactatttgaccatgagcaatctatgtaacataccttgagaagggcagcgttccaatagaataccatcaaggcaggtcattttcagaaaaggaagatgaatccagctgaaagaaaaaattgcaaatgttcatgatcattgctaggggacatgatataacttgaaagctagcaaaagcactagcaatagagagttaaaaaaaatgcaacagaggtgctaaaggcaacattaaaaactgacagattgcataaatgatccttgacaaacaagcagtaacaaaccagcttttatcgtgataagcctcacatcttaaattggagcaatacaagaaaatttatctcaaaatgaatttatcctccaggcagtgaagtgttggcacttaattccatttatcacatatgttccaggttgagtgcccataaaagtagtgatcaactttcttaatttggaaacaaccaattaaaaaaaacaatttgctaataaccaagcatcaagccaacaagtttggacatcagtacatcgtaatatgtgcaacgtttcgtgtgagtttgccagtagtatcgactcaaatgtatggaaagtatgaaagacagcttaataaaactgaaaagtgaacacactcgcaagtgaaaatcatttaataaccctattagcttataagctgcatgttagagaacacgtccaattcaatcaaatgttcaaacagaactaacaggactaaaacataataactgagattgtaataaccaatgaatggagaataatgggataaggagcctcaagatgtaaatggttatcaatcagtttcagacatttaatgagctgaccttagggatggattatgtaccacatatcatacctcaaactccatgtgatttttttccagtaatgatttgggaaatatgtagtcccctactaaatgcttcattgaacaggatcctcgtctgcatctcctggagtccaggcagccatgacaacacagctactggtgccataacaattactccaaacattatatcatataggcgtgccaaagtaaccacacttctccagaccatctcagacctcctcagataaggcttgaataccagagcaatagatatgattccccagccagtcggaagaaaagccaaaaggctggtaaaggtatcaatgaattggaactttgtgaattctaacaacagaacaatagcagccaccgttgcaccaacaataatagcctggacaagccggtaacgtatgtgcttctttgctgaatatttgtcgcgaaagtaagcaactgtcacaagagccacaaaagccagcaggacacatgcccaggaaagaaggtagacaaggatgcttttgcttgtaccggcaatgtgtagccgataaacaattgcatattgaaagaagaaaaaccgaaggtccaat

SEQ ID NO: 66351 - DNA, 11358 bp, Oryza sativa
gttactaaccgggaataaaaatcaaaacacactatataatccatagtaccgatcctcttttcccgtccacacaacaaactcctccctctatctctttttttcctctctaacttcttatctctttccttatctctaactcccctcctctccttccttttttccttcaccacagtgcaggcggtcggcgcggaggcggcgacgcgggggacggcgcggaggcggcctgcgcggcagtcggcgcggcagcgcgggggaccgcgcggcggcggtggtgggcggccggcgcggcggcgcgggaggccgcgcggcgatgccgggggccgcgcggaggcggcggctgcggtgggcggccgctcggcggtgaccgacgcgacgctggccggccggcgcggatgggaggaggggaggcggcagtggccgccggccggattttttttttgaaatgtgaatctgtgatgtatttttgtgtgagatgtgaatatgtgatgaattttttagaaccctgtgatgtaatttttttaagagtttgtgatgtatttggatatgatttgtttgaggatttggagatgttctgtaatatgtgatgatttggatatgggaggggatggtgtgaaatcaatattcaatattaaaagcagaaaaaaaagaaaaaatatctttagtcccggttggtgttatcaaccgggactaaagattctcccatctttagtcccggttggtaacattaaccgggactaaagattgatttttagtcccggttatttgaaccgggactaaagattctcccatctttagtcccggttggtaacattaaccgggactaaagattgatttttagtcccggttatttgaaccgggactaaagatagcgatctttagtcccggattcgtagtcccggttggaaaaccgggactacagggggttacgaaccgggactaaaaagcatttctccaccagtgaaccgaagtttcatcatggaccgccaagcttatattttcacttagcacagttaccaccactctttacactttaaactagggtttacaagttagcacaagaacatcaaatgtaacaggtatacaacatcctataaaataaatggaattgcattatattactgcatatgaacattcaaagataatatatatttcattactatgtatgaacattcaaagatcatatttcactgcttgaaaattaagatatcaacgcatgttgttcaaccttgtccaaagcgtgaacgattgtaactatatgctgtgatgttacgtgaaaagataaatctagcgtagtctattgggaaactttggttgataaaagtagctcaaagtgaaatttactctaacatttatctgcaaggacatacaaggaaaaaagttgcaaaaatgtcttaaagtaaaaaaaaacagcttacaacttggaaagagtcgagaacttatgttcgagacaggagagtcaaaaaaattaatttagggctttcatggaacaaagaaaaaacataagaccttttaggattgaaatccaatggaaaattttcataggtgctcatttggaagaaagaaatgagcacttgagattcctacgaaattcctatggaattggcttgaatcataatttattttaaggatttctatcatgaggttgggcctcatgggaaactttccttgtgttatctctctcgaaaaatcctgtatttttcctatgaagcatctaaataacatatttcacacaattcctgcattttaggaattatttaaaattcctaagatcaactaaacatgccattttgattcttacgtttttcatgtctagtgtttttagattcctgagcattttttttcttttttgccgataaccacctattaattcaatactcaacagtgacacaaaatgccagagctggcaaagtggagtagctattctatgcaaagatttttccaaacattctctccggttataaacatttgacgtggttgactttcattcatcttattaaaaaaatttatataaatattatttattatgttattacttgtgtgtctatatatatatatgtatttatttatttatttatttatttgcacgaaatttttaaataaaatgaacggttataaaatatttatggttaaagtcaaccgtatcaatatttatggtcaaagagagttcttcgtgaaagaaagaaaaggaaataagctctccaagaattgcatgcaatttgactttcggcactacggtcataaaagaactggagtagtgatcatttttgctacctgacacctcctaggctcctagcagaatctttaattaacacattgcctaaattttcattacatatggcagggaaagagctacagtaatgtcgttactcgttaggccagccaggctcatcgatctcccaacgaggcaatggcttggatgaagctctacagtaaatttgagcagtacatatctacagtattcactgccactcagccagactagcggagtggtgccgttctcaggctcacggtcccggtatggtcgattcttacgggcgatagaagtcgacagtatactaaattgcattggactgactctgtgtttctgtcaaaagctctatatatatggagtagtgtaactcatgtcaatctaggtgtctataggtggtgcgaaatccgcaatttactaacgcgacgctgctgcaaatttgtaaagaatatgataagcagagattggaaagtcgtgagaagggggggcagaggcatggacgcggtccagggaatggaacaggatggcgcagcgcagcggcaggggcgtcgccaggcaggcaggcaggcaaggccatggcgaggagggcagcagcagcagccgcgcagtgctgtcactgctgtgcttgagagacccacacacacccgataaaagcgagcgcgaaagcgagcgggcgaggtggacgtaacaccccccctctactaccgctgcacacacctgcacactgcctgcctccctcccgcgcgcatcgctacgacgagccagctgccagccagccggccggccggggaggtctttcctcttttactccctgttccttgctcgtatagttaacagtagtacgtactcatgcacggctgccagtgccacagcctctctccccacgggccgacggcgagctagcgcgcgcgcgcgcatcatccgtcgcgctcgcgtatggttggcgtggcgcatcattcatcagtagtcaacagtggcagcgccgcagcagcgagcgagtggcagcctggcgcagggccgcagggggggcatcaaaattttggcagctgcgtgcatgcgtcaacaatcgtatacacggccgagtacagagatgacatgggcgcgtcgtcgtagcgtggatccatgatgatgtgttatattccggggaaggaaggatgattggatgcgatgagcgatgtgccaatgtcacgccgcgcgcatctcagcaaattcagcatcgtctccccctgcacgattcggacctgtcttaaacggtttagctatggtcaaaaccaggagtagtttatttagggcagtcccaaccctctatataggatggtgtctatagtattaactacattgttatgtaggactattaacttatgtggcactatattaattaagagagagagtgaagagaggaagaaattgggtctcatgcaagacacaacttcaacacgagaacctatgcactagacactatcaagttttacattgagagataatactgtcttcataatagatgaataataaatatgattggtagagaaaagagatgatgtatttattaacggtccactttaagaaacaatgagttgtagagtgtagtttctattgtgatgtcttattgacatggtaccatagacactgcttatggacactataagttgggactgcccttacatgccacataatgttatgtgatgtcatgctgctgccaggcaggtataaagacatgagcaaggccttgcttagtcctaaaacaaagaattttcacggttatatagattacgtgtaaattatgagacaaatcttttaagcttaattataccatgatttgataacgtggtgttacagtaaatatttactaataacggattaattaggtttaataaatccttcttgtaattttctgacaagatctgtaatttagtttattactagactacatttaatatttcaaatgtatatacgtatatatgatgtgacaaccaaacctaaaaatttttctcatctaaataaggcctgaaccaaccggttgaattggtgttcaatgacggtgcattgatcgggctggccgtgcagtaaggaaattaaaagcagggctagctgggaagaaaggcagtaagacaccgtggacaaaagagtaatagcatatattgactacctccattattgttttctactggcatcgatacacatcttttactttatcgttgtttactttattacaactaggaaggatggaaagatgcgtggatatcttatttattatttatataaataatattagaagagttaagtcatatctcatcatataaatataaaaaaaattatagatttcgtctcataagaaaaaaaatatgttgtaaaatagatagtagactttaatataaacaataaaaatgtttcttgtattaaaaaatcactgttgatcaggatacatttaaactcatctattgtcgccgttacttattagcattatcgctaaatgccttttgaataaatggaactgcatatgtaccaccaaaataagtctaatgcatcattaatacataaaaacattcatcttcgctgcatacctaaatgtttatgtcaacacttaatttttaatctataaataagtaatctgaaaatattgcttctattggttaatggatagcaccgttaacaattagatatgaatgccccctctaacgggtgaagctaccaaggctttatttctcttttgccttcatacataggttccgtatcgatatactcgtgcctctcaaggccagcatggagcacacttttaagacttagttcactgtcaatatcttcaaagacgattgtatcgctaagtaggaagttgagcactattgtcaatggtaccctccactaggactgcctcaactcaaccatatatatgccccatgctatactcatggtaacgcaacaagcactatcatccatgcttgatgcccttcaggggaaagcaagaaaagataaatgtgatgagaatagttctttccataaaaagtatatatatttttattttttagacacaatttgtttgtggtgttaattcaaatttttatggtacagatacaatgctctgttttgaaatgagcaaggttgatccttaaaatcgcaatatttaaccatgataagtcatcaacaatataactatgatggagcggatggttaatggaattttttttatataatatatataccttcccacatctaactgtatactggtgccttacatgcatggccagtataaagtcagatttggtggataagagatttttgatatatttgaatgcaagtaccatgtgccaaaggaagtcgttttggacagcgatatggtctccaaaactcaactttgacttcttgtttctataaaaatatttattgaaaatgatatatgcatacttttatgaaagtatttttcaagacaaatctattcatataatttttacattttcaaactcaacaacttgagagctattcatgatttatattctcaaggtttgacttaaatattgtcttaaacgacttcctttacaagtacggagggattacaaataaaagtagttaaataagtaaatattccactgtattttcttatggcaaagctatcgatatcatttcaaagtgacaacacaaatatttttgttatgtatatgttgtgatcgaagttttttaaaggtatgcatgaactcacatgttctaaaatgacgacaagacctagagagggacaaatagaagttttcaccagaagatcgatcgacaaagagcaattttcacaaataatttatcagcacactaggtagctccaataatgcaggatacaaccatctcagattcacaaagcaaaccaaattattggccccaaaatacatccgaaaagtcataatatcacacacatctaagctagccatggaccacgagccgggccaacaggggggaaggtaacatggcaaccaaaggttgttaacacacacaagaagaggaggatctttcggaaacagctcaacgaatcgtgcccgagatgcagaagaaggccggacccccgggctagctatttactggcgagtactgtgttgtactacacatctatagtagggtggggaagggaaaagacatggacaagaacatgctcagatggctacaggaagttgatagtaatgccaatgtggacggcgcgggggccggttgatgaaggcaccaccagccgttctttctttggacagcatggcccctaaaatccaccatgcatgatcagtgctgtttaattagggttcagccgctcagaggaccagtaagcaaaagttgtgggctttaatttgctttagcaatcagtatccctgctaaaagtgtgcaggttatgtaaagggtagttaaagatgtatataactacatgttcacaatggcatgtcacatgttcacaatggcatgtccttgtgaccaaggagaatatcatagaacaacttcaagttctattatatgaagtcttaaataacatgtgatacactatacattgttcaattgcatgactcggaagatacgcttgttaattagtatatatagtgctaaactaaaagatgtgcttactagtgtagtggaaaaaaaacatgtggttttaacatgtcaacatgtattatattctcggatagtattcacctcattattatctgacatcttatacactctatattgtttgattgcacaactcgggagatgcgcttgttagtgcaatggtaaattaaacgatgtgcttgcatgtgtagtgggaagatgtgtggttttagcctgttggtatgcatcagattctcggatattattattattattattattattattattattattattattattattattattattattattatcaagtacccttttgcacgagtttcattatatgaagtcttaaataactcatgatatactctatattgtttgattgcataacttagaagatgcttttgttagtgcagtggtgaattaaaagatgcacttgttagtatagtgagaagatatgtggattgattagcctatcgacttgcattggatttgatagtattcacttttgtattattatttgatattaagtatttttttaattgtataatgtttttctattgcaaattcggttcctttcatgccatggttgcccattggcgtgtaagctagaatcaacaatcaagttcagccatcaacaatctgccggtggtcaagttgctatccctactcttcccaacttgcacacgctccttacctgactcacgctatctttgaattgtcaccaatgaacatgagttggttgatccggatccgaccattagcttatgatctatgccttgactgatatcaaactaaatgttcttttagttcggcaatacgtagttgttgttatgatataaaactagtggcgatgccaccgctcgataaattctgagcagtggctcggtctcatctgtgaacacataatataactttggtgttatcacaatgatggaaaataggaattttatagttaacatattctatagttagatatggtcgggctctaaggccccctttgattcaaagtaaattattttttctatatagccatttgaatcaaaagaatggatcttatggaatcctatgaaattcctatggaatgcctaatgccttgcaagttttggagaaattctaacatgaggtagaacctcgtggaaactttcctttgagtctttatctctcctctaattcctgtatttttcatgcgttccaatcaaacaaccattcttgtgttttacaattctctgttttacacttacattcatatcaaaatcctacgtttttcctattcctacattttccaatgttttaaatagcgggctaaggcatttagcagtttgctttttaaacagctatagcggcagctatagctagctaaatggagctatagcggctaaattgtacatgagagcaaatagctagaatccttctcaaacagctacaacgggagatagcgcagctatagcgggatatttaaaaccctgacgttttctcattcctgcgattcaaagggttctcgaactccatcattgtgtgaaaccatgaaaaaagaaagttgtagcagtggctacaccaaaatcgcttgagccatatatgaagaagagtccctttgatttggaggaaaaacatttaaattttgggatttttatcttataggagaatttcgtatgaaagcttttgatacaaaggattgaagcctatgttatcctttgaagggcccatttgatttgaaggaatgcataactctgtagagattttgaaggaaatttaacaagatcttcaacttcttggaaatttccctttgagtctctctctcttatccgattcttatgtttttcctgcagtccaatcaaatggtcatccatgtgtttttcctgtattttgcacttacattcctattggaatcccgtattttttatatttctctatttttctattcccgtgatttaaagaggctctaagagatatatagagcctatcatagttggaggcgatgaataagaagggtgaagtaccataaaaagtactcctagtgaaatgctaaattcttcatcagtgtttacctagggggtgtttgggagagaggagcccccctagtactacaatctgaaaatggagctagaatctatcgcagggagggcagctgtttggctgagagataggttccatttcttaaggaaaataagttccacttcatgctgggattaaacaagcaagttactacaactgtttagagataaacatcgatcatgccttcaagcaggaaccaggaatcttactttgttcacgttaaaaccaaaccagaagcacagaaaggtactactatagcagcactcctactttaggagtatatatgcagcaaatcaacattcagaaaccagccaacttttagaaaacaaacctgtagggagtgagaaatgtggccccgcatgttttgccaagactgcagcaaaggcagtaaggcagtgaatcagtgatggaaagcaaagcatgcatgcagcagcattgcgtttttacttctcactgataaagacattatcagcgcttcaccgctgggacagcatcgctgcggcagcctcatccaagcccacctctgccgctgccgcagcagctgcccctgcgcgcccttcactgcgctcggctcccgcctctcgcgctgcctgtctcttcctctcttgccatctcgcccacttcacttcttttactgcaaacgccagtactatgagcaagtaataatgtgataatttaagggcattcatacccctctgcccaaaataacttcacctttcatcgttttatttgttctaaaataattttatctttaaaacgatctaatatatattatattagagtttatgaaagtgagaaaaatacattacgatttgttaaagtagggataattgtattgagatttgttaaaatggagatcattctagtatttttcttttttgacttatattggctgcaatagaggaaaagtaaagttattttaggatggaaataatactgcttatagtgctagctttattttttcatagcattgtttgatacttcctattttagttcacgtattttttttaatttacatataaataaaaaattacaaaactaatataaaatccatgctccctcctattactcatttactccgctggtctctcttctcctattcactccaactcctccctctctaccgccaccatcactacctcttccttctttagccaccaacacctctcccctcaagctatagcaagcttcttcgacacaaattgaaggtggcttagtaccgggtggaccttattttaccaatttaggctgagtttaaaaaaggggagatagagaagattgggaagatacgcaaaatgaggtgagtaattaacgtatgattagttgagtattaactattttaaatttcaaaaatagattaatatgattttttaaaacaactttcctatagaaaatttttataaaaaacgtaccgtttaatagttcgggaagcgtgcgcgtgaaaaacggaacaaactatctcacagtctcacggtggcgaacgcagccttagacatgagacgagagcatcacttgcagcccaacaaaggaagcaggaagggggcgccttctgtggcagttgaggaggaggtagattggcgatgtagcacaagaggatctcattgttccctcaccatcaccggccatcccgttaagctcactgaacagcctaattttatagtcacaacctcactatcattcgttgctacatgtagcatggtgtttcaaccctctaagaccctgtttagatgggactaaaacttttaagtccctatcatatcggatgtttgaaaattaattataaatattaaacgtggactattaataaaacctatccataatcttggactaattcgcgagacgaatctattgagcctaattaatccatgattagcctatgtgatgctacagtaaccattctctaattatggattaactaggcttaaaaaaaatgtctcgtgaattagctttcatttatataattagttttataagtagtctatatttaatactataaattagtgtctaaatacagggactaaagttaagtccctagatccaaacaccacctaaggtatcgagtacaaccaatgtagggagtagtttttacggtaatgacaacccgcaaccatgcagggagggacaacacgtgtcattgggagacacggtttcagtcgaggggagctagagcgtcgatatggatggttggaacaacttacaagtgtcaaaagctacaaactatttttatcagttttcaaataaaatttttgaaaatcacttacactgttttatttttttaaagatgaatattttcgtcacgtacagtacacgctgttttggccagggttgattttaaatatttttattcagaagaaaacaatagaaaaaaaatccaaagctgctggggtcagctcagctcgaaccctgctcccctctgccgctctctttatccaacaatatttgtaggccgtagccctggcctcccctctgccgcctacgagagacacccccacccc

SEQ ID NO: 66352 - DNA, 62640 bp, Oryza sativa
gcctctcctcacccactccgctctccgctccattaaacccaagcgagggacctcgatcgcctcccctcctcgcttccctccccgtctctcctctttcgaccgcgttggaagcaagcgcggcggcggcgcggcgagctgccggtggggggttgcggctatggtgggcatcgacctcaacaccgtggaggaggaggaagacgaggaggagggcggcgccaccggcaccgtcacggcgcctgcggaggcgagggcggggggcgcggtgtgcctggagctgtggcacgcctgcgctggccccgtggcgccgctgccgcggaagggcagcgccgtcgtgtacctgccgcagggccacctcgagcacctcggggccgcgcccggctccggccccggcgccgcggtgccgccgcacgtgttctgccgcgtcgtcgacgtcagcctccacgtgagtgcgctcgccgcttgctgctctcgcgcgagcgcaatgtgttcgaggtattgattgagagagagggtctgctcctcccgttgtgctgtttgcaggcggacgccgcgacggacgaggtgtacgcgcaggtctcgttggtcgccgacaacgaggtgcgtttgcgtgcgtgctgatccaaaaatgggatgaatatctttgacattcggtcagtgctagtagctcaaacgaacattatttctgggtggttttttcaggaagtggagaggcggatgcgggagggagaggacggcgcggcctgcgacggcgagggcgaggacgccgtgaagcggccggcccggattccccacatgttctgcaagacgctcacggcctccgacaccagcacgcacggcggcttctccgtgcctcgccgcgccgccgaggactgcttcccgccgctggtacgggacgatatcgattgggacaagctacctcaccgtgatctgtttgattgcttgtgtggtgactctgttcagcttggcgcctgcaggactacagcctgcagaggccattccaggagctcgtggcaaaggatctgcacggcacggaatggaggttcagacatatctatcgaggtgattcgccggtttagcctatcttggtgactgggatatcagccgtactatcactaactaccatatatatgtcatacagcttggttgttaggcttctccctgggaacatgggattaattttcttaatgcgtgagagaacctagtaacctacgggctgtacagtcctacatcttcctatagtacatcacaggctgtttaggttgaactactgtactttgttcaccgaataacgcattagtatatatatgttttttcttttagtaagattatccaggtctcctttttagatacatctatcatgtctaggtattggaagcgagatggctgtccagtttagacgaaacaagcaaaccaaactgtaacttggctggctggatgagataaaaatgagcaaactatgctattttttctcattaggctctgctcacttactctgggagtgttttcaataaattattttaatttatgcatagactacctatttctacagctattgcgacataatctctaatagttaagctaattgcaatttggaggagtcttgagaaaattatggtccatgaatatctcataggtctgcctctaattgttacaggccaaccacggaggcaccttttaaccactggatggagcgggtttatcaacaagaagaagctagtatctggggatgcagtgctattcctcaggtaggcctatagctcatgtgctcatgaaccactaactcgaaatgtactaaagcttctcttttgtaatgatctccagaggtgaagatggagagcttcgattgggagtgcgccgagctgctcagctaaaaaatgcatctccttttcctgcacttcataaccagatctcaaatactagtagtcttagtgaagttgcacatgctgtggccgtgaaaagtatttttcacatctactacaatcccaggtaataaagtactttcctgattttttgaatatttaaatacctgtacctgtagatgttatttgcacaagtaaccatcataaaaataagtacaagtcacagatgcacataatattgcacatactgtacttttccaaccagtcaaataatcaaccatataataagaggatgtcggacagacagacacagcaatagcttgtgatagaacaagttatacataccatatgagctagagaatattaatatttattccttgtttcctcatgtcaagttcaaactccagatcatataagttggtggcatgttttcagtcatccagaaaatttccaatgctgacatttttcaaatgctcattgtttatatcatggaactggacttgtaattttgtattagaattgcaacattgtaaagtttagttccggctttttctaatccaaccttttggtatgtgaatagtagtttcctggctgactttgctgatctcgaccatgtagaatattgtgttgtttttaccacatttaatttgctgaatatatttgttttctcggatatactaaatgatgccacattgccattgcatgtgttcctcgaaagtgttgaggaagtgcacattgaagcagcaatatgatttaagaggatgtatctaattttcttgttttcaaatggtcatgtgtggtttactgctttactttcatgtgtggtttagcaatatagatttcagaggatgtatctaattgtcaccattttgcaataatcgagcaattttaacaatgttttgtgctatttctaagatacatcagataaaaaaaagaaggataattcagttccattgtagtgataatggtctttctttcaaatgatattcatgcatttgcaatgtgcaacttctgactgttcttctgcatgctatgtcctaatgtggatatggttaaaagtcttcagagttacagattttctttttgtctgcttctcttgttggataatgtcttgatgtcagttcctgcctttaataagttgtactcacaggttaagtcagtctgagttcattataccatattggaagtttatgagaagcttcagtcaacccttttctgttggaatgcgattcaaattgagatatgagagtgaggatgcttctgaaagaaggtattatccaacagttatatttcatgttttgcgaaatggcattacaatggtaaagatatttctagctcgtgcttggtttttcataaagaatttgtttttcaggcgtactggaataataattggaagcagagaggcagatccaatgtggcatggttcgaagtggaaatgtttagtggtatgcgctcttatatataatactgctttgcacagatggatgccagtagttctcttatttgatgttttactgcctagtgggtccgtgtctttcaaatagcagagtgcttctctgtattcagcattcaacattttgtgttccatgtcttagctttttatctgttgggaagttatagtttgtacaatccaaaattttgaatagatttaatggctcatacaagggtaaattacggaaacaaaggcatttaacctttttatgtgaaataaactagcttaaagtttatttttgtgaacttatgaaagtattggtcaagatttcagtgtttgcagcgcatatgtaaattcgtgtttgcagcgcatatgtaaattcttggtgtacttcaggttctatatctatgtttttctgaacacacaagtttagaagcatttgatatgatgaaccctgaaaaatagcgccctgcacttctgcttatcagcttataggatagaatatagaggttgaagggcatactttacatgccatagtgggcagggcatcgtctttactttgttaaaattttctccatttatattccaaatctttatcatgttcctgatttctagtattgtattgtgatggtgacaggtgaaatgggatgatgatgtggagtgccgtcggcctaatggggtatctccttgggagattgagcttagtggatcagtttcaggatctcatctgtccactccccattcaaaacggctgaaatcatgcttcccccaagttaatccagatattgtgcttccaagtaggttccatttacaagtcaaaggaatcattttctgtgctgcatgttccctgttgaactcacttttccttttcccattttggcagatggaagtgtttcttcagattttgcggagtctgccagattccacaaggtcttgcaaggtcaagaattgttgggtttaaaaactcgtgatggtactgttaatacagcttctcaggcgactgaggcaagaaattttcagtacactgatgaacgaagttgctctatcaacatgagtaacaatatcttaggggttccgagacttggggtgaaaactccaagtggaaaccctgggttttcctaccattgctcaggctttggggaatctcaaagattccaagaggtcttgcaaggtcaagaagtgtttcgtccttaccgaggagggactttgtccgatgcctgtataagaggttctggcttccgtcaacctgatggcaaccatgcacctggtgcagcatttaaatggcttgcaccacaaggatgtgatcatcatgggataaccacatcagttctgccgcaagcatcctctccatcatctgtcttaatgtttccacaaactagttcaaagatgcctggccttgaatacatatacggatgcctggatagaaatgagaatagccgacattttaagattggacctacacaagatatgacaagaactgatcaaacattacgactctggcctcatcttatttcaggcaaagtgctagatgagtgtacgagaaatgagaagctgcactctccagtcagtggtgctgagcatgaatcaaataacaagtgtcttaatacaaatggctgcaaaatctttggtatatcattgactgaaaaggcccaagcaggcgatgaagtggattgtggcaatgccagttatcattctcggctccagtctttaaaaccacagatgccaaaatcattgggcagcagttgtgccacggtaagtgctcaatgaaatgttcttttggcatcttcttcctgaaattgcttgctaaccgaattatttacaggtccatgaacaaaggcctgttgttggcagggtcgttgatatttcagcagtgaatacgatgatctgatacatttactgtatccagggagtatgcttgcagaaatagggaccaacattagtatcatactcactggtgctgaggacacaacttccattctggctatctcgtccctctacgtgcttgttgcctcaacttcagcatttccacaggctgtgctaccgcatccaggatgatgacaggggaaatgcagatgatacacgaaggatgcttgtcaagtttgttgtaatgcacttctaagttctaagctttgaacctcttaacgttgctcctattttaagctcccgttgtaatcggcatttatgttgcctgacctacttgcatatttttcaatttgtccgttaagacagcccttttagagggcttgcttatgttagcaacccttaatttccaaattccaagtatggcgaccgttcgaggggtttgtttgctcctgggacgacatcggtacatgacatagaatccattggtgacaccagggcacatcagaattaaggtgtagggcgaaacaatagaagctgaaagagcgatgctccggtgctttgatagcagtagaaataatcctaagggtacattagtaatatgatagtgatatggattaggggtaactttgaatattttttttttgtgtgtgtgtctcggtcggtctttaggtctgtcgtctccgtcatcgatcccacggtcgctttgtattgctcgctcgtccatcgaaaaagcgaaaagcaaaaagcgtcgctcgcttgtcgatcgtgactgagtcctcccgccggttgcacgtgtggatcgcgagtcctcccgccgatggcgaaacacttcggcggcccttctctgtgcattctccttcacgttctccattcatagctggcaacccgcttcgccgccgtacgtgcgcgcaggagcgccctcgatccaggcgggggtgccccgttcggaggctgctccgacgactttcggcgttggctgcgacgacccctctccgcgtgcggggcgagattagcgacgacgcccactttggaggattcgatccgttccagcggcgggtcctagtggcccttcccgcgtgctcccaattctatggacggcggccactccgatcctctggagccggccggttgcctgatcccctccgcgtgcgcgtgagacttgtggtggcgcccaattcggaagctacttcgatccattcctatgtcgatttcgcagtactcgtcgtgcgcgcgagacttgcacgaaccaccctcgccatcaccgtctcaggttaccccgccgtcgctgatccttgattcaaggacgttcgtcggctctatcaagtttaggtaaaaaattgtggctttctcttagtttgccttaaccttctccgctattaattacagttttcttcccaaaagcaaaaaaaaaaaattggggctttaatttaagcgatggtagttttatagtatattggtactcccttcattccaaattaatttatcatataaccaaaataaaaacttccaaattgatcataaccatgaccccttcatttgatatgtagcattattgcatctatgcatgtaaattgagtctgcattcatgcatgcaggcatttagggatagttaaaggttcgtttcttgtgcatgtggaaagttaaagtatgcatgtttctttatttttcaccaccacatactcacattaaataaaaaatcaacccccacatactcgtattaaatgaaatatatggtagttaagtctacctttatctcgatgaaaaactcatataatcatccatatggaatggagtgagtatattggtattgacagtctgatcacagcgtgtgggctcgcttgttctgtgcaatgtattctaggagatacattttttctgtctagtgaagcttagagcacacaaagtgatatagtaatatgagagtactaaccgtcacatgtatctagtgctgtgtctatgcatagcaaaattcttcacgttaacgctaaaacactgtatttctgatcaaataatttgcaagatgcctaagctgcataaaagcatcaaaagcagcatacttcagatgacacttgttctaaagttcagaaattggcatcttacaacttacaagctgaaattactgaaaaacacttgcatgttcattctattatcaatctgaacagcaaagtgaaaggacgatatatgaaaccttacagtttgggatgacgcagggcaggaagttggcctcgtcaccgacgtgcatctgcttgtaccctggctcgtactcgcacctgtaccccatgaaccccatcgccgccatgcagttcctattcccacatgccaccgtcttgcatatcaaccctgctctcaaccattccaaccaaggccgtgtttagttgttttggcaaaatttctttgacgtatacggacacacatttgaagtattaaacgtagactaaaaacaaaataaattaaagattccgcctgcaaacagtgagacgaatctattaagcctaattaatccgtcattagtaaatgtttactgtagcaccacattatcaaatcatagcgtaattagactcaaaagattcgtctcgcaatttacatgcaaattgtgcaattggttttttttttctccacattgtgtccaatcatttaatgtgacgaaaaagttgtaagtttgagtgaactaaacacaacccaaatcatcaaaaaacaagacgatggattgaagaaaaataaccccttttccacattaatcgggaaaaaggattttactaatttacatgggcaatgagagagataaggttgtggattcaaagcaccgctcttgcccgacgcagcgtgtgcctctccatggatccatagcaacgccacacaacctaacaaccacaactcgccatcgacttcccaaaccccgaatcgcgtacctcaccaccttgcctagggtttcatgctcacaagggatcgaggaagataatcgagggacgacatgggccgaccctcgaggcttgtcgtgatggagcggccaacagggatgggggtagggcagggcgaccgtcgacggaggaatggtcgagcctgctacgactgaggaggagaggaaacggggctgggcgacaacgcctgctagtgctatgattggtcggtgctagtcgacagtagaggtggcagaagggaggagacgctaagcggggatgagaatagggggagcgacacgttcgtgtttgggcggcggcatcaaacgacttaggtggtgtttttttctcctgaaaataaagatgaagatgaagattaagtttttttttacataaaacgaggtggtattaacgtatgattgattgagttttaattgttacaaacttaaaaaatagattaatatgatattttagagtaactttcatatagaaagtttcgcacgaaaaacaccgtcagtttgaaaagcgtgccataaaaatcttaatcttcatcaaactcttcttagaaaagagttgctaggtttagttgctgataaatgacacttatactccttcactccagctttttctagataaaagtttccatccacgtttctattattgataactatggtggtagtagagataaatctgatcccttcgatcaaataagattaaacagtttaaattgctttctaatacctgtagagatcactgtactatgcctgtttgttgctggaggtttccaagcgaaacagtgtgcatggaaaatagatctatatgatttcttttactacattagttattttttttaaaaaaaatgaatcaatatgattttttaaaaaactttcgtatagaatttttttttaaaaaaatacaccgtttaacagtttggaaagttgcgcgtggaaaacgaggcaaagggagttgggagcgagcagttgcgatttacgaacagagcctaaagctgaaaaggatcttgaaagtactgctctttcaggcagcgctgctctgaaaatacgatagggtgtgagaacccgggtttatttaaccggtatgggaaactggtgagaacactttgtacacgctttcacagcaaagacataatgaggaaatgagtatacacgagtgggttactataaacatattttaaagagataaaaacaagtttaatagtatagccaacccatttatataatagttaagtataaaaatatacatcattaatacctggtctcacctgtcatacacacataacgtcttgtattccgtgttgcaagtagctacaaatatatagccaactttcttctctcttctcttttcttcttgttacgtggttatagctggcttatagcctgctattggacctgctctaaaagaggagagaggagagcagtgggctacagatttatagccgactgcagcacagactctaaaacacagtgtgtgtatgacatgtgagactagatattaataatatagtaagtagctattgtatgaattagctataaatgatttgaagccagtagttgactgtactattaaacttgctctaactcctagccttcttccttttggttgttgacgtcgaagaatcttcaaagtcgaacacccgtgctctgaatgcatccaggttgaccaacagataaagctggtcaagcagctttcagagaccgagtagaatacctgtggacgcaggaaacgagttactccctcgttttttaatagatgacgctgttgattttttctcacatatttgaccattcattttattcaaaaattttattcaaatgtataagatataaatcacacttaaaatattaaaatattatgagtgataaaacaactcatgacaaaataaattataattacataatttttttaataagacgaatggtcaaacatgtgagaaaaggtcaatggcgtcatctattaaaaaattaaaaaaccggaggtagtactatttattatccttcactaatcgaacaaagagcaccgctagtactgctttacgctgctttaatggacgatgaatgccatattacgtgaattaggccccctaacacctttctgtaaggaagttcagaaaacgtttcatatgcatgccattatctcttcttcagggaccaacttatatcgagggcgatgcgctaaaataatccgctacgttgccctggtttgtctgtgcatttttcgtacttacaagaaggctgctttctcttctttatgccaactggcaatggcatcctccaatccgctcagcaccaaaattcacgcgtctgttagacacgaaacaatggaaaattccagaaaagaaaaaaagacactgatatgtgtgcctacatataatatgtcagacacgtacctcacaaaccagccaaaccaccgaaaacaacaggacaggaatcttcgccagtcgagtccaagctatcatccaccgccaaatagatatgtttaaagtatgagaagggaagacttccgtctccagttgcggatcacatggtagcagtagcacagagccaatgatatcaaacaagagagttgtcaaagaaaaacaaaacaatggcaaagtttctctatctgatcatcctttcattcttcctctctcttttggtgttctgcacttctgcttcaccccggctgacattgcacaccggctcatctttctcggtggaagattacaagcatacattcctcacatcaccgaattccaccttctcatgcggcttctacccaattgggacaaacgccttcaccttctccatctggctcaccaacacggcgggcaaaacagtcgtctggtctgcgaatcgccggtcaccagtgaatgggcatggatcgaaggtgttgctgcatgatgatggctacctggtcctgatcgatgtcaatggttccacggtctggacgagcaccatgagtgcaggcgaggggtcgacggctgcgctgctggagagtggaaaccttgtggtcagagattcaagcggcacaatcttgtgggaaagcttcacttccccaacggataccttgctacctgcacagcaattgaccaaagacacgaggttagtatctggataccatagcctttacttcgacaacgacaatagccttcgtcttgtatacaacggacctgagttctcaagcatctactggccaaatgatgattacaccatgttccgggatggcatcaaagtcaagaacaactccaggcttgcagtcctcgatgacaaaggcggtttcttctcaagtgatgctcttacagtacaggcttctgattttggtctcgggatcaagagaagactgactcttgactatgatggcaacctccgtatatacagccttgacgcatcagatgggagttggacagtcacatggcaagccatagtggagatgcattatgtgcacggcatgtgtggaaagaatgggatttgtgagtacttaccagaacttcgttgttcgtgtcctcctggattcgagatggttgatccacagaattggagcaagggttgtagaccgacatttagctataattgtgggaaagagaggtacaagttcattgagattccccaaactgatttctatgactttgatcttggctttaaccagtccatctcatttgaagagtgccaaaatatctgcttgagcacgtgctcttgcattgctttctcttaccggctaactggaactggtgtttgttaccctaaaggcctcctgttcaatggttacaagtctcctgcattcccaggaactttatatcttaaagtgccctacagcacaaatttacaggcctcatcaacacaatcagctctcacatgctcccctggcagtcaggagattgcaacaccttcagatcacccaagatggctatatttctatatattccctggagtattcggagccttggaactaattttcattctaacagcttggtggtttctttccataaggaatgacattcagaattcagcagagggaggttacatgatgataagaaatcaattcagggggtttacttaccaagagctgaaggaagcaacaggaaaattcagggaagagcttggaagaggtagttctggaatcgtatacagaggagtactcaaagataagagggtcattgcagtgaagaagctcatcgatgtcacacgaggcgaagttgaattccaggcagaaatgagtgttatcggtaagataaaccacatgaatttggtcaggatatggggcttctgctcagaaggaaaacataagctactggtttatgaatatgtggagaatgagtcactggacaggtatctgttcaataccatgggtactgaaagattgctcgtgtggaaagatcgtttcaatattgccttgggagcagcaagggcactggcttatctccaccatgactgtcttgagtgggttttccattgtgatgtgaagcctgagaacatactcttgacccgagatttcgaagccaagatagcagacttcggactatcaaaattgtataagagagagggctccagcttcaacttctcacaaatgcgaggaacaatgggctacatggctccggagtgggcaactaatttgccaatcaatgcaaaggtagatgtctacagctatggagtggtgcttctggaaattgtggctggacagagaatttcaagtcatacaaccagggaagggaaagttaccaagttaaagcaatttatcgagaatgtaaaggaagctcttgctactggggatactaagtgcatagtggatggtaggctacatgggcaatttaattctgagcaggcaatggttatgttgatagttgctgtatcatgtcttgaagaagaaagaagcaagaggccgaccatgcatgaagttgtcaaaagtctcctggattgtgaagagtaaattggtcatttttgctaatcaatgaacctgaaagcagtagggacgaaaagcagtaagagaaggagtaagcttggcattgatagcaatgttttgcaaacatatgtactttctgacccatcaaggaaaaggataaggcattacttgtagtcctgtgtcatttagccaataaccatattttgtccttttcctgtgaaaatcaagataatgcagtgtttagttattgacttattttaagatttatcaggaattttatgtaatcttttaaaaaaatgtattttgtttttttcttttgttcttgagacatacaattgtaggtaaatctctcaggttctttaaagacagataagccgaaataaaaggggtatctagtccctgaagcactaacatagttattttcaattaatcagttccatgaaggatttagctggctattattgtaaaacaatgagatacaaaatttccatccaaaattcacaactttgtagcttgttctattagcaatagattataaatttatgtgaactatctttgtcaataattcaatttgatcaacagcacaaatgtaatttggcaaaccaaactgttctttgaggaaatgtcttatgttgtactgagtttttctctaatctttaacacaaatatgcgtacaatgaacaaaaaggtagatgtatgcaagtatgtaactcatgttaacttcccaccgcatgaaccatctagatcaacaacatcttgtacaaatatatgtagttcatgtcagtttcgagtcttcgactaaccataggctgctaatgttacccgctgagttaccaaatgcagcaacgaggcagagcaaaatcacgcatcagactatcagagcattgcataacaacgaagagaagagggaggcgtcacctagacggtgcctgctgggaccacgatggagggggtgtggggggtggggggtccaaacttctcgtcccctgcgcccaagcctctctgcctcttccatcaccggcacggtgtgggggattccgtatcgcctaccaacacctccaccacttgcctcgccggcatgtcgcggaggttggcaggatcgggttcaacgcgggggcctctcgtaggcgtacccgtccgtatctcgctctcgccgccgctcggaagcggtcgccggcgtcattatcggtctctctttttttttatttgacaccgtcattaccggtctcctaacaattgcacagaacaacaacatgccgcacgtgcgtatatatatatatatcagatcgaacggttaaaagacaacgggcctgttcattcatttcgataccattttcaaccataccattttttaccaaaattataaaaaaaaaatggctacgtttagtttgttgccaacttttgtcaatacataaaaaatcctagcaaaattttagtaaaaccagatatcccacgtcctttaactaatcaaaaccggtcacaaaaggtccctcgacggttttgatcccagtttggtcctacgtggctgctgagtcagcgtgggacccacttgggccccacgtgtcagggtaatccacgtcatcaccctccctttttctcctcttctctctttctgggcgaggcaaagcggtgggtgcagagggccagaggctagcaacgcgaggcgggaaagtggagggcggccggcggcgcgacggtggccggtgcccgacggcggctgctatagcgggaaacacggcgacgcggcggccccaacggtgatgtcatcgactgcgtgccgacgcacctgcagccatccggttcgggatgaagcagccacgcgccgccgacatcgtccgccccgactccaccaacgatggctgcaactcctgctcgcgcatgccgaggcggcctctgtgctggcgctcctcctgcgcgcgttcggctgcccttggcgagcggcgcacaccttggcctcagcctctgcttcgcgggggccgcgccgtaggccgtggacgtgccgcggctggtgctccacttcgacagcgctgggtcatggagtagcagagctcgagcacggggcagtgctacagagctcggggattacgtcgtagttgaacccgaacccgagatccacgcaccccttcagctcctctaggtcgtcgttgactcgtcggtcaagctcggcgcgtgccgccgccgccgtcacccccgctcctcgccgtacacgcgccgccgccgaagacgacgacgccgcagggctcctccttggcgaccaccaccggcttcgtcccccgtggtcacgccgcctcccgctgtacaccgcaccacacgtcttcggcctcgacctcggccgccgcttccgctccgctcgtggcctgctaccgtcgtcgccccgctactccgcccgcccttccgcgttccaacacggcgagccatgcccggcggcgagaggaccatcgccgcggccgtgcaaatccggcagctgagcggcgggatccatacggcagcggcggaggaggaggagaccgggagattggccgccgcacgctgctcctctcccgcgagccgccgcgcgccgctcctcttccacaggccgtcgcgcgccgctgcctcctcgtcggtgaagactcggaggaaatagaggtagagaggggagaggtggacgccgccccgctgcacaccgccgccttgccgctcctgctcgcccgccgccatcctcgccgcggtcgtttccccatccgccatgccgcgccgcttccccatccgccaccccactgcgcgtcgccgccccttcgctggccgttgcctgtctcctccccatgccttcgatgccgcccaactccaaggcttcccccaccggccgtgcgaggagctcggccgggctgctgccgccgtcggccgccgtcgtggcgccgccctcctctcccgcctcaccccgccaaccggcctacaggcacagagagagagagaaagaggagtaactgaggaagagaagagagggagagtgacttagcctgacatgtggggcccacgtggggtcccatgctgactcagccgccacgtaggataaaaccggggttaaaaccacttaaggttctattgtgaccggttttgattaattaagggatgccggatatctggtttgcggtttggggacaattttgtaactcgatgacaagttgagggaccttcggtgtactttttctaaacttaataaggtttattttggctataatatgaaccgtctcaacaaatgtggattgctaccattggttgtgattcagttatcgggcagcctgactcatgagtcatgatgggcccagcccacctattgggggtgatcggaaaaacgcttctctctttcgagtagccacggccaccgccccgccggcagcttctcgccgtgtctgttcctccgtgagatagcatcaatggtggtgaccttttggtctccctcctgatgatgtcaagtactttgttggtccttagctgtttggcatggttgatttgatgatttgaggtgtgtttggttgactgtcatgtatgaatgggatatggccatccatatttagttggatatggcgattcaatttttgtttgttttgtagagatatgatgatccaatttcttatttggttggagggatatagtatggatgggaaaaaccaaaagttagtggggtccatttgtcatatatacttttttatcaaaatataatcatccgagatcttgttttaaagatttaaatataacaaatataatggtgtaatcaaatcataaattagataaacggtttaggataaaaaaatcatttggaagttgcttaacagaaaatcaaactaaccacaactaatcagaataggacacatcacccaatccaaaactggatggcttcatcgagccaaatcatccggatgcactcatctaacttattgagggaatattccctattccggaccgctccatttaccttgccctccaatcaaacaccacagaaaatcgagcggccatctcccatctagactcatctacctaaccaaactcaccatgcatcagcggaacggcaggaactctgcctacaatattcaaagagtatgcaaagctatcagctatggcacgtttagaaccaacaaaaaacaactaggacacctgattatcgtgagtaaaggaaagcttgtccaggtttgccgccaatcgtctttctccaaactttgtttcgtgagtcggcggaaagtccaaagtcgaaatcccgcgtccatgtgaatgcatgcatctagataacaggcataccaggtcatagagattccatatttccgtagaccaactcatgtatcgaggataaatgaagtggctgcccggtgttggtttttttgtcctttaattctgaaacaagggaaacttcttaagaatctcacacatcgcagttcagtttctatagaagtcctatgttctgtttagttcacactaaactttctctcaacttccaactttccatcacatcacatctaaaattttcctacacacacataaactcttaacttttttttttcaaactatcaactttccccaaacttcttctcaatttcaggaataaacaccgccctagtaaaagcacaattcttgcatcctattttccgaatggtattgcaataagtcagtttttcttctgtaagtcaacacaatccactaattctgaactaccatactttgactagcttcggtagtcatcagcgaccaaaagaaaggagagaacccaagctttccctttttcaaaataaaactttacgcagggtctcagaaagacattgtcactagtattttttacttaaaactcattccacaccacagtccacacaatcaaaacaaggaccctatgattaacaagaaaggaacaagagaacactacaaagtgatcagtaagaaacaatgcagaaacttttggcgtcatttaccagttttcagaagcgtaaatgtttgtgggggaagactgaatgagcctaacgctcttctagtgctatataaatacagaagaaatgcaccattccattcttccatgattccatcgaagtcacaagccaatcacgtatcttacacacttccgcacctgatcttcttccatcgaagtcacaagccaatgaactattagtaactggaagactgaggaattttgttctgaacaacattcctatgttgcccactcataccgtgccggaggtggttatctttaataccgatttcaaggccaagattctagcttgccattgggccacgtggcagcctcaaaatttagctacacacctcagaaatccttccacgtgtccatctgtatagttctatacctttctccagcttattggcacacatgagccacttgaactttgagataaatcttatagggaaaaagtgtcaagtagaaaaattacagattctagatgcttccaactatctagctgtttgcaacatctaggctccaagaggcattaaactgtttcattgaagataaatcataactgttttggggtaaaaaaacataatccagtaaaaaagaaggtgcagatgaccggctattacaaatacaagtgaggcgacggagagaaaagtggcatcgaggaagacagcataaatatatggtagtgactgaaatttttttactaggagtcggaacggatatatactagcaacttccaatgaaacatactacctccgactccgacttttaataaatgataccgttgactttttatccaacgtttaaccattcgtcttatttaaaaatttatgtaattataatttattttgttgtgagttgttttatcactcaaagtattttaagcaatatttatatcttatacatttgcataaattttttgaataaacaaatggtcaaacatgtgtttaaaagttagtgacaccatctattaaaaaagcggagggagtatatacggatttagtcctctttggatttttgtactataatttcttctttcgaaatttgtatgaaaaaaatatagaatagatttttatcgacaagataattatgaagcaaaagacttaggagtgtttttttcctcttactattatggattatgaagggcatgcttcacaagcttatggtttattatttgatttgttttaaatcagtacatcaactttataatatttaatccattcatttaagctctgaaataattgttatacaccagtttcatctatagtccatcatctatcgaaacttaatgctgcaggagcatcgtcaatcgaaacttaaatactgcaggagattaggctaataggatgatatgcaaaatagaatatttgatgaaaatcgagataactcttaaaaaatcctgtaaaattttcatattctaaacacaccttgaaaaatttacacgtgttatctagcgcgccatactaaaggtgtgctctacgacgtttgacgtgacttttaaaaattataaaaaagaaacctaatgagaccataaactataaaaactacaggatccaatttttaaatgtttcaaggagaataaatataagcatgtagatcggggaagcatataaagaaggtgtgacaaaaaaagtaaggggtagcatctgacgtgatttttaagaatcataaaattaaaacatgaggatgataaggtttggtctttcaaaatcgtaagacaatgaaatagcgatttaacaaattttaagtaaaatcatattaaaaaatagataactctgtattgttgttagccgcgcagctagttacaagtaggagtagaagaaatccgaagagcttgctaaactagccacgaggacacgcttataaccaagaaaaaaaaatacttggcagacctgattaccgtgagtaaaggaaagcttgaacaggttcgctgtcaatcttttttccaaacgttgtcggtgacaaaaatttcaaagtcaaaattccgtgtccatgtgaatgcatgcatctacagacttacggttataccaggtcatagagattccatttttccatagaccaacactgtgtttagttccacgccaaaattgaaagtttgaaaaaattgaaacggtgtgacagaaaaattgaaagtttgtgtgtgtaggaaagttcgatgtgacggaaaagttgaaagttcgaagaaaaaagttagaatcaaaacagggccactcaggtatcttcttttctttaggactacactcaggtatcgagtcctgaattctagaacaagggggaatttttaaaaatctcacacattagagttcagttcctataaaagacaaggaaaaagaacaattcttgcatcacaaatggtattgcaataggaaattatttcttctgtaagagtcaatacaatccactcatccagtaccaccatacttagacgagctttccataatcatcagtaaccagaaaaagaaaagggagaacctaggcttccccttttcaaaataaactttacgcggattcagaaagatattttcgctagtatttagtcctagacaaagctcgttccacaccacagtccacacaatcaaaacaaggaccgttctcattgaaaaaaaggataaagaaaattatcaaatgatcagtaagaaacaaatggataaacttttggccatttaccagtcttcagaagcaaaaatgcttgtggaggaagacttaaatgatccttgaccccagattagaatagcgctcttctagtgctacataaatacagaacaaatgcatcattcccttccttcttccatctctgaagccaatcatatatctcatacacttatgcacctgatgtaatggaaacaattccctgcctcatcctcttttcgtcactacagattctggcattctcttctgcatcaccagagcatacactgggtaccggctcattcttatcggtagaagaatatgagaaaccatttctcatctcacccagcaatactttctcctttggtttctacgaaacaggtgacaacgccttctccctctccatctggttcaccaatacagtcgaaaaaaccgttgtttgggcagcaaactcagaatcaccagtgaatggtcatggctccaagctatcctttactcaggagggtagcttagtcctcagcgatgagaagggcttcgttgtgtgggatagcaagacaatgctaggacaggattctcgagttgctctacttgatacaggcaatcttgtcatcactgattccaagggtagtgttgtgtggcaaagctttgattcacccactgataccttgctacctttgcagctccttaccaaggacaaaaggttggtgtctggttactatagcctctactatgacactgataatgtcctccggctcatatataatggaccagagatttcaagtccctattggccaaacccatctgagtcaatttttgattttggacgaactaactacaacagctccaggattggagtcctcgacaatactggtcatttcacgtcaagtgatggcctaaacatcattgcttctgactcaggtcttggaataaacagaaggctcacaattgatcaagatggcaatctcaagttgtacagcttaaataaagtggaaaaaagctggatagtcacatgggaggccatgccgcagcactgtgacgttcatggactatgtgggagaaatagcatatgtgagtattctcctggtcctcggtgttcctgtcttccaggttatgagatggctgatctagagaattggagcaaaggttgtcagccaatgttcacaaacaactacggccaagccatagggcaagtcatatttgtcgagatgcgtcatgttgaattttatggatatgatacgggatttaatatatccgtttcactggaagattgtgaggaattttgttctcaacaacgttcctgtgttgcctattcataccatgccggaagtggttattgctatactaaaggtatgctctacaacggccggaagactcaatccattactggaagcacatatttcaagctacccaaaacttgcaatatctcagaggtgaaacaacatggcttgacatgcagacattcacattctacatatgaaatgcatcgacaacacggaaagtggttgtatttctatacatgtgctgcaatatttggagggctagagttgttcttcacaacaacagcttgtttatttcttcgaagcaaacagaatattccaaagtcagtgatggatggttatgaattgatgactgagcacttcaggaaattctcatacagagaattgaaggaggctacaggaaattttaaggaagagcttggaagaggtggttctggagttgtttatagaggcgtacttgacagaaagaaagttgtgacagtgaaaagattaacaaatgcaacagaagctgaagaggagtttcaatcagaaataagtgtgattggcaggataaatcatgttaatttggtaaggacttggggctattgctcagaaggcaaacataaactattggtttatgattatgtggagaatgagtcactggacaagcatctctttgagagcatagatgcaaaaaaattacttcgatggaaccagaggttcaccatcgcattgggaacagcaaggggcttggcatacctccaccatgagtgccttgagtgggttgttcattgtgatgtgaagccagaaaacatactcttgacccaggactttgaagttaaaatagcagactttggcctagcgaagctatccaaaagggattgctcttgtttgcaattatcccatatgagaggaacagtaggatacatggctcctgaatgggcgttgaatttgcccattaacgcaaaggttgatgtttttagctatggaattgtgcttcttgaaattgtgatgggagctaggatttctagtcagacaacaacagaaggggagaaactggatttgacacaaattgtggaagcactaaagcaagttgtagcttgtggagatgttacacacatagtggatgctaagctgcatggacaatttaaccatctccaggccatggaaatggtgaagatttccttatcatgcataggagaaaggacaaagaggccaacaatggatgaaattaccaaagctctgatggcatgtggtgatgaagacaagtatgctgactgcacagaatagtatgtaacacataaatgcaaaccagtctcatcgaattaatcaaatgttacttcaaaagtataaaggcgaagcaaaaggaccattcaagagtcagggatgtaaaaagtagcacaagccaacttacaacttgttcatgccaatgaatgctattactacctctgtttcaggtataagactttttagcattgcccacattcatatagatattaatgaatctaggcacacatatatatctagattcattaacatatatatgaatgtgggcaatgctagaaagtcttataatatgaaatggagaaagtagtatttacgaatgatgtatgtttgtagattaagaattctctttaattatctttttccagttagttcccaagttctatataattcacagcctgatggttcctctttctgttaccacaccacttgttttcagaaaaaaaaaagattcatttactatctttgtttcatattataagactttttagcattaaccacattcatatatatatgttaatgaatctaaacatatatgtgtgcatagattcattaacatctacatgaatgtgggcaatgctagaaagtcttataacctgaaacggaagtaagttatagcaaatcagttcttcatgttaccagatttccttgttctcagctatatgaaagtgattgggacagggagatttgctcaaatgtagaacaaaggtaatggtacagagaaaaggataattaactaaaaagagcttccctacacgttcctgtggcttttcaatgaactattaataacctatactcctatagattcaagattactgcattttatctaaaagttctcgtcccgatctcttagagcagggtaaatttgttatttcaatttctagtaaccaaagctgctaatgctgccctctcagtaaccaaatgcagcaatgatccagagcaaaaccacgcgtcggtcagagcattgcataacagcgaagagaaagagggaggcgtcacctcgacgaacaagagccagcgccgtcaacctggccggcgagacggtggccggctgggaccgcgaagggggtccaaactgctcatcccccattccccctgcgcccaagcctcgccggatggccagccccctctccgcctcttccgtcgccggtacagcgtgggggtcccgtctcgcctgccaagccctccaccaccacctgcctcgtcggcatgtcgcggaggtaggcaggggcggggattcacgcggaggcctctcgtagcgtagttggctagcggcagcagcaggccgcttctcgttcgcgcgccgccgctcggcggaggtcgccaccgtcattatcgggcgcagccgataattcgaggggttttatgggaataacaacatcccgcacctacgtttctaaatcaaagctaccaatatcagatcggacagttcaaagttagcaagccttgaaccgctaccattggttgcggaacaaaaaaaattggtggagccgggcccgccgggggtgcaggcgtgcagcgcgcctcctccgtgctccctccgtctcagaaaaaaaaaggacttaattcttaggttttttatccaatgtttgaccgttcatcttatataaatttattttatgattagtatttttttttgttagatgataaaacataaataatacattatgtatgacttatcttcctgaacagagaacagtgaaggcggattagtgaggacgacgctttgtcaagtaggtgctacaaggtaatcaatatcaacatattagatatagtattttttttatttgtcatatcatataatcgagatacaatcataaaatcaggatactatcaaatttataaataacacattttatatataatcggtcgtggctgttctgatccaattgatgaatttcaagatgacttggtggtcacgaccgatcggagtggttcttttctggctgctcttctggttggaggcagtcatgttcttttctggctgctcttctggttggaggcagtcatcagttgcacctgttgtacccagtgagctttctttgatcatggaagaatgtatggaattcttggcaattaatgatatcacccggaggggggggggggtaaagtcatgtattatttttttgaaaaataataatgtcggtatttgtttgtcgattcttttctatggtgtcgcgtcttagagttgtctttgaagggaagtctagaattgactttttagcatggcttgagcgacattggtagacaaatgattattccttcttgaattcgatgttttggagggtgttatattcctagcgttctcctgattgtagttgaacacactgtcacagaaacaaatgatatgttaatttatgtgttcttttcttccttagttagtgtaagtggataggtcggatgatttcgttgttcagtttcattactaagaaaatattatgaaggtaaatatatttgtagttgcaaagccaggtagtttagtagtaattaactagtattgttaactaactcgtactcactggcacgtgcaattcacgtgtaggcgttgaccatataaaggaaaagggttgcgatattgtgggtggaagtatatccaatcaagataactaaggttacgtttagttctctttaaacttttaattttttcgtcacatcaaatgttttggacacatgtatggagtataaagctggacgaaaaaacaattgcacagtttgcatgtaaattacgagacgaatcttttgagcctaattacgccatgatttgacaatgtggtgctacagtaaatatttgctaatgatagattaattaggcttaatagatttgtaacgcagtttacagacataatctgtaatttattttgttattagtctacatttaatacttcaaatgtgtatccgtatacttaaaaaaaattaaaatggaactaacacggcctaacgctttgttctgctcattctcttccaagacttcacagttcacacccccacccgtagaaaaatgacttcctaccctccaacttgtcacgctagctgttgaaaaagacctccattgctgcgattggtgatacttctgcttctcttatgctacctccgttctaaattaaattaagtgtaaccatgggttttcgtatttagcatttaaccatccgtcttatttaaaagttttataaaaaaactattttaaaaattagtcacacataaaatattatttatattttatcatctaataataataaaaatattaatcataaaaaaatttcaattaaaatggacggtcaaacgttgaatataaacagtgcaaaactgtatttattttggacagaaggtagtatctctttggctacataaaataaaaaaaatagtttgaatttcaatttggacggagttcattaatcatccttgacgacataccctcgtttattctaacctgtcaaatataaatcaaatgcttaaaaaaaatctgaaatttttttttgctaagattgatacgacagtcgtttattattcctccaaaaagataattttgagctcaactgatctacaaattgataaacaaaataacaaactaacctttaagtttcacgagcactatccacggttagatttgtttcttcttaacttaatcgaattcaaacttccatgtatgtaaagtgatacatactccatctgtctcaaaaaaaaagacaaaacggggtttccgtgtctaacatttgactgtccgtcttatatgaaattttttttataattagtattttcattgttgttagatgataaaacatgattaataatttatgtgtaacttatctttttaattttttttatacttttcaaataagacgaacggtcaaacgttggacacggaaacctagggtttgccttttttgggacggagggagtatataccacaaagatctatgctgtgatatttcctaagattctttttactgtccaaatgattgcaaataatgaggagatattctcttaagaggcagaattgttttttttttttttgaaaggaatcagcacagactgtgctatatcattgaatagagaggtaaaaaagtactacccctatgggtgaaaggagaaaaaagaaactgtacaaggcgaaattaatctttgcactggccattgtccaagctcgtgcctcttcttttatttttgccattaggcttggggccgtcatctctttgtgttcaaagattctcctgttacgctccttccgaccgcaggtcttttttgggcacttccttcttgttggctatcatttcccaccaatcctgaacaccctgattggggcagaattgtttttccattttgaacccaattttcacatcgatgtttcgtattagacccacttttagtttatactttcactttaattcattttcttcttttttatgttttaacaaaactgatataaaaatatttggtgattgataaatactgctagcaaaagtcgtttattgattaaaacaaagagagcaattcacttcgcccctaatgcagctcgagtttggctcgatactccctcgcacgattttagatgtactctgacgtcttctgtggaccaaaaccgtacgttctatcatcacgcaactctattttaaggctccttagaacaacagatttttaaacaaattatagaggaatttattcttatagaaactttttgtttgatcatttggattaaagaaatagctatccaaaaatcctatgaaatttctttgaattagctcaaaacagagaaattttgtaggaattttgacgtgagtttcaacctcttgaaaaaaaaatcctttgcatctatctttattttgattcctacttttttctctccatccaaacacatttgttaaatagtcccacattggttgtggaagggcaaatgacctaaaatataagtgggggagcccctcacctcaatggagcttttggggtgggaaaggccctttacgatcctacaattggtatcagagcctggctaggttaacatctctggcccgatggacacgtgtgaaggcctgatggaccgtgggtacctgcggggcccgtatacctgatggaccgtgggccggtggggtctatacacggtgaaggggcggtgaagggctgagggacaccaatgtgtgaagggggagattgttgaatagtcccacattagttgtggaagggcaaatgacctaagatataagtgggggagcccctcacctcaatgtctagcttttggggtgggaaaggccctttacgatcctacaccatttctacaatgttgtcgtgttttcaaaatcatactcccttcgtccaaagaaagatgaatttagaactggatatgacatattacattataatacaatgtatctggacaaagatatgtccagatttgtattactaagatgtgtcacatccaatattatatcggttttaaatttgacggagagagtaagattgaaggtgttagtctgtttaaattcgtagtactaaaatgtagacagattcgtagtatttgattatgtgtcttatcatctaaaatcgaaagtatgacttatcgatccttatgtactttggaaatccactaccacggactcttgctgtcactatcggacagaagatatcaaaacagtttattttaaagtaataataaaaaaagcaagtggttatcagaaaggcgattcaacgcatccatctaattcatagtctacgtacgcatgcgttgcaggacccccttgctgtaccaaataattgcaagcaagtgacagtcagaaccctcgagcgtcatcaatttctcatgtgcgatatgattatctaaactctatcgaacgtgccaacttccatgcttttttttttttgaaggaatacaacttccatgcttaattgaggagtagttttgtccggctaatttgctagtctcggccaacccacatacagctagccaccatattttaagagctttatcatgcatatatgcgatttgccaaccaattgattcgagtccaactcaagactcgtagacgaaatcgatcatgtacacaggaagtacccagctaaaagtgaaatcaaaaccagcgtgtgctctgggtcttgccaatggacaaatgttccttttgtgattattactcaagaggaatttcccttcacgaacgaaaacggtcatatcaaatcggcatagcactagtgacggccacgactagttgaggactgaagaccagcaataatgacaatcgtaaactgatgaaatatcaaagtgattgtcagacaaagcgccattatcctgtcgcttacggctgcgtatgtccaaatcaagaatactacccgtactttgatttgcataatgattgcgttgaacgttggttgcttgatcatcttttatacactttgtcccataattttctttgcctttgtagaccgtagttcaaccaatgaaccaaacagcgagctgaaacgatggctggattggtcatcggctgcctggccgtgcagctctcgctggcgtctctgctgctgtgctcgtccgcgtcgacggcgcagcacacgctcggcaccggctcctccctgtcggtggcggaccggtcgcggccgttcctggtgtcgccggacggcaccttctcctgcggcttcattcaggccggcgacgacggcgacaacgccttctccttctccgtatggttcaccgccgccagggacggcgccgtcgtctggacggccaaccccgacgcccccgtgaacggcaggggctcgacgatctcgttccgccacgacggcgagctggccctcgccgacaccaacgggaccacggtgtgggcgagccggacgggcggcggcgggcggggcctgaccgtctccctccgcgacaccgggaacctcgtcatcgaggacccgtcgaccggccgcgccgtgtggcagagcttcgactggccgacggacacgctgctcccgtcgcagcggttcaccaaggacaccaagctcgtcgccggctacttcagcctctactacgacaacgacaacgtgctgcgcatgctctacgatggcccggagatcgccagcatctactggccgttgccgggggtgagcattttcgacttcggccggacaaactacaacagctcgaggatcgccatcctcgacgacgccggcgtcttccgctcctccgacaggctgcaagcccaggcctccgacatgggcgtcggcgtcaagaggcggctcaccatcgagcaggacggcaacctgagaatatacagcctgaacgcgtccaccggaggttgggcggtgacatgggcggcgctcagccagccgtgccaagctcacgggctgtgcggcaagaacggcctctgcgtgtacctgccgagcctccggtgctcgtgcccgccagggtacgagatgatcgaccgccgggactggaggaaaggctgccagccgatgttctccgtcggcaactgcagccagccggcggcgcctgagcggttcaagtctgtggtggtgccccaaaccgatttctacggctacgacctgatgttcaacgggtcctcgataacattcgagctatgcaggaaccagtgcctgagcgattgccagtgcgtcgccttctcctacaggttcgacggcgtcggcagatgcttcacgaaaggcaggcttttcaacggctacacgtcggcgaatttcccggggaacatctacctcaaggtgtccatcgacttcgacgaatcgtcgccattggtcagcgcgcggagcgccgccggcctcacgtgcaatcccaacgtctccatcgtgacagtgcccgctgccgtgtacgggatggctccaagaaacagcgggaagtggacctacctgtttgtgttcgccggtgtgctcggtgtcctggacctcctcttcatcgcgacagggtggtggttcctgtccagcaagcagagcatccccagctcgctggaggcagggtacaggagggtgatgacgagccagttcaggcggttcacgtaccgggagctcaaggacgtgacggccaacttcaaggaggagctcggccgcggcggctccggcgtggtgtaccgcggcgtgctcgacggcggtaaggtggtggccgtgaagaggctggcggtcgacgtgacgatgcagggggacgaggagttctgggccgagatgacggtgctcgggcggatcaaccatatgaaccttgtgaggatttggggattctgctccgagcgcaagcacaagctgctggtgtacgagtacgtggagaaccagtcgctggaccggcacctgttcgacacggccgaaggcggcggcggcatgtcgacgacgacgctggcgtggaaagatcggtacaagatcgcgctgggcacggcgaggggcctcgcctacctccaccacgagtgcctcgagtgggtcatccactgcgacatgaagccggagaacatcctcctgacgagggacttcgacgccaagatcgccgacttcgggctggccaagctgtcgaagcgggaccgcggcgccggcgtggagctcacccacatgagggggacgtcggggtacatggcgccggagtgggcgctgaacgtgcccatcaacgccaaggtggacgtgtacagcttcggcattgtgctgctggagatcgtggtcgggagccgggtggcggaccagaggacggaagccggcgagcggctgcagctgccgcagatcgcgcaggcgctgaggcatgtgctggacagtggcgatgtgaggtctctagttgatgccaggctgcaggggcagttcaaccctcgtcaggccatggagatggtgaggatttctctggcgtgtatggaggacaggaacagcaggccgaccatggacgacatcgccaaggctctcacggcgttcgatgacgaggacgaacaccccgcttaccggtcatgatcatcaccaggctaaccgttagcatagttcagcttagagcagcagtcagctgtgagtttaattcagcacttgaatttcaaatttaaggattatgaaattccgaaaaattgtagttaagacttcaaatcgagtatactcagtagaagtactatagtcagtattgagctcctccccaaatattaagcaatcagttgactgaaaaaaaaaagaaaaaaaaaagaaaagcactcccagaattctttgaaacaaaggtcccatcggttgcatacggctgattaaaaaccattacggcttattagtgataaaaaagatttatgagtaaaacttttatatatgtgtacttagcgtgtcggtgatatggctcggggtatgcgaagtgcgggggagttacctcctgatccagccacgtggccctacagcttggccctccccccgcgcctcggaagacccagaggcagccagggagcctcgggtgccacgtcacacccctcgggccctcgcgctgcctcgccctgaggccctcgctcaactgccatgtggcgaggggagcgagcggggaggagactcagactgaaccaccatcaatgcgcgccgccccaactgtccctcaccgcatttaatgcggtaagggcggacgtgcggtggggcccgtttgactcacgtcaatcaggcgtgaccaaactgtgactggcctgtcgccggtcacgtccgatcggacgggcggccgtgcccccacactcgcccctgtacccagcggagtggaggcaggtatgccccgtcccatcgaagtatcatccggagctccctccacgtgagaaggaccgccacaagtcttcatccatttaagacggaatgacacggctgtcccccgtgtcaggtggggggcggcgctgtgtcccactcaaggacggactgccgcttagcttccgggcgaagacacggatcgtggtccggtcaaggtaaagtggatccccctcccgtgaaagagtaggtagaagcggtgcatgtggtatccccttgaactataaaaggaggaccttgcccaccgagaaaagggacgacgctcagtaggcctgaactctaggaggagaagagcgagagtactctccggagtttaggaacctttgtaacactcaaccataaatcccacacacaggagtagggtattacgctccacaacggcccgaacctgtataatcttggcgcccgtacgcgatctagaaaccctcagggcggatacacgatctcgacaagcgagccttttcccccggccgaactcacaaaaggggatctcacgatctcccgctagagaggatcactcctcgacatagcgacttaaaagctaaagctaaaaaagaaaatctttgaaaaaacatcaaaatcaaatattaaaattcaaattttagcattggcttataactttatatgctataaggcaaacgatgaggctcaaacatcatcatataccttagcagaactgaattacaaatagtgtttttattccttcaaatttcagaacggtatggcatcccagcgcgctcacgctgccgatcgcgcccgtcgtgcctctctccatctctcatgcgcttcctcggtgcacgctaagccaattttgttatatatttgttgataagtgtttttctaaaaatttaacaaatgaaattatagtataatcgtaatataattacattggaacttgcatataaccgtaatataacctacacgtaactttcatataattttaaactattagatttgtttcaagattcatgtaagtgaggaaggaaaaaaatcacagcacacacatatgtgagaggattcagggtgtgttcggttgggcttttcaacttgcttttgcttttgtaaaagccaaaagccaaccaaatggtccaaaagtcacagctacttttgcccaaagtcagcttttggtatagtacaaatcaaaagcacctctactccctcattcatctgcttttgggggaaaaattagccacctcggccattacacaaaaaacgcttcacttcttctttcttttttctcccatccttccccccgtgcgtccctcctcctcacttcaccttcgccgtcgccgccgctcctcctccccccccggcgccgccgctcctccttgccgtcgaggccgactccatcaccgttgaggccgactccgccgccgcctgcgtctacctcccctccgccgccgttgcacgttctgcctccccgccgccgccgtcgaggccagctccgacgccgccgaggtcgactcccgcgtctgcctcctgcgcgttcgattccgccgccgacaccgtcgaggcctcctccgccgccacgcgcgtttgccgccgccgaggcctcctccgcgaccgccgccaccgccgctgaggtctccttcgccgccgcgcgtgtctgtcgccgccaccgccgctaaggccgacgccgcgcacgtttgtgttttttctttcctcttttttttccttcattttcccctcttttccaatgggtgtatgacatgtggagcccgcttgtaagtgggactagttatttcaaaagtcacaactgttgaaccaaacgagcttttccaaaagccacaccaatattccacagctacttttcgaaaagccacagcccacagctattttttcaaaagccacagctcaaccaaacacacctcagtccccacaaccttcatttcatagaaataacatgttttggagaaaattttttaaagttgaagatacatttacattgtaattacataaaaattacaatctaattgtattgtgattgtactataattacacaataaaggtacaggcaatccccgttgagctagttggcctgatagactggagggtggggagcgtggggctgggtgctgaggattcaattggaccgataatgagaggagatatatcctaatgggctgcacactgattggatcagcccaatagatgcatatctttcatgatcgtttatattagaaataagttcactttaactcccttaaagtgacccgaatctaatccgtaaccctgaaccgtaaaaccagaaatcttgacccctaaactattaaaaccggtgcaattttgactccccgggtggtttggagggcggtttcgctgacatggcggtgttgacttagtctccgtccgacgtggtgttgacgtggcgtttgtatggcattagaattaaaaaaaatgcaggacccatttgttattcgccaaaagaaatattgtgggacccacatgtcagcatctctctttgaccccttcttcctccctctctcccccttttctctctccctctctcctcgacaggggcgcgccgttgcagccgcgggcggtgaaggcagccgtggactcggcgttggtgctcacggcaaggggacaattgaggcaaagccgcgccatcctactgcggcgccagcgggatgacgacagggagcggcactgaggagactacaggcgacgagcttcatggttggtgagttatgaggaggaaggagagcccggagcagggggcggcatcctcctcgcccgccgctccgccccacttcggtcgatgggacaggagtcggagacggcgacgtcggcagagaggtcaacaccgacgccgcagccttgggagcaacaggtgcaccagcctgcccacgtcaccgtggtccccatcatagccagccctgcgccctagagctccctcgccgagctccgtaccgctggcgcctctctctctcaccatccctccatctcttcccccgatcctcaaccctgccccaccccaatcgaaaatggcagcatcggcggctcacatctagggcagcgttgccggtggctcacaggaggggaggagccaactggaggaggatgataaggcggcggcgtacgtagcaggtgggctcgttgttggtcattggaggcgaaggtgccagcctcgcgcgcgtgaggccggccaaacggtaggtcccatgtcgcctccgccctctcgccctccgccgccactccggcccccgcccgccgctgtcactggccctgctggccgaagggagagagagaaagagagagagataagggggagagagggaggaggaagaagggatagattgacatgtgggccccacatgtcagtgtgccccttttatttttcttgtgtgaatgacgaaggggtcctacgtgtatgtcttcaattctaatgccacctatgcaccatgtcaacggcagaccaggtcaacgctaccacgtggatgccacgtcagcgaaaccgctctccaaaaccatcgaggaagttaaattgcaccggttttaatagtttagggtgaagatatctggttttgcggttcaggatcacagattaaagtgaatcaaagtgaacttattccttcatattaggagaagtccattgtaggtcccttaaatatgggtcaacttaccacgtagcacctgccacgtcacaacgtccagccacggagggtccatgccattatgttgtccatgcggcggcgtggcatcaactggttcatgacaatttggatcgtcacaaatgttatgacgatgcctgttatcatgaacatctgtatcggacgactcgttttttttgtcacaataggtacggagcttccacagttctacgacgatgtttttttttatcacaagatcgttacagaacatgatttgtgatggaatcccgccggttcttgccaaaagtgccacttcaggaaagaccataactactagtagtgaatgatggccagattctgttgatatatggaacatatgagtaaggagggagggggggggggggggtttatgtgtatatcctaggtctatcttctattattgtcgaggatttcgacgagatggtggtcagatgtccgccggaggttgaactcctcatgctgttcgcagatattattagggctcgtttagtttttttttttcagttgcttatctttcgtttcgttgttcccctttctcctcttaattttagccctctcttggagtcgtgtactacccataggactcattgtattctaggagaccttgcatagagatattcttggtagtctctaatttaatcctagtcgagttcgagtatgtctcctacagtattttcaaagtagttctttattccttacgtgattggaatgtgatttctaagggaaaccatcccataaatatgtaggtattctatacggtattatttctaatgctataggtgtatgtcatgctttatacaccgacatcggtaataaaaattatatttgatatttgaaaaccaaacatgttcaaacttttgacattttgaccaataattttgtggttgattgatatagttgtattaccatcaaaaatttataaaattgtgatgcccagtaagtaattggagaaaaaaaagaaagaaagagagagagggaaaaaaaaaagcaaagctagcaacctattaacttaaggagcaaacagcagcagcagcaaaaaagcagcccagtactgtgctgtaagtgtaacatcgtgagtaaccgtagtaaaatttagtcccaatcgtccagccatgagagattgtgggcatcaccaatgtatatttaccaactactccctccgtcccataatataagagattttgagtttttcttgcactgtttgaccactcatcttattcaaaaaatttgtgcaaatataaaaaacgaaaagctgtacttaaagtactttgaataataaagtaagtaacaaaaaacataattacaaattttttttgaataagacaagtggttaaatagtgcaaacaaaaactcaaaatcccttatattatgagacggatggagtagtaaataaggtgtgacctagtaaaagtaggtatttattgttaaaagttccacaatgtataaccagtaataaggtaggttccaagataatgtaaagtttatcaccagccaatcgcatgaaggaagagggatgaggatcaatacatgccaaaagaataaatgttttttttactccttactacttggttgtagtgctcttacttgatagtagctatttactggttacacaatgcttactacttggtatgaagattaaaatattgcctattacctggtttgggagcacattgtggatgccgattaatgcccggtgactatttacttcagtttgaattgtctgtgtgaagcgagaacgaaaacgtaagagagttaaaagcgtatgtatgattcaactagatgagttggatccaaaaaccaatttcaggtcctaggcattacaaaaatctaataagctcatcatattatgctaccatttctaatgcatattacacatgcctatcaaagcttatgatattatgataccatttttattgcatacctacatatgctgtgtagaaccaagcatttgaggtattgatgatcaaagttccttttttttttataaattctatcatagacatcaaatactataagatttcgggtgtagttcacaccaaaattggaagtttggttgaaattagaacgatgtgatggaaaagttggaagtttgtgtgtgtaggaaagttttgatgtgatggaaaagttggaagtttgaagaaaaagtttggaactaaactcggggtgtgtttagttcacgccaaaattagaaatttggttgaaattgaaacgatgtacggaaaagttgtaagtttgtatgtgtagaaaagttttgatgtgatggaaaagttgaaagtttgaagaaaaagttgggaagtaaactcggagtcggccttacaaacagatgtaatatatccaatcaagaaaatagaaattaggttgttctgttcattctcgtccaagaatcgacgcctccgcccgttgttatgctcatcgtcttccaaaacttcacatctccaacttgtcacgctagctgttgaaaaagacctctattgtggcgattggtgatgcttcttcttctcttttactccctccgtttcactatgtaagtcattctagcatttctcacattcatattaatattaatgaatctagacatatgtatctatctagattcattaacatcaatatgaatatgggaaatgctagaatggcttacattgtgaaacatatgaaatatctctttggctggattgtataaagagagagagagaggaaggcatctatttggtgaggcattttatctgaaaaaaacatttatatgtgtcagggttatggataccacatacctaacagtagtcaactacatcttggcaggacccaccacatatcatgtcttatacggaaactgacctcggatatggagggagatccggataaggaaagacagccagagttctacatggaaacgatatggactactcggattgtatccatattggtttccctagttctacttagacaagaggacacctatgggtataaatacaaggccccctagcaggagagggggagacaatcaacacccaccacaatcgacagacacggaacaatagatcaaaacagaagccacattatacaagctaacatacgctaagacaagacgccggatatcgacttcagagataggcatggctagtcccctacggtgtctccggatactatcaggagagatgaaagcgctatctctgatctcgtcgagcccggattcgaggaggaagactaccctgttgtcgactacgagtcagagcttcagaccaccatgtcgacaacagttagataggctaccccaaatattgtactggtgtgattatgatgaataagagcaacgatcggcttcggccaacagaatgtagggttattacctaacaattcaggggcccgaacctgtataaaaatcctcgtctccgtctcttttacctaagtctcgcgtatatcctatgtcggtgacatgggatcgggagtatcatgactagaggtttgaggcagacacaatcgcccacgtggcctggcaccctcgggggacgtcgggcccgaaggtggtgtgttcgccctcctcttagtcccccgagggggtcgggctgcacccccctcggccccgagggccgaggcgccccgacccctcgtgggttttcgctccgcgtgtatggggtaggtgagcacagtggggctcacctaaccacatttattgcggtttggctgagcgtgtcacgacgcatgtaacgtagtgcattgcactcatttatccggtctgtgaccagtcacagaccggtcagatcgcgggattaggtggcgacaggcggtctgacgcacgcctcgccccatcccgtcaggacgagggcttctaggcgctcgtccccagctggagctagcgtgttacctcccagagatgacacgttagtcctgatcagatatatgccaggcttcatcctaaccattacaggcaaaatgtagtgtgaaggagggccaacgtgcagattgctaagctgacacgtggtggacaagaatgatcgatttgtgaccattctgacaccggtcatgtcgccagcagacagccatgattctacgtcgcacctgctcccggcgaaagtggaggtaggtgcgggccgtcccatcagaaggtgactcgaacggcaaccatgcagatctccgtccatttgtgaaaaggtagggtaagtccccataaaaaagggggggatggtgcatgtggtatccccttaagatataaaaggaggaccttgcccacggagagaaggggatagattttagagagagctttttcttggactggacctttccagattaggggcccagaacaagggagaggctggctgatactttgtagctctttcatacacagatctcccaaaaacacaggaatagggtattacgcttctcagcggcccgaacctgtatacatcgccggtgtcttctgtgcttcctgtctcgcgaaccttccacatacagattgggagtttagagtctcacccagggtccccggccgaatctgcaaaggggggccagcgcggtctcccggtgaggagccccacgctccgtcatcctagtaccaacgatcctcatactatacaaacaccggaatcgcgacatcaaacatcgacatcatgaatttttaatttttatttttacagggatacatgaatttttaatttgggatgtatacttacgaggagggttagagtctcatacatggataagtctaaattttgcgttatattaaataatgagaaaatggggattataccatcctcaaaacagggcttcgctgaaatgccatcctacaattgggattcgcccaaataccactttcaactgagcccaacccgctgaaatgccatcccaaatcattttcatcaaaaataaaagattttactctacttttcacatgagttgacgaaattacccctcagtcaatttcatccttagaaatcaatcggctgggagagcgagacgcatagggttagggttttgtccgcggcgccgatctgggcgccgccgcacgacctccctaccgccgccgcgccgccttgcccttccctccagccgccgctccgtcgtgccctcccctcgcgacgacgcggcgcgcctcccctcgcgccgccgctccgtgtcgtcgtccttcaccagcgccaccgcgccgcgttgcggccgtcccgtggcgccgacgaggtcgccgccctcccctcacgccgcggctctcccctggcgccgacgaggtctcccctcgcgccgcggctcggccggcgccctcccctcgcgccgacgcttggccggcgcgccctcccctcgcaccgcggctcggccggcgccctcccctagcgtcgcggctcggctggcagcctcccctcacgccgccctgcgctcggttgtactgcggcccctctccacgccggtctgtcgccgtctcagatctacttgcaggagtgatgcagatggattccaatgtttatgatatatgaactcagtttgagtgattatgcattttgtggttgggagtgatctgcgaatgatctgggaagcatgctcttaatgatgcttaactggtgttgtttgaatgctgttaatgatgcttaatgagtgattcttacgtggtgttgtttaaggcacgctcggtgtggtagttcctaggatgtaaaggtccttttttcatatgttcatcacatcctgtgtatatggtactctatatcctctaaatcgaatgaaccaggggtattttggtcatcaaagttgtgagaaaagagagaaaatgattttgatttactacaaatgaagagaatggcatttcagcgggttgggctcagttgaaagtggtatttgggcgaatcccaattgtaggatggcatttcagcgaagccctgttttgaggatggtataatccccattttctcattaaataatatagggtagaattggctcaaagttttgcaaatccgaacataaaatgcaactcaatacaaagacttacttgcatgctagtaattataagagcaagtttattagtatagtcaattgctagctctaaaatcatttacaaccaatctaatagtctactccatatacaatattgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggtcggaccactcctgcctcgcccccgagggccgaggcgccccgacccctcgcgggttctactccgcgtgtatgggttaggtgagcacagcggggctcaccgaaccgcatttattgcggctcgcctaaacgtgtcacgccgcacgaaatgcagtgcagtgcactcgtttatccggtctgtgaccagtcacagaccggtcagatcgcgggttaggtggcaacaggcggtctgacgcgcgcttcgccccatcccgtcaagacgagagcttctaggcactcgtccccagctggagctagcgtgttacctcccagagatggcacgttagccccggtcggatatatgccaggcttcatcctaaccattacaagcaagatgttgtgtgaagaagggcaaacatgcacgttgctaagctgacgcgtggtggacaagaatgaccgatttgtgaccggtctgacactgatcatgccgtcagcagacagccacgttcccacgacgcgcctgcctccggcagaagtggaggtaggtatgtgccgtcccgtcagaaggatgttcggagggcaaccgtgcaaatctccgtccatttatgaagagaagaaaagtccagtttggaaaggggggggtgcatgtggtatccccttgaaatataaaaggaggaccttgcccattgagaagaggggatttttctccagattcggaacctagaacaagggagaggttggctcacactttgtagctccttcatacacagatccaccaaaacacaggagtagggtattacgcttctcagcggcccgaacctgtatacatcgcctgtgcctcatgctctttcgataggtcgcgatctttccacatacagagagagcttgggatttcaccctgagcccccgaccgaaccggcaaagggggggcctgtgcggtctcccggtgaggagccccacgctccgtcatctggcgcgccaggtagggggcctcagcgtgtgtcttctgagctctcgcactctgccctgtgcaccaagcttttcctgttcagcctgatggccgagcaagcaaaggcgcacgacctctctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcgggcgatggaaaagaacggcgagatggggagcgtcgcctcctcgtctacggcgacggcagcacgccccagggcgcgctccaagctgcgggcgcgctcttacgccacccgcctgtcgtccctgacccggagtctccagcccaacgatggctggacgacgtggccaaattggtcatgacggcgcggcagtgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcactaagtcctcaccaagaagaaaactgcagcggaaaataaaatctagcgaagctccagctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacattgaacagcacacccatgctgcacaggcccaaccatcctgaacaaccatacccggctgtacagatctaatctccaaaccaagagctaagcaaattattatcaggtataacatccataattattgtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgccccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagaaattaattaaccaatcacgattgaccatcgtgagctaccattaaaccatcattaaataataatgaatcataagttatcccaatagtgtgctaatgtttctaagcatggctaagcaatcacatctaatatctagctgaaccaatatataaagctcaactagtcaaattataataacccaaggtatcaaggattaaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcacgaaccttcgcaacgacggaaacgacaagctaacacgcaaaacgaagaaaaagactaataaaaaccaaataaacagtacataaaaagtaaacaaacatgtagatcatatttttagatgaattatgagacttgaacggcctcattctgacttcaaatgaatttattaagaattttacaagattaaatctaattaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacgatgacgccagcgatgacgtcaccgacagcggcggcagctcggcggagcggatagctcgggcggcgcacgctcgccggcgaacggcggcacttcggcacaaacggagggcaccagcacgtagaggacgacgcggcgaactcaccggtgaccaaaacggcggcggaagaccaacggacggcggcggcgacgaggaggaagcggcgaagctcttcgggtcgacgacggcgatggcgctccgacggtcttcggcggcggcgaagcggtggacggggacggcgacgacttggcgaacccgatggtggcgacggcgaccgacgacggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcgggcggcagcggcggctcgaggaagacgaacctgacacgtgggacccacctgtcagcgacaccgagagagagaagagtggcggctcggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaataattccttttaaacaaccatttataagttaaggatttttaaacaagaaaagatcttaacaattatacttagatcattaatgatcaaataattactgaactattctttgtattatttaagaattgagctctgaaaaatccgagaaaatttcagagagttgacttaaccatggagaatttaacaaaaattaaatccatccatgctttagatttagaaaattttatttcccacattttacttcacttgaaagttaaagatcatttaatataaattctattaataatttattaaataatttataaatcctgaaacgaaaatcaggatgtgacaggcagcgcctagatgctggtggacggtcctccgccaccaaggcctctggtgctgctaccaccggctccgcgtcgtcaagacggagggcacgacgagcggcagccgctgttcgccgttcggctgccactccttcgtcgactccttcgacccgggaagatctgcgtggggagcaggacgcccacaccagcatcgagcgccggcgtaatgaccgaagtgctgcccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgctgaaaaatatgatggcagcatcaaccccgccgagtttctccaggtctacacgaccgggattgaggccgccgggggtgatgacagggtcatggcgaatttctttcccatggccctgaaggggcaagcgcggggttggctaatgaacttgccacccgcgtctgtccactcctgggaggatttgtgccagcagttcactatgaactttcagggcacatatccgcgcccaggtgaagaagcggacttacacgcagtacagcgaagggatgatgagtcgcttcgctcgtacattcagcggttctgtcaagtccgcaacaccataccgtgcatccctgcacacgcggtaatttacgcgttcaggggggggcgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccgctgctcaaacagggcggcgtgacaggaggaggaaaaagaggtcagtccattccgacgacgagggtcatgtcctcgccgtcgagggcgcttcgtgggccacccgaaaggggaggcctgcgagcgacaaaaagaaggaggccagcgctcccagcagggagcgccccaccggcaagtggtgcaccgtccacaacacctccctccatgaccttgcggactgtcgcgcagtcaaaagcttggctgagcggacaaggaagtgggaggaggagaggaggcaggggcgccgggaaggcaagtccccggcggttccttccggcaatcggcgaagtgaggccaagcagagggcccccgccgaggacatcgatgatggcgatgatgacctaggtttccaagagcctggggccaccattgccaccgtcgatgggggagcgtgtgctcacgtttctcgccggagcttcaaggctatgaagcgagagcttctggccgcggcccctactcatgaggcgacgcgtcgggcgcggtggtcggaggttgccctcacctttgaccagaccgaccacccaccgtgcgttgcccggggagggcagattgcgatggtggtttcccccaccgtttgcaatgtgaagttggggcgagtcctcattgatggaggagcagccctcaacatcctttcccccgcgacctttgacgccatcaaggccccggggatggtgctccggccgtcccagccgattatcggtgtgacgtcgggacacacttggccgctaggtcatatcgacctcccggtcaccttcggtggatccgccaatttccgtacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggtgacctcaaagtcgcgcttgcttgcatggagcagcgcgtagaccatctcgccgccgcgtccaagcccgagggtggcgatgagaggcttggcgcctccgcccccgctaccccgaggcagcggatgatcacatgcgacgaggtcccggtcaaggaggttgccctgggcgacggcccgtccaagaccacgcggatcggtggtcttctgaacggcaaataggaagacgcgctcgtctccttcctgcgggcaaatgctgacgtcttcgcatggagaccggcggatatgcccggggtccccagggaagtgattgagcaccgtctcgccgtacggccgggcgcaaggccggtccggcagaaagtgcggcgacaggccccggaacgtcaagccttcatccgcgaggaggtggcgcgacttctggaggccggattcatccgagaggtcatccatccggactggctggcgaacccggtggtcgttcccaaggtgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcagcgtactactcgaatttctttgggtagccaattaggacgtaatgttgaggcttatgtcgatgacttggttgtaaagacgcgcaaccaagaaacgttactctcagatctagcggaaacctttgagggtctccgctccgcccgcataaaactgaaccccgataagtgtgtgttcggtgtacctgcgggcaagcttctcgggttcttggtctctgcccgaggcattgaggctaaccccgagaagatacgagctatagagcggatgcgcccccccagcaaacttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctagtcgccccggagccaaatgagcccttgctactctacttagcggcgaccccgcaagtagttagtgcagcattggttgtggagcgcgatgaggacaatcctcactccacgcatcccaaccctgtgctgactcagcccgggagagggcagggaggagaggcccccgagccgaacggtggcccaaggcccccgacgaccggagttggctctctgcccgcttgtcagatggtgctaggagcccccgacccacaggaaggccctgaggccactatgggaaggccgcacctatcaccctttgaccccgaggctcaccctgtgctgactcaacccgggaaagagcagggagaagaggcccccgagccgaacggaggcctaaggcccctgacgaccggagttggccctttgcccgcttgtccgacgacaacaggagcccccgacccccaggatggccccgaagccactgaggtaaggccgcccctgttatcctccgaccccgaggtcatcagcaccgaagacaagtgtgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgactttgtggcagagtggaccccggctcccgagcccgtctcgatccctgaggccagcacggacccctcgcagttgcctcacaccgcccattgggtgatgcagttcgatggctccctgtctcttcagggcgccggtgcgggggtcacattgacctctccgagcagagacgtcctcagatacttggtccgcctcgactttcgagcgaccaataatatggcagagtacgagggactccttgccggactcagagtggcagctggactggggatccgccgcctcctggtattaggcgactcccagctggtcgttaaccaagtctgtaaggagtaccggtgctctgatccgcagatggacgcctacgtgcgccaagtacggcgcatggagcgccattttgacgggatagagcttcggcacgtgcccagacgggataatatgatagccgacgaactctcacgactcgcgtcctcgcgagcccagaccccaccgggcgtctttgaagaaaggcttgcccagccgtcggcgcgacccgaccccttaggggagatggacgcgcctgatcggcccccgaggcccgtcggagcccaggcctcgggacccgaggggagcgctcctagctcccttagattgattgcttggatcgctgagattcaagcatacctcacagataagactctacccgaggaccgcgaagggagtgaacgcgtccaacgtatctccaaacgctatgtgctggtagaagggaccctctatcggcgcgcggctaatggagttctcctgaagtgcattcctcgggaacaaggcgttgtgcttcttgccgatatccatgaaggcgaatgcggagcacactccgcctcgcgcaccttggttggtaaagcttttcgccagggtttctattggccgacagctctcagtgatgcggtcgacctggtccggcgatgtagagcgtgtcaattccacgccaagcaaatccatcagccggcccaggctctgcagaccataccactttcgtggccatttgctgtctgggggctcgatatcctgggaccgtttaggcgggccccgggcgggtttgagtatctgtatgtcgcgatcgacaagttcactaagtggcccgaggcttatccggtcatcaagatcgataagtactccgcacttaaattcattaagggcatcacggcccggtttggagtgcccaaccgtattattacagataatggcacctaattcactagtgaactcttcggcgactactgcgaagacatgggcatcaagctctgcttcgcctcacctgcccaccccagaagcaatggccaagtggagcgcgccaatttggaaatcctcaaaggccttaaaaccaagacttacaacatactcaagaagcacggcgattcatgggtcgaggagttgccagcggtgctctgggcaaaccgaactacaccaagccgagcgactggagaaacgcctttcttcctcgtctacggcgcggaagcagttctcccatccgagctcaccctgaggtctcctcgggccaccatgtactgcgaggctgatcaagatcagcttcgtagagatgacctcgactacttggaagaacgaaggcggcgcgcggccctccgagccgcgcgttaccagcagagcctgcggcgctaccatcagcgccaagtccgggcccgatcactctgcgtcgacgaccttgtcctacgccgcgtccaaacgcgtgctggattgagcaagctctcaccaatgtgggagggtccgtatcgagtgatcggtgtcccccggccgggttccgtgcggctggccacgggcgacggcacagagctgcctaacccgtggaacatcgaacaccttcgtcgcttctacccctgagagggggggtcgggtgtcaggtttcgggctcgggccaaccccgcacccccttgggcgtgcagggttggccgggggctgccacacatgcacattcttatttctcttgtttcagtatttcaataaaagaagtttcattctcctaaaggccgtatctgtgctattttttccttttgaagaatcttgacttgaaataggtcacttgtgctcaatcctgccctcgggggctcgggtcggctaaaaccgccaaacggggcccagaaccgagccgtgccccggggcgtggtgaactccgggggggaatcggcaaaaacccacaatcgggtcacccataaccctcggtcaccacgtttccgccctggccagtctcgacatgtggatctccccaggcactagccccgacccgcgccttttgaggattgggacttggacacgagcccttaatcaagctaagacacaaaaggaccatggcacagatcgtcctcatctcatgcacatagcaaaatgaaattaacacaaaaaatttctgcatttttgattacagattaagttggtctatacaaaaaagaggcccgaaggccttagaagaaggaaaaaaaaggaaaaactaaagactgggggcgccctgggggctcagtccgatgctcccgggtcgccggcctcgtcgtcactatcgtctgcacctccggcatcgtcctcctcgtcggagttgggggcaaacgcgagccgaggggccgagccctcgaagctgtggacgatatgttcggcggcatcccgaacccgcgcgcgcgcgtcgtcctcggtcccgggagggaactcatccagcgccatccatggggagaagttggggtccctggcctggtaactcgctagtacgagttccaccgctccttgggcgaggtccctcgaggatgacttgatggtcttctcgagctcctcggggagctgctggagagccccggccatcttcgagaggtgctgagcgaggcctccctggttggtggagtacttcattgtctggcctttccagaggcccacttgccgaccggcgcgatccagacgggagactgcatcccaaagcatgccgggccctatctcgctcgccaagcggagggcctcggcttccccggcggatgagtctagcgcgcgctgcatgtcggcgatggtgagttcggtagctgcgaggcgggtggctaagtcactttcgcccgcagccgccccgccgctgcgtgccctcgagtccagctccttttcccgcgcctcgaggtcagcggcccgctggtccagtgcggccctctcggcgcggacacattctagattgcggcgtgcctgctccgccagcgctgcctcacggagggacaggctgtcatccaaccgttgcgccgcggcctcggcctcttcgagagctcgctcccgctcggtaagcgcgtcctcgcggaggcggagtgcggactcctcttcggcgcaggcagactcgtgcgccgccagcgttgcctcccggatggcgacggcggcctcgcggtccgccaggtccttctccacgacgcaggcgcgctcttccagcgccatggcgcgcgcctcaagggtctcttcgcgctgtcgggacgccgcttcggtctccgccgcccgctgctcttgggcagcggcagtgtcaagcaccctttgggcggcgtcgagctttttccctagtgtcacgtcctgataaattcatcccgaaataaaaatcattcgctaaaaggaataatagaattaattaaaattcgaaaagaaattggcaaacactaaaatacgtgcaagaaaaattcaaatgtggcccagagaatttttgttaaattctccttggtctaaaaggagccctcaaattttacttgaattttcagagcaccggaaataattattaagcaacaaaaacaattaacaaagtttattaaaaagaaaatctaaaaataattctcctcctcctttgggccaagcccagcccgaagtccttctctcctccctctctttctctccctccccttctctccctctctctcccgggcctctcttcccctcccgggcagcccactccctcctctcctcctccttctgggccgcccctccctcctctccttcccggcccaccttctccccctcctctcctcctgggccgtgtcccggcccagctgagccgccccccccctcccgcgcacgtgcgctgaccgcgcgccgcgcgcgcgctgacgccgcccgaccgcgtggggcccacgcgtcaggccgccgtcgcccccaacctccagccgcccggccccttcctctctctccctcccgtgcgaaccctactcccttcctccctcaaatccgcgcgaatcaagcatgggattcccaaattgattgaggggaattaatcccctttcccttctctctatttcccccttaatttccccttgaatggtgcccccaatcgccgggaacggccgcgccaagtccggccgccttcctttgccgccggccaccattcccgtcgccgttccgccctctcccgtgctcggctcgcttccctcagctataaaatgcaacccactcgctccgttctatcgctttagccccctcccgcggtctcccgtggtctctagccacctccccaccgtcgccctctctctcccacgttgccggccgcctccagccgcctgtgccgcctcgaccgtgcgccggccggccgcgccgtcgcctcctccagcgtcgccgccacctcctccaccccggcctgccctccgtttcgcgcggtgaccgccggaggcgcactcccgccgtcgcccttctcattcctccttgccggccacctccagccgcacctcccgcctcgcccgtgcaccctccggccgcgccgccacctctcccggcgtcgcagccgcctcctctttcccggcttcgcctccgtttcgcggggaaatcaccggagacgcgtcctcgccggcgtccagtggcgtcgccaccacttctccgcctccggccgcctctgccgcgtccccggtgcaccggccgacgtcgccaccacctctcccggcaccggagtgccgtcctctctcccggccaggccacggcgtcgcccgaatttcgccggaacgccgtcatctccgcgccggcctctccttcctcctcgtcggctcgtcgccccgctgcaccaccaccttcaccaacatcgcagcggcgtgttccacgccgtcccctcctccactcagccgctgctgcctgccatcatcgtttcatcgtcgtctccgatcgttctcgtcgtcgacgtcccgtcggtcgcccggctcgtcgtctcgcggcgccgcctccgtcatcgtcatcgtagcggcgtgttccacgtcatcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcattcgtcaagcgcgccgctgcagccccgtcctcgtcttcgtcctcggctccgcgtcgtcaagccccgtgccggccgcgtctcgccttcgtccaaggatcgccgccgaagccgtcccctcgccgttcgtctccgttgtgcccgtctgtctccgccgcgcccgttcgtcgttgtcgttcctacgcctcgtcgcgtggtggtaaggatccgtcctctcgctgccccgttctcgtcctttcggtgtcgcccgtgcccgttgtgcggttgacgaccccggtacccgtgtaccggtgtcggtagtcgttcacgcgtgcgggtggtgaccgtgtagtgtccgcgttagtgtgcccgctcggtagccgcgtggtttccacgtgtgcaggccgtgtggtgtctagtggagtccgtttgtcggccactcgcctcggttgacacacgggatccgcttccgtcgacccgtggaccgactctgtgtactcggtctaccgcggtcctttaggttgacatgtggggtccgcatgtcaacggcgcagccttcctgtcttttccaggctagcgcttgcacatgttttataattgcaaagcttgattataataatccgcaaatctccatataacagcattaaacctcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccttaatattattgttattgatattattaccttgttcaccctagattaaacaaaaccccaactagtgggtactctatttatggttccactagtatgaacttaggtagatgcttcgctggttaattaggcaacattaggtgattttataactttagactttgggaactctcatatcatttggacactatggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctagtgggtaaggcttagtttgtggctcagcctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgtgaggaagatgtgtcttgtgggtaaagatgtacgcctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaaggctgttactgcaaaacttaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagctgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctctttttctccttcccctaatgctatttgcaaagggtttacccttttcttccttcttcaaatttcaactagtactagatggtcagctttgcgaagaagaagatgtcgtcagttgtttgccgaagctccggaagaatgcaggatccgctagcgaagtggaggaagcagtgaagccagctgtgaagcaggagtgaagatcttagaaaacccgtcgcagaacctaagccgccctatagggtagtgttgttagtcgtgtgttccttgcttgtgtgtgtagcgcgtggtttgcatcggtgggtggtgatgtaaccatgctaggttgtttgcttaatcaacttgcagaataagcaaaacaaacaacacatcaacaaaaagagttagttcctttaaggtcctgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtacctacagtccagcaacagtgcaagttatcagaatttctcaaaacggggcctccaacctttgccatggccgtcgatcctatggaagccagtgattggttgcgcacaatcgagaagaagctagggttgattcagtgcaccgaccaggagcgggttggcttcgcaactcatcagctggttggaccggcttcagagtggtgggatagctacgaagcatcacggccagaaggacataccatcacctggaacgagttttcatctgtattcaagagatcacatgttcccgcaggaatgatcacactaagaaaacgagagttccgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactacttctagaggattatgaagattttgagaaacttgtggacaaagccatgcaactcgaaagtgagcataatcggatgacgaactgcaagagaaggattgtcaacatcccagtatttccaggtggtaaccaaagacagcgcactgagccacttcagatcaccggatcttctgttgcgcatcaagagtttccgccccaagaagatggacgcaatacagacaacaacactagcaatactaatgatgatgataccaccaacaaccatggttcttgccccattagtgaccactcgaataaagcgtgcaatgtcagtagcattcaccaagatgtcaacgatagtatcaatgttggaacccagaatgacaaccttagcaatttcgacactgagaaagactccaatggtgatagcaactatggtaccactgatgccaatgttagcaaggattcccaaccaccaattccaactccaagtcaaaatgatcgtccccagatggacagctcagtaaagaagacgttgatttgttacaactgcaaagaaccagggcattactcgagggactgcctgcaaccaaggcaaagtcgacctccacattaccgccaatttacacgaagcagacatcccaatcgtattgtggtcactggagcaaacgccgtacccgtaaggcctcgggttaatcagaacccatagcagaaacaatgtaccaatgccaatcacctttccttttaggcagtgcttagtattcatgtaatgagggagaaatgtgtaatacagacaagttctgagaggattctattggaagatgcggatatgtgatcatgtgtataattgtttactgaaaaaggagacctagggtctcgtgccagaggaactatattctaccctcgagctaataacccacctgaggatggaaaagaaaatcaagtgattaaccaaagagacatttgtttggactaagagtttcagatgtgtctttttcggatcaaaggcaatgacagtcagtatagcttttggcgaaacacttcaaggtttcactgaaaggtagcagaccaaaggacctcatcgccaccagaagcatccacaactctcggagtgaagagtacttagtgacaaaggtcaaaagatgactgatagaagatatcgaaaaagatgtttattaccaggcaaagaagtaggtcgaaaggtgattgataagagaaatcgggaaagaacacatcaaggtcaaagggtaaaggaatacgttgaatgctaactgaggacaacatgaagtgaatagtggtaagttagaagtaaatgacaagcatgatattctcatgataacaagcatggtatcctagtaatgacaagctgatatcgacgcataacgtgaagtgggtaacttgtatgaggttgacgccaaagatatgaattatgagaagtctggaactgaagtcccatcttcaagtgccacaatccagtcgaagtcagctagaggtgcaaccagggaaaagtcaggtgaagagaagattccatctgcaacaggagattgagccaagcagtccagagtggagaagttttgctaggcaagtttgttataaaagatgcgacggaagaagtcggacaagaagagaagaccgcccaacctatcttcttgctagcctcctcgaatctcggggacgagattcttgtaaggggggtggatttgtcacgtcctgataaattcatcccgaaataaaaatcattcgctaaaaggaataatagaattaattaaaattcgaaaagaaattggcaaacactaaaatacgtgcaagaaaaattcaaatgtggcccagagaatttttgttaaattctccttggtctaaaaggagccctcaaattttacttgaattttcagagcaccggaaataattattaagcaacaaaaacaattaacaaagtttattaaaaagaaaatctaaaaataattctcctcctcctttgggccaagcccagcccgaagtccttctctcctccctctctttctctccctccccttctctccctctctctcccgggcctctcttcccctcccgggcagcccactccctcctctcctcctccttctgggccgcccctccctcctctccttcccggcccaccttctccccctcctctcctcctgggccgtgtcccggcccagctgagccgccccccccctcccgcgcacgtgcgctgaccgcgcgccgcgcgcgcgctgacgccgcccgaccgcgtggggcccacgcgtcaggccgccgtcgcccccaacctccagccgcccggcccttcctctctctccctcccgtgcgaaccctactcccttcctccctcaaatccgcgcgaatcaagcatgggattcccaaattgattgaggggaattaatcccctttcccttctctctatttcccccttaatttccccttgaatggtgcccccaatcgccgggaacggccgcgccaagtccggccgccttcctttgccgccggccaccattcccgtcgccgttccgccctctcccgtgctcggctcgcttccctccgctataa

SEQ ID NO: 66353 - DNA, 929 bp, Oryza sativa
cgtaacaaattttttaagcccacttaatctataattagcgtatgtttactgtagcatcatataggctaatcatcgattaattaggttttatagattcgtctagcgaattagtttaggattatagaatgagctttattaataatctatatttaatatttataattagtgtccaaaccttgatagggacttgaaagtctacacagtagtacagtaccactcgtatatccgcccaaatttttgggttcacactcggcggcacactcgaagctcccaacaaccaaccaaaccccaaagcatatcacaatcagtggggagggaagggccccttatttattcgcattcctctcctcatcatcactcatctcccttccctgtcgattaccttctctccttcctctgttcctcctctcctccacacatccaggcaggcaacacaagaatcatccgggagagcgacatggccccggttgccgtgggcgacaccctccccgacggccagctggggtggttcgacggggaggacaagctgcagcaggtctccgtccacggcctcgccgccggcaagaaggtcgtcctcttcggcgtccccggtgccttcaccccgacctgcaggtctcttcctccttttttcgatttcctctcccccctctttcttggagacgttatatttccctgaaaaaaaaattccttaaaaaatgggacttctttttatcagatcgagaaattttactgcaaaactgaaatgtgtactagctgatgtccggaccaaatccaagattactgctttattatacagatactcacaatttatgggattgatttgacgagctctgaagtcactcccacttccttgggtgtcagagttagggttaaaaatcttgatgtgggtttatatattgctagttgcatgactaaaaagtagacttcga

SEQ ID NO: 66354 - DNA, 1989 bp, Oryza sativa
attttgcagttaacgacccctttgtcatgaaggcgtgggcaaagtcataccctgagaataagcatgtgaaattccttgccgatggtttgggaacatacaccaaggcacttggtcttgagcttgacctttcggagaaagggcttggtattcgttcgagacggtttgctctccttgctgacaacctcaaggttactgttgcaaacattgaggaaggtggccaattcacaatctctggtgctgaggagatcctcaaggcactgtaagagcttcagctcttaggaacggcagcgatcacttggacctatcgtgtcaatcttgtttaaatttgtctgcaaaatacttgtgcgaataaaattgtcgatgagctgcctagttgtgaggactttatgataatgtttgaatctgtatccactgttgaatcaagtagtaatgttcagtgctcatgttaagttataatcttcagtttatatctccagaaaaaggtttgatctttccgttgacacttagacagtgacttctagagtaaactggattattggtcaagaagagagaattttatggtagaaactgatcggatcgcaacagcaatgcccgttctctgaacaggcatatactgcctctgcacagcttaatactcttttaatagatgacgctgttgactttttctcacacatttgaccattcgtcttattcaaaaattttatgcaaatatataagatataaatcacacttaaagtactatgagtgataaaacaactcataacaaaataaagtataattacgtaaattttttgaataagatgaatggttaaacatgtgagaaaaagtcaacggcgtcatctattaaaaaagaaggtagtatcagcgtgcgaagatggcaataaggaggctgtgcggttatttcatttacaaggtaaatatggtgataaatctaggcttaatgcctgggccatcttgccaattacttatactccgcatagtttacagcaactgtagcttgcatatctttgtgttactgttggtgcgcgcacgtctgcttttgtattccgaaggaaaatatgctagtgtgcattctgttattcagatactagcggtttcacattttgaatttctgatctattcatgcaaaaattttccaaccaaaatgaggccgtgaaatatgcatactgatttcatctcaactgagatgagcagattacaccgccaaatcgccaatacaacccatccagcctctctgaagtttgagctatttacaggtgctccccccggtagcacaaccaagcatgcagctgtctgaccattttttcaggctacagctacctatgagaaaagcttttcaacccaccccccaaattatcaactttctcaatgtgcaaaagtttctttgtgaccatgcggtggactttcctcagcctcgcgcctttgtcctcgtgttcttgctcttgccagtgaatagagttgttggtcacttgtgaattggcatctatgctgttcacagtctcctcttcctccagtgcattgtcaatgatctcggggatgtcaactagactgggccttctccttgatttcgtgcgctttgggtctctagcaatggcatcagcgtgaagaacatcctcgatccgagataaaactgcaaaggctaagctctcaagagtcctggagtagctctccaagatggcatacccaacatcctgaagaaaagaagtagcaaatgcaggtggcatgagtataagtactgtagcaaatccgaaaaaagtaactaaacatgcagctatggttttttttttttgaccttgttgtattgtatcttgctgatgtcaagtgatgactgaggaaccccagggaactggtgcttgaggatgagtaggacagtttgcgcccgctcttcaaactgctctcgcttctccaagctaacaccggggccccaggaaagcttattggaaattttcctctgccaaattacaacggaggcctcaattcggtctttga

SEQ ID NO: 66355 - DNA, 4620 bp, Oryza sativa
cattttttccccatattcatccagctagatatagccatgtacatttcattttttttctcgtttctgtccgttatatacatacatatcacctcacagatgtgaatgttcccctccattggaactgttgaagagcaaagcagatactctctttgatatacatgaacaaaggttaaatcaaaaccatagattgtacacacaatggtgtgcttggtcctaactcgcaagttccttttcaatatttcattctcctcagctgcgttgcaccttgctctgttctgatctctgaattcctgtcaatgcaaatatcgtgttgcgtgctaatgtatcatgtattcactgagaatgttcgtggcttggcttcctataccagctgtagtaccgaaatttccctatgtaaagcctcctttggaacggagaaattcgtggtaattttaagggatttgaactaaaatcctactagtataaaattaatgcattgcaaggtatggtcagagctcagcattttcggaaagcaagcaagctcacctgacgtggaaaggctaacgggcgatcgattgctgtcggcgatcgttttttttttctttttctcttttagtaagtttatacacataaagtttacacatctaaagtttatccatctaaaatttgtaaagcgaatgtttataagttaaaagtttatatacccgattcaaattcaaattcgaattcaaatattttatattttcctcttttagtaagtttatacacctaaaatttatacacctaaagtttacacatctaaagtttatccatttaaagtttttacaacgaatgtttataagtcaaaagtttatgtacccgattcaaattcaaattcgaattcaaatatttgatattttcctattttagtaagtttatacacctaaagtttacacatataaagtttatccacctaaagtttgtaaagcgaatgtttataagtcaaaagtttatatacccgattcaaattcaaattcgaattcaaatattttatatttttctattttagtaagtttatacacctaaagtttacccatctaaagtttatccacctaaagtttgtacaccgaatgtttataagttaaaagtttatgtatccaattcaaattcaaattcggattcaaatattttatatataaaatatttctatacacaaagtttatgcatgcaaagtttacggtataaagtctatgcacatgaatgagagtattagatttttttcctaattttcttttactattttttttaaatttatgatgtaataaaaaagtaaaaaagagagatgaaagataagtattaggagggagggatgggtgatcgctaggaggagagggaagcgatcacccgcccactagcaacctcctttaaaaaccatataaatagttaccaattttttttaataaattgataatattcatataatatacatataccgctctacaaaatattaagttccaactcaaacttatacaccatataaaatagttaccattttttttaaaaaaatgataatattcatataatacatataccactctacgaaatactaggttcaaactcaacttatacattgagatataaaaacacaaattcagatacaatatttttttacgggaattcagatactatacagaatggccatttgtgcttgggcccaggagtaatctgaaccaaacgggccaactccaacgatacgagtgggccctttccttctttcaacccacggaaaccggaaccccaccatctggccatctccaactccaatcaggcgtccaaatgcaaaaatccgttaccaaaattatggaaagcctccttccccacgccggctcattctaacaggctgcgttacccactcaccagtcggtatgccgtatgccaatcgggctgcgccctgactgcttacgacgatactatgacaaaataaaagcgaaaatgattatccagtcggttgcgttgcattccattccgtgtcggacacgatgagtttgccctgcgttcgcagcgatcgccctggactccgatcaggtctcgaggcgcatacgcattcgcgcctataaatccagggcatatgcgccatccaaacccccttccatattgagttcccgagggagaattcgatcgaagaatacgagcaaattaaaatcgatcgcgatacttcggtgttgacgaaacagcgtgatctctctgccccgcaatatgccgccggctgctgcgggctactccgccggcatgaagcggcctctcgccgcggtggcgccgtcgtgcgacgtcgacgggcgcaatgccgctgccgctgccgctgcgaaacggcgggaacgacgacgggaggccaagcgggcgcgcgcggcggcggctgcggcgacgggcgctctggtcccgtacgtggcgcccatcgacgcccggcccatacgcgccgtcccgctcgccgccgccgcggccgcgcggaggaaggaggccgacgaccaggcggcggcggcgccgtccgcggagccggcgtggatccgcaagatactgctcgagcggctggggatgacgtacgaccagccggtggtgttcatcgcgaggaagacggtgaccaggaccgacctcgacccgcaccagaaccggttccgcctcccgatcttcggcgtggagcgccgcctcctcccgatgctcaccgtcgacgaggccaaggaggccaacctggtggagaacgacgaggagaagggggttcctcgcccgaggccgaggcccaagaagaagcgacgcacggagaaaggcagcgtcgtcatcgccgccaccgccgccgccgacggggagctgcagaagccgcagggaacgacgccggagacgaacgtggagggagaggatcaggctcctcctcgcccaaagccggtgccgaagaagaagaagcgacgaacggagaaaggcagcgtcgacgtcgccgacggtgagcagcagcagcagcagaaggggagggagaaggagccgaggaagaaggcgcaggggaaggaccacggcggggtgccggtgacggtgctgcacctgagcggcgccatgaaggagctgcggctggtgctctgggacagcagccatggcaccatcatcaaggggaccggctacatggacttcatcgccggaaccggcctgagggagcacgacgccgtgcagatctgggccttcaagcgccgcgggttccgcctcttcggcgccaccgtgccggagagccgcttctacctggtgatcgtcggcggttcgtggcgcccgctggaagctccaccgccgcagtgcatgctcccgccatctcacgcgcctgtggaagtatgtgcttaggcaggatgggtatagactgaatagagtagtgagatattttacagtgctggcacctcccaatgtactgtacatcccatctctaactcatctctcgagactacgagtatgtaattttttttaaggataataaattgagatttacaaataaactttaataaatgtgtatttcttatcctatatgggttatttttcttcttagtttggtgttcttaattttatttgaacttcgctcgttttagagtgctacatctatctatctatctatctatctatctatctatctatctatctatctatctattatatagtaaaagtccattaaacttcctacaaacgctcctaagccgtcacgtagcaattctataaacactcctaagtcgccatgtggcgttttaatatattagaaacatctggcccttaattttcatttaaattggtgggtccataattttacaccattagattagattaaaaatagaccctcatacgtatgcctccctcaccgcctgcaagtacgtacatatgagtaagaacgtaacataccccacttttttccttttttattccccttcttttattattttgctttacctaatatacctccataatattattggcgtttgaacatatgtttatttactaaagaaatatgtaattatcatttattttgttatacttttccattaaatttcctacaaacgctctcacgtcaccatgtgtcactctacaaacgcttctacgttgctaagtagcgctataataaattaaataaaataatataaattcttagttaaaataaaacatttaattctcgattttcacttaaagctaagagaccattattttagacaattaaattattatatctataaaaaataatctctccctcctaatatcccgttcaaattattaaatctataaaaaataatctctcgctcccaatatcctattcacatagcctagtggttacaagagcttcagtagcacctgaggtcctgggttcgactccccgtgggagcgaattttccaggatttaacggcgttgtgcttttagtggtaggcgacgtacccgtcgacagcgagacgcctacggtgacttcatcaatctctccaggatttgccggcccagtcttcgaagatgctcataggagtagggtttgcgtgcgtgcgttcataggggtgagtgcgcgtgcgttgtgagtgtctgtgttgtactgtgtaattctcaaaaaaaaaaaatcctattcacatacaagagaaaatcgttgcgtacaattcatctggttaaaa

SEQ ID NO: 66356 - DNA, 16641 bp, Oryza sativa
gctgttgtcgtcgtcggcgatggcggtggcggcggaggcggcggcgatctcccgcagcgcctcctccatggcggccttggcgtcggcgagcttcatctggacgcgctcctcccgccagagctcggcgacgcgcagcatccggcgctcgtcgtcgacctcctccagcgcgcgctccacctccgcgcgcatctcgcccacctccccgcgcatcctcctgcactccgcctccgccgccccgcgccgccgcctctcctcctccagctccacggcgagcacctcgctcaccgcctccgccttccgccgcatccgccgctccacctccagctccaccctcagctccctcacctccacctccaccgccgccgccgccccgccgccaccgcagcgataccactccaccatgtcatcctccacctccacctccatgccgatcataggatgccgagacgaagcgctcgaggaggcgtggcggcgcggcaacaagtagggagggcttgtgatcgacaaagctagtggtagtgcgccatgattggggcgcggagggggaagattcctggggcttgtctccgccaccgccaccaccaccaccaccaccactttgatttctcacctacgccatggagctttttggcgaggtcgggatggaatattttagtcggcatgagtggctccagcctccaccgcgtggccggcatggtcgccggctttgtgagctgtaaaagcgacgagctagctagccctaagccctagcccggcggcggccggacgaggagggagatggagatggtcaagtcgtcgatcacatgcgcggatcccgattccgatgccgccatgatggcgggctcatgctccatctctcctgtcctgctattgcaacgccgccatgaatgattcttgaaactttgccaaattgcaatgcattgaacgatcgttaattaggccgtgtttagttgttttggccaaaatttttttttactcacagggacacatatttaagagaaaatcccctatatatccatgaaagttcacctaatctcttctatacccctgaattttgcttaatcccttacatacccctgaattttagtttggatcccttccatatcctttccgctagttgaccgttaaattcttttgaaaaagtccattttgacctttgctataaagaaacataatgaattaatgaagtatattgttggaatgtaaaaatttattggataagactattatatttatgaatatgtgatgcactatattattggtaacaaatttacttttacatatgatataaaaagtaaaagttcttttatgtagcatatgtgttttcatagtaatacaacagatttgtttattactccagaacacatatgataaaaaaaatcttttaataactaataaattaatattaattttttatgtcatatctaaaagtatatttatcgcaaataatatggtgcataactatctcataaacataatagtctcatataacaaatttatatgctccaacaatatactatgttaatttatatgcttctttataccaaagggcaaaatggactttttcataagaatttaacggtcaactaacggaaagggcatggaagggatacaaactaaaattcaggggtatgtaaggaattgagcaaaattcacaggtacagaagggattaggtgaactttcaatgatacacaggggattttctccatatttaaaggattaaacttagactaataacaaaacatattccgcatgtaaactgcgagatgaatctattaatcctaattaatccgtcattatcaaatgtttattatatcatcacattgttaaataatggtgtaattagactcaaaagattcgtctcgtaatttatagtcggactgtgcaattggtttttttcgtccacatttgatgctccatatatgtgtctaaatatttaatgtgacggaaaagttagaaattcgaagaaaaaaagttggaatctaaacatgacctaattaattaattcggaattgattttctgctgcaattgtgcaggcaattactccatgaattgatttttgtgtgttgctgctcgatggatggatcgatctgttctttcgtgcgtggatcgatgtgatttgtcaggattgcgtggtacgcgaggtcgtagtaaatggctttcactgacgctttcgtaacgggcactggatgaatcgccatgaatcagcaacatccgtgatctgatgccaatcaatgctgctgcctgtacgagttgctggcttgctgcagtgcagtgaaatgcaaaacccggtggactttttgacaggccaaactgggccggaagaaaggcccattataatgagctacggatttgggccatttggtccggcccattaatactaggcctgtatagatacatacactgcccatcaatactttcgttggagcgtgttttattttgggccttttatatcatttttggttgtggttccaaaacttgaaattaaagagggcagcgaccgccgaaccaatgctttcatggcgccgccggtgccagcgaggcctccgccgcttccctcgtcggcgacgaccggcctcgtgcactcgttggtacgtcaccgcttgctctctcgatcatacttgcatactggtccatggcacgcatggcgcgtcgctttctatctctacctagagatactggtacttggatcctatatttataatttcaccgcattatgtttgttgtaaaccaatgcgcctattagtggatcatcggatccgttccccgtcccttgtacagcagtagagacatgagaagatgtagaacacttgtggcgcttttctttatcattaagaacattacagaagtagacaatgtacacatgtgtgggatgaagtcctctattcatcatagatctaatctcaaatacaagcccgtcatagatgtctcatactgcccctctatatacaagggtcttaggagggatatattttatctctactccgatttggattggtcaaaaaaaacttatctcctagaaatttgtttcacaatagtgttcactttcttgtatttggatcctacttagttccacactgcatgccatacctcgaggcaggcgggtttctttaacaatgcagaacactgatatcctttttatatatttcgataagatgttgtatggaaatcatatgcatagatttgcctaaaaatttactattatggactcatgatattatgaatttctttcttttttctaatgttttgcaaccagaattagcaatcaaagcctcattttgaagaccttattgctcacagaaatgatcgagtgagcatgcatcatcattggttttgtcatgcacatggccatagcccataggcgtagagcccatcacaagccacaccacatcattagctctgttccatatagaacatcatcatacaatgcatgaccagagtaaaaaaaaaggaaaaaaaaaactgtgatcttgcctgccactatcatgtctcttccaagttcttatcctctctcgtgtaacaatagaagcacccacttataggtgccatggtattgtctggtccaaaacacccaattaacacctacacttgcaaaaggttcagctacatacaaaaccagacacacttctttatcaccagattctctatccagcatgagagtgtgttttttggacccttgccctagcccacaaatcatctcacaacttgggcatgaaacagcagtggggacccaaccagagttcacaaaattgatcggttttcatgaaatcgtcagcggtcattttgtggaaaccgatcggttttagttgtttttttctagcattaactgaaagtcatcggtttttttatcagttttcgtaaaccaagtttttttatcggttttttcataaaccagtgaggagcagtttttgtttgcaaaaaagaaaaggtggcacatgttgataccatatgccccaagaattctctccatgcttccagccatcaaatcaagcaatgtggtactagtatcatgcatatgccatggagatgaatgccacaaccactttttcatgccctttcacaagaaagaaagggaggagagtagttgccctttgcaaaccaacagccttgtcatgcatgatgcagctgtgtccaacaaccagcataggtccaaattgccagccttgctgctattcatctcccagccagccaagccaccatgttgttgaagaggggggcaactagttatcactgatcagatattcagatatattcagatatgccatgcaatgcaagctatggcagacaagaggggcatgcatgagtagtgacacagcatttgactaatcccttcgcggctaagttacagcaactttaaaaggcaggtcctttttacagttgttgcagacttgctggcttgatgcaggtaggaaaggaagaacagacgaaactttagaacgaaatgcatgtgcaaaagcagatatgattatgtgtcgtttcagacaaacaacaaaaagaggctgtggtgagttgtgagcatcagagcattggccaaaactccagaagtctacaatgacgttgctagatcatgttttagttaatcttggacaatgcagcacgacattaattacatgggggccaaaatgggacatcaaagattcaagacgaatgtcctccatccagacagtcagacagcacaaagatgcagggacagctccaagtctccaaccactggaaacatagctaattcagttcagaattctgacatttttttcccagaagaacaaatggttagttactatcttccatgggagaagtgcaagcataactcgccgttagatttgctaggtgaagtgaccacagcatctgtacaatgtaatcttcccttgcacttcacaggacaagcaaaagaacatcaacaatcctgagtaaaatcatttatctacaaccaaaatgaccaactcccaacaaggcaaaacatcaagggagccttctcccccatattctcatcactaattttagctatatatattgcattttccctatataaattactgaaccacccaaaaagacttaacgaacggtttcttggaaagtctggcagcgcaagcttctaccgcaccgatccagctcgcctgcagacaacgtcaagggcttcaacaactgttcctgagaaaccagctatggcttggaacattcctggcaggcctgtttggatgttgttcagtgtcattgatctagttacctccactgccttagcatgccttgtcatttcgtcctccaccttccgccgacattgggcaatctcggttttcttctctgcaagaggatcgcgggcatcgaacgaatggctttcaatgccatcgcgcccactgccaggaaggccaaggccaaccattgaataggattggtagtacttcttctcaatggctcgaagtgagttggtcttcttttccagctcctttgaatatgtctctgtccgcttttttattttcatctcctctgcctgcttagtgtagatgacatggacaacattcacgaagctcttgatagcctccgaagccgaagcatctggaagccggtccagtgcttgcttccactcatcacagaaggtggtgagttcacgagagatcagcgaggtgtaagcctcttgtgggatattactgtccacttggaagagtgtgagcttcagccagccatagagggcacgtatataatcacgttgatacttgatgagacggttgaagtttgagtgccatgctgagacagcagcctcaagatcacgggtggcaagccggtgaagatcagatgttgactcagccatggaattgtctaccagaccacggacttgctgaacaatttcattctggatctcatggaaatggttcattgatctccacatgctcaacagcctgcatatcaatattcagatacaatttaaatacttgcacacaatgtcgcaaaatctggtatcatagatgtcagaacagggaacaagtcttacgcgaagcaaagctcgacaagctgtggtgcaagctcattgtcacgcaccctgacaatggctgaggatgtggtagttgcggcctgtgaagtcacgatgatcaacgattgcagcttgtttatggaggccttggtcttatccagcttggtactatccctccctctgtactccaggctctgcagagtagaaagcttcttctcgtgctcaatcttaacgctctctctagcctgaagcagtaaaaagttaatacatatgggaatagtttcaataaagtttcataaactgcttagagaatagaagcatttagtagacaccggacagtaagaatccattatgttctagattgcagaaataaaaagaacattggttagtctcactcaattatcgaatagatatggtataagtctcatgcctaccaagggtaatgcccctaaaggcctaaacatctctggactctggtgctttagacatagatacgctaaatctacctttggcattatgaggtatatttatgtgcagtaaagacaatttcttgaggatctaaaccttcacccacaaagccacaaagaatctcaaaggacaggagtagtttagatataaaaagagcataaaggaagggtatatgaaggtgtggttgagagatcaatggccatgtattgtgcctgcttcctttactgaaagtagtgaaaaattatcaaccaaatgctacagctgtttcagaatccagggtaggcaagtgcaggacctctgtaaagacgctttatgcaatagaatcagattcttctaccacatttgctgaacaaaaggcgggctgctcaaaacaccaatttcaaatgaggtgaagcttcacctaatcgattagaagctacaccagaagtgttaaagttagcctcaattcatccttgattatttgactgctaggtaggcctatgctgcaatgccaagtgcaacagttcatgcattctattctagcatccaacaagggtggctactagaagattacacctcattaaacttgcattgctgctaaagttgtgcagtgacctaaattatcggttagtccactactatgctctagcaaatatatatagctggataattttcaagtggagccaagtgaatagtttgaagatgcttcaccgacaacgaatgattgaggcgtgcaacaaaaaatgtcacagcaaacaaacacctcaattttagtggtgtgctcatctattaagtataaccactaaccagcagtcaagaatggcattgtaatcaagcgtcgatgagcagaattaccttgacctcctgatagagctttttctcccaggccaaaagacgctccagtgtcgacccatggctcttcccttccattgactccatctctaacgcattggtgtccaacttgtagcgaacagccaatggtggctttgaagtccatgtcgacgacagcgacgatagcaagctgttcgagtggtacaccgtctctgcaaaagaagaagtcaaattaagtgaaattgttaagcaattgcttgcgttttttcactaaaaatgtacattgccacaccaattcaaaccacattatagtttttgttcaagcataatatgtctgctatgaatctctgattacttttgagctgccggaagttgcggtccagctgcgcgcggctagcctccaggagctccgagacgccattgccggcctcggccgccttgacaaagtactcctcgatggcggccacgatctccgccagcgtgcggtggcggatcaccatccgcatctcggcggccgccgtgaccgtggaggaggagtccccggcctccgacctctcgtccctcctcctcagcggcagtggcagcggcgcggcggcgtactccgacggcgccgtgccgccgtactccgatctggccgcgaagccgcactccgatctgttccccatttccccctcctccgatctggtctccgaggtggtcgtcgacgcgtagtggtcgtcgtcgtcctcccatccgccgcaatgcatctcctcctccctctcgtcgtcgtcgtcgtcgacctcgtcctcttccttgaggtggtgggggtggaggtagccccgggccttctcctcctcctcgagctcgcggaggcggttggcctcctcgaggtcggccttgcggcggtcgaagaactcggagtccggcggcgacggcgggtagaagttctcccagtcccacgccgacgacgacgacggcgtccccaccaccggcttccggaacgacgaccgcgccgggctggcgacgctggagtcggacaggatgtgcggcaccttgaggcgacgcggcccgccgcggggagccctcaccgccacgggaggaggcggctgatgcgactgcgtgggcggtggcgccggcggcgcctgctggtgcttggggagcagcggcgtcggtggcgggagcgaggacgaccccgtggatgacgtcgacggcggcgtcggcgtcggcgccagcgcgggcgcgaccgtggtgaggagcaccggcgcggtgtggtgcgacacggcgagcgacgggtggccctgcgcgaagcgggagagcgcggcggcggtgaggcggagggagcggaggtagtcggcgtgcgccgacgccagctgctgccgcgacgccaccgcctccttcatgtgccgccgccgctccttgcaccgccgcaccgtgtcctcctgctccaccttcgacgccgtgcaccccatcgccccccacccgcgacgcgagcgcgcgcgcgcgcttcccctcctctccgattcgatctaacgccctctccgattcgccgtcgtctccctcctcgctgcggcgagagagagagagaggagttggctgctctactcgagtgggaggagtgagctgcagctgctgcttcgctttgctttgctctctattctcgcttcagttgtgtgtggtttttggttttattttttttttctcgccctttcgctttcgtgtttcctggcccggtagccgtgtggggggtgggggccatggcgagtaattttgatttttttttttgaaggttgtgactacacagtttgaggtaaactggtttttgaagcctttttgtttttttgggaggttcttgaagcttttttttagctaaaaaaggtttttgaagcctttttagctgcttcgctcaccatgaaacaccacaaatgtgcgatcataactgttttttttctctatcaaacttatgacacaacatgttttccctttttgcttttaaaaggatatcttatataatagacatatcacagggaaggttttattggtgcttttcagcttgtcaaacattgcgttgtaagaggctttctgtttaacccgttatgtatgttaggcattgttttttccaacttatttactggaatattaaaactgattattttgcttcgtgattaaaaggaacatgttttcttaagaaaaagcattttctactgtttagataacttgttttggttatttgttaagtattatctaaaaaaagttatttgttaagtttatttcataaaatatgcatttacatttataatcaagtggatgtttgcaataataatctgcttaataatctaaatcaaacatgtgatttttttctgaagttttctaccaagtttcctctaagcaatcccaacagttattatcagatctagtggctctgacgaacggagaggaaccaacggtacatacttgctcatcagaattggtccaacccaatacagtgaacaataatgaaggactactacgttgcacactgtcagaacacaacatcgtcagagaaaaaggctcaacttggagaaagatgagtccaaaagacaccctctgctctaaccaccatcacaaacgtgatttaaccggtaaagaaaagatcaaatgagtaaattaacagagagatcaaagtgatcaacttacttaattaccggcatctaatgatacccctgccattgctaatctcctccatttgattactgccattagtacacccggtgttttttctcgcctacttttatgcagttgcaggtaggattattccaggaaaacgccgtgcttaacgtgttaacgacggtggcttcttctgaagaagaaggctgagcaagtgcagtgcagtgcagtactctgcagtggccacacttcgaagcacgatcttggtcggttcccttctttaatcgccgtgtcggcgcctttcactgtttattaacgcacgatgccgttaacttttcatataacacaaccattcattttatttaaaaatttaataaaaaaagtgtaaaataatatgttgatgttgtagttcctttgatgataaaataaatcacagcaaaataaataatatctactttttaataaaataaatgatcaaacataacgttaaatgttaacggtgccataatacattatgaaaagagagggagtattagttagcaccagtgaaaaactgtaacttagctagcctttgctaattacgatgggccgtgcagtataatccgtgtgtttcaagtcaacattggcttaggtgagtcctaattacttaattagggatccaagtatattattaactgaccatgtaggactatgcggcatccctgtccctgtggaccaccactatagagcatcttcatttgccagagcacaaatagcattctttttttttaaatcactccgtaatttgttaaagaacaaataatggaagtgtggaaaagagcagggaatgggatgaatacaaaaggcacaaattagttatgtttcaatttgcacttaaaatataagttccatcgacgaacgtgtgaaacttccaattccaaacgccgagagtgcgccggacaccccacgtgtgggcgtagaaatggtgctcccctgcacttgctgctcctcaatggctatttcacattcttttttttttccaagttggttgtttggtttacattctcttggatatgtgcctcaaaaatacctcaagatttatgcaaatataaaaaaggtttttttatacaattgggctgcagctgtgcaacaaccacagctacaacattgagcaaaattgtaaagctttagttgcgtagccagctatagtcacaactcagctaatactgaaagggtccaaacatagaagagttagtgatgtgcacataaatctcaagatacattcaaaaaacgctcatgctatgtgaagatcacgtatatgtgatattctctttccacctcacttccgtcttttacgatttgagttggtgacgtgcacataaatctcaagatacattccaacgacgctagtgctatgtgaaaggccacgtatatgtgatattctctttccacctcatttccgtcttttgcatattgcaaactctatcaatagcatccttggagcctcgtatgcacatctctactcttattttttttagaagcctcccacatctctactctatagcataagctttatctatccttcaagatgagtttgttttcgatcacaacctttttagcttgcatgtacgtgtcaccttatgtgtgtcgatccatctatctagccagcaagatctctgcttttatgcctttgacatgttataaagtggtgacgatatatagtaagcagtccaagaaaccatatataaaagtatgcactttgcatttgtagttttgtatgtgtagtgggcagaagagacggaatcacggaagctgcgccggtggtttcaggctttcagcctacctgcattgcccctgtactgtaacaccagaaagtgctttgtgctggagagattctgggttgcaaaagttcagaatagaaataagaaatctgatttggcgatttatattcttgcgagattctttgggctggattggaagagtataggctggcattttgggccgtcttggttagattcatggtagtctgatgctgaagcttcatgtcatctatttgggccgaatgatactgagttcttttggtaggcctggcaattttattcagaaaaaaaaaagagacatactttttttttttgggggggggggggggacgttcattctggctcccaagatcggatctaatttgtatccctcgaccgtaaagctggatagaacgaattcttcaactgttaaaataataaacagtacaaaattactcctaggacattgaaggtggtcctcgacattcgtgtcatctatttgggctgaataatactgatggaaccatcgtttcacggaacggcatatttgtaaacgaaaaataatttgtaaataaaacttttatatgcgtgttcttagcaatttaaaagcaatggcggaaaaataaagttcgataaaaaaaatctcaaaattagctccaaatttaatattgaaaatttaaattttggctgataagcataagcataagcgaaaagatgaggccctgagttcttttggttggcctggcccttgctatattttacaactgctgcaattttatttagaaaataaaaaaaaggccttatgcatttcatgttcattttatcagccttgcccatttcagcccaccctaaggaggagggagagagggagaacagatcagtgcgtcagatgatatctgtcatcctgaaaatcgaagttttccggtgtgcgtgtgtgttcataattcaaatgaacatgttcagggtagtatcgtacttgggatcttcttgaaataaaacggatgtctattcaatcgaaattgagaatagaataatcatctttattaagattccatgttcaacatctgaacggggatcttctcatcctgagccatgtctcagtcggctggcgtgcctatgagggaggcaaattcgtttcctttattttactgatttaattgtatatcaccgcaaggaaattcaccgtaactgttagaatcttgcatcatttataaatctacgggctgttcagcacaagtgttgtttgccaaactttggaagcttattaatatgctgaagcaaacgccagaatattttgccaatcattatgacaagttgtttgcagtgagattgtgagggtaaaagtcttccgaacaaaacaaaataaggaccatggatgatatgcccgacacgtacaagcaaagcatgcgtctaaaattggagtacacatatatagtcgaggtcctgacgtgctttgaatggcgcgactaggaggacccttgattctcgttgcgtacgtcttgaaaatattggaagcttcacagcatcgccaagcagtacacgacctttccatgaagcacctgtacagtctttgttctgcgttccaggataccttgtgataccagtacctcacgacaacaaatcattttcgatcgttagatctaacaatacacgttatgtttagatctaacgatccgcgaaacgatttggtaccatgagataccgttacctcgagttatttttgttagatcggagcaaatctcatcgtttacacattaacttattaaaacgctgctaaaatttaaaatgtaaattttaattttgaagttggttttgatgttttttaagccgttacggcttattacaaatcatgggtaaccgatggggtcctatgtagtagtgtcaaaacccttttaaatatagttcatttctatggagttgtgataaacagaaaaagaaaaacctgcttgtcagtatcacttcttgcatatccttgttcccaactacacgcacctatctagtactagatacctccacataaaaaagaaaaaaagtaactcttttctagtttgaaagaaatgcacacttactataccattttcataagagaaaaacatgcgagagctagcaaaattaacaagatgtagtaaaattctctggttaaacaagcaacaaactaattaatgttgcgttgttcgacagaaatttaggagtaaactctacttcaaataacattttattatcgatgtttcgtttatcaccttttaaccaatattttcattttaaattgtgtatttttacattggtgacacttcggaccatcgttaactattttatccatctacatacaacttgtcgtatgcaaaacacataatcttacatatggatgtgagatttcattgaagagtacgaatcaacgtactcgaaattgttcatatgattgagaagagagtcgaggtgatctaaatggaaataaggtaaaagtacttggtataaaatgttacatcgataataagatgtgacccaaagagaaatttactccaattttaatatccctgatgctattgcacttgattagcttgcgattttcgtaactgtggggttaagaattttttagcttgtctctgttaatcaaccaatcacctcatggtttcttccaaaaatctcagtcacatatttatccgttggatcaatccaatgccatatacctttgtttcttcaacctctcctgacggtgctttccaaccaagaactcaccacggccatgaacgttcaaatcatgctttgatttctgtcgccgacgacgagcttccaccgccatgcgtgctattcttccccggcgacggtagacggctagacgcagtcgaaccaattaaactacgatcggatttaacgactgacaacttttgtatttgacctatctcgtttaatttattgatgctctattcatatattaagcaaacctcttcatattcttagataggagtagatagatagacttaacgactgcacaaaatacaggggcaaaaacaaaagaatcgactcgatcagggtaatcttgctatgaaattttcaacaccactgtaagctagaatctaagattgcttatctagctagtcggtacttttacttactagtcagtttgacttcaaagatgcaagaatttattaagcacataaattgcttaacacaataaacgtaacgcaacaggacaagctatatagattaattagttaattaattaattgagctagcgtcaggcaggtgagcaaatgagaccagcagctttggttgattgattctttgaccaccctggcgtagcaatttgattcttgccatttccagccagccactctcacagtgtcatctccgacttgtccatagactgcaaaagaacacatactcctactacatatgcatgatgctagcctgtatgactttggaccggctagcctgactaatttgtatattgctgttgagcgttaactcgatactgtacatgtcgttagctgaccggtaaagaatcaccaagttaattaattaaatatagctagctagtagtgttactgatacaaatttaagtgactctttttaaagtaattgtttgttaatatttgaagactagttgcgtataactctagctggctggtatatatgtacttagggtgtgttcgctactccagtttcctaaagtgcacagtaaacacgaaaaacgaagcggtccattagcacgtgattaattaagtatttgctatttttttaaaaaaatggattaatttgatttttgtaagcaactttcgtatagaaacttttttaaaaaaacgcaccgtttagtagtttgaaaagagtgcgtgcggaaaacgagggagatgggttgggaaaaagggtttgcaaacacacccttaattactagtgaagaatgtttgcaagaacaaaatttaaagcaactttgaattgtaatccaaataatatttgaatttttaaagtttgacttttaagaacaagtttaggtagattcttcttcttctcttgttaggaaaaacacacatgcatgtacactaaaggagagttggaagttatgaagaaaaacataattttatcctaaaatcaaactaaaaaaattaaactaagctttgattatgcgtggaagttagggagtcaagtctacactctatatagactcggattgaacggcaccgtggactcctattgtctatactcaccgccgtgcaccgttgtactccctccattttttaatagatgacaccgttgactttttctcacatgtttgatcattcgtcttattcaaaaaatttatacaaatgtataagctataaatcacacttaaaatactataagtgataaaacaactcgtaacaaaataaactataattacgtaaattttttgaataagacgaatagtcaaacatgtgagaaaaagtcaacggtattatctattaaaaaacaaaggttatatatatatatatatatatacactctatatgcaagatgaagattcctggaaacgttctaattaaccaaggtagtagctaatcacgggttaattagagacatcgtcagttatagctaggttacaaacccatggatgacgcatatatagtcgtctttttgttttgactgtccatgtatccaactgtaaatgcaatgggatgtttacgttggaccattggaagtttggaacaaagccctgcatgcctatgtgactattgctgagttcgttaggcccgtagaacacgtgcgggaagcgtgctgtctcatctgaacgggtgcaaattaaaatggattattattcactggattgtctatttaattatagggacgaataaatattttgatggataagcttaaaaagatacgtactcgtgatctaaataattcatcagaaaaaaaaaattctatttcaagacagtgtgaaataaatatactccctccgtttcaaaatgtttgacactgttgactttttagtatgtgtttgaccattcgtcttatttaaaaaatt

SEQ ID NO: 66357 - DNA, 55334 bp, Oryza sativa
tcgtattattgcatgattaattaagtattaacttttttttttgaaaaatagattaatatgtttttttaaaacaactttcatatagaaagtttttgcatgaatcacaccatttagcagtttgaaaaacgtgcgcgcggaaaacgagagaggtgggttgggaaaatgggggaaggacacagcctagtgttttaactaactcagaattcttattggcttgtatggctgtacattggtatctaatgtgcaatagaaggttgagtcccaatatattcattaacgtgcatggttatcctgcatgggctattcattagtacaggttcttgtggactgcaaatctgtctgtaacaagatacaacttacagctgtaaaaataccactgtaccagttaattaactactcaatatatgtaaccattaactgtgaagcccattttgacctttccaccttgtttcaggataaaactgagctattttgatttacatgcatgaacaaaccttttagttagtttaacccatcttcttaattctccaggatatgacagattatttgaagggttgcaagtttcttccaaagcttaacaatgagataccaagtgaaagaaatgctacgtataaacaaagattcagcagcctggaaaatctagtattgattatggtaagatgaacacgtaattgttgctatttgacatactctgggttgggtacttgtatgtggtgtagatggaatatgctgtgtgcagtccttgttaactttatatatatagcattatgcattcaaacgatcatatcgaacaagataatgaattaaaagttgttctacacaaaaacaaaagaaaacaaatagaacatctatttattttttgaaggcacaatacatctatttatgatcgcgatgtgtaaaacaatatgcttttagtaagctacataaaccttttagttcattaagtcacacatgcattttgtctcgtgttttgtataaatgttgttgatttatataatcttactgaactcaaatgccatttatgcatgcccaaagcaaatggatttaagttgcaacacattcagcttagtttttgtatctcaaatagctgatttttaagataaaggattacaagaaacatgaaaccatactggaccaatccatctgctgatacccttttgaactgctaaacagtttgaggacgacgcagtgttaataccccgggaaacggcatggttcgggtactatcccgatggcgccttcagtccagtgcagccacctcaaaaggtatatgtatatcttgagttgttgtacagaagacatagcatgctttttgttttaaactactgttatttaggggtgtgtattaagtaaggccatttttgtgtgatagacaaagttgtacacggaggactggatcggcttgaaggctttggaggaggctgggcgtgttaagttcgtatcagtgccaggaggtcacctgagcatctccagaagtgacacgaagaagtacatagtgccatacttgaaaccggacggatcatccaggttcggcattcgtcgcatcttgtcggattgattcacgagaagaaggcgttccgagtgaccagttctaacgtcacatggacatggattgtatgtaagctctgaattgtggacttaattgttgatgccatgtaaataccttggtaaaggtaatggggtaatggaatacgtcgtgtactgtagggcaggtggttagcgtacctgaactgcagaactggcgatgctagaattgtgctgcctattagcaaaacgcaattgtgggcttttatgtagcagacctcactaggaaaaagtccaattcgacaatctcgtatatagttcggatttaattcaacaacagaaacagctataatgattcctccagttaggcttcctccaatggtgccttgtaagctatctcataacatgtccacatcatcatgtatcctatgtggaggaaagagaaggcaaaaaatcaatccatctatctcctattcccacgcctatctcgctcagttaccgatgccgtatgagcctgtgcaagagatagcagtcgactcttccacaccaaaatcagatctcgtgctcccttcccccaaatcgccccgccgcacctcccgcccacccccgcacgctgcaccccgttcccgcacgatcccgcgcgctgcaattcgctcccccaccccctggcgcgccaatttgctctcccccgcgcaaatcctccagccacccgcgcgccaatccttcccttgcaccctccctcctcttttcttctccagtgtgtgaaatcttcctcggcggcgtcgacgtatccgtttccacgagcacaacgacgaatccactcctcttgccaatgacgacgagctgtagagcaggatgagctgccggtccaaacgacaagtagctccgcggccgccgccaccgtcgtcgtcgccgccgccgccgccgccgtcgggatctacgactgcctctgggtgcttcgatgctgcctcgtctgccttctttcaggccagtactgcaatggctcctcctctaggaggccaaccaggtactgtaccgtacactcaaacctgatggggattgcagtggctctgccttgcttgcttcctggatgttagagtagaacaataagctgatgatgctctcaacgatgtgcagggttgtggaacggatctttgccacacaccaactcctttgaccctgcatcctcagattggtaagaaaccaatttgcttgtgtgttgtttctgcaagaaacaagcaaattcctttttgttgagactatttagattgtagaattaataatgttttagcacagataggaaatgtgttgtttcttcctcgctcatagtcatgattttggctcctgatatttcagtggtatggatatacatccacctggtggtttcctaagcatgttacaaagtggtcaacagccattagtcccacctcatgttttgttcccagcaacatggccacctatgccacctatggcaccaacaactaattcaggcactatcatcaacttagatgatggtgacgatgttaggactgctaagcgtcttacatgggcatcagatgaggacttgcggttggtgagtaaaattttagacaacttgcagggatttgtaccatcattctgaaactttactaacacataatgctaaatgtaggtgagtgcatggctgtaccactctaatgatccgatcaatggaaatggcaagaagaatgagagctactagggagatgtagttgaattatacaacagcactacacctattaaccggaaaagggaagtaaagcatctcaaagatcgatggcaaaggattaagagatgggtgggatttttctgcgcctcctggaagaaggctgcattagtttatactagtggatattcagatgatcagttgagagactttgctaatcagttttatgtggatgactatcctaacgaaggtccattcacagttttgcactgttggaaggttcttcgtgatgaacccaagtggcatgctgttttggaggagcttgaaaagccacacaagcggagcttggatgatggaagtgacacactatcacaaaaagatatcggagaaaaggagcgcccaatggggaggaatgaagctaagaaacaacgcaatggcaaaggcaaaggcaaaggcaaggatgatgatgacagtttacatgaagatatgaagaagtacatggatgttcaagctgcagctagcaaacgacatgaagagtttttagggactcagcaccgtatttcagatgcaaaagttgaagtagcaaggcttaggagagaggctgtcttgacggaatcatatcaaaaattgatgagcatggacactagtcaaatgactgatgagataagctgagcacgtgatgggtctcaagatgttgagggagaaactgcttggtgatataatctaaggtattttctgtcaatcaccatgcactttattgttagtcaatgttcaacaaatgaccatgtattgtaatatgtattcttagtcaatgtaccacaaataaccatgcattgtaatctgtattattagtcaatgtaccacaaataaccataaattataatctgtattcttagtcaatgtaccacaaattaatctgtaccatgtgactatatattgctctgttatattcagtctagcaaaacaatccagcactgtcctcctctgttccttctatccagtactattcttcctattctattctgcctcatttgttccttccatccagtccaacacttcctcatctgttccttccatccagtaaaacatgtcggatgagtttgacaattccatagacccagccgagatttacactacagatatgttcatggcagagcatagtgtccttaactcttttgccgggcggatcgacagaaggattaaggccagactagaaggaggtacatctaggcgtacaagtggtccaaggaagtacatcaataggaaccatgaaggagcccatgatcaactatttgctgattattttgctgaagatcctctctactctgctgcaacattccgtagaaggttccggatgagaaggcatgtgttcctacacattgtggatgaactaggcaagtggtcttcctattttacacatagagtagattgtactggatgccttgggcactcaccattgcagaagtgcactgcagcgatccgtatgcttgcatatgggactgctgctgacactcttgatgagtacttgaaggttccccagagtactgctctagagtgcttagaaaattttgtggaaggtgtcgtcgaggtatttagtagtaggtacctgcgtcgtcccacggctgaggatctcgagcgtttgctccaagttggagagtctcgtggattccctgggatgttgggaagcattgactgcatgcactggcgatggaaaaattgcccaaccgcatggaagggacaatatacccgaggtgaccaaaagtatccaactattatccttgaggctgtagcttcatatgaccttcatatttggcatgcattctttggtattcctgggtccaacaatgacattaatgtgctcaatcagtcccctctgtttattgaagcaataaaaggtgaagctccccaaatccaatttattgtcaatgggacacaatacaacacgggatattatcttgctgatggaatttatccggaatgggcagcctttgtaaagtctataagatctcctcaactagagaagcacaagctgtttgcaagggaacaagaagggaaacggaaagatattgagcgtgcttttggggtgttgcaagctcgcttcaacatcgtgcatcgtccagcacgatcatggagccaaaaagttcttcgaaaaatcatgcaagcttgtgtaattctccacaacatgatagtggaagacgagggagaaatggcagaagatcctattgacttgaatgctgccccaggaacatcaattgttcttccaccagaagttcatgcagggagtaatgatcacccaagcttcagcgatgtgcggcgaagaaatgcttctatccgagccaaaccaatccatagccagcttaaaaatgacttaattgagcatatttggcaacggtttcaaactaggcaaaataattcagtataatgtaagctctagtgtacaatttcattgtaattttatcttagactgactgtatttatcactttcacttactgtacatgtttttctctctaccaggggcgaacagattcgatgtcttttacttgtttttgtggctgcggtccagcttttggtgatcttgttcaaggaatgggataagcacttctggttgctgtccagcttttggtggttgtcgaactcttctatcacttctgtgacgtgatgcagtcttttttttcccttcagtttgctcttttccgcattgtactaaagtgccatgatatggctatgatgttatctagttactgttgtggaccgtgagttggaagaattgcacttcattgttatatactctaagtcgacgttgtgctatttatctatattcacactatgctgagatgttcatttttaatcgacagatcttttgaatagcatcacatgaaggaccatagagatattgtgtagtttatcaccatgtcatttactacccatgctgccataaaagcaagaagagataaccttagagagttcattagagaaactatctcttgttctatctcttagatgtgtacgatttatgagctagcagttgtctcaacctttgaaggaggccttactaaaataagtgcagtgcagaatgactcagtagtcaggatggtatgtgacgccgacgtagcaactagtcataatttttttataaaataaagtaaggctcccatgtcatcctccccctctcttcctcatcccttgctgctcgtacagtgccaccgtccagccacgccctcctctcatgccggcactgctgtttctgcctcctccgttgtccttgttgccgtcaccgtccattgcgaagaacgccagctttggtgtgtgccccgttgatgtgcatgcatgtgtggttctcagagtacgacaaaccgagtacgcgtgctaggccgagatggcgacgatggagccgaagaggatcccgacgaacgatgcatggagaacccccccccccaccccttccggagggggggggtgggggttcctgtcaatcgtcgacgcatgtacgtactccatgccgaggccggggaatgcagaagagatcgtaggtgtcgagtgaagaaccccatgccgaagaagaagacgatgttgggtttgatggcaccacagactgtcgacgaagggaccgatcaaggtgatgtcaatggaaggtttgcacggcgggaaaaaaacacgccggcagcgatggtgcctgccatctccggcgacgcccaccaccgttgccctctcctcgcacagtatcttgtgtggcgccgctgacgtacggtagagagtagtacaactacctttgttggtaaaaagaactacgaggcatgcatgttcccgtgcgtccgcgcttctcaaactgttaaacggtatatcttttacagcaattttctgtagaaaaattgctttaaaaatcatactaactcatttttcttgctttaaaaatcacacttaattaatcgtgcagctccatttttcttgctggaggtgagggttcccatccctcacccaagtactccactaagcaccagttttcactgtacaccttgcaaattccagaaacataaactttatatagtaatcagtacatttacaaagttacagcgcaggtggagcagcctagtctggcaccaccacacctcattaatcaacaaataaacttactgtataccgcatgaaggtcctgaattcccatcgccggtgacatttcaaagttacttttacacaccaaatgaataaaagaaaattgcacacgccccccacgtcgcaaacaaaaaaggcaagaaaaactactctatgggttcccctcatggagaggcatgaagcgactccccaaccctcccgattgcctcgttcatgtttactcagctcacagctctctttaggtgattctacctacatcccgaaacaaacagcctgcacatgccgagtggtaatgtgacacaagctttgaaagccaaaacattaccttgggccgcaattttgcgatgttttgaacaggctgagaaggctgctgaagaaatgccttgttggaagattagcataagctccactgctgtgctttcatgttgaagtccctgtctgatggtgttccaaatttctgaggacaattcttgcaaagactttggcttcgatagaagcggtcgtggctgctgctgctgcgcgcaagactcgagctgcccctgctttctgcaggagacccgcatggtgcactgcgtgccgacctccagggattgtgaactgcattatgttgggagtattctcattagatctataagtatgttttgctggatggtaaaatcattttgcatcaaatagaagagcagatggaagtcctcttgtgtgaatgtctgagtattttgtgtgcgcacgtgtgtttgagagataaaaacacaaatacatgcaagcatgatattaatcatgaggtatggttcctcttcttagaacagatcaatggtgctcaactttcataatgtcttgtgcatgcggaatagccaaggaatacgttggttctcaatagataggggtcttcagaatattaagatggtacggaaggaaacaaacctgaagaagggcaaaggcagcacaagcgcgaagaattgatgcaggattccggagcatggcaacaaatctagcgatctcggcaccactgaagggaagtaaaggactatattagtactacattcctcttagctacattgctaccaagacaggtccaaaataagatgaacgggacaagcatgaatccggtttaaaatgttccacatgctctgcctaaagaatagccagctaaacttcaggaatagtaaaactttagtgaaagaataaagccaaacctgcatctcaggtgtccagcttcttgtataaacactgcatcagcaatctgagatagtgctgctgaggctgaggaggtggaagccgtagtgaaaacttgtgggtccgaaaatgtcagaacaaaagtctgtatatgcttcaaagccattctcctagctccctcaacattaacactcttggaactgccctctgatgacgtcccaaccaatgcaacctcatccattctgtcatttgagaaaattcagttttagactttgcaaatttcttattaagataatattgcacatcagcaatggcctatgcactacacgttttttgtcaagcaaaacacagtccgattatacaagtaatctgctagccatgctagtatgctgcgaaagataaagccaagtacatcacattgtgatactgtgttagcatctacagttaactgcttttcaagtaagtagtacaaggaaatgggaactatttaatataaaaatataactattaaatacagaaagaatataattcttaatagcaacaacaataaaaataatgctgtcaagtttcaatgcaaaagaaaccaattcaaatactgctgcaaaaaaataaatcttatttgccaaaaaaatgccatgtgcttgcacaatttaatacgacagtaggaaagttagcaggggatgcacaccaacaataggctgatctacaatggtaagttaactttttaattcctcagaagtggtttttaccaatcattgaatacagacgctctctctctctctctctcagagagaatatgtggagcccttaaagtatcaatgtatcactcatggatgttattcttcaataaggagagtaaggagttaaggtaactatagtcagacattactaagaaaacaattaacagaagcaatatatacaaaccaacttaaacggagcttgtaggctcatagctacaaacagaatgtcaaatgagccctaaacttgcaatctaagttgctgctgaaaaataagcaacttggtgattaattgaagtcaccaaactcttttataaaccaatgcatatttttctgtgtgtgtagaataactaatcgtcataataaggctcgaagcactgtgtatattgcattcaagacaaaggtatatcacaaagaacatgaatagatagaattatgaagataacactactggatcaatcggcattctagaataactgtgtgctgttagcctgctggtagagtttaaagtccttatacaaatcaaaattgaatgaaatacaccataattcaaaagcaaacagataaaataatcggtttgaaaaacaacataccttccatcgaacatataagcaagggctagcgcagacatgaaacgtgccatttttgaccctgatgatgagcaaagccgcactagaataggaaccccaccttcttcaacaatacagagagcattaccagaatagaaagcaagattccatagtgcccctgcagctgtctcgtgaacatcctgaataaacagaaagtcgtcatatctagagtaaggaatagcattcattcccaatgacagataaaacatttattcccaacgatagatataacaatctacagtaactgtcaatgccaacgttccttgttttatccataattttatttttttttcaaaaaaaacttacacccgttaccatattaaaaagagagagaaaaactaccctctttatcaaacaatgggctgggctgtgcactctaacaaacaaacagaataaattgacgtgagatcaaagtactatcaaaccattagagaacaaataaattgcatgcctgcagcaggcagcaggacaatattaatactcaaataaatgatgttttccccatcagaatatgttctctcaagcaattggaataatattatataaactggaataacattatataaacagtggcacagccaggattttcctaggcatggttagaaaacaatggcatgaagcaacaaattaagttgaaatggattaaggatgtttaaatctgataagataaatgaatgtttttagtcacttggacatataagttgcatacatgtgcgtatatgttagtaaaagcatatacttgatcttgtgcccaaaataaataaataaataaataaaatcagggtacaaatatatccccatgaatcatcgccactggatataaagttgactaaaaaagtttaatacatatactacattgaactcctgaaaggcatgtacaaaaagaataacacgacgagtggtagcttcataaaaccagaacattaggtaaaagcacaagctgaaggtggcgcactaaccatgaaattacttataatcaagtagctacttcaacaaactcgtctgtttgttcatggacaatactagtcaaacgtatctcaagatatgacagactacggcatggagcaactaatatttccaggtgccaggcagaaggtctatcataaagaaaaaaagtgatttggagtccctaagtaacagaatgtattcgcacatcaatatatgatgtatcagacataaagaatatacaattgtaaatgaaacttacttcaacatctgattgtgccagtgtgagcaaaggtgcgacaccaccctcctgtccaattgccatactgaaaaaggcaaataaaagttgtcaacaagaatgttggagaaaggaataacaagcgatagatggaggaaattatctggtacggaaagacgagagatgcagttctctttattgcagcaagtctgtaaaaaaggccaactagggagagagagagagagagagagagaattgattacaagttgcgacctaaaaggggcgctcctcattcatttacaggcagttatcagacactcgcctcacactgtgcctacacttaccctccagacaaaaatttcatccatcgcttgcacatatgatctggaattcatcagcactaattttccagtagctatattattaacccaaaacagaccacaccctgctactaccatctaacaccagggtcaccaaaaaagtctatggaaataggaggcaatctacaaaaaaaatggttaaagtggatcgtgtgctaagataatgcaattcaaaataagcatgcagtgcaaaccatccaccatctatatccatcaagccatcaagagctttgaagttgagtgcgagattgaagtgttcaagtgtggtcctgaatttagcgcaggcacagctgtcattaaggctgtgttctttccccttctttcccaactcacctcccccttttttcgcgcgcacgcttttcaaactgctaaaaggtgtgtttttcacaaaaagttttctataggaaagttgctttaaaaaatcatattaatccatttttcaagttttttaggctaatacttaattaatcatgcattaatgggcaacactgttttacatgtggggaggtggagttcccaactccacctcctgaactcagcctaagtgtaagtgtgtaactaactttgatatcagcatattttcatcatgtgtgaagctatctgatatgaatgttaggaaatatagaaactcaggaccaatctaggcataccacaatgtgcaatttttaacaattgctgtgcatgacatctaaaagtgaactgtgaacggattcaaatttgacttaggagagtaagtgtttttttaaattattaatacacttttcttgattgacactaagctagctttcactaattccaaaaaaaaaagtgcattactaagtttaagtgtttatggacaatcaacttgtacacttcatcagctaggcatgtcacaaagaatatcttaaaaataggtcaatctggtagttggtgcaagttcagttcatgagcaagcatatgaagttacctgttagcttctgaaacagatagtccccataatgcgccagcagctctctcctgaaggccttccgaagcattcaaacattcttgtgcaagtgaaacctaaaatatgaaagccatctatgtgaaaaatataaacagcttatttaagtctatttatgaaaagatgggaggagcacacacaaatgatctttaaaacattgtgtcctagaaccagttccacgggtaaacatagaagatttattattatttagttgatagtcggtataacacagtactaataaacatattcaagagaatatgttcaatcagaattaatcaaataactagaggtttctacagaccaatatttttattcagaactgctatatgaaaaactttatagagggattgcatctatttactgaactagatgtactgcttaatacaatgttgatcaaaggatgcaaagctgtgttaaagcacaaatggggcacgtaccaaagcttcaacgccacccgcagcagcaatgccttcacggtttctatcatcaaatgacagattccacagagcaccagcagcttcttgtctaattaaatgcacaggaatcacaatattaaattaggataatataaagtataatttaatggcaaaatcaggcgttgcaacttaaaacagcacatcagctagaagtataccttacaccctcattttgagagcttgttagctgcactaatgcctcaagagcccctgcttcctgacccacagcggcattattattgttgttatctccatgtgcggctaagttagctaatgcccttgcagcctacatgaacaacagtgatagtattagaaagtaaatgcagtacatatacagtgattgtgagcatgtaaaagacaaagcactaggtagcaagttagatggagcatttatttgtagagcttaaaacgcagcaaactgctactataagaaaatagcaattttaagtggctccacgacaaatccaattgttttaaagcagatatagattgtgcaagttgagaataaactgtatcttggaattacatgtacatggtaagagtccagtcagcatcccgacaaatcatttgagataagtatggcaggtacagactttcctttcttataggaaattgggaatccacgtggctcatgccatgagattgagcgatctgataaatataaaaaatcatccaagtccatgcatgaaaagttgcacccagtgcttaatcaatgaagtaggcgtgaaccaagagatcctcatttggcaggataaagttcaatatgcaagcataaaataaagatagcatgtgcacaggtcatcccgttttgtctttatcgtgcttcctattttgtagatcttgtaccgttagttgtattatcagagctagcaaaaaaagctatggtataactagctgactagaacgaatgcgtacaagcatgacgacatgatgtacccgctcacctgttctaggacaccctcaagtttacatgatcgagcaagcatgaccaaagcatggacaccaccagcctttgcaacttccatgctacacttgtcatcagcagctaggtttgcaagtgccccagcagcacgttcctaaagaaaaagagcaaccgttataaaaaatttattatccagaaaaggatagcaagcagcattgaaattactgaaaattgagaagtatcaaagatacatacaagaactccatcagtcccagcaggccagcggagtatgagatcgaccaaagcctttataccaccagctgctgcaatggctgcctgaaaaagaataatcaatatattgttagtaccagcaacacatcagacattgcaatcagagtattcagcatccaaggagtgacaaccttgtgctcctcacccacggagagattccaaaggccaccagcagcttcttcagcaacaagccgattcattgacctggccaaattggttagtattgtgatacctccctcgtctgcaactgcctttgcaaccttggcattcaccgataagttggcaatagcctgaagtcacattaacaactgtaagaaaatggtaataccaaacatagtagatatcggcaattagatccagggattcagctaaaatggacatcattacctttgctgcttctgactgtgcactctcccttgaacaccttgcaaggtccagtagcattggaatgcccccaacacgcatcactgcctctgatcttgcagcatccacattcgcgctctcgtcatcaataaccacaaacgtagcaagtgtggtagctgcacgctcctgtacatcctcctgagagctcttcaccaaactcagcagcatatctgcgccctgctgcagccagaagtcatccattccttgcgggttggactccgctatccgtagaagtgtctgcgacaggatccactcgagccagctcatcatatcaccaagtgcattgtctttgcccttccagttacattcattgaacacctcattctccttcacaaccttatcaggaaaaagtgagacgaccgatttgaaaatgtggcttgtaatggtgagtacaagcttgcccttggagttgctaaatgctccaggattgtgtgcctgttcctcctcaacagatttgcagttaagcgtgcatataagcttgagggttttggagtgggagatgagcctagagatggcacttggtgagacatcggtgcgggacacatcaacggcaacaagggagggcagctgagcccaggaggtggatgctgtagcccatttcaggttgtgacatccagcgacggagaggaaccggagggataggatgccggcgatggcggcctcatctacggatccgcagtcgaggaaggcgacgtcttctaggagggggcagtagcgcgcgagcgctccgatggcgtccgcgtcggcatcgcggagacccgagaggcgcaggcggcggaggcgcgagcagcagaaggctacttggcggagggcgtcgctggagatgcgttcgagtgggtcgggcccgatctggaggctctcgagggcctcgtgccgcgccgcgaggacggcgagcgtggcgtccgtgaggccgcggcagccgtcggccaccacctcccggagcccccgcgcgcggaggcccgaggctgccgccgccgcctcgtgcccccgcagccgcagccgccgcaggctcccgcaccgcgacgagagcgacgacgccacctcggcgtcgcaccggtgcgcgcggaggtcgagcgcgctccacaggcacggcgacgcccccaggtccctccacgtcctgcacgcggccgccatgctcgcccggtcgcggtagttcagtcgcccgaacagctgcagcaccgtgtcatccggcagcgtcctccagtccaccacgcagctcccgctcccgccaccgccaccccccctcgccgccaccgccacccccaaacccccccgccgccgactcgacgacgagcagctcaccagctccctctcctcatccgccgccacatccttacccttcccaccgtccttgcacagccggcggcgcacccggcgcgtcatccccacccctcacgccgccgggatcgagtagggttcggtgccactcgagccccaattcgggggagggggatccgattcgcgggcacgcggatgcaggaggaggagggcggtggtggtagctccgattcgcgcgcggcggcggatcgtgcgggggtgggtggatcggctcgctcgctcgcgcgaggcgagctagcttccctgccctttcctcctcctctgcggtgcggtgacggcaaggggagaactggaaggggtgggcaatttatatatagcgtatgcgggtacgcgtatgcgtattccgggctccaaaatacggcgacctgggctacggagtatacggtaatacggtatatatatatagcggtagtagcagtacgcacgtaacgtcaaggcaaggtaaagctggtttatgtacatcctgcagcttttgatcagctcgagagaggagtttttactgtgtttcagaagaatgtaaataaatttgatcagaagagaatcgtacttttggaattggaatccgagtaggaaaggcaacttcactgcattgtagctaaaaaatgggttgggaacttgggatgttcaaaaggattttgacgacttcatgcacaggccatattagcattcaacgctggaaaacggatattacacgttaaatggagtaaagattccacgtttactgacatctacaaaaaaacaatctagccagtttcaaggagcgtagggtgtgtagcaaagatggtttaagaatatcagatgcagcctacaacgacagcgtctctatgtgttttaaagcggaaagaaacatgtgtcttccctcccattgttagagcaaggcatacaaagctcacattcatcttctgagctatcatcagatcgatcagcaacttcagaacaagctgttacccaggtacatctatcgatatgatacaaatgtagatccactgattaaaagctgcacatcccattgttagagcaaggcctgcaagttcattcatcttctgaggtaacatcagattgatcagcctcttcttcctctggcaaaggagagacaattgcggcacagcagaaagaatcacggtccttcaggaggaggcaagttccatctgagttccatttcaagtccacaacccgaaagtttggcaacggaacgttgacgcagcatgcaccagatggtgtccacatgtacaggtgcggactctccgtgcagaaaacaaggcgtgggcaattagggtcccaagcggcagcacggattggatctttctgaacaagaacagcagcaagatcaaggcggcagatatcccatatccaaagagcagttggcatattgtcattccgagtgaagaaatagtgactgtcgctgctccatgacagcatacctgcacatgaattgcaaggtgagattagttcagctacagagaaaaaagaacccttaatagtagaatatgaaatgttaacaatgcagtttatactgaaccatattctactagaaattcatgaatggccaacacaaatcacgcaaggggattttagtacttagaagggttatcgataatgtttatagtaggaaccattatcacagtttacaaaatgaattagagatctactgcacatcagatacagaatgtgtaatagtaactacagtagttcacaagttcatgacactggtcacaagtgtattaggcattaggaaaaagaccaacatcctgatccatatgcatgagaaataggagcaactaaccaattccctgcttggggttgggcttgtctgtaacgggtttctgtgaaggcaaagtgattggagcatccatcacagcatacttaactcgagaacctccctctgtcccattttctgaccacaaaaaaagatcagtctccaaaactaaacataaggttagcgctggccctaacacaaggcatcataaaacatgccaaataatttatcaaaaaaggaggaacaagatgcgatataaaagtatcgttagtaatctcaccagcaccattgccttgcatgttacgggagaatccttcacttaggcataactctgacatgtcaagctgccatggatcatccacttcctgtgacattttgtagttacaatcagataccatgaacagaaaaacactagatctgctaagatgtcaattagtgatagatatcagtaggcttaccttaaatatagcagcattagtaggatttcgaatagatgctgcgtgtgagaactcagcaaaagttttccatgtcaggtggttcaaagtccgaactgcttgatcatagctgccaactgctaaaaactgtccacatggtgaccacgcaacagttttcacacctaatccactttcatatgctaagtacttgaacaggcacctcccatccggtgaatatatcagaacctgtgacaatcatgttcttaggattatcagtttaaatccaaaaactgctaacaacaacataagagtagaacaagagattagtatccgttgagatgaaccctatattttatctaaagcagaaaaaaaaaacatagctctataaaaacagactgggatgaacccttaagagtacaataagaaattagttcagctacagagaaaggagaactattaatagtagaatataaaataagttcagctacacagaaaagagaacccttaagagtagataagagattagtttcgctgcagagagaaatgactcaatgagctcttgaacaggatattggttaagaaataaccctgtatgttttgggggagtcatgacccaatataccaactgattgatcattaaagtccaactaataaccagatccgtcaatgtaatcaaatatcaaccgagaaacttgagtaaaccagaataagcaaaaaaaaattgttataagtgccatttgaagaaaaggtggtgtggtttgccatacatgcaagataaagtaattcacaaccagtgcccatctaaattctgaagtaaataagtgaccctaccaacaaaaagtattaacaagttatatgcatatataatgacatacagtaaatgatgatgattttcaaaagtaagcaaataaaacaacaatgggagtacaatgaagagatgcaccttgtattccagaagtgaatcccagaccacaatagcactatcatctggtgaccactcaacacctgccaagtctaccgtgtcaacagcaaagacactcattatctcccaggaatggcatgacagcaaatttacataatccttgcagtcacgcctagtacagattgcagcgaacttcccgtctttagtaaaagaaacacctctggaggcatgctttggccactgtacatgtatgcatgctgtatttacaagagaccaaacagtcagacggagctgaaactctgatgttgttagtatatgacgactgtcagggctccagcgagcatatgcaatcccagcagggccctcatcaatcttgcaggtccagtcaggctggctcagtgaccaagcctgcaccatgggtcgcttgtaaagtccacatagaatatactctgaatccggtgcccagtccagaaagcttatcttgtccacacatgaaaacaactgcaccacctgcataaattaaagcaaaccatacattgttgtcaattgtattctctagatatgactagcagttcttatataaatctccccagaaacagcatgcactcattagccactatacgataccatttggtattaacatttctttggtccagccatactgccaattactcatgaaccctggctacagatcaggcaaaacaaggaacatttcatattttctgtgaattagaaggctcaaattttagctataccagatgacaataccccctatcacaaattcagcaactactccagaaggcccaaaacttttaagcctgcattccaattcccaagcactaagtgtgtgcacccaatatgatgcccattggatgtcagtacatactaggagatgattgtgaattggtaatctctctcctacacagtttcaacagttattacatagaatatatggccgacagattgtcttattaatacaatatattcctagagttatactgttcacaaatatgcaaaagatttgtggggttatataatagtacaatgtattcaggcatttattgctgtgatatgattaaaggtatgttaaagggtcagtgttcaccaaggcactatcagatagtggatcagtacagtccttgcccgcccagccagatacaaagctagaaatgagggaggggccagcaagaaggccaaaccaagggagcagagagttgagcatccgcagtacaagtagcggcgccaattagccaattacagtgatggggctgaaaaattcaggctgagtggaggcaaaatctggtgcctgaaagatgtacttctcacctcagatctggccaacttaaagtagaacaacagacaacataacctgagaggtggcatgcagacatggtggtggaggatgacgatgccatggctgcacccctacttgctcgctcagtctcagtctcctatgccagaatgtaatgtaatgccgctgctctgtgtgcatgttgtgacgggggtgggggtgggggtggggggggatagcctattttgtcgcttttgagaaaacattaaatgctaggcctaggccttaagcttgcctactcccttgtacgtagtccgtatacgtactagggcaatgccagctaccccaaattgtctattgcctccacctttgccccattatctactttctcataggtacttcctctcctctaaatcattccccttcccttcccactcagcatctccctatcacagggcccgtcgtgcccaccatgcatgtctccataccttcttagatcatcgagaaggatagcaagtctatgatgtcaagctctaccttagacttcctacagccaccctaggcaagctgacctcctagcgcacctattttggcaaaatcgtggtaggagggtgctgcctaaaactagaaatttccatgtcaatcacaccaaataaagaaatattttcactgtttagttggtgagcctatattatacatatctggcttatcgaatatagatatcatatctacagaagtatttgaacaatgagtaggctgatgattttaatcgtaggtattaaaggcacagtacaacatatagtctcattatcactctcctcaaacataaacatgcatatcatggtatctagtccgcacaattgagcaggtaatctagctagcttggtactgatttcgtccatccagtacaaacctaccctgaaccctaggctacggatcgggcaaaactaggcgcaattcctgaaccagaacactcaaaattgagcccagcggtagatggcatttcccccaaccccagattcagcgactactccagaaggcacaaaccctaaacccgcattccagttccggaccactaaaacaggatcaagcgggggaggaaggaggtgaggggggggaatggcgcggataccttgagggagacgacgtcccggacgacgaggcggtagtcgacggcgacggcgaggtagcggccgtcgggggagaagcagcacggccccgtctgcttgtacgcctccgtgaactccatcccttcgccttccccttgtcacgcggcggcgggcgggcgggcccggcgccggatcgggcggcggaagcgagaccggggggctctcgccggcgtcgaggtgggggagaagaatgcaaatctactcgcctgaaatttttttttcccttgctattttggacgccccgtggttggaatttgaaattgtttggagggtagagatgataagtgggaacgtatgtacgcgcgccaccgcctaacgagtgggaacgtttgtctgtgcccgtagagcggagcagcggtaggctcctccaggctccagtgcacccgatcgttgtcgttgatacggtgagaatcgtgtaatcccaccttaaaatttttcagcatgtcatatcgaatgtttgaacatctatataaagtagtattaaatataaacgctaaaaaataactaattacacatagtgcgactaatttgcgagatgaatttttaagactaatggctccatgatttgacaatattgtgctatagtaaacgtttgctaatgacggattaattaggcttaataaatttctctcgcagtttactaaacggcttgtttggtaactcgagggaaggggattgggagtttacacgagggaattgatgatgagattaagataggaatttgatttttaatcccaatatcttgtttggtaaaggtgatggaaattaatagggagtttaggagattaggtcattaataaaaaaaggatggctgagattcgtttaaacaacgtaaaggaggaattccctcccaattacctgtccctactcaagtattgaaaaggagggagttccttcctcaattctccatccccatcccactaaaattctcatgcctcccatccaaacaaaaacacttaatagcatcatctctctaaactcccaatccctgctaaaaactccctccaaccaaacaggccgtaagggattatgtaattagtttttttattagtgcccgaacaccccatacgacaccctatataatactcgatgtgacacgccaaaactttacacccatgaatctaaacacccccatactcctacatgagttgtaaaaaaaaagattattacttactatacaattttctttcatgtatttatatattttgtaatttgatcaattattcaaatgtttcaaatgactgtgttgtatggtgtgatttttggagaaaaaaatgcaatttacattcttgataaatcattcaaaggttaaaaaataattgaggtgatgtggtttcatgaaataaaaagataattagtattaactatatttagtagatatgaactttataggtatatacgatactttgtttgtcgatgttttttagccttctatccacgattttaaatgtatacagtttattacccctttgtttcataaaagtacatataattttagaccggcaatgttttagtttcatcggtcctgtcttatatcaaacttatatgaatattaaagaaaaagaaaggacaacatattacttaagcatattacgttcaccatgtaaattccattcataataatcaaacaactaaaagatatcaatgatctaatcaaagcaattattagtcaaaacagccaaatacttaaaaaaaagctaattattcttccattggtaagaaaacagtcggaatcagcagcatctcttcagaactaaccggtaattgaccatatttatcatttaaactactcagtatcaacattaatacgataaaaaaattagaaaaaacaaaatttaaaaatagacaaaaacggtacgatcggaaatagtaccccttaaacagaaacgacgtctggtcgatcgagaatttccgtgaccattttcatccctaggtaagtgacataagcatcgacagcgaagtgtctataataactcattgatctcaagatacgtcgacccattatttgaaggaaatcagataaatatatgcgcgtatttataggagttagcgtgcgcgtgtttatataaaaccatgagtcataccatgttatttgaaaaataaattatgaaaagggaggggctatagaggacccatgtagaacgtgacaatgtcagccaaggatatagaaaggctgcatccatcttccagcccaggaacacagtcgcaactcttaatctcaaaagtccaaaaaacacccttgtagtcttcttagccagtggcaataagcccaagacccaacggcgggctgacggctcacaattcccatcctgccgccggcggctaccgcgggcggtgctcgactcgacctcgatggcgagctcgcgggagcggaggcttccgccgccggcgtaccggatggagaaccccttcagcgtgaaggtgctccaggtcttcaccgggcttcggcgtcggctgcggcgtcggcatcggcgtcggccgccccatctacctaggtatagcaaagcttccgaagctaagtgattccgccgtttcctggatagtttgggtctggggattgggatggacatcgatccggtcggccatgagtcggtgggtttcgcatttcgtcgagcggctgagggttgtgattattgcccgcccctggcttgtggccatttcgtcgaacagttcgtgtcgtgtgtcaccgcacatagttccattgcttgaactgtggataagatagtagatgataaaaatgggatgtttgctggtgcataggaatacagtttacttttagttaagtctactagtctgtcgaactgacactggtattgtgcacttcccctcttcacagactacagaccacagttactgccccatactgccatactatagggcatttagggctcgatgattaatttcaatgactttaagtagttggcttctgtcttgatggataggtgtcataccggggcttaatcaagttatgaccgcaacaaggggcgcaacggatgccttttcaggcgtaacaaggcatgttaattccgctgtaagtaaagataatccttgtgtaaccacgaataattaggtgccaatcacgttagtaggatacttttgacttatgttaatctaattatgtattttggacttgtctcgatctaattctgctgtttttcttccttatttttgtgctctagctaaggaagtcagggttaaagaacattgaagcaggcattggctgtggagttggtataggccacggttttggaataggtacatattgcagcttttccatgtagttagtcctctaaattttcttttggtgctgtcctagtaggaactattgtcagtcaaggtcatcttttgtgcttgatatcctcatatcttgagcatatctttcctgtttattacttttgcagtgatcacgccattttttttaacatttgtattatcagaaaccaaaacatgtgttcttgctaggcggtggcaatgtcatgctttattcatagtttcttttttatacagcaatcagattaaatttaggcacctggtgaattggtgatactttgattcttttgtatgttttttattttcattgactgctgcagcagatctatcagttcatctaatctagtccaaaaatgaagtgataattgaggggactcatttaatagaaccacatttcatactttcgcacctagcatactagcacactccctaaataggatccatggaaatatctataatatctgcaacgcttccaggtcattgtttttgttagtagaaatcatcagctgccaagcctctgctattttactcttatttatattctatatcaaatgctacacatctgttaaatatttttcttgcataagcatgcaaacttgtttgatctgaagctgaaccattaagtatctcaatactcaggaattgcattgaagccacaagtaattcatggaattcagtcaaccgttggagtacaaacctaaactttgatcacctgaatttttctttgtttccctttttggtgtatgaattctaagggaactttttctctaggaacttatgtctaagttcacttctaggctgaaggataccccaactttgtcatctgcaccaaatatggctggttctgtgcctagcaatggacaagctcccaatggtgtgtccattgatctaaaggctaagaccacgaaaagtaatttccaccatacaagtaatgaaacatcacaagtaaaaccagctcctgggttgcaaagccagcatggaatgcaaccagatatgactgaaagtcggactgaaaaggttgttgccaactttctacagtctcccctgttccaggatgaaaccaagatggacatcagagatgtggtatgcactaaaacattacctcaaatatctaacctgcactatatatattgcacaattatgggttgcccctatgcctctcgctgctaaaatttgcttagtcagacatgttattcatggactttgaacactcttttctttgttctttttgcaggctagaaattcacatgggatggataatgtgctggaattggtgagtccagttatacctagtgtttcttatgctatactccataatcccactcttgcttggttgttccatcctcattctttgaatttgatatgttctactcacgccatcccatacagcccccttaacatgaagcgcctctaatagtctaatatttttaacaagtaatgtagcattaaaacatgatttcacaagtaaagttctataacagaattttgtcttgcatttgttttaaaacttagttctgtatagtgtacagaatggtccacggttgtctttctacctatgtttatgccttcactgctgtctgctaactgagcttttcatttctgacccagttgctgaagcaccaaagaattattgacgaactgcgggacgagaacgacaagctccgtcaaatgctcatagaagaactcaaggtttcaccttccaagttacaattagatcataaaaatggagtgaaggcctacaacccatgctcggactgctttgattgccggaggcgaagtcgaaaaacaagaagatgataatggaattgcaggattgcattttggctattttcgcaatcctttgcaatttcttggattcttcagtagctaaatagttcatcggattagctttcgacataatatcctcagcagaagatccactcttgttgttcaggccagttatgttacctatctcctgaacattcgtgaacacttgatccaattgatgcgttacttctgtgctgaacatgcgcagactgatagcatcacagcagtacgtgattttagttctctctttggattctattcaatgcagtcaaatctaaaatcattagtagatgcaaaactattaaggtttaaaatataaaatttatattagtagattatctgtgaaaaactcttttatatagttatattttaaatattttttataaatataactttttatagcataaccgtatagtttgagaaatcaatgacaaaacatttgtaccggaggcggtaatacctttttcttttctgccgaagtagagagttttctttcctttttttttttgtgataggagttgagagttgagacgtgccaggtggagttctactgcagcaacgggggaggctgcttttctgtgtacgctggtgtttgggccgtagcaattacaagcccgagagagggaaaaccgcgcgggaaacgccacgtgctcagatccacccgctccccaaaactcccacccccccgcaccaaaatttttcccgcctcccgcccaccaccaacccacaaaatcgcacaactccaaggtccaaatcgcaaaaaaccaacccctcctcaagtgagaaaccaactccaaggaccaaatcgcaaaaacaccaccccctcctcaagaacaaggtagtagtagtgtactagtgttccccccattctctctcccattccccaaatcctccgcggcggcggcgcctcctcctcccatgccttccgagcactagcgcggcagatccgatccgagccccctccgccctatctccgatggactccaaggctgccggctcgtcggagatcgagcgggcgtggcacctcctcaccgtggtcatccgcctcggccggcccgccgccgcctccgacgtcgcgcgcttcgcgaccgccgacgacgtcgagcggctgtgccgcatccccgggtcgccgcttcggctctccgggggcgtcgtggcggcttccgagacggccttcgtggcgttcctgaggtacgtggggttggatgttccgccgccgagggtgagcccgagggcgcccgatgatgtgatgaggtggttgcggaggcgggtgcccgttacgtacgagcgcaagcggaaggcgtcagatgcggggcgcttcgtcgcgaggaagcgtctcctggcggctcccgatgcaggttactttgcttgtttttctgtactgatgttggtttatgcggagccatcagtagtgtggttttgaactccatttgggaaaattttgtacagatttgccggaacacgagctgcggcagtcgcagcaactgatcgtgcaaagctgtgctccagttgctactggagaggtgtgctatctctttcaaccttcaagtttttctagtcgcagaaatatcatggtgcagtaacacaatgcataactgctctagtagctttgctgtagataatgcagggaaaattaggttatcacactgagggcttgttcggttaatccccacgagtacaggattaattccatacctaatcccctccgaagccccttgtggagggattagccaaacaaggcctgaatctgctgtcctacatttctgatttactttttgctcgataattaattacaattggggcttggtctgctccttctgtggacatttctcactgcaaatgacgagagagatttctttagttgactatttgactattttggtcactaggttgatgctacctattgaattgacctgcaatgttctcagtgattttatgaaataagctatgcagtccaatgctttgatacacatatttttatggacatatcatactctcaaaatggatgaccccatgaaagataattctcttgaatatgtctcaagtttgtatgttagtcttgatcttgaccctccaagtagttaaaactttcattattagtagaattcacctattacttcatttttctcttctttctgtgtcttgcctcaggtacatcaggaggctacccaagaattgcaagacaggcttcctagtctcaacatatttactgctcagcgttcctttgaagtttcaattggctctaatgtattttcagacattgaaattagcatgccttctcttccgtccaagattgaccagtttataggaggcaatgatggcagtgttcttgtgagcatggcttctgcactagtgccaaaggaggtgacagacatgtctggctgtatcaatatcttccatgctacagttgacagagagagtactaggattggtgaacctgaaggatcagcttcactttgttgttctagagtagaggaccgtgaggaactagaaaaggagtccaccctccttactatggcagttggcttagctgtgggaaagaaaaatgggattgagcaggatctgaatcttagacctagcagtcctagaaattgtagcacaaaggcaacagatgatatggaaacgttcgatgtgatttcgaaagaagctgaagctctacaatattgcagcccaaatgctcaatacccacagaagatcctaacttgtggtcaggacagtgatgctctagtagttaatgctcatgtggcaattcatgagaataagatagaagacattacattccagcctcctgaaggcaccaaaacagaagctattgtacatgaaatggtccatgaaactatgggaagtttgtgtcaaccttcttcaaacacaaaggttgaacatgcagtgttgccactacaagccccaacttatggttgcattagcaatgagaacttgaacattgctgctgaaaacagagcaagcacacatcaaaatcatgtggagccatcaacacagaacgaagtggctgtcagattatctaagaaagagcaagatagaaagattatgaagcaaagggataagggcaagaaaaaagaagcactgcccaaagaagataaggatcaagttgcagcaaaggttcaaaaggttagtttgtccacatgatgatgactcaactgttgctatttcaggttctttctatttatgaacagtttcatgcactactgatgtgttgtaaccatcatgaaccttgtatttcttttgaaaaatagcttatactgatcttcaaaaaatgatttattgaatgttgctgcttgcagggtcatacagaaccaaaaccactgcctaacttcaaaaattttgaaattgaagaagaggaaggttcaggtgagaatttctaaatattctgttaaaactttcttggtttatattgattgctgaccaatgtgaatgtttacgcatactcagggggttacgggactgtttatagggctcgaagaaaatcagatggaagactgtttgccataaaatgtgtgtacatctctttgctagtctcgatttgatgttttttcatgtggatttgttgatctataaatgtatcttctgttgttttgtcttttgacagtctcagtcatctttctataattatatggctaagatctttacaagagttaaccctgcacctgtattttttttattaacaggtcctcatgcaaatgctcattcacatcatgtttacaatgaacagaagatgttggaacgctttgggtactaataagttcatgtcctccgaaaattttataatgatatttttcttgttccatgcagtaactttaaacatatgtatcatgtttttctgctgcagaggcaagaatttcgtgattaaatatgagtgctctcttaggagtggtgatctagaatgctttgttctagaacatgttgagcacgatagaccagaggttgaaacactcatgttgtctctgatgtttatttttccttttattggctattcatattggtccatcttttgttgaatatttcttttatctctgcagaatctgagaaaagaaataggtttgtttgatttaaggtggtatgggttttgtctgttcaaagctctggcaagcttacataagcaggtctggttaaatgcatgttaccttagtcaactgctaacttgcgtttgtcaccagcttatcttggatatctgatatttctgtttccaggggatagtgcatagagatgtcaaacctggaaatttcctgttctcccgtaaactggcaaaggggtatcttattgacttcaacttggcaaatgttagtgcatatacttatctcccaatctgatgctcgccttctgttttctttatgctaattttaacattttgtgttttccctgaaaatccatgcaggaccttcaccagaagttctttcgaaacagtaagttcactttctaagtttcgaattttgttttgaatttcgatggttaattgcagtgcattgattgttatctgttctgtgttattgcctcttccagttttaggctctctgtactgaatatagctcttgaaaatttccatgccgctaataatatcctgggaaatattccactttggagcattttatcttagtgttggcatgttagcattattaaattattccaacagttagtccaaggtttggaatgattaggctatttgaggtggtaacgaatttattttttgaaaatgcattctgcttcttattaaatgcatttcaaactcttcagatttggaatgttttaagactgttgctgactgatattttggtttaattggttaggtaaatctgagacaatctcacgtgggaaggataccatatctcagcctgcactgaagtctaccccagtggttcaggccaaagaaccagttgccgattcaaagcagctccttggatccaagaggaaaagatccaacagaagcccagtgggtagtgcacctaagaatgataataaaagtaggcatggtatccaagctgctgatgtgtctggtgtaacctctgccaaggatcctacaagcacgaaaacatcattagacaggttgaagcagccaatgccctacaaagggcggaaggaattaatgaacttcttgcatgatgcaatgcaaagtcctgacaaaaatacttcgacagcacctgtttcccaaaggaagagggttgctgctcctctcggaaatgtggatcagaagctctttatactcaccccgatgcccctgtgttcgggtggtagtgctattgctggttctggcatgcttaacagcaaaggtgtgttacaaactttataccttctcactgaacccagcatcctctgagatgtttcatctatataaatatctcaatcttgcaggaaatggaaaacatcgaagagaaggtccatgtgttggaactaaaggatttcgagctccagaggttttagtctctttcaaaccatgagagcttgtctttcagctttgcgggccatgcatttatgtggtgtctttacctgcaggttctttttaggtctttccatcaaggttgtaaggttgatgtctggtcagcaggggtgacactcctgtacttcataattggcaaatcgccttttggtggagatcctgaacagtgagtttactaatgcattttgcaaagctctgattcctcaacatgttaaaggttgttgctgatgatatatcttctcaaatacaggaacatcaaggaaatagcaaagcttagaggcagcgaagaactatgggaggtggcgaaactgcacaactgtgaatcttcctacccatcggtaagtgttgataacctttgaacatcaaggaactgtgaagcttaaccaaaagtgttgataacctttgaacagctttgccgaaacagaaacagcggtgattcttagaacatttctcattgctttcaggacctattcgatgccaaatcgttgcgctcagtggatctcagggagtggtgtgcagccaatacgcgcaggccggagttcttcaagtcgatacctgactcattgtttgatcttgtagacaagtgcttatcagtcaaccccaggtgcaggatcacatcagaggatgctctgatgcacgacttctttgctccgtgccatgatctaattcggcagcacaggcttgctagaaggccagccccttctaataatctgccatgtttgcctcaagacaaatcggtcaaggcaaacgagtcgaagcgatcttcttccaccgtgccgactactgttaactctgtaagttgattgcctccaccagcaaattaaccagtgtgccaatagtcttaactattttgctccctcagatgttgatgtaaccatgtaaatactatatataccccccaaaaatatgtaagatgtcaaatgtaccaatgtttgctccagatggcagcgtgatgtactggtgttgaattcatgcacgatgatcatgtgctacttgatgtacctgtcaatgttgatagactgatagtgggtcactgacgtgtgggcccaacttttgtgggacgtgggtcactgacgcgctcctttgtgggacgtgggtcattgaagtgtgggcccaacctttgtgggacgtgggtcactgacgcgcttctctgacaaagttagatggacgtgggttactgacgtgtgggcccaacctttgtgggtcccacatatcagtgacaaagtccctctgactttatgtcagaggagactcgtccagactgataataccaaccagtagaccattttgcttcctggaatcgaatggggaaaaaaattttctccacttttgttcattattgttcacttcttttttatatatgcggtgtacatttcgtgcgtaccacacggtatacgtggtctaccattgaaccgtatacgtggtctaccattgaaccatccgcattctgcttcatcagtcaacatcattcactcgtatgtactccatctgccatgccatttcgcagcaattgcaacgctttgctcaccacgcgtcgcgcataaccctcctgatttcttatccaaaacgattttgtcaaatactaaacccaaacaaaaccaccgtctaaggggctattcactttgatgccaaaataaatcttactaaatttttacaataccaaaattttggtaaggttgataatattgccaaattttggcaagatagctattttagatgtgttcactttattgctaacgtacatgcacccaattttggtcattactatgcagttgccaaatttctaggatatttaccaaagttaagaaatcaaacagatgcacattttttttactttattaaaaaattgtatggattaaaatgacatcaaagtaaacagcccctaaggctgagttcggatggggggagatgggaacccaactcctgcgtacggaaaacagagcagtctattaacgcgtgattaattaagtattagctaatttttttcaaaaatggattaattttattttttaagcaactttcgtatagaaacttttttaaaaaaacaccgtttagcaatttaaaaaacgtgtgcgtggaaaacgagagagagggaatgggaaaaggtgcatgcgaacacagcctaaatgttgtccacttccccggctgaacggcaaccagatacaagtaaccaccacaagccgttaaccccgttgtttacctcctccttgataatctaacagcgtttaattcccttcaaacaataatattccgttggattcaaaacactaatccaatatacaggattcaaaattcaaaatggatttgctccaaaattcagaatttgtttgtatttcggatggatactgtgtggtgtgtgtgtggctgaaaccgcgaggccgccgcgagagtcgagaagcagcaacagatgcaaaaggagaagaggccgagaagggaaggcaagcgaagcaaccacaccaggcaccaaggcaccaaccaaccgcgcgtcgaagcttctgggccacgccgccacaaaagccgaagcggaaaggaaaagcctccctcgatgcctcctctcctcgcctccacctcctccacgtcccctctcctcctcgcctctcgcctccgcggaggcggcggctgcggctgcggcggcgcccctctcctccaccggacgcgccgcggcttcctcgcgccgagcaccaccaccacccagacgacgaggacgagtttcgcggcgatgagctggctcgggaagctggggctgggcgggctggggggaagcccgcgggcgtcggcggcgtcggcggcgctggcgcagggccccgatgaggaccgcccggcggccgggaacgagttcgcgcagttcggcgccgggtgcttctggggcgtggagctcgcgttccagcgcgtccccggcgtgactcgcaccgaggtgggatacagccaggggaacctccacgacccgacctacgaggacgtctgcaccggcgccacctaccacaacgaggtcgtccgcgtccactacgacgtctccgcctgcaagttcgacgacctcctcgacgtcttctgggcgcgccacgatcccaccacgcccaaccgccaggtcagccagccacagattaactcgattcacaaacctaatcgcatgatttcgtttaccgtaccttgctctatgcttaatttcgggttctttgattgagtgggtggcagggaggttcagaattggggatttcatttacgataatttcgtgagggtttagtggaattgaagaattaggctactgatattactagttcagttagtaggagtcactagacagatattctactgcaaatttttacagagaagaagaattcctcgcgagtaaggtaaatcactctatatacgaaagaaacgtgggtgctgtcgtgcacagtaagagctcaaacctgtgacaagtgcggcatagaattgactatcagtactgcggtttcttaattagcttgcaggtcacggctgaccggaattattgatgagttcctcaccaaccaaaggagcttactttggccttatgttctttacgcagttttggtttacagcaagtaccacaatcccataatcctgagcactggcagagaatagactgtcatagcgtcatggttgtgttaggctgtgggcactcagcgttgattgtcctgttcatgggaccattgggcccaatgaatcaggttctgttatattggatcaagaatttgcagcatcccagctgcagtttgcactttcatcatcaaagggccgaataccaagtggctacctgcatattaatcttgagcagtcaatgttatagtgtgggtactgttagcaagtatataccatcatattggtgttatcggttggtttgacaagcatctaattttgtagtggtgctgagtctagcatgtcttgcagtgtttgtaatgcataaccttgcacttgggcagcgctatgtaattttgcaagatcgattgcctatagtatgtatcattttgtgttcactaatttatgtataacttgcatcttgattctttagattggtggacaattgactgctaccaaggagtgccaccaaaaataacaaactaactgaaaaaaaataacttagcctgttattttgttctgttttctgaacaaaccaatgctgatttgcattagataaacttgttcctagacaattagattctatttctttcaagcatccgtttgactgtttgacataactgaagtttctgatcacatatactctgaactctttgtatgcagggtaatgatgttgggacccaatacaggtcaggtatctactactacacccctgagcaggagaaggcggcaagagaatctctggagaagcagcagaagcttctgaatcggacgattgtcactgaaattcttcctgcaaagaggttctacagggcagaggagtaccaccagcaataccttgcgaaaggcggtcgcttcgggttcaggcagtctgcggagaagggttgcaacgaccccatccgttgctacgggtgaagggcaagtttgaaccagaacgccacacaagaacagtgcttgaataaggataaataatagccagacaaaaattatgcagcataatactattttgttacctttgtttgtatcaatccatcgattgtaagagatgagctgaacctggaccatgatacttgccgctgattatgtacaaaccaccttagaaaacttgatatagtattatccttttcgatgcgggaagaaaaccactttttctgattgaattcattcaaatggcaatagccagtagcacttcaggaaatgcagtgtgctctccaattcaagatgaaagtcactcgctgagaactcagacactacagtgaggtcattgacgaaaaatgttgaaattcacctgtaaaaaggtaagttttctaatcttctcatccaaaaaaaaaaaaggtgagttttctctagcgattttttttgcaattgtgttcggagttacatgattgcagtgtggtagtggactgtagtagcattttgagttgtgatacgttctactgttatggttgctgataactgttatttttaccatcatctttttacaaatactccatccatcctcatccatcctaaaatatacaggacattggtaccatgtgatagtacgaatctatctataccaggtaagatataagtatgaattaactgttatattttattgagtggtctcatctataactgttgctatattttaaaacatatattttgttgttatattttatcgagtggcctcatctataactcttgctatatattttaaaacagagcaactaatttcgtgagaccataaatcatgatttagcacttcactacataagcaagagcatgccaggcaatgtttggttggtgcctatgctcacacaatgaaggttaggcaaggcttagctaacaatttattggcaataaccaatatcgacctagttacactaatttacgtataacctgtatcttgatccactagattggttgatgccccacgttactgacctcttagacaggtttgcttagacaggtttggtttcctaacgaagagttgcaccaaagagaacaaactaactgaaaacgaacttgttatgttcaacacaacttgttgccagcactcaaatgataaggcttcaaacaccatgcaatgcaactccacatcaaaggattaaagcaataccatatatcaagagcaactggtaaatgcatgcataacatgcaacataatgaagaaaaacttcagttcgcacagacaaaggttcttgagatgctgatctcaattctcaactataaaatagcagctaaatagcacggtagatcttcagatgccaactctccaggttcatagtgacaaggcattttagacctcatagatccatgggtgctggttgctcctccactcggcgatgccctcagggaaccacagagcaatctccttcctggcgttctcgaccgagtcgcttccgtggatgacattcctgcaaggtatgaggtcatctttagaacttggattctggatacatatttaggtctatgaacagatgagaactcaaagggataacatgagtactagtagaaaggtaaatttgaaggactctagagcaccatttggtgttctgtcgaccatacttgtccttacatactccctccattccaaattgatctacgtatagtttttctgaggttattcctaaatgatctacatatttgtgttcacttattaagtctattcgttatttgtgcattggagtaaatgaacattgatgcatgtatccatgcacacaagtatttataacccacatgcaatatcttaatttgctattgactaggaaatattggggatggtgcatacatcgagtttgttgctagagtaaatatagtatgagagagttattagtttttcttggtcttggtgtacctatgaaatatgtagatcaatgtggaatagagggagtacaaggcaatcattgtgatagtaagatgccagtcctaatgattgttttttgtttttgctggtcgaaatgatgaagtgttattgggccattgaaacattcacatggtaaaatgcactcttattcattaagaaagtatatattttttctgtggaccacgaattagacttggaaaatttggatgcaaggttaatcatggtaaaccatgtagcacatggtgctgtcccacagtggacccataaagtgatatataaaccaaaattcaatcaataagatactagtagtagaatgaatcagcacggttgcaattatttggtatgattggacagtgtatcacttggtacttcaaagtgcataaaacattgcatatggccctgtcagatgctctcaccatgcttaagctagacagaactattcaacagggagtcagtcaactaagctcccaggacagaccaatgctatatattgcacaataaaataaacaacacaccaaaatgtactttagaaacataagtaattttgaactacacaagccttcatgtgctacataagtttaggtgtttctccaaaagcatttaataccatgcctcttgggaggaaaaaaatcattttagcatctgtttctgaaaataaagcatcttagaataactgtgatgggcatctctaattatactccagtggaatttgcatttgaatctggcgcacagcaacatatgagcaaatcaaaattaagagtgagcaagcagtggaggatgcaactgaattaaaatttatcacccactgatgaatgtaaaccacagagtgaatgaacgaaacctgacctgccaatgtcgacagcgaagtcgccacggatggtgcccggctcagcggccagggggttggtggccccgacgagcttgcggccggtggagacgacctgcttgccctcccagaccatggcgacgacggggccggagacgatgtactccacgagccctccgaagaagggcttggaggacagatcggcgtagtgcttctcggcgaacgacttctccacgttgatgagcttcatggctgcatgttcagatagcatatcagcaaaaagaaaaaaaatcatcgctccccacagagcaatcgatgcataaatcatcaaacaagccactaattagacccacggagtgaggaaagatcgaagaaattaagctactcaacaacaaaacatgcttagtttcagagggagagagagaaatccttttaacacataaatagcatggcacatcgtgttgtgtagcacaaagattcaatctaatcttctcacggtgcagcgcaagcacaaatcaggatcattggcaaggtgggcatggttacctttgaggtagaatcccttcttctcgaagcggccgatgacctcgccaatctgagcaaaacaagcaaaagacaaacacattgaagctaagcactagccaacaccaaatcgatgcgaggggaagtgaaaggtaagcttacgaggcccctctggacgccgtcgggcttgatcatgatgaaggtctgctccaacgccattgctaccgaaaaaagacaagctcctcgagatttcggggtctggttttggaggtggtcggcgccgtaggttgagggagaagggaaaccctagccgtgggtgcccctcccatatataggcctcctgcactgtccggcccaaccacgtgagacaccgcatcgatctccacccaaccctagctagactcgcaaacttgggcccaaattagatctcgtgggcctccaaaacggcattcatggcctgagccatttcacccctgtctccatttcactcgacattatagagagtagtagtaggaactatactaatcacttcattcactcatctcaaagaaaaattaacaaattcttcccggtgtacattgtttgattttttttctcttccggataatgaggtgtatatgctgacagttcaacttgcattactttcggtaaatttctgcgttccgaactagtagtgaatttggaacgagggagtttcgtaggattttcacaagaaatagttcattgacaccaaaggaggctttaggttcggatcttttcagcttattagtcggattattgaaacggatggtttacttcatacttgaaaaaataagtttttttttacttggacaatttgtttaagttagttcttaaatttatttctcaaaaatatatatatatatatatatatattgttcttataataaagttcataatctgcaacaacaatatccactgtaaaataaatttaaaaaaaaaggcaatagtgtttgtgtcaatgggaatagttttgctggcattagctgactttacttgcaagtgtaccggcacaaagagaaagagaggtaggcacatcagcacatggcaaattttgccaattagcaaatgcatcggtgaagcgaaggcgacggcgtgtggaggctggagctggaggaggtgcgaccttgcaagtgcgacttccaggaagcattggcgttgccgttgcgttggttgttagcagttaggtgcgctcgtctctcacggtcgcatggtacgattggcaaatggcaactacacttccacattcttctcgaagaaatggagagaaaaaagggtataaaaccaacaaacttcttggaggtagtacggcattgcaggaccatgaataatttctgaacttgaatgaatgcagcaacgacttgattcttcagtaatttcagagatcatcagattcagtggccaaaacacagagtattctctagtcatttcttgcaaatgtattaggtatttgatcaagaactcaatattggtcaatcctctattgctacagaagaatgaatgccttaccaagaaacctctcaattccttttctcagatcgagttgagtctctctcactatctatacattctacggatgattttttttctctctcttttttttttcaaaaaattctatgccaagattgactttatcaagaacagccaggcagatctggccaattacctgttgaatcgtatgatcaattagctatagctcgtagtaagtagaagtgtttgtcacttcggcgatcttggcgccgccgccatggaccgccgcgtcggccctgcctcgacgtcgccgtcctccttcttctccaccacggccgccgtctcctcctcgccgttctccgccgccggggacggcagcgagggcccctccaggtcgtcgcggacgcggaaggaggcgtggagcacgatgaccgggacgccgacggcgagcgcggcgaggaggttggcgatggcgccggcggcggcgaggtcggcgaggacgagcgcgacgaagacgagggcgacgaggcggcggtcgaggaggcggcggagcagcgccgagttggggaacacccggaggagccccccgtagaggaggaggcccttggaggccgccatgaggaagagcatggacgccctgtgccgcggcgcgagcgacgccaggaggagcgcccactgcagcgcggcgtagtggaaccggaacgtgcggaggttgcgcacggcgcgcaccgccgcggcctccgcgtcggccgcggcgccgaacgccgacggccgcggcgcgaaccgcgccagcgcccgccgcgcccccctcgccgccgcgcacgccctgtccgccgccgcgcacgccgcccgccggatcgcgcccgcgcccgcgccggccgcgcccatatcgccgagattcgcgctgccgccgctcggatcccccgcggcgtcggcgtccttgcacggctcgctttctttatttggaggcggagtctgagacacgggaggagaggcgaggtcaagacgcggtttttaacgggtcgcgcacttccgggagacgaccggcgcgtcgcctgcgctgcgaatacgaaaagaattccggctgcatatcgccaaattttaaatttttaagctgattttgaggggttttttttatcaaaatttatttttcagtcaataattttaagtcacaaaagttttattcataaattacttctcgtttgcaaatatgcgggccgttcggccccatcttttcctcatcagctgctgctaaaatttaattttaaagttaattattttgtgaggaattttaaagtttttttcattgaagttattcttttaaattagtattcaagtcactaataacgtactccctgcgtttctaaatatttgacgctgttgactttttaaaaatatgtttaaccattcgtcttattaaaaaaaatttaagtaatcattagttcttttcctatcatttgattcattgttaaatatacttttatgtatacatatagttttacatatttcacaaaagtttttgaataaaacgaacggtcaaacatctgctaaaaagtcaatggcgttaaatatttagaaacggagggattatatgtataaaagatttatccatattttttattacgttatacattatacggcgtattatcggtatttgaccaaactatggagccttcgtcgccgtatttgcagaaaaaaaaaaaaaaaaaacggggccgtttccactagtttttccgtggaattttttgttgcgatcgccaccgacctcatggtgccatggaccatggtggtgtggttggttcttcccaaatgttcggccgagtccaccaagacaccaacatcctcttctggcgcatgctagcccagctgtttgtttcaattttttatttacacaccttaaaaaaatcttactaaagtcttaatcgtttgatttaacttacagacaataatgatttactcgcagcatgccatatgagcgtgtataataagaatttcataagaaaaactttacatatagcctttctttattttgtttcccttgatgatcttttttaaaagaaagaaatatttttgtcatattattatgttggtgttggagcctaaaaaaatatagatttgacaaagtagtaatgcatgttagtagtagcaatcagtggtcgggctctgattaggtagtattttgtttgcagactggctgactgagttggaatattcagagtttcaccgattcagtcttcagacagtaacaagcttgattactgcagagattggggaacagtgtgctaaaatcagtgaacccccacttgattgggttcctgctttcttgcccagaaaattggaagggtgtactaatcaaaagtgagtttttttttaatgatttttgctccggtgccttaacggagacatcacggtttttcgctgaacaaccggggaggtggatacatcaccaacctaataacaaagatgagagcataagggaaaaaagatgctaggtattgttctttgcttggtcgaagaacactatcagaagagtctggacatctaggaaaacgattgcttaacattcactcaataaaacattgtattaaaaataatatattcactcgagaacaacagactgtgggcttgttcttttcttcaggttagcctgcgtgcgtgcgtgtgtgtgttgtgttgcccaggttattcagagttcagacaatgagacacttttagcctgcgtgcgtgttgtgttgcccaagacgaccttttctttctcataccacaacattcagtcaaaaaacagcatagacctaggcttcctttttccccttttctctgaagaaccttataaaaatcagcctggctttacaaagtcgtttcactccaacaaagaaaacttgcaggatcattagacatatagttcctgcttactaacttctactcctctgctagtacaatacgagcttctttcagcgaaaagattgcacgatttgttggcgataaactctacaagcagatcatgtattccagaagaaggtacatacaaaattcatctagaaaaatcgtacatggagaaatctacatggatcaagttatactgggccctgcctgagcttagtaggcttctcttcgataagtgggccactttgggcctttcctgcttcccctggtattggacctgagaggccgtgtcgctgttcctttttctagctcgggcttcaatagcactaggccatgagcctagtagggttcctagtataaaatgctcaccttttctctcaacaatggaaaatggtaaccacaaactaaaattcaactgaaaatacaacaaaggagcatatgagtaggcgacagttccaagtcgaaaattcaggacaacaataaaacgtgccatgcaaagactctgtgttcttccccacctttcccaactcaccttccctcgtgttccgcacacacttttcaaactaataaacggtgtgttctttacaaaaggtttctatacgaaagttgctttaaaagtttatattaatccatttttcaaaaaaaagagacttaattaatcataagaacatacgtcgctccattttgcatgcgaggaggtgagttcccaatctcacttcccgaacacagccttatgtgagcaggcaaaaaaaagtgggatatactccatatcagcggtactccgtattaaggaggaggtgactttcgaagccaagctagttagtgcgttaagggtgtgtttagttcgtgtaaagaaaatttatgggtgtcacatcggacgtttgaccggatgttggaaggggttttcggacacgaatgaaaaactaatttcataactcgcctggaaactacgagataaatttattaagcctaattaatctgtcattatcacatgtgggttactgtagcactttatggctaatcacggactaattaggctcaaaagattcatctcgtgatttccatacaaactgtacaattagtttttttatctatatttaatgctccatgcacgtgtccaaagattcgatgtgacgtttttggacaattattttttgaaactaaacaagacctaacttatgggtctttctataggctagcatcatgtgagtgggctagttagcctgggttcaagactcacctcctccttaataccattgatatggaaattttggtaaattttgttctcagtttattgtctagatatggtaacccctcttcaaaccgtaagagagatgtggaactcgtgctgctgtcaatttttttaaaaaaaaataaagagagaggagacgaggttgtaatcacgtagggtagtagtagtagatgtatctgttcatcttgttctgagatcagacagttggaacaaatacagcgcagctaggggcagcaccacacccagcaagccaagtaatactgctgctacacttgcctcatgctgcttggaagggacagacaaaccgaaacagatcgaccacgcatgctttgctaattgctgtgctttggcgttttcgctgtaaagtctcctcctcctatatccatttctcactccctcacattgttaaacaatcaattaattaatttgacagctaatctaacaacagatgcatcactctaagatgctactactaatctccctgtggcatggataagacacagacacttgtaattcataacatgagcatatgcatgcacactgaatgagtgtcatcacagcattagatgggatcagggtgtcatgtcatgcagcttcatgctagctactagtagctatactaactttctctctatctttaacaaaaggagataattaaatccttcacttagaccggatgattagcatctgagggcgacgcaatgcagcatatgtgcatgaatcatgatcatcatcatcaggctttctgctgtgacaggacctggaaaaaaattattctagtagcttttggttttgtgtttaactatatatatggtgataaattaagccaccctgatcacatggatcagagtctggctggaccacgggatcccataaaatcggctattaaatcgcaaaagggggcaaaaaacaatagcaatattctggatgaactgccaaggtgtctctcatgtgcattcttgtgggtatattccttccctcttctactagttttcgtccaaactgttccatccatctgcatctttcttcagatcagttcacaatatacttgtactacctcattggcacaggcacattcttgtgggagaaattttggatagagaaatggagatgatgctcctgatgctgggaaagaacatcacatgcttgcatgctcctcgacgtgatgagcaacatgtaagtatatgttagtactgcagtagtgcccttgcagcatcgatcaccaaccaatctgtcgcctgcatggcagaatctgattgtctgttcctcacaaacatgtcatattctgatgcctcctagcaatctgaattactaccatattaaaattttcacccctcctgatggtgttttcaccttctgttctgacacatatgttaagatttcaagttgttcagggaaacacttgtgatatgtatatccacccatcccaccagggttcaagtcctgttgcccatgaatattacagacatactagtgggcattcaatagaatttagtaagatcagggatgtgttgtggattcccgtctctttgagcatgtgttagatggcgcatctgtcattgtgtgagtgtggtgttacgtgtgtagtgttgtgcatgcatttacatctgtcgtgtaatcgcaaaaagatttcaggttgttcaggtgtgtatgtgttcagtgtatctctgaattgatctgtgctgttgctgcatatgctgaagctgacacacatatgttcagtttcagagttcagtctgtttcgagtgttcaatgtatctctgaactgatcactgttgatgctgaatatactacgctgaagacgacactgacattttgactaactgggtgcctataatcagcacggaatacacgaggaaaaacaaaaaatgaagcgccactaatcagttaattaccgtttcaaatgatccatcattagccaatacatgcatgaatttttcgtgcggaatgcccactgctagaactgcgaaacaccctaattctcgctgaatttgtgtgcatgtatatccatccattcatcgttcggctgcctaacagctggaaaaatgactttgtgcatcttgtgagaattgcagctaaagtcaggttagctctgaaagtgctctaccctgcattcttgccaaggttaaattcttccaaccaatacacgctctcgaatcgaaccttatcactcttgtcataaattaagctgcaagaatcagatgattccacagttcagataaccctcaagaaaagaacttcacaagttcagaattcagactgacttaattcaccaggttgccgaaaattcactgcaagtactaatgcagtgcagccgtacgaacctatctgtacggtcgatacgaatttaagcaaaaatccgatccatcattataatctaaatttgagagtctgatcaaacccagatttaaactaatttttaccaggttgctcaaaattcactgcacgtactagtgcagtgcagccgacaaatccatctgtacagttgatacgaatttaaagcaaaattaaatccatctttataatctaaatttgagaatctgatcaaacccagacttaaactaatttttacctgcttgctcaaaattcactgcaaggactagtgcagtgcagccgacaaatacatctgtacagttaatgaaattttaaagcgaaattcaatttaaattcgagagagagaagaagaagaagaagaagaaagacagactaatcatgccaacttgcaagcccaaagacccaatctttccttagaaatttaatttttttttcatctctttcctcgcgttttccctccctttataaccaccaccaccatctcgtctccttcctcccgctcgcttactgctcgactcgtcgccttcctcctcgtggcgagcgatcgatgaggacgggggaggtggcggaggcggtgccgagggtggtggcgatcctgtcgtcgctgctgcagcgggtggcggagcggaacgacgcggcggcggcggcggcggcggtgggggaggaggcggcggcggtgtcggcgttccaggggctgacgaagccggcgatatccatcggagggtacctggagcggatcttccggttcgccaactgcagcccgtcgtgctacgtcgtcgcctacatctacctcgaccgcttcctccgccgccgccctgccctcgccgtcgactccttcaacgtccaccgcctcctcatcacatccgtcctcaccgccgtcaagttcgtcgacgacatgtacgtcgctgcaccaccactctctctctgtttttttttacttcctaattccccatttcacgcgaattacgcacgacaacgccaccgacagagttgcttgcttgcgatcgtcgtcgacagaattgtagattgattcaacggtggcatttgttcgtagcttctgaatttcaaattttgaaacttcaagagcaagtgtagataaaaaacgaactctttttctatcttgaaaacacaattgcataaacacttgcaccggttagattaaaaaaagttgcatattcttgtattatctagccagccaaatcaaatcgaactaaatcaacctgaaattctgagcaaagttgcataatgcagcagcagcatgatcgcataattcgaccttttttttctctttacaatcgcacaattcgactttagtagcgatgttgcttggcgaaatgtgatcgaccaatcctttttctttttcgttttttgaaccaaatgtgatcgaccaatcgatggatcgatcgatcccctttggattgattggcacacgagcactgctgcacagccccaccactgtaccacaggcatgtggtccccactcacagacctactagctaatcccctttttcacctagcaatagcattttccaactggcattggcaatagcatcaaatccaagccatcgagttggtcacaaatccaaaggacagttgtcgaattcgaggttgatgcggcggccattctactaccaaattcgccattcttaccaaagtgacagacaccttgggtgtgtgtgtgtgtgtttgtcctatctaccttctcacaggctcacattgccctcaaaacaagccactcggttttgtccgtttcgccattgacaagagctattgcttcggtgacatgctggctggcctggccatcattgatcagtggtctaaaactctgaatatgctcttcttcttgtcgtagtttggaatatgttttttttttaccgggttcgttttatctttcggttgaactggtcggtgcatacaattcaacctgatgaccgtcacaatgcgtcgtcgatgcagatgctacaacaatgcctacttcgcgagggtgggaggcatcagcttgatggagatgaattatcttgaggtggacttcctctttggcatcgccttcgacctcaatgtcacgccggctgccttcgcctcctactgcgccgtgctgcagagcgagatgacctacctggagcagccgcccgccgtcgatctccccaggctgcactgctgtccgtccgatcaggacgatgccggctgccatcacaagcagcagcagcagcagcaacaacagcagcagcatcagctcgccgtctgaatgttcaggagttcagaatcaatgagaagttcagagctcttcttttttgtcactggatgtggtgtcaatttgcctttcttttttcttttctttaatcttttttttaccgtgcttggtacataggtgttagttaattgtggttagtgaaagaattgagctttgattagataggtggatcatggttcatggatgggtcagcttcttgggatatttttttcgccattgttcgttcgatggatggatggatcatggataggtggatcagctttgggatcttgccattgtttaagtgatgctaacttgtgcgcatgtgagtcacagcacattgcatgtctcttgtttgcttcctttttttttctctcttttattttcctcttttctgaacattattcgcggcaggggcaagaaaagggtaggagagatatcatgggattgtggcgacaattgggttattggtcagaacatggcatgtttcttcaatgtttggacgaaaatgatcagctcagcatctctcatgaaaatgaaaattttcgattatatatttgatgggcatagaacctgaaaactctgaataaatgcagagagcaactgaaagttgtcagtctgaaatagtagtcagttgatggtactggcataaatgtcactggagtacaattccattaatatggaaagtccactagggcaagaaagaaccaattgtttttgttcgatctaccagaagagaagaagttccattgctttcttcatactccagagctctcctactagtttagttcgcgaaaaaaaaaaattttaggtgtcacatcgaatatttgacaggatgtcagaagaggttttcggacacgaatgaaaagactaatttcataactcgcctggaaaccgcgagacgaaattattaagcctaattaatccggcattaacatatgcgggttactgtagcacttatggctaatcatgtactaattaggcttaaaagattcgtctcgcgatttccatgcaaactatgtaattagtttttttatctatatttaatgctttatgcatgtgtccaaatattcgatatgatgtttttgggaaaaaaaatttagaactaaacaaggccttaacagcaagcaacaaacatgccagagttgcatcaggggttacaggagcagaagtaaatgagtcacaaaaaggaaaagaaaaaaaaagagaggaacacaattaaatgcaatgtcaattcacctcatgtacttgtccaaaagggccaagtagatgagagattctactacaaggagatggagagattctcatggcagcagaggcatcttgggcggtactacctctgttcacaaatataagctattttagaacaatactgagtcaagtatttttaactatgactgccagtaaaataaaataaaaatcaatgacttaagaatgatgttacagcaattagagttaaacaaactatcataatatgcaactctttttatttgaaataattatttttaaaaaatacttccattgatcaaaataacatattggtgaccatgtccaagtccaaaatcgcttatattcatggacggagagagtatatcagacaggtaattaaagggtgccattaccatgaacagtagatgcatcatgtcatatactatctatgcagatgttagtagtggagagcaaggaggaggggtgataagagaagagaagagaacgtggtgtgcatgaggtttgtagggctaaggcagtggttgtggagggcaaacactgcgtgccaacttttgagctgggggtgtaatatataatgcctttggccttaatgctgtgagctggacatgaacatggatggatgccggtcacaagaaattcggcggttgcaaatggtgatctgatgagatgaccagtgatgcagggcgaggtgaggtgaggtgaggcttaattgcagccaagtcagaaaggagaagtagtaaacgattccctctctagtctctatgctcatttgacattccaggtgaaggttatgtgcatcctaagctaatgtgctgtacttagtgatctaagctagtgcacttatactatattgtaactagcttgttcttaattgcggcaataacagcatacacaattttattacagatgtggtttgtattttgtatttttttaaatgaaaaggtcaaaataatttattttgagctattaccttatggtaagaaaattggatttgttagagtgtaatatatttgggggaagatgtgtcggtgggtaaatgtttaagctgatgaagcgtttctattggtagaaaactattatggacaaaattaaatatatgtggtgagaattggcatgtgggtactgaaccatgtgactccagaactgccaaagccaatggtatttgaacctgtgatgtgaagcctagctagctagctagcccatgcaatgtggatcagtggcctaaagaatcacaggagtaaaccatcagggacagtgatgattctttgggcatttgcttttcataaaggcttccatttgctttggttgttcccctgtgaaatggagatggattttggttgggagcttaactttatctatgtactttgatgccaatgcatgtgtgtgcctttaatcattcttgttgagttgctggtacatgtcttctgaattccatggcttccatcctttcttatcttctggaatagtgacaagtgcactaattgtggctcctatgcaatagaagtgaaaacagggatgtcatgagctcaggaccaccacaggggatttactaggggttgaagtatacagtaaaaatagtttcttttcttaacatttgaactcacaatatgaaattgatcgatgcatgatgcatgaaactcaacaatcaatttaacccgtctccagtaaatttgcacaaccttattaggtgcaaattttgtaaggataggcaggtggtaaacattacagaagccccaaaacaatgaagactgtactttttgatgttaaaccctgcagcacagttttcttgcaaagataagttgaccatcaaacaattaatgggaaaatttaaatcatgccacacaaaatttacaaaatttatgatataccaccctgacccacatgtcattaactcatgtgggtcctatacgtcattgagatacgggtggcatatctcaaattttgtaaaattagggtggcatggttccatcaaacccaacattaataccctatttgattaataccctgtctagaaacagtgacctctggcagtctaggatattgcttcctacactagttgtgtacaaccatgactactacagtaccacccagtagatcaccatcagataacatggaagctagaaacacttgcacatgatcgtacccagctcatacggggtgaccagctcagtacaagatgacaaaaggcactctatcattcatacttcggtctaccatgtgtttatttgaagtggacactattactctctatacataagacttcgctctttaaaacttgcgaagtctgggccgttagattaggatccaaagtttcacatatcctcttctctatcaatcgcacatcctcctatccggaggcatgattttgttaaacaggagagttgaacgatgtaattttaaaattttattaaaattcaaatttaatgtttttttctttagaatttgttgtcatgtgtagggcccaagcctaagctgacctacacgttgctccttctcatgctccttctatttctcaaaaatgaaagtgtataattctatatcggacatacaaaattggcattactagaattaccatatgaaatgcttttgcaacagtaaggttctttttttaaaaaaaactaacactaaggtttcttgaaccacagttttccgccttacctccctcgtttagtaaggttgccaaccttagctgttcgttttccacgcgcacgtttcctaaaccgtaacacatgtgagaatgacaagtgggccacagctgaattccaaagcctaaatgttaaggccttgttcaatcgcggcccatccaaatgagccccaaacggcaacacgagtaggcccaggaaaacgtaaaccccggcctgctagtagatctgggcccatagtgccgctcgtgtgaaatcaaacagatctcgtgctcctctcctcctcgtcgccgtctgcctcccaccacttgacaacaacaaagtctctctctcttctctctctcgcctcgacgccccaaaccctagccatggccgacccagccgctgccgccgccgccgccgagttcggggatcccgattcgccgcccgcgccggccgccgaggaggccgaggcggctgcggcggtgggggaggaggcggtcccggcggcggaggccgcggcggcgaagaggtggcccgggtggcccggggacagcgtgttcaggctcgtggtccccgtgctcaaggtcgggagcatcatcgggaggaagggggagctcatcaagcgcctcgtcgaggagaccaaggccaaggtccgcgtcctcgagggccccgtcggcgccaccgagcgcattgtgagtgccccgcgctagttagtttatcgagtgcctatgtagttctttccgttcaatttgtcgagtattttagaagctctaaatttgacattaaattgttggattgtctggtaggtaggatcttttcttagagatgttatttagtgctctgaattagagattttgtgagttagctgcttaggttgggtgtatattcagtaaaaattttgttgattgttttgctttgacttatatatgttagcctatgagttgctgcaattgttaattgcattttttgtcatgtcaaataatagagcagaggtggacaggtggtttatattattcttaaattggttaaaatttcaagccaaatttagagctgatgttgattgcgtgtagtattggtgtgtggtggtggccttattgtaattatgcttgttagggtggtcttatcctgaagttattggacttgttattgcttacgattgtaggcagttcatctctcaagatgatgggtagtgaacagatggcattcaatatgttttcctgcatttgtatctcgcctggtttggtgtgactcaaacagaacgatcttatttataatttggttcaaattgatgaaagcaataatctatcattctatctgttctctgaatgtgttcgaaattttgtattgggcactcacattagtgttgtttgcattattgtttagtcgtttgatgttatcctttggattcactaactgaatcaatcccacgcctcttggttataggttcttgtgtctgggaaagaagacccagccttggagcttcctccagctatggatgctctcatgagagtttttaagcgtgtcagtggtataacagatggagctgctgagg

SEQ ID NO: 66358 - DNA, 14706 bp, Oryza sativa
tcatctagatccctcgcggtgatggattgcaggtgttggagacacaacccaaactcctcgattccaacttcaccaccaacatgtcatcctctccgacatgggaggagatggctaaggaaggctggcctgtggattttgctgccaccaactggcaagaggggtaggtcactgcaatggagcggcgggtgtcgacgaccccccctccccctcctcaaacattagaaatccaacaacaggattaggacggtatcaccctttggcctttgctagcagtgggcagaggcggagaagaggagggtcgtgaggagggagctagagttggtggtagagagaactcgatatggtgctggaacattgaagattgtggcgcggtgaccaagaagccctgggaggtagctcgacgaaaggctaggcgtcacatccccattgtcgccacacccaccattaggtgatgacattaagaggcgtcggagtagaaaaaggaggtggcgaggaggcttgcatatctgcattggttttgatcttctcctaagagaaagccatggtgtgttttcctttctcctgttccctggtttgtcaactagtagatcaagaagatagataatgatgtgcgttctaacccgcgcatgcaaggcacaagcgagttcctagcgaaggcatgctcacgcaacataccatccgtcttatccaaaccagcttctactgtcgtttgttcggcgcattacgttaagcacttcgtgcgcatggcacaagagcggctagagaagtcacaaggggagaagtggagacgaggaggtgagtggggggggagggattgaggagttggagcataagtgtgcccatggcctctgcattagcctaccacacttatgggtacaataacattttcattttggacatggtaagtttaccaaatattttagtttgaacgctttcttctctagccttccctttctcttcccctcccctctctctcgctcttcaagtttgatgtgttaatgagaaaggcttggctaagttccgagcacgaggccctaggtagagatcaagcatgagcttgagtatatggctcatggtgccgatagagcgatagagatcgagcttagatggccagagcatgaggatgaaatggtgctgataaaggtcaagcttagatagtcggagcatggggacaaaaaggaaggcaagaccagtcctcaaggactatgacaatgggtgacgctccaaggtcattgtagtgggagttgtgcatggcgaggctgcttagggataagatggaggcgggcggtggtgctccatggctgcaacataaggagccgcttttgaacaatacagtgggagttatctgagaatggtggtgatgaggcgatgcttcagggctacgacaatggagtgggtcatagatgtggtagcaggagacactacaaaaagatcgcgagctcaacaccagctcaccagcatgacaatctagagtattgatacgggaggatggagaataagggtccaaattgaaaccttttgcaaacttatatatagtccaagctaaaaataatgccttacccctagtccaaactatcacatcgataaaaacatatagttcactgtgcaatttactatcgaaaaggtaatgatatttcattcctaatgaccgtggaagagtgacgagtacacctcatgagattaaaaccttgggaggctagggaggaaacatgtcaacaggattcatgcctttcaccatgatactatacatacatactaacaccattgataaccgatccacctttttctcacaaaacttggttgagcccgttcttctcttttatcttctccaattcagcacacaactgatgtggcaacttatatagtccgtttacatcatctttttatacttactctaaggtggtgttcttttcttctgaagatgaagaataagttttttacgcaaaacgaggtggtattaacgtatgattgattgagttttaactattacaaacttgaaaaaaaattaatatgatattttagagcaccttttatatagaaagttttcgcacgaaacgcaccgtttagcagtttaaaaagtgtgccacaaaattcttaatcttcatccatctcatacaactcatgcgtgcgagccaccctctacacatgtaaccaaatgtagcctacatacatttctatgacctttgtatcaatatgttccatctaacttctttgcacaaaatgattgaatagatttactgatgaaatccaataaaagttttcaataaaggtttaatatctggtgttaaaaaaatatatctaggtggtgatttggcgctaggtaaggggttgatgccccattttgcctactagtagtgagctaggcggttggattacctcggtggtcaactttaacacttagagggtgtttgggaactagggactaaatttagtccctctcacaaaaggataagtccctatggtagggacttatacttttgtgagagggactaaagtttagccctactttagtccctccaaccaaacaccaccttagtaggcctagtcacacgatggcacgaaagtgacgaggcaagtgccgaggtgactagacggggtgcgaaatagtagtttacaaggtgacaaactctatctttcccaaattagagtgggcgggaaaaacctgagagccctacccagagatggctagggattaggaggacgaattgggttcccaactcactgctactggccaacgcaatttgtccatatcctcaattcatcgattcccccaagtccagttgttgtgcccctatgcgtcaaggctctcgatgctcgaattagtgacacccttgttggtggctttgctttgaacgtgccatctccatgctactagtcgccattaatcatctatacaccgccggctactcaactccaccaccatcctgaactagtaaacaccactttttgttgaatgctatgctccgttgatgcttgagcctatggattttactttttttttctattcttgctctgtttatttactctagtttctgttctacatctctatcttcagttggaactaggggccgctgtgttgaacactactaatattcataatagtattctctccgccccaaaatataagggtgtgtttggtttgtggtcaaagttgtataggatatggccatccatatttataaggatatggctctctatccaacttcgtagtattaggatatatctcatctatccaaaatgtcttatatttttggatgaagggagtatccaactttgtagtattaggatatatctcatctatctaaaatgccttatatttttggatgaagggagtattattttttaagttgctattgtatagcataggtattgaagaaaactctccctttcacgtgtgataccataattcttatttcctccgctttaagacatagggcatgtttggtttaaaaccctaccgagatgtaagtttaggtactaccaattttttttgttaggcaagagtatatcaactctattgattttggcataagttagcatcaatctaaatggctagtactccctccgtcccaaaataagtgtagttttacactgttcatgtccaatgtttgaccgttcgtcttattaaaaaaaatgattagtatttatattgttattagattataaatatgaatagtactttatgtgtgactattttttaaaaaaagtaataaattttacatatgagacggacggtacacggatatacgactgtacttattttagaacggaggtagtatatacaattaaagttgtcaaatgattggtaggcaaaatttaacaccaaactaataacataaagttaatctaataatatattctaatactataaatttggataatacattcgatcatagattcgttcttcatgtgacggagttactatgcattttgaattgatggagtattcatgttgacagcggaaattttctcttggagctactgctcacagttaacagttgacacacacataaattcaccaacaccatcatgactcgcgaccaagtctcactcacccatccactcaagttgatatccccccgttaaatccactgtctgaactcatcactgcccttgtcacacaccaggaaacaaaaaccctgttcagtacgccaagcacatcagcccggacactgacaggcctcacagtcccctgtcacgtgcacacgcccggtgccacaagtccatccgccgcagaagatcccgcgcgagttctaatctagcccccacgcttcgtccaacgaacgcctccctccctccgtccctcgtactgcacgagagagtcgatcgatcgatcgatcgacgaacacgcgcggtcgcgcaccaacaccaacaaacccgtcaccctccatacggcgccaatttccccccaccagaaaacgtccccgcgctcgtcaaaagcacaaaagcaacccccaaagatcaaacccccaagaaatccaagcactccaccactaattattctgcccatccaaatattcctctcgtcagaactcgtaccggtgctaaggagaaaaaaagtcacgcaaaagaaaataaaataaaaagggaagttggattgaggagaggaggccaaaaagaaaaagaaaagggtttggttttattataggagcgaggggagtgtgtgtgttaagcgcggccgcatagaatggaagcgttccaaatcggaacccaatcccggaggcgcatgaataatcatccaccagttcgagtagtggtggcagtagtagtagtggtagcagccgctctcctcctccttctccctgttgccgtgctgttcctgctgtttccccaatctcctcctcattatatccctatctatctactactactcgcctcagcggctgctgtggctgccgcctttttggccttgttcgtggtgttcaagttggaattattaccgctgtttttgctgcgatcggtgttggtggtagcggagatccagccgcacatcggatcgccttttactgggctggcgtgtatattagcgggcgcggcatttcattgttgtcgcgagcgagccctggaggaggaggaaaagtgtgggagtttttccgtgcttttgtttggcggtggcctcgggaggaggagtttggatctaggtttgcggggaggtagtctccgatcgccgcggcggccatggacgacggggacggtgcggcgcccggagacggctctgctgcgtacacagccccgccggcgcctcccgctgcggccgcggcggcggcggcggctgtgtcagcgggtagcacgggcgcgtctggttccggggagaagacggtgaagcgcatgatgaagagcccctaccagcttgaggtactcgagaagacgtatgcaggtgcgtggattctgatggttttgcgaggctttggaagtttggagaattttttttggaggatttttgggtggggaattgaggttttggtgtttggggatgtgattttggtttggtgcagtggagcagtacccgtcggagaccttgcgggcggagctgtccgcgaagataggcttgtcagacaggcagctgcaaatgtggttctgtcaccggcggctgaaggatcggaagccccccacaaagcggcaacggagggaggaagaagctgcagcggtgccattgatggcacctccgccagtgttgccgccaccagcactgccgctgtcaagtggcgagctactgatcggtgctagtagcccgtatgatgagccgccgctgcccccagttcactcgcgaaggggtgcagggcggtcctcagcagtgcccaggttatctgcgccagatattgggcggaggtattatgaacctctaccagtaatgctgccgccaccaccggtggcatcgatgcagctcatgccatctgagctccgggtgattcattctgtggagtcgcagcttggggagccactgagggatgacgggccggtgctcggaattgactttgatccacttccccctggctccttcggtgcaccaataggtatgcatcccaaaaccctgcacttcgtaggattaagctaaaacttcaaacttgaatgctagtgatatatattttgcaggctgtcacctttttatagtactgttaagccaactgtgttttgctctgcagttgttgaaatcaaataattttgtttacttaattgcttgttgttcctgcaagtagggaaatcgcaataggatgttatgggatggacactgtttagttaaataaagaaaatcaactggacttgttacgaagatgcacaaaaatgattgattgataaataatgtttcaaaagcaaaggtgaattttgagtatttggccagttgccaagtttctatgttagcaagaccatgttataaagtgttaatattcccaatgactaatttagcaaaaaggacatattgcaggaatttttaaataaactgaaaagctaccatgctgtttaacaaaactagctgaaactttgtgtgaaattttggagagctagacagttcatgcatctgcagcgatcaatgtacactgttattaatgaacccaccatgatcaatggtataaatctttctctttgcctatgattaacatggttaattctgtacctctaaagtgagcctgatggctccttttagcctttattgaatagtatatactagtaaatatacattagttctatccctgattataacactatccaccctaactcattgtcatcaattgtctcttaccttttattttatcatcttccctgtgcattgctacacttctctattgccatcgttgcacagcctcctaataactacttactttgcacattgtagtacatgaaaatagacattttgtgcatttgcttttctactgctcattcttgtagtagttagtcatgaaaaattaccttttttctgtattctagctatcttctttttaatttacattgtgtgaatcttccacattgttttgtctctgcattcatggtgaggttaccacaagcagggaggggaggactgggagggagaggggatgactgaggcaggttgtagtctcttaaatgagttagtgagaggcatagtggtggttcggccaggagagcatatagaggagggcaagggtgacgtcaagtgcatggggccgtttgtacaaggttgtcaggactaaggggagagggtggaagaaggggcaatttagtcttggcccattgtggtttatcttgaaacagaggaacacgttgatggtatatttcagaaagaagaacttcgtagcggtttcaaattatttaaaaaggtctatatatattaaaaaaaggagcagattcaaatttgaatctacaactggcaggggtatattgactatttctaatttgtttttggtgctcatgctccatctaatatgaacccaaaatgctatcatgggaactcagaatgcatacagttagatgagacttggatgggttacatttaaggagtcttgaacactgcatggatgataattttcatccaacagcatcgagaaatttacttatggggatcccaccacatgaagcttctttaagttcaatctattgtaatctcatccaatggccagtgtgtttttgcaagatgggcctagagccccaaagagggttttacactcgattctcagcctagggttatactaggaaacaatagatgagcctggcttaaaggcagtctaatttttgtattgctgagcttatctattggtgaatagaagtattatgtagactctgttcatagcatttacatagtaaccggtttattcatataattttaattgctgacattcctttccttatgtattatgaacagttccagagcaacaaaagcagcatgtgcgatcttatgatacaaagatatattctaggcatgattcaaagctgttaaaggtatatttttaggaaatttccaaaagtaagtttgtgacttgaagtgtgttgtgttttttccattgaataaacccgctctggttttatgtgcttaccttttggagtagcattgcttcagtttaaaatgtcatggcagtgaattgacaatgtaatcttacccagaatgttttggcagttttaatatgtcatggcagtgaaatgacatgtgtcttacccagaatgttttgccatgacaatgtaatcttacccaaaacttttaaaatgtcttggcagttttaaaatgataagaatgttttggagatttggccatatgatgaaccgctttacccagtttgtatgtaaaccccctttcatggcttcacccccatccagggccagtcctaacattttagaggtcctgagcgagacaagaatggatgccctttattcaaagaaaaaacacatacaattactttccatttagctgcaaaataaaattgcatacatgcatagaaacaggctcataatcaatactcttttgggactataactgtaacatgcttgtcgagaactcatcccccacccaggacctgcagcgagccatgactatggaatggagaatacaggaagcaattgctacattgaaaatagcaataataacacatgatcctaaacactttctgaaaattagcggaaggtcgcttagtacttaaattttagtaaagtaggggaaaatgtgccataattgggcagtcctaaaaaaatagcagtgctaatccatacccttttcaaccctatcgcagatgtttgaaaccaaaaaccaaatccacaacaaaaatgagatattcccttatagtgctgatgtcgtgttccagacttccagtggaagtgtggaacagtagtatataataggtaaccgaagaagaagaattgggaaaagataccatgtatcggattctggtagtgtcattgcaaatgaaaagaattgtactatcgtagacaagttggttggaaatcgttaacatgccaccccctcacccaccaccaccaccaaaaaaagaaacttaattgagaagaacatcatctgtaaaagaactcggcccccaggggaaagacttcccctgaggtatttcaattaagaagaagcacccgaaacctgggccgagaaaagccacgaaagcatgtcccctgtagatggggagctgccccttatggatcaggccttaacctgtgctttgaggcccctgccccatacacgaggaacaaaggaaatccatcatctatcacctgcagggagccatgaatatggaaaacgcaggaagtaatttctacattcaaaacagtagtaacgacacatgatcctaaacagttagaaaattaatgggaagttgcttagtagttagattgcagtcaagtaggggaaagcgtgatattattgggcagtgctaatctatacccttttcaaccctaatggagatgtttgaagctaaaatcacaaaaaagttcaggatattgtcttatagtgctggttccgtgttcctggggtatttaattggtaatcaaggaagaagaatcgagagaggtaccgtatatgcaatgactgtgtgggactccggtagtgtcattgcgaattgaaagaatcgtactatcatagacaacttggttgaaaatccttaaaatctggctctcatcctttagtcatctgttttgggataaagagggtagaacgagaaggctcttatcagcacataggctagcctactaggttggcatcttgctttggggcttggccgactgggtcttccttgcttgtcaatatgagcatgtaggctatgccgtagtccttgtgagttgcggcggcatcccacatgaactagacactggttttagtgcatgggtaggcccaaattttggggggccctgcacggttgccgtgggcctgtggctgccctgccctgctgcgagactagactgcacggaacacgtgttttaaggccattaggtgtgagttggtgccaaactgccaacacattggcatggcacaattatcttgtagtgtttcatgtcctgttaacgccatatattcgccttataaaaagggaaataacaccacgtttgtgtgcatgcattagttctgctcatctggcattacctggattctcctttcgtggttccagtggccttttataacggaaatgctagctgtctattccattcacacttgcctattgattttttgccttatttatatttggcccttttatatcgtcttcttggtgagcccccgtgctactatcttcataattagcttgtcgctgcagagatctgtatttgagaattgagattgagcgtactcttggtatcgttgttttcttataagttttgagtttcgcctcttgatttcttcatacctcgtttaatattttgttgttcctctttttcccttaggcctcggctttcttccccagcgtggaacacccttttgttccaaattcgatcgctgggaaaaaaaagtcaatggttggtaatctgcccccagttcaccctcatgctggatcacgggcagtccatgagtatcaatttcttcctgaacagccaagtgataggtatgagggtgcaagcagatctcatgagggagcaagcagatctcattattatgacactccagttgaagcatcgaattcgaggatgtcatcgcataccccgggatcacatcttctccgtggatctgatgaggcagcacctggttatgctttccaaggtcaaatgtctggttctggccatttgcctcaatcaggcaggcgtgaggtgcttccagcagtaccaacagattacgagatgattcagtccaatagcgaccttaattctgttccagtcgaaggccagtatggtatttctcaggttgctggaattgaaaactcacttctaccgtctgaaagaagagcctatcatgatgaagacggctctcgagtggatagaaagcgaaaagtatgttttcctctgaccccatatagtcatatttgcatctttcttcatatccttaaatcttagttatagacatattgaatttgtttaccatctgccatagcacaatgaggaagcaaaaattgcaaaggaagttgaagctcatgaaagacgaattaggaaggagcttgaaaaacaagacatgatgaagagaaaggtatggcttattattagtgcagatcattagatcttaatgtatttcgattagaagtcatttacagtttatgcttgcagagagaggaacagatgcgcaaggagatggagagacatgatcgtgagagaagaaaagaagaggagagattgctgcgtgagaggcagagagaacaagagaggttcctaagagagcaaaggcgtgaacatgagcgtatggagaagtttatgcagaagcaatctagacgagttagttttcaaattcatattatgtaaactgcaatgcagtgtagtatctatgccagtaccactgtttagtaatataatgttatgcctatatttgtgcaggcagagaagcaaaggcaaaaggaggagctccgaaaggagaaagaggctgcaaggcaaaaggctgccaatgaaagagccacagcacgcagaattgcacgggaatacatggaacttgtggaagatgagtgcttagaactaatggaattggctgcacagagcaaagggttgccatccatgcttagtcttgatagtgacacattgcagcagcttgattcctttagaggtattctgaccaaatttagactttcttagtactacaatgtgccaaaagtaaaagttcactgctagtggctttgtgagaattgtttcagtttcttgtgcatccctaatagagtaaatataaccagactgaaatgaaaaacaatgtattagtatttatatggaacagatctgtagaaatacatgcacaatcaaaatagaatactgtgttatgtaataggtgacactattaggccatgcttggatcttgatgttttgggtaaagtaatctaaaatttgttgccttaacagctgcttcaaattaaatgatgcctagctagtagtgattggaggaatagctcagccatttctacttttgcctaacatttgcttggtagtgaaaattctgttgtaaacagtttcgaatatctgaagtttaaccaaataatgtggtactttgtgattattgattgattattcccttcatccaggcatgttgactccattcccccctgaaccggtgagactgaaggagccattttcgataaagccttggacagtatctgaggataatgttgggaaccttctgatggtaaacctgtgatatattcctttcttgtagtattttgtgatattcagtgaaagagatctgagttcttaaaagttgtgtgagttgacagtgtaaccacaagaagccataacgttgatttgcacattttattttccactagatgctaaattacaaaaaaaattgaccttactgcttttatttgcttggaatcataaatgtaactatcttgcttgtagactcatattctgtccatgcagatggataaacaaatagacctttttgatacattagcatcacttcatcaggtctataggagaggtgttgcttcactttatacagatgcacattgcagcaatccatcttcttaaaaaatttcaaactagtcttttatggccttattagttctttcttgttgagaagacatttgctctgatgacacttgagagtagagacgtttccttatggttttctagtgctaattgaaaatttagtttcatttcatgcactaaatctggtaacagatttacatgatctgttctatttatatttcagtacatctttacagatggtaaatgctgcatcctattctgagttgcataattccattctagtgtgtttttcaatgttctttttaatggaaactgacaaactgttgctaaatgctaactgcattacaggtgtggaaattctcgattacttttgctgatgttctcgggctttcttcagttacatttgatgaatttgttcagtctcttcatgattatgtaagtttttaatttggggaggaattatgtatctatttgtcctttactattatcataatggtaaaaggtgagaatatctttgttggatgtgattaagagctggataactaggttgtttgattgattttaatgttatgcttgtctccacgaatcaagagaataagtaccatggtggatacatatgaatatgagtttacacaatctcttctatttgttggattatttcgtgtcgaatttgtttactagtcaatttacacattctttttccaaataatatgtaagttatacacttgtactatgaaggactttcatgcagtttatgtgttatgtatgtttgtatctcttgggttgttaagttgtttaagtccaattccataagacactggatgttatcttaccaacgttcttggactatgtacattctagttttttgttgttaccttggactatctgtagttagcatttagctttagtcttgaaagatgtcatctttggactgctaatgttgaattatgtaaatttttagcagttaactatgcttatcctgattgatcttctcatctctttactaggattcaaggttgttgggggaactgcacattgctctgctgaaatccatcataaaggatattgaggatgtctcccgaacaccatcagttgcattagcggtgaatccagcaggtggtcatccacaaattgttgaaggggtgcgcatgcatttgtctttttttcaaaacctctagctttttatcttttagtttccttttgttctgtgtgctactatgcttaaaagcttcagtatgttttcataggcatacgcttgggggttcaatatacgaagctggcaacgccacctgaatgttcttacttggcctgagatattacgacaatttgctttatctgctggttttgggcctcagttaaagaaaaggaacgctgaagatgtttattatcgagatgataatgaggtattacactatctcatactatatacatctattcgctctataagataattccatattgaaaattttcatgatatttggtttatctcagtgatccaaaaatatcatgtgagtactctgcatctaatactttgtatgatgctcggttttctgagattcaaaagggccaccgggatatagtcagcagtactaaggttgcgtcctattgtatagtgtgattcttgaaatttagtgtactgaatgtagggcgatgagtgatatcggtcaaatattggtgagtttattttttttcaaataattaattaatgaaggtgcttttattagcagataaggattattttattttttaaaaaaattggtatattctttttgtctggtgtgcttcaaagttctttagatttacccggatctactccttcagacctcggttctagtttctgcctagagatcctcctatcagattttttctgatggatccatggattctttgttaatggagtttccaacttctggattgcggacaagcctagtcagagttcacttgtttattacaaagatggtccaataatatcattcgtgaagttacttttttttatgttgaagtcaggtaattatataacctggtttgaaaacaagcccaaagttgttcaagttcatacaaaaacaaaagagaaaagaccactgggatcaccagctttccaacaaaggcatcacacatctgcctcagtgctggggactaactagtatctgggttggaaactaactagtatctggcaagtgaacttgacagcttcct

SEQ ID NO: 66359 - DNA, 26799 bp, Oryza sativa
aaaaattcatccgttgttcttaaaaaaaatccaccgcctccacctcgccaccgccgctacagagccgtgccgcagcctccatcgtggcccgtgcgccagatctgagagagagagtgtgtggtggtggcagagagagacctgggaggtgcgccgcctcgatccgtgtgctcctccgctccggatctggtcccgtcgccggatccgccgcgagccgcctcgggcaccgccgccgtgagctgcacgagcgccgccgcatcgcgacgcacgggcgccgcctcgatccgcgtgctgctgctgctgggctcgtcgccgctgctagtggggagtgaagggggaggagagggagaggtgggtggagagaagaggagagggagaggtgggtggagaggactgttgcgcccgttccgtcttggcgcctagcgggaaaattatctcttaaaaaccctaattgcgaaatttgtttctttgcttgttgtctagtgtccgtgccatctcaagatctcaatccccgatctatcgtcgagttcaattccgaatccaatccctccaaatcaaattcctccgcaaaagtccattttgcctcccccagggtcgatgggccgattttccctcggcccatcttcccctctctctcccggctctctctctcgctttccccggcgcgcccccgctctctccctctctccctccgctccgccccgcgccgcgcgcgcgagcgcgtgtcgccgcgccgagcgcccctccctcgcgcgccgcgcgcgagcgcgagagccgcgccctgcgcccctccgctcggccccgcgagccagcacgcgtaagccgcccgcgccgagccaagtcctccctcaccgctccctcgctgccgcttcccgcgcgccgtgttcgcgtgcgcgcgcccgcgcggacgccgcccgttgcaagccgcgcgcgcgtgccgaatggtcgaccgcccggtcgccgccgccgtcagcctctgcacgcgcctgtcgccaatgtcgccgctccgctccaagccgccccccgtcatcgtcgtcgtcatcgcccggcccccgccactccgcgcgcaagccgccaagggacggagccgcgcccctcctccctctgccgcgacgctcccgctccccttcccctttttcccgaatcggcaaaggggcaagcccctttctccccctcctttttccctttttcctcctcgccggcgtcatcctcctgccgccgctttggctgcaagcgccgagcgccagctcgcgccttgaccgttcaatgtcggtttccctcgcccaaaccgacattgccgcccatttaagcccaagccctccccctccaaactctctcattttcgcctccgcgccattgccgccctctgtttcgccgtcgccgatcgtcgttgcgcgtgtcggaggagccggcacgagcaaggacgcggaagaggactccggccgcgccctctccttcctcttccccggcccgaggccggagagattactcccgcgccgtcggcctctcgtcacagcgccccgtcccgcacggtagtgcctccctccgttcttcctcctcgctccatctcctccccttagatttcggtagtagctcgagtagcctccccgtagttagccggcgccgccccgactgttgccgtcgctcgccgtgtgctcgccgccgtcgccgcccgagctccgtagcacccgctcgtcgccggcctcgctcggcgtagttccgcccaatccgacgctagcgtcgagttcccgacgccgcgtagatgctctcaccgccgggaatcgacctctcgtgacctcgtcgccgtttccctcttctcccgccgccggttgccgccgccgcaatccgccgccgtcgagcaacctccgacgaatccgagccgttggctcgtctccccttgtcacgtgcagccgcccggtgtgctcgcttttgcctgtatcaccgtggttcgctccgctgctcgccgccgccacccgccgtccattcgcggccgggtcgtcgtctacctcccgccggcccgcgtggcagccacgtaggcgccacgtcggcgccagctcagcctagaccgggtcgagcccaccccggtcggtccctccccgtgcgcgcgttccaccgcgagccgtgaggctgcgcgtgggcccgccgcatccgcgtccaccgcgagccgcgcgcgtgcaccgcgtcccaaccccgcccgcgcgcgtgcgccgtgcgcaccctccgcacggtgagccgagccgctgacaagcgggtcccacccgggaccacgcgtggtgagcccggtccaccggctccctctctctcctccctcccgcgcgcgcgcgcttgggccgtcttgggccggccggtccgttaagctcggccgagctgccccaaatctcttgggccgcaccctagccacccgagaaaagtctatattccctccctcctttcttttctttttcttttccaaaaaggatttaattaaatcctttttccgttagaccaaaaatccaataatcttagaaattcaatatcttcccacccgtaaatccgtttgactccgttcaacttccaaaattcctcaaatctcgagatctatctaatggcacgcttagaggtcattaatagggctttattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatctaattatattgcttgcaaaatattatgcattgataggatcgcacttaatctattgttccgtctgcaaggcagattggcggacctacctaaattgttgcatttgatcctttccttgttaattgttacagcatgtccccttgtaaccacctagttgcgtcttgatattcgtgcatcctgtgcgagtatcgacggacgccttcaaacttataatctgaataacaacttgggtaaaacttgggttttacgaaagatttggaaaacccgacacctgggtcggtgcttgcgaactaaatgaatttccagaaccgcggaccggggaacgtaccgggtgtacggtttcccgctctcgcacttaaggaccgatttccttggaatttcatccaaacataagataagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgttggcatatggtaaacctgtatcggctttcaaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggttcgatgtttgaaaaatcagcagctgacgggatcagctaggcccgggtggccgtttgaaaagttgttggcccgggtggccgtttgaaaagttgttggcccgggtggccgtttgaaaagctgttggccgggtgccaaccttgttgcaatcctaaagagtgacacattgcacatactccgaccggacgagacgcactgtctcatccgagtcgtttgagaagcactcacctaatcattttagaaaagagttcaaataaaataaattgcaaaaataacagcctttccttgaagcctgcattaaacacttatttcccctggcttgctgagtactcccgtactcacccttgctctatataaataatccccccccagttgctgaagaagatgaagtggatcctgctgacgaggagttcttccaggagcaagtcggctacgatgagttttagggtttcggcctagttcccaagtcgtgcctgtgatgattggtccaagtcctggcttccgctttccttttgtaatgcagttgtgagctcgggatctgtccgcagcccaacatgactatacttctactctttaataaagagacctctgttgctgtgatactctgtctccctgtgataccagcactgtttcctgggactggtatcgattaacaggttaatttggagcgtcacgggctagttccggtcgggactagttcggggcgtgacaaggacagaggagacgcagtgggtggagataagacacgatttttctggcggaggtgttagtagccgctagtgaaaacacgatttttcttggcggacgcttaagtgctccgcctcgaaaaatagagtttttttatggcggatctcttagcgtggccgccagggaaaatatacttttgctggcggtccgtagccccccatcactcgttacatttttgctggcggttttcgcgtacggccaccagcgaaaattatagggcgacgccatgaaaaatcgtttttctagtagtatacgtttggttttcaagtttttgcacctaatcgtacccacctgccaagtttttgtaccgccaacgcaatttactcttttgatatatttggtggtccacttgtcatcgaaggctggatcaagtttagcgccgtgttcaagacgtgggagcgagaggcagatacggcaggggatgttgtgtcaatggcctgcaaacgtgtctagcccatgtgccggcctcacttcaagcctattaggcccacaacgggttacaagagtgcgtacgcagagttctgagctcatttgacatttagcccagctaaaaattaaaaaacttggtacatgaaacttcttaatagcaacattcagtatacaataggaactttatacataaaagttggcatagaaattttatacataaaaacctttttcatagaaactagtgttgcttgaggaggatgcaaaataaatgcttgaggatgcaaatgcaatataagtacaaagtaataatgatttactggggagggttctacatggtcaccataaaatctactccctccattctaaaatataacaacttttagccctcttctccaccatcattctattcccaaccaatcacaacactcttctatattcacttttctcacctacctccactactcaaccaatcacaaccctccaccattcaattctatatatttttttaataaccgtgtctaactctaaaatgcttattatattctaatatggagggaacagaacacgacgatggcacgatacctcatttattccaagaaactttgctcccacagcttacggaacaagaggaagataacctggtcctctagctaagtcaggggacggaaactagcgatcgaaacgatgactctgacagtgagggcgatgttgttggtacaaacgagaaagacgatgagaccgattgcaacacactcccacagtgactactctgatcatgagcctagctcacctgggctcacttggctggtgggaaatgttggttttaactgtcaggtggaagaatgtggatctttttatcgtcttgaatttgtgggttaatttgtttcttaataaactagatactaaaatattacttcctatacctatacatagattgtcaaactaagaaaaaaattcaatagagaattattgtttgggctgggatattcttactagttgtctagctaaataataagaaaaatgatactttacacatgcataacattttttttatatttatgaaaaagcaagtccttatatttaagcgatcaatgtacaatattgaattccaacattatttttgtatagaacaacatatatatatatatatatatatatcattaaacaaaaaaattgagaatgtcaagttatatatgtgtacacatgtaacaataatgaacactgtaagaatatcgacccccctacgcttcaacatctgtgcagcaactcactcgacacactccttattgtccagtaatacgtacgtagacggtttagtaaactccttttttttcactcgatgcaaattacaccatgctagcatgcatgatgcacatttgccatcatatacctgccctgccctctccatctaacctatatatatcatcagtcaaatatgtttaatttgctttgttttcttccatccatcaggggccaaagcctgcacctcctgtgtgcacctcaaagttaggcatcgtcaaatgagcagaagcagccgccctgttgttaggagccgcctggctgtagccgattagcgccgccgctgggttgtagaaatctacaatgcctgcagcttccttcagcatgctgctgttgttgccaccgtggccgccgccgccgacgccgtcgttatggtggtgttcagcagcagcattgctagccttgatgttgttaccggcgacgaggtcgacggagaggtccttggccgtcgctgccgagccgccgccgcactgcctcggctgcgtctggtagaacaccttggacacgacgagctcgccgtccttctcctcctcgtcggagcccaggtggtactggtgcatcacccagttggtcttctccggcttgcgctgcttgccgtagttggtgtagagcaccaggatcttcttgtaccccttcagcttgccgccggtgaacaccggccgcgtcttgccggtcttgtgccaccgcgtctcgccgccctgctcgtcggtgtgcaccttccgccgcttccgcgtccccgtcgtgtacgccttcgacgggcggtggaagaagtgccggatcaggccgtccttgccgactcctgaaattaacagcggcagaaagagaacagtacggttaatatggtagagtgccacactgccactgctctcacgaatgagttaagagatgcaaatgtaatcaattatattacgtgcatgcatgcaacagcaggtcagcaacacaacaagagtggcttcgtaatcgtagtatccagttgaccagttccaatgtcctgacggctgacggctgacgcagcataagaccattcagtcaaactatatgacgaatgggcccagttaatgatggttttgggccgactccagcaattctctgattctatctctctccccctgaactgttattgtttagttattttttgcgtcctttccatcataagaaaaatacttgctcggtgtttcaatacatattctctctgttccaaaaataaatttattttacactcatcccatatgtaccaatataaaacaaaaagacataccctcactttatcaaatcttaatgcaattattcctcattttacctacattccagtgcatctattatttactttcacaaactctagtgcaatgagtgttcaaaaataaatttattttaaaataaatgggagagacaaaaataaacttattctgaggtagggagtattacactaccaactttattcgttcgtatagctttgactattttttttctattagtataacaataatgtgtaacaaaaatttagtattgtaaaagtacttaaaaaaactgctcttttgatttttattttcaaattaaatacatatttgagagatgttgatggttaaactttaaagtttcaccgaataaaattatatttaaagaggaggtgggggcgtatttgtgttttgcatctcttaacatagaaatgaaatttcccaggttgtaaaaaaaggaaaagattatgcatgttaactacaaccttaaacttttataaaagtgtgatagacaatcctagaatcttcatacattatttaaccataaactatcaaaaatagattactttttatacaacggactgaatttaaagtggtttagtggagatatggcgctgaagggtgaaactatctttgaatttaaagaattactcaccgataaacttcagaaaatccttatccacattatggagtacttataatataatgtagatagtagtggagccatgctgtgaccctgtaaggtcaattaaccccgatagaatttttgcaatcaagtactattagtaaaaaaaatatttgcatttcgcgcgaggtggatcttgatcttggctcagccactgaatctaggtaaatttggtgtaatataaataaaatgtatatatggcctgaaaatagtgtgcggaactaaataacacatttttatttgtcggcttaattattttcttacagatagaattaatttaggtcagctgtaatctatgaaatgtaaagaaaattactttgtaccatggaaggagcatcccctgcatgcacattgttttccagctcaacacgcatatgtctaacagactaccacaccaatattcccatgagaataccccacgaacggccgctagctccagcaccaacaaagaaaaaaaatgtttgcgttgtaaacgacataaagagccacttgcattggttttttaatcataattaattcttgctagataaaagtatttgtaatatatcattttctactggattaatatatagtacaatggtgacacgtggtttattattgataactgcttatatgaaaatagagttccatgaaaataatatgatcagtgcactataatgtctcttggtgcaatatttctatcactatggtagaaaatagtacaagttatcctgtggaatggaatgcaacccccctgaagaatataatattatatttccaaaagcaggaaaggcactcataataatttaaagtatctgtcagttattcttaggccatgtttagattcaaaaatttttctttaaacttccaacttttccgtcacatcaaatgtttagacacatccatgtagcattaaatgtggatgaaaaaaaaccaattcacagtttgcatgtaaataacgagacgaatcttttgagcctaattatgccatgatttaacaatgtgatgctacagtaaacatttgctaataatgaattaattaggcttaataaaattgtctcgcagtttatagacggaatctgtaatttgttttgttattagtcttcgttaatacttcaaatgtaatttgttttgttattagtcttcgttaatactttaaatgtgtgtccgtatagttcaaaaaaaatttggcacacaaactaaacatagccttattgcacaaatatacaatgactatcctacccatgcaaatacaccattatatataggcaaattaaatactaggaatataaaaggataagggaaaaaccagttcatattgcaacaagtcttttcaaagtttattctccctttgatctgatgttgcgtgtatcctgcatgacgtggacctttgatgcactgtgctgtcacaatcactcgttttcaatgtgaaataaacttttatgcaagtaggagaagcaattacttcaaaggcaaactttagcaatatttatacggtatcgtgctcaaatgcaacaacacacgatcggacatacacgaaattaatgaaaaacgcaaggacgatcgacatgtatataccctagtgtggatgttacaaatactaagcggctacgcatgattgacatatatgaagcaaggtcatcaaattggaaacgaccagtaaaactttatatcaaaatagggaattttaaactgagaatcaaccaagcaagaaaatgttttgtcaggagtacttccgtgacggacagcacctatagtttccacgtcccgtccagatctgatcatctttgcaattgctatagctgatggcacaatgtaattaagcatgcaagctagctgatcgagacaaatgcacttatgtagatcatgaactgatgaaactaaaactgattcgatatatgtcgatgagtcgtaggaaaagcatgcatgtaagtatattatacgtgcctggaagcctctcgggatgggtgtagcagatgccgttctcgccctcgatggtggggatgaactcgtcgatgagggggtggagcttccgcgcgtcaggcctcgccttcccttccaggtgctccagcagctcctggtccgtcgggtcgaacttcaccccggccggcagccccggcaggtcctggatcgtcgccgccgccgctgcctgcaactgactctacaccatgctcaatgccatccaacatgtacacaggagaccgatcgatcgatcgagcagggaggaagctctagctagctacctgctcatactgcgcgcggtggccgcaggaggggcaggtcttgatgaggttgacgtgctgggagacctgctgctgctgctgctgcttcttggccgcggccacggcggcggcggtggccaggttgttctccacggcgcgcacgtcgttgaagctgttgcaccatgtcatggctgtataatccaacaagacgagagatcgtgcagagagagcgagccagaaagcctctctctctctctctccctgtccctccctccggcctacgctttgctcgtcgcccccatatgcggcaaacgttaaggcgagaccccgcgcgcgggaggagggagagagaaaggaggagaggagggaacaaagcggcctgatcgacgagagggagaacaaagagaaaagagaggggagctataggaagcttgtccctgttaaaagctactcctactagctgctaatcgcctaatcctccctgcctgccttcccggcccagctgctgcgcgcggctactgattttctatctccatctggtacagaccaaggaggagaatgaaggtggattctaaacactaatcagagtttgatttgttatttttgttacaacttatagaagttgaatttgaacttgcatatttgtggggtgatatattacatatgaatctatcttgtcaaatttttttgaatttttttcatacacatttagttgacatacaacaaatgggtgtatctacctaggtgattaaaagtgtttccggaggagaatacatcaattctcacaccaacttttcggttggcgcttcccaggaagatcgccacgagctgatctctctctctctctctctctctctctctctctctctctctctctctctctctctggcgaggcaggcagaggcagaaccggcagtgcatcagctgtgtagtgcaggcaacaactacagaaagaacactccacaaaaggagcaagagactaggattagagagagatcgagctagctataggggacgtacgtgcaacagctagctaggagatcaaaatgaaaggctaaagcgatcgattaacaggctgaacaatgagcgtttgacagctatgggcatggacggatatgtgtcatgtgtgtcgtcgtcgcgaggtgtgcggcaacacgcgcggatgataaactgacaataaatcaatcaatcaaactccatagctaattaagctaggcgaacagcgagagcgaatcatagaacgcaggggatcgatccgggcgaatgatgcggtgttgcttggccctcaagtctgggcttgctaatgcaaaccgtatacgtgagccgcaaaccaggcgccggattctctgcgcgcgagttgctgcgtgtacatctcccgatcgagatatggacgtccggccaccacacgtacacaccacaccaatttgacggttaacatttacacgtcagaaatgacaccggccggtgttaatatagcttagctgctgctatagcgctggtcgtacgtactactactatagtatagtccatggccaaaggcttgcgttgcaagaaagcacctacacttgcgattaaccggaagacccgtacaccaaacgcatatgaaatgcatgacgaagcgattggtcgaggagaaggttgcgcgaaatgcgtgtactttggctggggtttaaattaaaggcggcaggatgacctacattctcctccgcgcgcgcgagaccccggctggtacggtgcgcgcagggtgtgcgtgcgtgcatgtacgtgcaggtagccgctgcgaaatacgtatacgcacacatatactaaccactgttcatcgtttcaacacggttagctagctctatagctatccaatcagttggtaaacaaactatacacgtacactttgattaatattattccattcgatctgtgatttatggtgtgtatgacgttcgatcgatataactctatcaaactgggggattgcgaataccctaagctatttcgcaatagaatacagatgagagaggagagggttgggggaaaaggcaaaggagggacagagaggaggtagctagatgcatgagagagagggaattagaccggctggccaaaagcgtacgtgtggaggagggggaggaggaggaggagggtggagtggagatggggcaacctgattcgatcgcgaggacgtcccaccacaccacaccacaccacaccgccccacctgcaacacgcacaacaccctactacttggcagcacgattgatcgcctgtcagtcagtcgtctctcgcggatggatcgagtcgcggggggtggcggctgggctggctgcggtgtgcgcgcgcgtgcgtgaccgcgtgagatggggatggatttgggagagagagggacttttagatatgaggtcaccgtagagtgtcttggaagagagaaatgatgatagtagtgtatagagcccagcccccagcgacaaaaggactcctgaacgaccgagccgggggggcgcgcgcgtacgtcgtcgatccaccggtcgagacgaggcgcgtccgcgcgtgtattgatccgtcccgtacgttgatcgatctgggcgtttgggggccatgtgcagatgcgtcgtggcgtgcgtgaacatgcgcacctgcgggatttggaccggtcgatctaagtttgagggcgtggatttgggaccattgatcttcggcgtatcggtccggccggtcgcgatgagctaagcgatacgtcatgcccctggatcagattgacaggaatcagagattagttaattaagtataatactccctccatactcgtaaagacagtgacacggtttccaaaatacaactttgacttcttatttctataaaaatatttattgaaaagtgatatatgtatacttttatgaaagtatttttcaagacaaatctatatatataatttttacatttttaaactcaacaacttaagagttattcataatttatattttcaaggtttgacttaaacattgttctaaaagacttcctttatgagtatggagggagtataagtagtactaggcactactccctccgtttccaattaatcatcgtattataggagcgcaccaagatcaaaaaaaaaaagaaaaatccataactctcatatacttatatttactttggtaacaaactcgatgcatgtggacaattctcactattttctaactaataacaaaccaagacatcactttggttgtaaaatattatgtgcagggatacatgcaccaatattcatttactcccatacacagataacgaatagacttatgtaatgataataatatgatgatcacttgggaataaccccaaaaaagttagatgatgatcaattgggaatagagggagtatattataagacgttttggcatttccatcgctcgtttagatccactaacatctatacgaatttggacacatatatgaagcacatatatggatccatgcataactatattcaaaatccaaacatcttataatgtgaaacaaatgaagtaggtgagaattaacaagggtatttaaggtatagcattatactcccaaacattgccacacctccttacaaaacctagccaaaggtgtggtcataaattgatggccacacctcttagacaaggtttggctaaaagatgggtgtaagacatgtgggcctttgaattgaaaaactatggtatgccataactttgatagtgaaacaaatatactccatatgtaccatatatggcaattttgtactggatgagacatcctaaaactacgaatctggacaggggcatgtccagattcgtagttataagatgtgtcacatccagcacgcccctatccaaattcatagttatagaatgcgtcatatctgacactagattgctatattaattatgggacggaagtggtatatcctagaaagggtggtgaagtttggcaaaataagggagtgacccaaacaaccacaagcataacttcaggctgattacaacgtgttagtcgccaacccttgaggatattatatggactataattactggtattttaagattgaaattcaaatattatgttaaatgtatgatcactcagatttaaatgtcttttaaaggatgtttctactttaaaagtttctatatatataccttgtgtatataaacttaattaagaaaaaaataaaaccgtgtgagcggaaaaaaatagaagtagggtgtttgcgaggggtcattagacttctctctcaaagtgtctaattagtaaagaatagatagatagatagatagatagatagatagatagatgtagatgagtacatggttaggctaccttttagcatagtcgacatgtgtcaaattagtacaccagatggggcaatagatgggagaatgtatattttattttgaaagtttaatgttgtatggtttgatcaataattagccagattcgtgcatttagtgtattaaaaagtaccttgaattgctttagtttcagaaaaagtaccttgaatatgttttacttaatggtcaaagtttaaactttaatactttttagaaaataatatacagcctacgaaaaaataatttaacaccctttcctcaacccccccaaaaaaaaccaaaaaaaagaacagttgaggtatattattcgttttcttcaacgagatttgcaacctatttctacacaccaataatattatttttcacatgtattttctccatgcatatttggttgaagaaaaaaaagtttaatctgagtatataatctcattgtgcttctcaggagggcatataaaaagcacaaagtgtgcacgtatctgcttctccctcgaagagttaaaaataactggtccatatgtatcttgacatgcaagcgtctccctattgttcgactgtgacaatctttgcgttagactacaacaaatatacgcgtcgtcgattagttggagaggtatatgcgtcgttggtaagtagtgtaatctaatcaggtactccactgctactaatactatttaatttaacttgtagggcaagtctcaccatctatagctagctccgtcatgttgaaaaacggaggcagtacttcgatccgagagaatcggaattatgttggagtttgacattttaccacactttttcaacagatgggtatgaaaatgcacaaagacttcaaggatgcaatcacttctccaacttgctctctgactctaccatgcgccttaaattttcgcagaaagctagaaaaaggcacgtttttttttctcatttctcttgatatttcagagtacttttctcaacatcaaggaatgaatgaacgatcggtatgaaatgaacattggcagtcaaagatattactagtaatttctcagtgacagtctctcatattttattcgagagaattttaacccccaaaaaaaatctagagagcagttaattactacgaatacagggattgcttttgtaggactttcatgtgatttggtacatgatggacaacgacatatatcgaccattggcgattagatgttgcttcgtgtgacactgacactggacttgcttctgatgcattccatatatcgcacgatagagtacatgtacctaactgaacctgatgtatccatgtgagtgataccacctctagctaagctaccacgaagaactgaactcgcctagtgaagccaagagacaagacaaatgttacttacactgaagctttttcagaggataaaaacagttaattaaggggcgtcacacgcacaccaaggcaattcggtatgcagatatacaaagctctgacctttactagatcattggctacaactaaagctccgggcatgatcatgccatgatatgtgcaaatttaaagggatggaaagaaggaatcacatgattaaagccgtatgctgtcgcctctgatgatcggcagcttttaatttacaatgttccccagactcctggtagcagtagcacactgtcgcctcatgtcttgagaattgcagatgcagcttggttatcactcagagatcagctaggaggaccactgcatacatgcaggaggatttgtctcaaggaaagtgttttacttggaggagcctaaactgttttgttccaatggtctttatgtggtcgcctaggtgaggcaagcatgcatgcaggtttgtctctactctcaaatgctgttgttctgttctcaaaaaagaaaaaagaagtgctgttgttctgaagattgtcgaggatgatcgatgttctctttgcaggctttgcagccttatattgggctgggctttgcatctatgagtttggatcagcccatttttgcctctgacatatgcatggctcggtggatccacatctatgagcaaggcattgtagttcttcataccagatgaaaagaatcaaaccaaatgcataatccagttaagcacggctaggagggaacatctatttacgtgtatatataactgccacagaacaattttagacccaaaaaactgttctttccgttaccaatgtgcgtctacaactgttggagctcaaaaaagagaaactggaacaccaaacattctcgcatttcttgccagcagaactcccagttcatttaatttttgcatctttcttgcaagaaggcatccataaacggacaacaaacagaaacagagtaacagaccattaccttccttcccttcaaatcccttccttttccattgataaaatccctagttgcgtctcctctaacaaaagatcaccaacgctaaatagaacgaactggacgaagaggacagctactatgtctgctccacaccaccgtcaccacaacatggaattgctggcaggatcagaggaatcctcttttgttgaatatatttgatcgtaccagcaacatgagcccatgcagaaaacaatcgcccagacataagaacatcaaatttcttccttcagacactgtccctgtcttccaattcctggctccaaccttggcaacggcagcacaaggcccctgcagtgacaatgttacattcatcaaatggtaacatgatggttctttgtgcgttgccctgctttgttctcagtttcacagatagcttcagggataaggaagggaatgcgcgctataggtttgtcgcattcaagggattgtggggtcatcgacaatcaagcacctcttgatccacacgttgtagttgaatgaatacaatttctagactttgtccattgaactgtttcagcaatgacttttgtttctatagcgctgttagaccaaaatgtggtgtcttgcttcaatccaataccgtaagagtaagcaaagaaagttctcataatattgctgactattatagtggttattggcagaatgcagtttgtcagcttcccagccacccaccatgacattggctttccactctccacaacagtctggtaatcaaagatcttgctcgctcaaattcatgttgattgatcaaacaggtgtaatcccctcaacatagacagaaaaacatacagtagcatgtatctcaatacttgatattttggctgttgactttttctcatggttatactcctagccaatagaatgaagatccataattccatattttgcgatgctgtttagcctgttccattaagtgaattcatagattaagcatgttagacatgtcataagcagaggattcactatgacaattaagcagcataaactctaaagaaagctatcagaacaaaagtacagtgaatttcttttggaaaacaaggttattatatgcaagtggaaagtaataaacatatttgatttaatctttatggagggaaccgatggaaaacatcactagaaactgtgcatttccagggaggttcacattgtagagattttcttttgccgtgcaataaacctgaacaattgatatgctactcagcagtccataagaaaatgaaagaaaaatgaatagaataaaatcgacatatgaaaatatgaaacagtgcaataacctagctaacatttcactttcccaataaatctacctaacattggttgtacaatatgtcaataattacatttgacttaactgcctagcttgctatgcaatagtttgagctacaggttttgatcatttatcaccaaactccacatatatgaacaattaaagttaatgcttagtatatttacgtatgtactccctccggtttcattttaattgacgctttggacaatgacacgctctacaagatatacctttgaccttatttttctattataatatatacaataaataaatgcatgtttacttttattatagtgttttgaaagacaaatctatatatgtttttctagtttctttaaactaaatatttttaaagttattgatggtcaaagttataaaaatttaacctcaaccatgtccaaaacatcaattaatatagaaccggagggagtaatgaacaagatgtatgggactatggaaaacaacatcgcaccatacctgaacactgccaactgctcgtaacttcaaaaaaaaacagatatcattacataacctggaaaagtgaacaccaaaatgtaagatctatcgacaacaaatctcccacttgtgtaacagcatagaaagagtaagaagtatatgacctctgagcacaatgtttgcttggcaacagctcgcgcatacgatgtatcagtggagtgtagtctgtacctttatttcaatttgaaacggttaactggctccacatttcctcagcttcttgtcttacctttttcttactccaatatgcacgtacaatcgtatcccatgtttccctctcagggatgcatctctctgataacatgtcacgcacaacatgagcagctttctctaaattgttctttttcgataagcactcgacaaggagatggaaagttgttggcttggtagaaattccacgggtacgcatgctctggtacacctgaaaagcccttacaacttcacccttagaacacagtgctgtcaccactgcatcatttatcctgccatgcaggctccaagtcaagcggtttggtcggatgccagcaaaattcatctcatcgaggtaatttgaagcctccaaagcccttcctgcatcacatagcccaacaattagcttaccgaacaacccagcatcaggcttcctcccctggagacgcatccggtctaaaatctccatggcctgacccagacagccctccttacagagcccatcaataacagaactgtatgtgattgtatttggaagcttcctctccttaaccatcctgtccagcagctccactgctgaggcggcacgcccacccttgcacaatccatcgatcagtgaactgtatgttaccacattcggcatgatccctctcctagccatttcatcgaacagtttcagagcatcatcaaagcaagcctcccgcgcgagccagtggataagagtggtgtaagtaaccaccgttggtgcagtgccattcgcaatcatctccgcgaacaggtcgcgggcctccggcagccggccgcggcggcagagcccatcgatcacagtattgtaggagcacgcgtcgggtttggggatgttccgaaaaacgcgaacggcgtcgtcgatggggacggcggcgtcggagcagtgggccttgacgaggacattgtaggtggcggtggtgggggcaaagccggcggcgcgcatgtcggcgaggagggagcgggccagggagaggtgggagtgagcgacgagggcggcgaggaccgcggtgtaggagcgggcggagtgcgggaggccgagggcggagggcgcggagcggaagaggtggagcgcggcgaggggctggtgggcgcgggagtaggcgcggaggagggagaggaacgggggctcgagctcgccgggcgaggggaagagctcgcgcgagcgggagaggagggaggatgcgagcgggaggaggctggcggaggcgaggcgggacgtgaggagggagacggtgtcgcgcgacgggaggacgggcgcggcggcggcggccgtggaatcgtcgggcggggacgcggacgagggcctggcggtggccgcgtcgaagagcgccagggcccggcgcgggtcacgctccgcgcggaccaggcggtggaggtggtcggcggtgagggtcttgggccatctggtcgccgagggggtggccggcggcattgggctgcggcggcggcggcgggatgggcaaagcctgcgtgtacgaggcgggacagaggtgttcggcggaatgctgccctgccctggcaacacgaggacctctagcaagtgcgcgcagttgcgtgaccgaacatttgtcgggccggccaaatgtcaaagaaaaggatgggcctatttcggccatagctgaaaattaattagggcctgcttgggaattaaggacctttctcgaccggaataagttcaccagaggtccctcaacttaacagcgagacttttgagatcccctaaccacaaaaccagaaatttccacccctaaactttacgaaaccgtgtaaaaaaggtcccagggcagtatggatctctagtttcgctgatgtggcatcctagttagcaaaaaaaaataaaaaaaattatagggccacatgtaagtgagaagaaaaaaatgtgggacccacacttctttttggttttcttttctcttttctttctcctcttctcttctcttctccggaagccgccggcggtagagggagcctgggagagagggggcaggggtgggcgaagtggccactggcgagcgcggcagtgggcggctggagaggggggaagaggtggccggtgagcctgcgagggaggagaggggggcggcggtgggtggagcagcagcgggagagaagagagagggggtcgcgccggccgagcttcacttgcgagctcgtcggcggcaatggcgtccctccgcgcgctcccccttctcgtcctgggcatggcgttgtgcgcactcgcgttgttccccttcgtcgcctctgcgtcccgtgacctccgccaccatcccgcgggcttcgtcatcggcgggagagggtagagagggggtcgagccacccgagcttcactcatcggcgacaatggcgtccctctagccaactgttgttggtgttgctgatgctaatgcggcttcctccgccgcctccccgcctgcaccaccatctcgggcagctccacgccgtggtcccgcacccacagcgacgtcgtccgcagcgccctcgctgcgcactgccccagctcctctcccttcccttccccgtctttcccgccgtcaaagcagcacaagaggcacccaaggcggcgacgtcgcctccctccgagcggcagcggcgaccttgtctccctccgttcttgcccgtcgccaccctgcccgccggcctctcaggctcgggggaagaagagaagaggagaagagagaacaaagaaaagagaagaagaaaaaaaaagaaaaagaaaagaggagaaaagggcgctgatatgtgggttccaccatatgccacgtcagctaaacgggggaaaattagatcagtactgtttagggacttttttttgcacggttttgtatagtttaggaatggagatttctgattttgtggttaagggatctcaaaaatctcgctgttaagttgataaaccttcggtgaacttattccttctcgacctggtaaaagaaataaaagcccgtaactttcggccacctaaagtaccggagaatatattcaatacccttcctgttcgggagaaaaaattggtagaaataacttatcggagcaatttgggacttcgaagtagacaaatagatagataaaaaaactatgatgaataatcaaaaataacatcaaactcaccaacagatgttcatgtaatgttccacatgttttcacgtaaatcttcattgtagttcgtaaagcaatgtctcggtgcttcttcgtttgtacttatatttcaccggtaattaggaatgcagtttttataggcgatatataccgagaacaaaatggatatccttaaaaaaacaaatggaactgatagatctcgatataaaaagtcacctaataaatctatctattatattattaaaacagctttaaaaggagacatcacgttcgctgtgggagctagaaattctcatattaatcggagaaaaagaaaaaaagaaaagaagagtccaagtagaaatacaatctaaaaatagctgaaattcggaattaaaaataagcaatattgaaagaagtttctatataacaacccaatacgagattaatacaaattcgaaataaaaataaaataaaatccaaaattataaaataaaaggaagtccaagtaggaatacaatttaaaaatagctgaaattcagaattaaaaataaggaatattgagagaagagtccatataataacccaatacgagattagttaatattcggaataaaaataaaaaaaattcgaaattagcaaaaagaaaaaaagttaaaataggaatacaatttaaaatcaactgaaatacgaaattaaaaataagtaatagtgaaagaagaatcaatataagaaaccaatatgagattaattaaaattcagaataaaaaataaaaaatatccaaaattaataaaaaaataaaagagagttcaactgaaattcaaaaaataaaaaaaaataaaagtattaaaaacactatacggtattaattaaaaaaatttaaattagaaaaagaaaaaaagatttcaattaggaatagtggtggcagttgatacaatatataaaaactgttagtaaaacaccaaatagaatcctaatgatgattaaaaggagggacgagcaagacggttgccgggacttctagaaagtaaaaaaaaaacccaattgataaacatattcgatttttaaaatctcaatgagaataaaggagaagcagcatgcggggtgtataggagtatagttgcagagccgccaacggttagcgggacttttagaaaagaaaaaataaattccaacgatagttatgttcgattttagaatcctgatgaaaataaagaataggcggcggatgggccgtagaggtgtatagtggcatcgtttgacgggacttctgaaactataaaaaatgaaacccaacaagacaataaactctaaaaactacaaggtccaatttttaaaggttcggaacttctaaaaagtaaaaataaaacaatgataatcatgatgcattttaaaatctcaagggaggcagcgggcgagccataaaggagtacaatggcaaacccgctgacggtttggcgggacttatagaaagtaaaaaaaataaacccgaacgataattatgttcgatttgtaaaatcccaatgataataaagagaaaagagagtggacgggccttagaggagtataatggcagcgtttgacgggacttctagaaattataaaaacgaaacccaacgagataataaactcaaaaagctataagatccaattttaagaggtttcaaggagaatgaatagaaatagtggtagaccgaggaaacaaaagaaggatatgacagaagtaaggggtagcagctggtgtgacttttcaaaactatataattagaaatacgaggataactatttaataaatcttaagtaaaatcatactgaaaaatatatgattttgtttgggtgctagccgcgcaattgcgcgggccaaaaggaggcactacgttcgttgtgggggttagaaattcccacattaatcagagaaaaagaaaaaaaagaaaaggagagtcatacaatttaaaaaaaagctgaaactcagaattaaaaataagcaatattgaaagaagtttccatataagaacccaatacgagattaatcaaaattcaaaataaaaataaaataaaatccaaaattagaaaaggaaaggagagtccaaataggaatacaatttaaaaatagctgaaattcggaattaaaaataagaaatattaaaagaagagtccatataagaacctaatacgtgattaattaaaattcggaataaaaataaaaataaatccgaaattagcaaaagaaaataaaagaagaactcaagtaggaatacaatttaaaattacctgaaattcggaattaaaaattagcaatattgaaagaagaatatatataagaacccaatacgagataaaaaaaataaaataatatcaaaaattagaaaaatcaaaataataaaataatatcaaaaattaaaaaaaaatcaaaagagagttcaagtagaaatacaattttgaaacaactgaaattgaaaataaaaaattaaaacattaaaagaacacaatacggtattaactattttttaaaaaaaaataaattctgaaattagaaaaagaaaaataagatttcaattaggaatacaatttataaataactaaaatttgtaataaaaataaagattattgaaagaaaagaccatctaaaacgtataacgagataaattaagtaacatgcctataaaggagtagagtggtggcggttgatacgacatataaaagttgttaataaaacaccaaatagaatcctaatgacgattaaaaggagggactttaggcagaccgtgaagcaaacaagtaaggcggttgctgggacttctacaaagtaaaaaaaaacaccattgataatcatattcgatttttaaaatctcaatgacaataaaaaggagaagcagcgggcggggtgtataagagtatagttgtagagccgccggcggttgacgggacttctagaaaattaaaaatgaattccaacgatagttatgttcgatttttagaatcacaatgacaataaagagtaggtgacggatgggctgtagaggggcaaataaagagtaggtgacggatggactgtagaggggcatagtggcatcatttgatggcacttctaaaaattataaaaaatgaaactataagtccaatttttaaaggttcagaacttctaaaaagtaaaaaaaaacaatgataatcatggttgattttaaaaatctcaatgataataaagaagggaggcagcgggcgagccgtagaggagtacaatggcaaagccactgatggtttggcaggacttctagaaagtaaaaatgaacccaaacgataattatgttcgattttttaaatctcaatgacaataaagagaagagacagtggacgggccgtagaggagtataatggcaacgtttgatggggggcatctagaaattataaaaagaaacccaacatgacaataaactctaaaaactataaaatccaatttttaaaggttccaagaagaataaataaaaatagtgatagatcgagcaagcaaataaataacgagataacataaggggtagcaactggtgtgattttaaaactatataattaggaacaataggatgataaggtttggtctttcaaaatcttaagacaatgagatagctatttaataaattttaagtaaaatcgtactaaaagatatgattttgtttgggtgctagccgcgcaattgcgcgagccacccagctagttactcctaaatgaaagaggaaaataaatgcgggagggataataagaaacatgaaactgacaagaaccaagaagtagcgtatataaaacattaaaaaagcacgaaaaatagttctcatcttgctgtcaatgacttaagaaaaagggaaatatttgaattgtccttttttttaataatggaagttttattcagactcagttaattacaccaagatgatacaacgaagcccatacctagcctatgcatataatgcacaaatcccaaagaaaagatagaaacaaccaaacctcttacaagcacaaaagtttaacaaaaacataggtcttagtggctatcaattcgtagactatacctcttaaactaatgaggtagtctaatttatctctgtcatggttatggataagacatacctcctgtcctacgacttgcggtataccttcgtgcatacgatgtactttcttatgtgataaggaaatctacaagatatcatggaaaatatcctcatgggcaagtgattactagagtcctactcggagaggattgggtttattcgttgtctcagagttctacttggagactgaggtaattcacggtataaaaggcacaccccctaaggggtttagatcatcgaatcatagcgccaacacatccaccatagtctacggagctggaggacgcaaaacctactcacccgagatctcgtcgaatcatctcgacaaggatctcgctggtaacaccgaattcatctgttctctttgtactctgtggttttccatatcaatctcatataaactagattggggctattacattacgaggggcctgaaccagcataatctctatattcttgtttgcttgacgtcgtatcgtgtagatcctcgtaccaacgtaccccaataccctatttatccggtctaggggtatcccacgtcgacaatcccctcaattcaaataccaaagattttgtgcctcaaaatctttcaaacccgatgagttacacccctcaacctaagaggggttttggtcctagctggtgtacatgtggcattaatctgattatgtggcaatctagtcaataatattattaaaaatataaaaaaataattattcacccaa

SEQ ID NO: 66360 - DNA, 6905 bp, Oryza sativa
ttcgatgggccgaattcctctcggcccatctctccctccctccccatctctctctctctctcccccgctctgcccgtgcgctgcgcgcgcgtgcgcgtgagccgcgccgagccgagcgccctccaccctcgctgccgcttcccgccgacgccgcccaaatcgccgcgccgcccgttgcttcccccgcgcgcgcgccgtggtggccgaccgcctggtcgccgccgccgtcaacctctgccgcgcctgtccacgcctgccgcccgtgtcgccgctccgttccaaaccgcccccgccgtcatcgccgtcgtcatcgactcagccccgcctctccccgcgcgtgcttccaaggaaaggaggcagggctcctcctcatcgccctctctccctccctcttttctcaaagaggcaaggggcaagccccctttctctcctcctttttcccttttctctcccgccggcgtcattcccctcctccctgtcgccgttttggccgcgagcgccgagcgccagctcgcgccttgaccacccaaggtcggtttccaaaccgacattgccgccctataaacccaggtgccctcccttcctttttccctcccaatcttccccgtttttagcccgcgccattgccgtcccgttgtctctctcgccgaccgccgccgtcgcgtgtgccggaggagccggtgcgtgccaggacgcgggtggggactccgggcgctcgccttcttcctcttccccggcccgaggccggagagatcactcccgtgccgtcggcctttcgtctcagcgccctcctctgcagcggtagtgcatcatccccgttctccctcctcgctcctcctcctccccttagctttgagtagccgctcgagtagtgccccagtagctagctggcgccgccccgactgctgccgccgctcgctgtgtgctcgccgccatcgccgcccgagctcgatagcgcctctcgtcgccggcctcgctgggcgtagctccgcctaatccggcgcaagggatggattcccgtagccgcgtagatgctctcaccaccgggaatcggcccctcgtgacctcgtcgccgtttccccctttcctcgccaccggttgccgccgccgcaatccgccgccgtcgagctccctccggcgaatccaagccgttggctcgctccctctcgttctccctcgtcattccggtgtacaccccatcgccccttgtcgtcgcacggcgtcccggagaaaccgccgccgcccaccgtccattcgcggccggcgccttcgtcttcctctcgccggcccgcgtggctgccacgaaggcgccacgtcggtgccacctcggccgcgaccgggtcgagccgacctcgatcggccgctccctccgttccaccctccccgtgagcgcggtccaccgcgggccgagaggctgcatgtgggcccgccgcaccgcgtcctccgcgaaccgtgcgcatgcgccgagcctaccctccccaaaccctagcacgccccgcgtgcacctcgctcacggtgagccgagcagccgacaagcgggtcccacccaagaccacgcgagatggacccggcccaccggcttcctctctcctccccgcccgcgcgcgccttgggccgccttcttgggccggccggcctattaagctcggccttgccgcccctttctctcgggccgcgccctagccgcccgagggaagtctaattcccctccctccttcttttcttttcttttcctttcaaaaaggatttaaataaatccttttcctttagaccaaaaatccaataatcttagaaattcaatatcttcccaaccgtacgtccgtttgactccattcaatttcgagatctatctaatggcacgcttagaggtcattaatagggctttattttcgccgtttgttgagttgtcccgtttcgcgtgtagtttcggagcccgaagacccgcagtgcgaggatttcgaggatcaagctcaagatctcgagcaagacaagccacccttgaacatattgagcctatatttgaacttaattatattgcttgcaaaatattatgcattgataggaatgcacttaatttgtttgccccgtctacgaggcagaccggtgggcctacctaacttgttgcatctgatccttcgattgttaattgttatatcatgttccgttgtaaccatctagttgcacctcgataattcgtgcactctgtgcgagtatcgacggtcgccttcaaatataaaatttgagtaacatcttgggtaaaacttgggttttacaaaagacttggaaaacccgacacctgggtcggtgcttgcgaactaaatgaatttccaaaatcgtggaccggggaacgtaccaggtgtacggtttcccgctcctgcacttaaggaccgttttcttagaatttcatctgaacataagacaagtgcgaccacatgggtggaatgggacgcccctggctgagtaaatagctaaacaggggagccttgatgccaagagacatgtggattcaacggggtggtgtcggggggaacccccgggcttcctagcacagtatggtctgggacctaacctgttgttggtctgggacccctctcgttggcatatggcaaccctgtgtcagctttggaaatgccttgtcatgaaagcctcaaagtcaccagacgtggctgttctgcacgggctgggtgacccgggttagtaacgtcgtgtgggtaaagtgtaccccctctacagaggttattaaactgttcgaacagccgtgctcacggtcataggcagatgtgaggtgattcctagcgtagttttgtttgactactgctttgtgaaatttgctgttgtggattgggttcgatgcctggaaaatctgcggctgatgggatcagccaggcccgggtggccgtttgagagctgttggccggatgccaaccttgatcaattcaaaagactgataccttgcacatactccgaccggacgagacgcactgtctcatccgtgtcgtttgagaagcacacacttagttgtttcagaaaagagtttaaataaaatcaattgcaaaaacaacagccttttcttgaagcctgcattaaacacttaatctccatggcttgctgagtactctcgtacttacccttgctctatataaataattcccccccagttgctgaagaagatgaagtggatctcgctgacgaggagttcttccaggagcaagtcggctacgatgagttttagggtttcagcctagttcccaagtcgcgcctgtgatgtttggtccaagttttggcttccgcttctcttttgtaatgcagttgtgagctcgggatctgtccgcagcccaacatgactgtactcctactctgtaataaagagaccactgttgctgtgatattctgtcttcctgtgataccagcactgtttcctgggactggtatcgattaacaagttaatttggagcgtcacgggctagttccgctcggggctagttcggggcgtgacaagagatggtatcagagcacaggcttggccctagggcgaaacccgacgtttaggatgaccctaaggatactaagttcaaaactacttgcgaaaagctaaggcttcttttggtttctttttttttaatagtttgttgctaaaatggttactgatcttttctccttctttcaaaattgtagatggcagtgaacgccagcttcagttcccacggttttggtgagggtcaccacgtcgctcagcttcgtgacctcgcccgcttccttggcttctcgtgtcccgagtacacggggtactccgtggaccgtgttccccctcgctgtgagctttcggtgtacctttaccctcgtggaggtatacacggagctggccttcgcccacaccacttcactgtggccaggcccactctccagatcgcgtaccaggacctctcctggacagcgcttcgtcgcttggcccacgactacagccaccgtctcgggggctctgccttccggcagctcccacgccttccttccggccacacagacgccaggtacccttgtccgtacagcgagtctcagccagtgctgactcgcatggttgagctttcggaggctcaggccactcagcacgacctactccttgaggcttaccgctcccttgcccgccgctacgccgctctggaggcccgtctggccgaggagggtgtcaccttagttgacactgtctcttgggactcaggccgcctttgccacgccagccacctgtcctcccacagctctcgcggctcagcccgcactcccccagctcgcgtgcgccatactcaccagtgtacttcccctacccacacccagttagccccttctacaccccggacataccccagttgcttcctcccgccgtggcccacgctttatccgcactgcgcggaagcgtgttgttggttcttccactgtgttccgcttcgactacccagctcccccactgccagcggcccgtgctgctgccggccctcgataggttccgctggtcccttcgcgtcagccgatcgatgtttcttcgactgaggagccgactacaggaggcagccaggcagacgaggagtagaggaggcagtcttcagcagccgtccgtgtgttaggcccttttgttccgccgccaactcttttggaatcgtggcgaggtagtgcgtgcgtgtgattgatgtgggtgttgtttggtagtctggttctcctaggtggtgtgcgtacagtcaagctcggcgtaactttgtgacttgtccacgcccgttgtatcatgtgtttttatgatttgaaaaatccagtttatgcctagtgtgtgctatctgagttgttatttactttgctccttgccctcctaagtgcttatatgattcttacctcgccttcttctgggagtttagatggctagccgcccccgccgtgctgctcatgcaccagcccgcttcggttttgaggaaggtagagttgagccagaagcaaatcatgagtcagctaatcagcagtctcaccacagcaaccgttcgcaccgtactgcttcccgcaatgcagaagttgagcaaccccaccgcagcaaccgctcgcatcacacagcttcccgtaatgcagaggtggaacagtctcactgctctcaccgtgctgccagtcataattctggagaagaacgcatcccctccctacctcatgtggaaaacaacatgcaacacttgatggcagttcagacacagatcttgcaaggattagccgcagccatagccggcttccagcataatgcgcatggaaatgaccaccctcacatgggcaacaatagatccaagctgacagactttctgaggtctcgtccgccagagttctcttagaccgtcgagcccgtcgaggctgacgattggctgaaggatgttgatagaaaactcaacttagtgcagtgtactcctgttgagaagacgctctacgcctctcaccagctaagaggacctgctgcagattggtgggagaattactgcaatgcacaccctaaacccactaacattgcttgggatgagtttgctacggctttccgtgcagctcatgtgcctgaaagcaccattgatatgaagaaagaggaatttaacaggctcaagcaaggcaacaacagtgtcaatgagtacctaagtcagttcaacaagttggctcggtatgcccctgaggaagtggacacagacaagaaaaagatcaggaagttcttgaagggaatcgcagttggaatgagactccagttgcttgctcatgactttcccacttttcagcatatgatcaacaaggcacttctacttgaggatgccagaaaggagaccaccgaagaatacaagaaacgcaggtctaaccatcaggggaattcttcccgaggcgcacctcgccctcgctttggtcaacccatgcaatatcaccagtcggtcactcaggctaactgctagccaggctatgcccctcgtcctcagggttaagcgtgcttggcctggagcaatttgggatgggtgactgaccgggaaattctttccaggtgcacacgagtgaggacaaagtgtgcagaaaagacatgtgttggtctgtgagggcagtctatgacctatgaaagctatcagatgtaagtgggcccggcctgggggaaggcgggacgttacaaaatggtatcagagccgactctcgcggtttcacgggcgcgtgtgtcgcagttgcgcaggcatggtgcgtatggctggtgtagaccgggagtggttacacagcatggcacatgcgctggcactggacacatggacgtggccaagagaggacgttcctggcctggggttgatcgacgggggcgtcgatctctcttaagggggtgagggtgtaacatcccggcctaggacttaataggattaatagaatatttatatcaacaagttgcaacttctttttcggaagccaatctccaaagaactccagggttaagcatgcttggcctggagcaatttgggatgggtgaccgaccgggaaattcttcccgggtgcacacgagtgagacacgagtgaggacaaagtgtgtagaaaagacatatgttggtctgtgagggcagtctatgacctatgaaagctatcagatgtaagtgggctcggcctgggggaaggcgggacattataattacatgcatgttagattgttatcattttgaactttgccaaaaaaattgggaagccaaaagttttagggatgcctcctaggagttgaatccccagatgaacagggttttcatcacaagaactctaagggcattagcagtgcgccacccatattgcggagcttgggactgtcacgtaggacgaagacacaagaagaataatacttgccacaagtttcacattgctatgtagcttcaaacggggtccacaca

SEQ ID NO: 66361 - DNA, 832 bp, Oryza sativa
gcgatggcagcgactcgccggatctccccttctccttgccggcaggtgctagacgatgccattctccgtcgcctccctctcccattctcttctcctccaccacacctcccctctcctccgaccgccgcaacgtagaatggggtggacggggtgaggtggcactcgaagcggctcggcggcagatcgatgacagatccatcctcgtcttcctcgcctctccactgccctgccctctccgtgacaaggtcgggacgtcgtgtggagtaagggctccccggcggcggcgtggagtagcgagcttccccatcgagccggcgagcgcccgacagctctcctcccttggcaatggtcgacgcggcattgagcgtggcgatggtcgacaacagcgtggagcgtggggatggtcgacgacagcaacgaggtctctctcctccatctcctttccctgacgatgcgttgctcaattgtgggccccacctgcaaaactgatgaggaacggggagctcaaattggctccgcggtcttgagcaggctacacggtttgcttatgtggctaacaatattcgcttttttgctacgaggctgaacgccacgtccttgcactgtaaacgccctaacaaacttacctacgcttatctcttgtatgttcatttgtatctgttgcaacatgcaaacagtagagaattgaaagtgtaaataatctactctgaatttgataatgattaaaccatatccattgtgcacttatgtaagttgagacagattacaatacgaatcagccagatgtacgttgaatacgtatatggataggatactagcgcattcgggtcaa

SEQ ID NO: 66362 - DNA, 1835 bp, Oryza sativa
gtgtaacattcataagcacctggagcggatctatagtataatggtcgatgtcgggtgacaccgatgacttttgacaaaatctatagttaaattgcttatccatatatattataacactatgatctaaacataattagtatattatgacacaccagtagatacgttataatactaacgaatcaattttatggattcgccactgataagcactaggttgtaaaccctgagtaatataatagtcatacgatcataacttcaccacaataccacctgtgtttccccgaatattattctatttttaaggctaaatgggcagctgtaggcctatatgtaaataataagattgaaagatatccttccacgttagcaaaaatagattttatttgatcaagatcatgttatcaaaggcaccaatagaatagcagggcacaccacacacatacaagcttcgattggactccagcctggccatcgaatcctgtcaggtcacataatagtacaacacaagctaaagcctcctaacaatataagatcagctaaaaattattgcgcaagcagattatctgagaaaaaagattgtgcacacaggagatgagctaaaacaacatggcaaggagtggagtacatcttgtcaaagaccatcgagatggctgtgtgctggctaagctggcttacaattttcggtgaaaaatatataaacaggagaatctttgagtcaagctggagcgtccgtccctgtcaaactccttaaaggagacaacatctaccccgcatggcctgatacccttcctttccccctaatttaagttaatttaatggggggagttagtgaaggatcagattagaaataatgcatcacgcattgcatgccgcgtagtattttatcactatgcctaacgccacggatcttttttaatatcaattgcggctagctcgatcatctagctagctgtctgcattccttaattagtcgcatcagcaaatatttttctaaagtgtcactgatgtttacagtttggtaaattttcagaaagttgctttctagctctgttcaaatgcttattgctggttccaattagcttggacctcaaacaaggctgaagctctaggcccggccctaagaaaatattaattcctttgcctagctagtcgtacaaaacagaatgtagacgctgaaaaaactagcgatacgtggatgtcaaacaacacttatcacccgctctgctaccagcctaccacaacttgagacatcgcctttcaccttctcgttgagtgtatctacatacacgaaaaaaaatctgggatctgatgggaaccaaaatctcgtgcgagcaagtcaagccattggaaggcaatatagatagtacatgagcggtaggaacccaaacatggggacacactccattgcttcctcgtcctcctcgtatcctagaaattatggaaggaaagttaccaaaagtatttttagataaagtactttcaataatagttttattaggatatatacaatggttattaataggaggatttttaacattgctaattagaaatatttactgacatagaaaagagagaaagagcggagagggaaaaacatcgttgctatggttaacaatggctttcctttcccattttctactctctcatttttcaatcgcatacttccaaaccactaaacggtgtgttttttcaaaaaaaaagtcacttaaaaatcatattaatatatttttaagttaatacttaattaattatgtgcgaacgagtccatccatattttatgcgcgggattagtttcataccctctatgccaaacacaaccttaccctttataaaat

SEQ ID NO: 66363 - DNA, 4705 bp, Oryza sativa
  unsure (1)..(4705): unsure at all n locations
agcgaaaatcaagaacgttgtaaacaacaaaggcatctctccctgcaggctgaagcacatatcgtccattcatgatcgggaaagcttcgaactgaaatatatagtgaaattcttttgttaggttagctgtgcagccatcagcgagatgccgacgctacgcacgtgtggctgcagccatcagacgatgatcgatggagtgagcggaaagcgaggcatcacctcgtaaagatccaggcaagaatctcttcaaatctaacttgcagcaaccagcaagaatcccgccgccacttgggtacagaaagctctcgctagatctcaacgtcaggctgggtgatcgaccggcgtggccaccctgtacacatagcggccgcatttgccaaatgccataggcattcggcagatcagggatccagtttctacttgacttaacttacctaattcttcagccttttttcttttactttctttctgacctactcctccttcctttgtctcgttttctttctgaacatcgccttccgcaattgtttaattgagagggccatggaagctcatggccgtggattggccaggttgcctccctaagtattctgctttagcaaatcatcacaagctaagtattctgctttggcaaatcatcacaagcactagttgatggtttcccagctgcatcaatcaccatcctagctttcttgcactagtgttaaatcacacgagcacttctgtacaatcttggcacttacttatatttttcaattataggaaaaggagaagcagataggaagatagtagtaatttatacttttatagtacaagggatttggagaaattcaaagagtccgctaacttgaaacaaaagaaatttggcgtctcaacgatgtttttagcgacattaggctgacataagagcctttgactaaaactagcctaggttcagcattcagatttgagagttcttgtccaattgtctgcatagctagagataattattctgatccttattgatacttccatgaatgaccagtgccaaagtttgattggtgaaacacctgtcgatcagctgttgatgagcggctaatgatttttttttcaaggaactgattgatcacatgtctgaattggcaaggaatacgtcgttatcaaaagttcagaacacagagatggcaaattggcttggcatgcaggcatggcgtggcacacgtgttcatacgacacacgtacgtaagcatggaaataattttacgatgcaaacgttaatggcatggctaatctgatggattattgtgcttgatctttgattctcttgtcgagcgagccttttgtgaattttgctgagtggagcaggaaacgtggatcggttattttggcgcgggacacatgctgagagtgaaacttacttaccacacacagttgatagtatctttacttctttaaaaaaaactttattaccggtgaatatgtcactcacatactcctataaaagattttacatattgcccccttaaacttcttaacattacataacgtgcttttacaatcaccatctgtccattctaatgtttctttgttgatatatattaaggaaagtaattcaaaaattaaaatatttttagtacattccccatttgggtttgtcggacccgtttcttgtcacaaactgtcacatatttcaaatctaaacacctttcgacccatgccgctatatataatttatactgcaatgtaatattgtccaatctatacaaagtaaattgcggtgcggcgaagattaattattaccccatggcaaaaggttattaaaaaatttatgtgctactctttttcgaataaggaaatttctatgctaatcctaaaatagagccagaagaacctcatgttggctgtcgaaggactatatttacctacatgtataaccacagtggatcctggttattaccatgttaatagaacataaaagaattacctacatgtttaaccagaatggatcatatgcattacagcgataaatatgctacaattgtataagaaatgcaattatatttatcaaaataaattaagagttctgtaagaaatacagatccttgtaattgatgagaaattcgatcaattctattcaaaatgttttttttaagaagaaataagttcatcggacatccctcaacttaacagcgagattttttgagatcccttaaccacaaactagaaatgtgtaccctaaactcatacaaaccgtgcactcaaggtccattggcagtatatatgggtggtttcgctgacgtggcatcctagtcagaaaaaaaaatacatgggacccacatgtcagctgcacatttttttcttctccttctcttctctcttctctcttctcttctcaagcgccggagtgcgtccggagtgtggcgtcgcctcgagcgccacgacaggaggagggaaaggggaagcaaccggcgggagatgggggaggggagaggtgcaacgatgtcacgccccgaactagccccgaacggaactagcccgtgacgctccaaattaacctgttaatcgataccagtcccaggaaacagtgctggtatcacaggaagacagaatatcacagcaacagtggtctctttattacagagtaggagtacagtcatgttgggctgcggacagatcccgagctcacaactgcattacaaaaggaaaagcggaagccaagacttggaccaatcatcacaggcgcgacttgggaactaggccgaaaccctaaaactcatcgtaaccgacttactcctggaagaactcctcgtcagcgggatccacatcatcttcttcagcaacttggggaggggttatttatatagagcaagggtgagtataggagtactcagcaagccatgggaattaagtgtttaatgcaggcttcaaggaaaggctgttgtttttgcaattgcttttatttaaactcctttttgaaacaactaagtgagtgcttctcaaacgacacggatgagacagtgcgtcacgcccggtcggagtatgtgcaatgtatcagtctttgaattgattcaaggttggcacccggccaacaactttcaaacggccacccgggcctggctgatcccatcagccgccgattttccaaacatcgaatccattccacagcagcaatttcacaaagtagtagtcaaacaaaactacgctaggaatcacctcacatccgcccatgaccgtggacacggctgttcgaacagtttaataacttctgcagagggggtgcactttacccacatgacattactaacccggatcatccagcccgtgcagaacggccacgtctagacaccttaaggctttcatgacaaggcatttcgaaagccgacacaggttcaccatatgccaacgagaggggtcccagaccaacaccagattaggtcccagaccaaacgttccaggaaaccctggggttctctccggcaccaccccgttgaatccacatatctcttggcatcatggttcccccaattagnagttactcagccaggggtgtcccattccacccatgtggtcgcacttgtcttatgttcggatgaaattccaaggaaacggtccttaagtgcaagagcgggaaaccatactcccggtacgttctccggtccgcgattttggaaattcatttagttcgcaagcaccgacccannnncgggttttccaagtcttttgtaaaacccaagttttacccatcgttggatattttaaattttgaggggggtgttccgatgcgcgtacccgaaggcccgtgcatcgaagcacaacagttgacaaaagaggtttaagtgttcaataattcaaggagggtaattgcagcaattaggattgggggccggcaggctatctcgcaagccgcggccgaattacttgtgtaaatcctattcatgcaatatttgcggaaaagaaatacttagatttaaattataggtgcaagatgatcaaaggtgacttgccttgctcgagaccttgagcttgatcctcgaaatcctcgcactgcgggtcttcgggctccgaaactacacgcgaaacgggacaactcaacaaatggcgaaaataaagctctattattgacctctaagcatgccattagatagatctcgagatttgaggaattttggaagttgaacggagtcaaacggacttacggttgggaagatattgaatttctaagattattggatttttgatctaaaggaaaaaggatttaattaaacccttttgaaaaataaaagaaagagggaggaggaacggacttcgcgggcggcttgagcgcggcccgagaggggttggcacggcccggccttgccattgggccggccggcctgaagggcggcccaagggggctcacggggaggggaggagagagggagccggtgggccgggtccaccttgcgtggtcccgggtgggactcgcttgtcggcggctcggctcaccgtgagcgaggtgcacgcggtgcgtgctagggtttgggaagggaacgcgcggtgcacgcgcggatcgcggtgggcgcggatgcggcgagcccacgcgcagcctcacggctcgcggtggaccgcgcgcgcaagcggggccgaggggagcggctaaccggggtcggcttgacctggtcgcgcccgaggtggcgccaacgtggcgccttcgtggcagccacgcgggccggcgagaggtagacga

SEQ ID NO: 66364 - DNA, 2330 bp, Oryza sativa
attagcttgttaatcgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccaggacttggaccaatcaacacagacgcgacttgggaactaggccgaaaccctaaaactcatcgtagctggcttgctcctagaagaactcctcatcaacaggatccgcttcatcttctacagcaactgagggggggatatttatatagagcaagggtgagtacgggagtactcagcacgccatgggaattaagtgtttaatgcaggcttcaaggaaaggctgttgtttttgcaattgattttatttgaactcttttctgaaagcaactaagtgagtgcttctcaaacgacacggttgagacagtgcgtctcgtccggtcggagtttgtgcaatgtatcagtctttagaattgatcaagatgggcacccggccaacaactttcaaacggccacccgggccaacaactttcaaacggccacccgggcctagctgatcccgtcagctgctgatttttcaaacatcgaacccctttctacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggcgatcagccacgtcgggagacctccaaactttcatgacaaggcatttccaaagccgacacaggtttaccatatgccgacgagaggggttccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgtggttttggaaattcatttagttcgcaagcaccgacccaggtgtcgggttttccaagtcttttgtaaaacccaagttttacccaagttgtttttcagattttaagtttgaaggcgtccgtcgatactcgcacagggtgcacgaatatcgagacgcatctagatggttacaaggggacatgatataacaattaacaaagggagcatcaatgcaacaaattaggtatgtccgccaaactgccttgcaaacgggacaacagattaagtgcgatcctatcagtgcataatatttttcaagcaacataattaaatttcaaatataggctcaagatgttcaaaggtggcttgccttgctcaagatctggagcttgatcctcgaaatcctcgcactgctggtcttcgggctccgaaactacacgcgaaacggatcaactcaacaaacggcgaaaataaagccctattaatgacctctaagcgtgccattagatagatctcgagatttgaggaattttggaagttgaacggagtcaaacggatttacggttgggaaggtattgaatttctaagattattggatttttggtctaaaggaaaaggatttaattaaatcctttttggaaaagaaaagaaaagaaaagaaaagaaaagagggagggaaaatagacttttctcgggcggctagggcgcggccgaagagaattggggcggtccggccgagctaaatgggccggccggcccaagacggtcgcgcgcgcgggagggaggagagagagccggtggaccgggctcaccgcgcgcggtcccgggtgggacccgcttgtcagcggctcggctcaccgtgcggagggagtatgcggcgcacgcgcgcaggcgggggagggacgcggtgcacgcgcacggtctgcggaggaacggatgcggcgggcccacgcgcagcctcacggctcgcggtggaacgcgcgcacgggaggggctgaccggggtcggcccgtcccgacctcggctgagctggcgccgacgtggcgcctatgtggctgccacgtgggctggcgggaggtagacgacgacgccgaccggaacggatggcggacaacagcggcgagcggcggagcgaaccacggcgataccggcgaaaacgagcacaccgggtggttgcacgagacgaggggagacgagccaacggctcggattcg

SEQ ID NO: 66365 - DNA, 92822 bp, Oryza sativa
agcagctgcagagtgtgagcacgaggtcgaacaggttgcgtgcgggcggagtggcgcctgcgtctgaatgcgtagtgaggagagaggggggtttttattgcgagttccaaatgcaaacgagagttttaacttggagattataaacaactgatgatggggcctcaaacccgtcctatatatgcttcgtgtccccccgttgttgtccccacggtgtcgccgtgtttatttcaggctcgctcgttcatcatatgatttttttaaaaaaaaattccttagttgctggtataagttagaaaaaaaaactgtgtgagataaaaagcagttttatttgttgtatgtatgatgagctttagttggtccagttttagtagttgaggctaggacatcaaattggtactagtttctccaaaatttgtttatttgtcctatgaaacggggtggacgaaactttcttaaatcatgcaacctccatcgtgtagctattggtttccgtgaccaacgtttgatcgtccatcttattttaaaaaaatgattaatatttttattgttattagataataaagcatgaatagtactttatgtgtgactattttttaaaaaaaatttcatatttttttcaaatatgacgaacagtcaaacgttggtcacggaaacctataactgcaattatattggacggaggtagtacgtggtaggttaattagtaacatcgtgtgatctacatcatcttaatctatagcgagtttcttgtttaaggccttgtttagttgcgaaaattttttgggtttggttatcacatcagatataagaacatacatttgaagtattaaacatagtctaataataaaataattacagattccgccagaaaactgcgtggcgaatttattaagtctaattaatccatcattagcaaatatttactgtagcaccacattgtcaaatcatggcgcaattatgcttaaaagatttgtctcgcaatttacacgcaatctgtataattggttttttttcctgtatttaatactgtatgtatgtgtccgaacattcgatgtgagcgtgaaaattttgttttggaaactaaacagggtctaattctcggtatgtaataagttcttatgaaccagaacacaccacatgttgtaattaaggagaaaattccgaggggttttttaggaaaggggaaaaaacgcgtgtaacacctgtgttccactttgatctacaagtaacatgggacatatatcagcatccacatccatttcacctcatatcaatgtagaaggtgatgggacgggcccatgcaaaaggaggaagaggaggactgttcagtcactgacagcttggccctcaagggatgactaatattcatggaaggcagccaaggacaccatgaggggctcctcaatgtattgttcctttcaagtgctcaagaaaccctggtgtcttgctggtgacacacccccaattaaaggcatgtcacaccagcccacaacccccccccccccccttcatgtgtgctgcatcaccccccattttacaactcatctggcttttccatgctgctgcccacattagctcctgttggcttggctctttatcttatctcatcctgcaagggatcacacaaccaaagagattctctatatcaacagctgttggtgtgatacgagccactgacatgtgagaccggacctatctgtcagtgatcactactgcagaggatgtgaaaaatgcaatgcgaacagctgaccattgcaggttctggaacaggttaggatgtgaaaatggcagcccatgcaagtggaaatcaaggcaaggggcatatcagcatatggcagtggtattggccagtgggcagtagtagtatggcattgggattggagcacatggatttggccaggggatgtgtggctgcacccaaggtctggcttttggaaggccctgctgtctcttggaagcaaaaaaaatttgtgcttgccttgcatgcagccatgctgggcttgctcccttggatgtatgtggcaagtgaaccccatctacgcataattgcattggattttcccttcattggattccagatgcatgttgttattgtttttgttggtattctcttttgtgagcaaccattcactgtttcgcttttagttccttttctccttctagagtgtacttaccactactagtttattactccctccaaagtttgtcgttaggataaaaaaattgtaggtaaaatgtatggttaatttggttgtccaaaatgtatagcatgtataatgactagagatgacaactactccgtccgtcctaaaatatataagaatttttagacggaaggactatatcctaaattcgtagtattaaaatatattttatccgtaaaaaaattattatattttagaatggatggagtaattactgccacactaactacgagctccatcgcttcacctgccactgattataaactgtaacacttaatactgactaaaaaataaaaaataatatgtgaatagatcttttatatatattcttagcgacttagaaacaatgaaaaaaaactacgataaaaaatatcaaaaataactttaaaattaagttttagaatttaaattttagtcacgactagtaagctgaagagcaaatgaaaaagctaacggtgtttccatgtcagagttgtgcgtacatccaaaagagttcaaattctgatatccacgaatcagcgttcccgccctcacgcgccggcccacacgaacttgtgtaggtagaaagcatgtgtcttcgtatcgtaagagtggatacctatacgtacactcaacccgtcaacggccttcgttttccacgggggagatcgatcaatgcatgcatattgtcgatcgatcgatcgaagcgccgccgcgcggcgcgcgtcgtcccattgcctggccctgatgcggtgaacgcgcacgcgctccggacatcggcccgcgacgcgccctccgtgttctgatgcgtcctccaccgcgcatgtgcctgccgccatgtgcgcgcgcatgcttcgtgtccgctgcacagagcgtggccgcgtcgcggcgacgatggtttgcacggtccaatgcccgggcgacagccatggcgcgagcgcgacccccggcttgctgggagggcggcaataatccatttcaactattggatccaagcgttcggttccagctgccgggacacgtagtgcactctcctcgttatctcctggtgtgtcttcttcccctcctcatcactgtggccatactacatgctactactcaattgtgtatgtagccaatcggttggagtacagactacgacagagaacggtgctctgcttcccattattttctttcaagagctaggacagtacaaaggagtacagtaggagtatgcaccccccatactactctacattcgaattcgagatggcgaccacaaccttgttttggttgcaaaaatcattcggggatgcatgcttatattagtgttgccacgtttttctccactgaaatgaaaggctcaatagatccgtgcttcaacggataaaaaatcgatcttcatatctacaagtagatatacacgatcaaaatatatacttcatttgttttcaaatagctaacactgggcacaaattttaaaactgacaactcagtctttttgttacaaaaggaattacaaatacttaaaggaataacagatcatagtatattgtatgtcttaaatataagcattatggagttagtactatcactgtgacttcagagttttttttttttttatagaactgacttcagagttgacatgagaaaaacctgacatcgtccggcgacgatggcatcaggcaatatcggcacacggcaggtttgattcgctcatcagatttcggtgcgtaccaatctgtaccatgcatacgcgttagctaggtttgcggcgtttttactcatcatcgcggtagctagctgcatatgatgcatctttggccatatctgaggtgaacagtggggatgaagctgtaccaaagcaccatgatctggctgcataaaacacatttgaatctctacactgtagtcttccgtgaggcaattaattaggtgctggagaataacgcataattaatcaaggaatgaaaaatggtgagaaaaatggcacatgtattgctggtacatcgttggcacttggcagttaggcttaagactgagttcttttcatcaacttcaaacgataacttctttgtttttcgttagcatgttttcgaacctattaaacgcataattaataaaggactgaaaaatggtgagaaacaatgttattgttactggtactagtacatcgtttgcagtggcctgtcgagtcaatttcttttgaggcaaccaagacgaaagcatcagctaaccgagtgaaaaataggcccaagacgagcacgctgaggcctatctcaaagttggtccggccgagcaagcccactgcaactctagaaatacgggccacataactaacttgcaaattttgggctgaatactgggcttccaagaggcggaatcctatttgggccggatatctgcgaacgctaaatgggccgccaaaagagccctctactattcaatgggcgggcccacgaagaaaaggttgggcccactacggaacggaagcctagggccagccggcagccgtcggatcaagatggacggcttctgtgcctcgaccagccctctcgccctcgtcgccggctgcctccgccgccgcacgccgccgccgccacctcatcgctggcccgcgccgcgccgccgcctgatgggattccgcgcgtctatatcccacgtccctcttgctgcttctcttccactcgcctccgtcgcggtgagcgagcgagcgcgagcggcgatggaggagacgaggaggaggggtggtcgaatgtgagaggcgaatccacgtcttgccgctgagaaggcggcgggagggagcaacgtcgtgagacccaccacgcggtcgctgacgggtgggcccaaccacccggccgccgccactcccgcgcccttatcatctatctgcctcgtcttctccgccccctcaagctgttcgacggaatggcgcagtgggacgcgctcgtggacgccgcgctggcgaggctggcgtccaggagcctcctgcgcgccacgcgccccatcgccctcgcgccgccgcccgcgccgccggagaccttcccctgcccaggcccgtgggaccgcgcagccgtcgagatccggctcgaccgcgcaacgctccaccaatggctggctgaaggtccaacctttttttatcatctgctttgcttccatgcatatcaaattttcatttttttattattatttcttccatgtaataactgcctttgagataagcctaaacaacatgttctagtttctttcaatatcatttttaatgggaaaggtgttatcaacaattctagttgttatcaatatagtttcgttttgcagaaactctaccaacttctcatgtatcgttttacttgattaggtggtgaggggagtggccaagaagagaaagtggacgagaaactgattcttttctccgggaatgattacatgggcctcagctcgcatcctgcaattcgccatgccgcagtgaaggtgctcctttcttgcacccatggctattgtttggtgcggaatttttttgacactctaggatttgcaccatgtttcattgaggggcaaatcctagactggcgcatgatcgatttttccttgtttgatctatggagtggactgaatcaatgcttcggtggttaactttgccaacattctggtgtatctactaggcagctgaagagtacggcatgggccctagaggatctgcgttgatttgtggatatactacctatcacaaaatggtggaggaatcgttggcagagctgaagaaaaaggaggtactgttgcgttcaaaatttaagcaaccacatgtgcccggtatacaaaataaaataaaaaacttgcagccttactagagtccttctacaggattgccttctttgtcccactggattttctgccaatatggctgtaatgacggctctgggaaacatcagctctctgttggctgctgggagaaaacctgcggaggacgaaagaatagcaattttctcagatgctctgaaccatgcttcgatcattgatgggattcgccttgttgagcgacagcaagaagtggtatcatttgtgtacaagcactgtgacatgtcccatcttgaacttttgctgtatgtttttcactttccagtcataactcataacatacaaaatgctaagcactaatttacttagttataaaccatgtttgtgattacacatgcagatccagttgctcaatggaaaagaaagttgttgtcacagataggcaagttatacatccaagtaaatttcatcatttaagaagcatttattctctgtattagtgagtagtgtaccgaactcagaagctcttttgattggtaaaatgcagcctgttcagcatggatggtgattttgctccattgcctgagcttgtcaagttgcgcagaaagtatgggtttttgttggtgatcgacgatgttagtatattatcttccctgaaatacagtatttttctggcctaatattaatcaagttatgttgcaaatttccttttcaaggcacatggaacacttgtttgtggtgagaatggtggtggtgcacctgagctgtttgaatgtgagaatgagattgacataagtgttggcaccttaagcaaggctgctggctgccagggtggttttatagcatgcaggtattctattctaaggcatgtccatattatctggcaaggaagaactgctcatagtgcatattaaactgtggaaatgaatcatagatgccttgaaataaaggacttcataaaatacctgagacaaaacctacttgataatatgtaaacagtagcggcatgctcatcacggccaacaggaaatgttagaacaaatgcttggatgacttcaaacattttccatatctgttgctgtcctgagtaacttatgggcatcggcgattatagtttaggaattacgctaagtgcttaacttttgatgttaatagatgctctggacaccacataatattatttatcagggtcttggttatgaaatttgcacttcagagcctcatgcttataaactcaataaatagaagttctcttgaattagcctctcttgataatacttcatgccataatctctgcattttggatgcatgccataatctgtctttacaatttccaatcttatgacgaataataatttgaaatttgtttgcagtacccgatggaagaggctgattcaatcgcgaggtcgttccttcatattttcaactgctttaccagtgccagtagttgcttctgtgtatggtaatactctacacattgtgttctaataatttaaaatattgatatgggaatctggtattgattgctacatatacctgtttgtgttacactgttttcacgaggaagggcatagaaaaccttctctatcacattaatccatagaaggacgaatttaaataaaacattaactaacgtaaaaattatctcattgtcaaagtaaatatcaggaattcttctaaacagaatcaattaatttcagctgccctctatgtatcaagggaggagagatggcggagatcagtgatctggaggcatgtgcagtattttgcctctttgacaaaactcaacataacaagtcccataatttccattgtagttggaagtgaaaaagcagcacttagagctggaaggttctcacttcctcccatttttgtttcttgataatatcagtagttgtgtgttctaatcttttcattttgaaactgcagggatatgctaagatctggatttcatgtcacgccaatccgaccacccacagtaccgcccaactcatgcaggttgaaaattttctgttcctagcattttccatcctaatctctattcatagacttcagcaacctaaagcatcagtgttcctagggaccatagactgtaattggattaggaaccagggtatatatgcatttttattaatgtgttttcttggtctttgctactgctctccaaagatggaatccctgctagactttttttttgaactgcttgctataatttgttgtccagatattagatggtcctagtgttcatcgacataaggtcgggcctgtttcaaccaagattaactgttttatttctttccatgaattctttgcaggttgcgaataactctcagtgcttctcattcttcggatgacatcaaaaggctggtggatgcgctgacgccgtggctccctcacaaacatgatattcagatatatgctgtggcatcaaagctctaaacaatgattcatccgagtgttcagctcatcaagcttcaagaagtaacattagctgagatcccaccggatgatatgggagaaaaggggataagttagtgctggttgacgcgattaatactgggatatctttgtattacagcacaatcaatatgaatatgaaacataactgatgaaacagtactacatcttttgccctctctaatttgactttacttaaacataaagcatcacataattagctaggtaacaacatgaatgcatagcatccactctttactgcaaatacagaaacgtatgcacaaactacaaatatcgacaaattgagagagaggggccacgctttatgcaaggaacaacatttatacaaactctaagtgatcagcagattaagagcaaacaaataaagctaaattattatggtgtattggaacaagcgtgctaaaaataatatgttatactatatatataactctctcttaatatgatgtaaacacaattagaggtgcagtaaaaatggcagcatctgctcccctgtgttattgaatattcggcttaactagttgatggatcaactcgtgcatgaaatgtctttgcaacaaatgcagcttaatctgattctccatcattccacatgcagcttactgtacaagtatttttacagtcattaagaagataacgggatgtaccatattttttaagttgatacttatctgttggtacctctcaaagacactaaaatttctattaaccaaagaagtgcaagctatgcagaaagcagaggaggtaagaataagatagtgaaacactcatccttgcatttctttctgatgcaatatgaatcttcagaaatatatatagtactccttctactagctagctagtatagttatcttgtcaccgacaccatagaatatgaatcatcagaattatatatagtgaaagccaaggagtaagttcggagaattagagactacaacttttcactaatatcaatacagtatacaggcaactacagaatgtagggcctgttcactttaatgctatttttaaccataccattttttttgataaagttacccaaaaaatatccacgtttagtttgttgccaaatttagtcaatacataaaaaatcctgccaaaattttagcaatattgtcatcttgtcaaaattttagtattgacaaaacttggtaaggtttattttagctacaatctgttcatattctacggaacactcaaaatagcatagtagatgatttactaatgggcaaaaggcgatttgaaatagcatatatacaaatgaaaacaacagcgtttaggaagggtatacagtagtacttaagaagttgagagttcatgatctcaacagaattgaagaaataaataatcacgaaatagatgtgtatttatgtgtgaagagagaaaaaccgatcaatatacaacctgatgtatgcttaattgactagagggatatgactaattagttctacactagtaatatcgtgcgcgtgcaatatacattcttcacaaatatatataatgaaaattaaacatacatttccagctcgaccgaagtgtcctgcaataaaaatacggatttgctataaatgtgccatcatgtttttcatgaaaaaatagttagcatgtatttacattgtaagtccctaaattacatatgtaagtccctaaattacatatataattacattagatttgtaatataattgcatttgacatatttttacctatgtcgtcatatttttagattgaccctaaaaatataactaatatccacattttacatgatttggattagtcatttagtatgacaattgataaaacctatccttattcaaaatataatctaaaaggttcaacatatgaagttgaagctgatatattggtggtaaaaactagtagaacctatccttgtgaaagaaggcacctgaaaacttactggatatataaaaaaaaaggtgaatagctaattaagtccctcaagtttcactgaaggctcaatttgatccttcacgttttattttgttcacatagctcctctaaatatttgttttggtttgacatcatccttgggccaacttaatatgccatatggctatttttagtcaatatttctattagaaaatgtcccttttgcccttaatttatatacaactatatactaaaagggagaaaatcaagatgaataaacaacattgcagatatacttccaattatttcaacatgtgcacatgaaacttaagcaattactattgtatacagcttgctagtacataatttattttcgttttacataatttactatacattatcttaaaaaaatcaagcatacaatttttctcttatatatgtgaatgatgagggtataagtgtcatttatcaagagagttattggttcaaggataaatttgaactaaaatgaaaacttgaaggactaatatggatagattgaaacatcaaggactaaactgaggcttagatgaaacttggaggactacttgagctattcaccctaaaaaaaatagtggtaaccatatttgcacccaacacctcccacggagagctaacgagattgaaataatattgaagaaaatccttaccttcagacaatttgttagcattggagttatcaggatccatggagtcctccaatggaatcctagacttgtctgtttcgtttatgtgaaggaatattaattaatgtatgtctggatttctagttagagaagcaaattgtttggcaatgctacagcaacctacagaagatgatttaaagatgcttctgtctaaccagaaatcaaagatagcaagtagataatatttcatatgctctatcttagcctgaatatagggctggaagaggctcccttcttttctgaacagaatgcacaattattctactcttcgtgaaacaaaaaccaaacattattatcagaatctttggagaggaatagatgtcaaccctaaaaatttagtcaattttcagactattttgtatattaaatctccgtccaagaatcaagccagtatacatagaatgacaattaattaatatgtaaattcaaacaaaaataaaacgtaaatacttacagaagaggcaccacatagaataacacagtagcagaaggtcaatcctagcgtgactttagctccactgcacaaacaaacttaattgggatataagccttggcttcttcactctaactcaactctgtaatttgactttcctgattgccaaccagaacaaacaataaagtagcagtgcagcacataattaactaggtaacaacatgcatgtatatagcatccactgttcattgcaaaattaccaaaaacgtatgcacaagctacaaacatcgatagactgatgatgaaagacacacatttattccatgagagacaagctagcaaaacatgcaattaagctctgtccaaagctctagatagggtagtatgcttggacatgcatgcctaacacacaaacatcaacagatcatacatggatcaacacttgtctctctctgagctagtatagctaaacacatacttaattaattcatgtgattatatatgataatatagctctggctgcagcttgatgatactatatcagcgtaagtgtatagcattcatgcatatgtagtagtagtattcagttcagttcagttcagttcagttgggcttggagcttggcacgtagatcctggcccagaggtgcctccccttgatcatgtacttcgccgtctgctgtccgtcgagcaccaccgggatcatcgacgggcaccggagcaccacccgtccgtacaccggcagctgccccgccgccgccttctccaccatcaccgactccacgcacggcccgtacaacctatgttgaagaagaaggtgttgttggtatgatcattcatggcgagagatcgatcgagaagaaggtgtttgatctgggtttggtttggtttacgagttgaagaagttgatgatgtcgtcctgtctgatcgggtagccgcgggagaaggtgatgaacagcgagcggtagtcctccggcaatgggatgtagccgtgctgctggtgcggctgcggcggcggcggcggcggctgctcctgctgctgcaccgggaaccatggcgaggccatcgggttcagctcggccaccggcggcggcggcggcagcatcggggccatgtggacggcgtggtggtggtactggtggtacatcggcggcggcggcggtggtggtggtgtgccgtcgagcgcgtcgagcacgtcgcgggggaggaacgcggcggcttcggcgtcgtcgtcgtcgtcggcggcggcgacggcggcggcgacgccgtcgtcgaagatgacgcggcagacgttcctgtacacgtcgctgacgccctccatgacctcgtcgcggtgcgcgtcgaagtaggcgaggccctcgacgggctcggcgaggagcgcgttggtgcaggggaggaagcggagcgccgggtcggcgtccccggcggcggcgagcgccgcgagccgccgctccgccccgcccgcgacccctcgccgccgcggcagccgcgccaggcacgccagcgcctcgtctacgaagcgcagcacgacgggggccggcagcacggcgacgcggcggacgaagtcgtggtggccgacggactcgagccacagccacagcgcgatcacccacctcatcggccccggctgctgcccgtgctcgccgaccagccgccagaacagctcccgctccatcgtgtggaacatcatcagcgcaaccgccccgctgctcgccattgccgccgcccacctcgatctcgatctcgatcgaaacgctcgctgcagctggcgatcgatcgatcgatggcgctgttaaatagctggccggattggcagctggtggctcgccggggaagcatgaggccaaggcggttgttgctgcagctacgagacaaatcaaatcaacggggagtggacacacgtcactgcacctagccgtgctcccgctccggcgagctcacgtgggaagcacgcatgcatgcatgcatggccaaaccgccaaagcacacaaaagctagttcttccacctctgcacacaaagctctgaacatcgatcatcatgcgtgatcgttcgagcttagcttaagctatcttttcaacagcatgatttggagatacatgagttaggtagaaaaagttttagaaaaacttacgaacttggataatcaatatgagctggctcgagatggaagaggctcctctaacgtaaagtcagagggacataagtcgtctctgacacgtgaggctcaccccaatagacccacacgtcagagagatatatgtccctatggtgtacgtgagaggagcttcgttggctcgagatatatctggcgtggcaacgggattacggattgttgatcatgtgtagctctgctccaaaacttttgatccaagtgattcaccagttagtaaatgttgtttgctactacccttggggatgtgtaaagctaggtggatcaatccaaacatgacataataaggacatggttatatgaatttaagttcaaaagttatgggcagctagcataacaaacctttaaaaagatcttagaaagactttttttttacgattacacgaaagacacacacgcacactacaatcaccacccgtaagtgcgtcccctaacacacgctatctaaagagacaatttgattacaccaggaagctaacagatccttgtcaaaaatgctaggagttgggaatattctatctccatatcattaagttgattattgtggtgatcattaagctatatctacttgtatatctggcgtggcaacgagatggatcatgtgtgcttgctccatggctttcaatccaagtgattcagttcgttaatgctgtctgctaccacctttggggatgtgtaaaggtagattatatcaatccaaacatgacttaacaagaccatggttcataatagtttcagttctgaagttatgacttatcagcagctagcacgagaaacctttgaaaaaggatcctagctagaaagacactttgattacacatttacacctgggagttaactgatccttttgtcgataatatatgatctggctctgcctcgaaattaacttgattgtggtgattagatagagtaaaggtgaactcactcaaatgatgatggcgaatctcctgacagaagtactgaactagtcaaccaggccagcatggatggattgttggtgaccagttgtctccaatgcatttgagagtgaggaacatgtttctgacaagggaaggggaaaaaacagtgatgagaataatcccatattgggaattgctacaacattaccaaataaagaattgaaagaaaataaactttaaaagatctaataattgccttcgcccccaaatgatagaaaaaaaaataggccgttggatggagatccgatgatccagatacatttaatcttgtaacaaccctaattactagtccacctcaattgttttttgttgccaccaccatcgatcccctacctcgccgccgccagcagcaacaagtccgttcttccccgggcacctccctctcttactatcgaacaccttcttctacttctctctgaacatcctctccaacaacgttgttttaccttttctcttgttgtattgcctttagatcaaccgctgtcgtagcatcaatcacctcgtaatcacaaagacttcctccgcctcctccctgtttctcccctcactcacccacaacctcatcttgtagagccttactctagccaacttcgccacctccaccaccgtatagcgagaaagccatgataatttgggttccgtggtgtatatatggcggagaggctgcctaaaattcacaaatgaggataagagcaatggacgaaagcaggaaaggcagccagccttttgcccttttataagcaatgacggtttgtaccgacctaatcgtatttctaaatgggcctaaacatatatttgggtctaaaatagtcgctcccgtctatcacattaaggctttatttggatgggtcgacatttctatggaccacatttatgggctgaagttttattgaatttgtcgccctgtacacaacacaatagaaaaaacttgggtttactcatattgtagccacctttcctttaaaaatgttctttatgaattttcaaaagtatttcgttttctatttattctgatgaaatttataccaaatataaagttacaacccactaaatctaaaactcgacatgcaatcatgccacaatcaattattacatatcaaagctcatgtaagcatgaacatcatctacaatctactgaattctacaaattaacaagcaagcatatcttatcatcaccactcatatcatttccacaatatttcaaagtatctatttatcatttttataatacttaaaacatatatctatcaatatattcagcatcaaagcacaatatcatttgtttgtttcatgattagtatcgtaaactctgacgtttcattattttttgcattctgcttcttgcaatacaaatcttgatcaacaatctaatattttatctattgaatttatttctctccaaatatatattagtaaaccagtttaatttgttgttaataactaatatcctttttactcctaactcgattgttgaaaaaatatattgaagattgcttcgtaattcccacagcaaagcgcgtgtggaaacacataattaaacaaaaagttgtatccacttgagccgtaggctacaacagacagatagtaaagtctctacatcaaagagcgtctaaaggtatgcatggtccatactcattttatttcaaattgtttatcattctagtaaattttatagcaaataaagagctatggcaaattacattattccccttatttatcagagtacattccaatcatttttcaaagtagtcattaactctgattactaattgtggctgcatatatagggtagggagggaagatcacatttaaagccttgggacatgagagtgactattttagttaaaaaaaatgaattgctaataatatgaaatggagggagtaattgaatatgccttttgggctgccatctgcccattgggctgtgaccatccggtttgagcccattttactgacctgtctccctgggctttgttgcgcgagcacgagccatggccgacgtgggtgggagagctcgagctccgaagatggcaacaatggcggccggcgtcgcactgcacctgcacctacaaggtgacgcggccggccgccggataagcggcgaagctgcccaagttcttctccttgggctgcttctgcttctactggtgagttcagagttcagactccaacttgggtcagatctcgtttccatgactcccatgtacccatgtattctgaatttctgatcctagctcaaaattgtttttttctctttttgtcatttcctgttttgatgaaacatgcgcatcattcaagtattataaatttataattggtgccagccgcaaatttgcggaggttggtacgaataggattgtttttttgtcctcatgtatttgtacttttgtagtcctgttgaatccactagagactgctgcttattgctgaactgccacatattgctgctaggaactcacaaattttcaggagttctactcgataaacttatcagcacattgcacatccagctttgcctctgagtgcttccagggatgaaggtgaaggcaattagagtccacaagattggtggtccagaggtaagtgtgtgttctataccaagaagaaaactccatctaatttccttttccttataattcatctcctgcaaatctaatccatttgggagtaagcagttcttcttctgatgtccaaaggtgctaacttgggaagaggtggagattggggagcccagcgagggggagatccggatcaagaacaaggctatcggtgtcaactatgtcgatatttattaccgtactgggttgcatcaagaacctctcccgtttgttcctggtacggattttagtattttaccatcatcaatgacagtgatgtgctgaatgttttcagatctggtgtatggggattctgataacaaaattccaacttactttgttaaatctaatgtcagttcatggcccggagaaaattcttggttgccatctgagcttatagagtatactggtaggctaaggaaaaattataggacatgttcatattgtagccaaaataaaccttaccaaaccaaaattttggcaatttggcaatattgtcaagttttggcaggatttcttatttatttaccagagtttggtaagaaactaaatggatgcgcatatttgacaactttaccaaaaaaaatagtatggtttaaaatggcatcaatctgaacaagcccttactctagcacttttcagtcttctatcactgttcactaactaggcaagtgagcagtgatataggacttttgaaccttgtaatttctatgtaggatttctcaaatcactacagccaatcaccatttgcatacgaagaatcagactcagtgttatgcttgaagagtcttcccctgaataaagttctttggtgttttttgtactagccaagcaccgaattatcacaagaagtgcagtttgtgacttctagaaaaattgaaaacacacaaaagaaactgtttaactaatgagtattcaatcgaatttatcagaaattatttaatggtatgccgaaaaggcaagatcgcactatccatttgcaaatgaacagtcaaacttgtcgaaaatgtgaatgatcttattcttggagcattgactttgtgttcatccaggcaaggaagcagtaggagtagtgtctgctgttggacctggggtaacaggtatcgaagttggcgatgtagtcggctatgctgatactccaatgggcacttacactgaagaacagattataccggcaacactggccattcctattccaccttcagtggaccacattactgcagcatctgttttactcaagggaatgactacatatgtccttgtgaaacaagcctttaaggtgattgttttgtgctaagctgattcagtagttcagtaccaacttccatgatttcagagacacaaaacaaaagaaaacaaaacagaaactgattttgatttcagaatgcaacttagaaacacctccatgttggtctcttgtgcagattcaggcaggccatactgtcctagtccatgctgctgcaggaggagttggctctctcctttgtcagtgggcgaatgcccttggtgccaccgttatcgggaccgtttcgacacaagagaaagcaatccaagcagccgaagacgggtgccatcatgtgatcatctacaccgaggaggatttcgtagcccaagttgctgaaatcacatcgaggaagggtgttcatgttgtttatgatgctgtcggtaaagacaccttcaaggtagcaaaaccatcctactctcattttgcaacaccttacaatcactttcaccttctttgatcttgacaaaaagcattgccatgaaaattggaattaaatgttgaatcataggcttgacatgaggtaaatcagctgcctgaaactgaatatttttttgtctgaaactctgaatgtgaagggatcaatggagtgtctgatgccgcgtggatgcatgatctcttatgggcaatgttcagggaggcctgaccctgtaccagtgagtgatctggcgtccaagtccctgatcttgggcaggccagggatgaggcactacaccgccacccgcgacgagctgctgcacgccgccggcgaggtcttcgccggcgtggcggctggcgttctgcgcgtccgcgtcaaccatgtctacccgctgcatgaggcggctcgcgcgcacgcggatctcgaggcacggagaacctctggatctgtggtgttgttgcctgccatgccagcagctgacagctgatgagagtatcctgtggcattgatgttgttagaataggtgtcgaatatactagttctatttggttacagttggacttggaattgtaataggtgttagggggtggagttagagtcaaactctgtaacccggcatctctcttaaatagagcggggggcaccacaatgtaaccatggcgactacaatgtagcgtagacacgcagggagatgatggcggcgtggccatggactcgtagcggctaggagctatattggttggggaggagcgcccataatcagagccccggggatgtaggtttcggctgaacctcgttaacaaatatcgtgtgttcctgtgtcgtcatctggcatgtcttgggtgatcaatgattgaagcgatcgggaaggttagttatcgttccgctatatcggctaacttttataacaagtggtatcagagcccaaggtttggaacctggaacaatttccatgggtcacatggtggagaggccaggtaacaagtcttcggggtcacatgggttggtgtgacgggggagattgttaggcctgaggccaggtaacaagtctttggggtcacatgggttgatgtgatgggggagattgttgggcccgatgtgtgatggaggagattgttgggtttagtcctacatcggtaattgatggtgggggagcacgacttaaaaggtgggggcggtcctcacccatcagactagtcttttgggttgtgtaggcctaggacctaaaagttgtggctccggttggacctgtggtggagcaggcccaatgtgacctgggtggcctacggttggtgggccgggctgcgcactccaacaagtggtagactaacctttataacaagtggtgagaacaatttccatgggtcacatggtaacaaagtggtatcagagcccaaggtttggatcccggaacaatttccatgggtcacatggtggacaggccaggtaacaagtattcggggtcacatgggttgatgtgatgggggagattgttgggcctgaggccaggtaacaagtcttcggggtcacatgggttgatgtgacgggggagattgtgacttaaaaggtgggggcggtcctcacccatcagactagtcttttgggttgtgtaggcccaggacctaaaatttgtggctccggtgagcctgtggtggagcagacccaatatgacctgggtggcccatggttggtgggccgggctgcgcactctaacagatgttcttgtgtaaactttgtcaaaagaaaaaagagaacacttttgttcagtgatgctaaatgtgatctagagtaaaaaattcatggatcatccagcctcatcgtttggtcgatggctgaagcttcataagctgtagaaaaatgaacggagaaatgaaatataatttataaataaaaacttatatatttgtgttttagtgaattaaaagtcaatgctagaaaataaaatactgtgatagaacatcaaaatcaactttaaaattaagtttttaaaatctaaatgttagttgcgactaataagtacaggcaaacgagatggaggtgatcatcattctgataaacctcatgctggcatgtcatttcaagcggtgaacttgaaagatttaacagtttagccaaggctgatggtactgtcagtccgacaacaagagcaatatatagcttcgctgcctttgtttaaacatgatccacaatttgcgtctgcatctgcttcactgctcagtgaagtgattggacatgatctcaatttctcccaaacaaagacatggatttgcaaaccacaaacaggaagtttggcgaatagatcaaagtgagctatttgattcgagcaattcttctacaggctatcactgtcatcagggcaaaaactgtgaggatgaaggatacattacataccaaaaaataaataaatgtatccaaacttacaaaactgaatgattaaggcacacgttatacctttctactcaaataaaaaaaacaaaaaaaacgtgggctttcagcattatatactcatgcagtcatgcatgcactggggatggaagatctcaaggattcagcttctgttgtgtaacggctctcatattgctatctacagtcgacgagtcaagtaacggtggttagttttttcaggcagtttgctcgaaggatgtgtgcagttctcctacaattggcagacattgttcttcctcattgtttctatgcttcctgctatggttgatccagcagtccccacaaatcctagtgatgcacagctacagacagattcttcaacatataacaaaatttctggtagttgaactggatcacaatccttcctcgtgtttgctatgtttttgggaataaatccagatctcacaccatgttcagcagccataagccgctctgcggtctgtgccaccagttcatcactttccttcagggtgtgcaatttatatctcccatcttttgcaatatctgcaagataggtctttgaccagtttgctggtggaagatcagtcatcatgaacatgtgaataggaccactaccctgggttttcttcatttccaacgcaacagcctttaacttctccttgagtgcagaaaatgtagctttccagtgatttttgaattgcccatctaacagccttagctgtgcgcaaagaaatggctccttgatctttttcctagcgaactccttccctgtagcaatgatctcaggggcaaaagggaggaactcaaccttctcaagtatagtctgtagccgacgatcctttggcgattcgtggatatcaaaatatgactctgatcccttgtatggtcctgagaaaagtgtcccaaatgccaacaaggaagcatcctcagcttcagaaccaggccccaaagccttgtacatatctttgcgcctcctaacgtatgatatctttttcctctttttcaagtcttcatctggttgaaatgaatcaagcgccccatcattattctcttgatatgtccagactgttgttcggcaatcgtcctggacaggatacacacagccattttcgctgccccctaaaccggacagcatcgatcggcatctatcgtaatcacctggcagcgatccaccaccagagacagcacagcacaagccagagaagcaagtcttgcgcatgtctacgccgcaccacaatgagacaaacaccctgaaatcaatcgttctaaccgtagcctttatcggcgatagatcaattatgtcacccatggatacatacctgcaagttaaacagatgaaaatagcaataaatatttggctttgtgtcgaatttaccaaatgaacatggtaatctatggtggaaaccgtgaaatttggaaattgcattactgtaacattaacaagcaaagagagtaatctaggattaaccaaccccactttgggggagtgagatttttacctccgctcccggaggagctgcatggagtggtcccagacggcggcgcggaggtcggaagcgtcggcgaccctgaacttggggcagctcccgaggacgacggcgtggtggtcgagcaccgggggcacgacgagggtgcggttgagcagcgcggcggcgacggcggcattccggagctcgcccacctggttgctgaacccgctgtgcggcgcgtaccaaagaaacctctccccttccagctccggcgaccgcccacatcttctgccccctcctccgccaccgcctccgaagccggagaaggggaggatggagcggagcagcgaggagtaggccgaggagaggaggagggaggccgggatgaggagcacgaggacggccacgaggaggggcgcgtgcgaccgggcgctccgcttccgccaccgcccgcggctcgccggcaaatccatctcgccgccgccgccgccgacgccggcgaatcggatcggatcggtaagcaaagccgctcctccccatggcccacctgccagatatcacgcacactcccacgtgggcccaatatgtcagcccgctagttcaggatgggccacattaagctggcacccacctgtctgtccagagtcaacagcatgggccatgttaacttgggctttatcacgtgcagcagcaacacaaaggacaaaaaaagaagaagcccataacctacggagccaccgacatgtggggcccacttaaaacaagatattatcgcgctctcatgtgggcctaacctgtcagtcagcatgggccaccccgcccatctagacttacgtactctaagttgggcttgttaggcatgtgcagcccagaacgtaccccggggggtgggtcgctgacaggtggggcccggagaactgccgaaggcgtcagggtccagaagctcgtgacgcgtgcggcggcttgcccatgtcggcatccgccaacccctcctcgccttcttcttctccagtaataaatccacgcaaaagcctcgccgcgcaccaccacccagctctctccactccactctcgcgttcttgtggagtcgtgctccactccgggaaggaaggagtgggtgggtaggtgagtggagttggtcgatggcgattggggcgttcgtggagagcggcggcggcggcggcgggggagggggaggagggtacggcgggcgggtgacggcgtacgtggtgctgacctgcgtcgtcgccggcagcggcgggatcctcttcggctacgacctcggcatctccggttcgtgccgccgccgccgcctcgcgcggttgattacttcctcgctgtagtaaatctatctcatctgttcatctcgtctactgcttgtgagttgtgactgtgtcgtgtgctggctcgtggttgggcctgtctgcatctgcatgggccggtgttaatggctggctcgggcccagtctacgtacaagaaaaggtttgcaagcttttttgtcatgaggaattaagaagctgcatttccagctcaaaagatctcatcttccagcagtaatgcagcttctcatcaatgttgccaacactttactctttgtattccttttttttttttgtgtgtgtgtgtgtgtgtgtgtgagatggaagacgaggcttcttgttttgtgtggagagtatagataaagataagtaatgtagtttggatgatcacgcaaacattgttcaagttctcctgcttaatctgtccactgatgttgtgacttaactaccactagtacggaggaaagatcatgctgaaagctcatgtactcgatcgtgtatgaattgtggcaggtggtgtgacctcaatggactcgtttctgaagagattcttcccggatgtgtaccagaagaagcaggacaccagagtgagccactactgcgcgttcgacagcgagctcctcaccgtgttcacctcgtcactctacatcgccggcctcgtcgcgaccctcttcgcgtcgtccgtcacaaggaggtatggccgccggacgtccatgctgatcggcggcaccgtcttcatcgccggctcggtgttcggcggcgccgccgtcaatgtgttcatgctgctcatcaaccggatcctactgggaataggtctcgggttcactaatcaggtataattctcagcacatttgatttcaggtcagtaatctctgaatgaatgtgaatctagttcaagagatagtgcagagatatctgtcacacatttttagagtgcctgttatattaaagaaaataaggaactctgttaaactattgcacaattcagataaaaaaaaaacttgtactccgtatgtggcatggtactccttatgttgttttagaagtcactagtacatcaagttcatgccatcatgcacatcgtgatgctatctagagttctagacaatgtatcaaaatcataaatcttgcatgctgaacctaacaccacacacttgaaaacgaaatgcaggccatgcgtgtcgtgtgcacaaaagtcaagtcttcattgacttgggtttagagggtatagacagcgggtttatgtggatgtactttgttccaagttgataacactcgacaagaagtggagcactgacaaactacatggttgtctttataatattaaggtcttgtttgtgtatagatcattgcattgacttgacaagtcatattttcgtttttgtggccataacgagtgagtgggtcattaaaaagttaagaagtttttacagcctgttgaatctctgttttggagagggacagtgttgaaatattgtgtggagatacaacgcagagggaaagcaacaaactatgtcgtggtctaaaaacttggcgatttactgcctagataggaattagaatggcttatgagaaaaacagtgactgttcactgatccaatctcacactgtgcaagacaagggagatccggagataaagcccaatcttgcaatcaagattttcagataacatagaaaagggattccactttgtaactaaacttcattatgcacataattttccttctgatgcatactcctaatcctagactctaatttttgcatttgttctttcttaacaatagtttcctccttcccaaaggacagtggtaactgtactgacgcctttgctatgaaactatattttgcagtcaatcccactgtacctgtcagaaatggcgcctccacgataccgtggggcgatcaataacggcttcgagctctgcatcagcctcggcattctcttcgcaaatgttcttaactattgcgttgtgaaaatcacagctggatggggctggaggatatccctatccatggctgcagttcctgctgcattcctaaccatcggtgcggtcttcctcccagagacaccgagcttcataatcgaacgcgatggcgacactgacaaggcaaggatcctactccagagacttcgtggcaccacttcagtccagaaagagcttgatgacttagttgctgctagcaacctctccaggacagttcagtatccgttcaggaatatattcaagaggaaatacaggccacagcttgtcatagcactcctggtccctttcttcaaccagcttactggaatcaatgtgatgaacttctatgcaccggttatgttcaggacgattggtctgaaggagagcgcgtctctcctatcctcagtggtcaatcgactctgcgcaactttcgccaatatcatggcgatgatcgttgtcgacaggtttgggcgtagaaagctcttccttgtaggtggtattcagatgatcctttcccagcttgctgtgggtgcaatcctggctgcagagttcaaggactatggatccatggacagagagtatgcttaccttgtgttgatcaccatgtgtgtgtttgttgctggctttgcatggtcatgggggccattgacattcttggtcccaactgagatatgtccacttgagatcagatcagcagggcagagtattgttgttgcagtggtcttcctgatgacatttgtgattggacagacattccttgcagttctatgccgcatcaagtcagggacattcttcttctttgcaggatggatctgcttgatgacagtgtttgtttatttcttcctgccggagacaaagaagctgcccatggagcagatggagcaggtctggaggaagcattggttctggaagaagattgtaggggaggaggaggaaaaacaagcagagaaaacagctctccctagcatgtaaagccctatgaattggaatgtatttgaccatacaaaaaccatacaaagtgtagggttctaattagcaaatgtaagtttgtaattcttctgtctaaatgtagtgtgttgaggtggtcagttgccgtgactggctctttcagatggtaattacaaagaaatgtaacattaatgttgtaacaagggtgccattttgtttctgattccagatgaaaaggaaaaactattccatattctgcaggattaaacgtttctgctgttcacaacaggtaaagtcactccacttcagggaaagacagcaaaatcatttcttttacacagactttagataacccttttttttggggttcttggtatatgccaacttttgtagcctgcaccagaaacaaaaatgaagacttttgctaaagatgtaaaagtggcatgatgtcctggatgaccaaataattcatgacaaatggattaaaagagcccaatatctgaaagagactggccagcagccactaatgtcaccaaccacatatgtaacacttggtgcataattcaagagggagcatctcctccagaatcaggattgaaaggtacaacctcatagtaaatcctcggaatatagcatgtgcagcataagaatatatcagtgttgtgctgggtaagaaaccacatgaaccaattaggaataaataatcatgctgaaattatagcaatgcttgcaatttgcaaacgataaagctagacgcgggttgctggaataacaatccatctccaacaaaatagtacagaatataactgaatggccagctcagaccctaacagaattgaaaagctggattcatcagcactccattgagcaatctagatcaggaaagagcatagatgcataatgaactgagatcccttcaaaatgactaactaatatttttttttcttataaaagagtttacaacagtacaaccacgaagatcagcactaccattactgattttgttaacatagagtgatttatcatgtgtgccagacaaacaacagatacattcatacatagcataacttacagcacatgatacagactacggagaacggttaatcttaaaataaaaacaaaaaaacaaggaggcaaagcttattttgcctgggattcatctaaatgcagttgtgtgcagaaggagatcatgcctgtgcccttgttggtggatttgcatggaaagctgattgtctattttgacctcctaccagatttaatgaaagagaagtagacactgtctcttgattggactctcctatgctgagcttcgacatgccaacaagctcatcaacgttgattgggctctttgaatgaactggaacaggcttgacaatctcatgtgtttcttgcacaggaccatcttcatctttctgattttgccagaaaggaaccgagaattgcaaaaagggcgagaaataagctggaacaatcactggataggtcgactgcaaattatctggcatgatagcagaagcggaagagctctctgcaacggcagaagtatctgactccatagaatctacctcctcctcctccctcggtggaggtagtgctggttgatttaatacttgggtctctggttcttgacctccaggaagtggtggaaggtccatagactgtaaaaccaccaaaacacagttcagttcccccattagagtacagagaaaacagtacaacctttctaattcgaacaaggataaaagtgttctcaagtcttcatgcaatacataaataaactacacaatttgttcaaaaagataagttttagcaatatgatatctatcaccacacaaatgagcaatctcctcgtctcaatataagaatagacccaggcaggcttattatgctacatgccaatatcagcacaataatcgaaataagatcaagcaagctacctcatctggcaccatgtcaaaaaggctagaccttcttttccttctggtcatattggattggcgtataaaatatttctgagcatgactggctacttgagtaggtgttcttgagaccacgaaattacgagagattcctcgccaatcacctttgccaagcttttgcaatccaagcaaaaacctccggtgttcttcttcagtccaaggaacacctgtcaaagtcatcttaatcagaaacatggcacacagaatgtggcctgcaggcacgcaggtagcgagtaatgactggagtacaagaagctggagaactgtaatagttaagctcccatcatatactgacaaaaataccaacaaacttgggactactacacaaaataacagtactgcctatcaccaaaggaaaattatccagcccaaaaaagagcccgttcctaagaaacagggcgcacagagagaggactccaatcttaaaaagtaaaaggattctatgagattccaagagaaatgccagaacataaaagggaaagagacaaattttatgtcttttgccaccttaacaagttatgcagaaggttaacaagattaaaacattgtcaatctggcataatcctcttaacagaataaatgtcaaaagaatagcaaattgtacatttcaaggcgatttcttttatccaatttagtgcctttcattacaaattgataaaggacaaacatatacttttgacttttccaatacatttaagtcagtaggcatataagtctaaaactgcactccaagcatcaaatttggatggaagtacaagttaatgaggcaatgacaacgcagtctaccaatggcatgacctctagtaaggccgttacagtaggaactactgccacagtaaagatcaaacaatcacgtgctgctttgaagctttcacacattaacataggcatgccattaggaaggttcttgggttttgaaagctgacagcttggaagacttttcttggaccaacaccgcgaatataactacgcagtaaactagaaatcattctgaatcagaacagagctaacaacaccgtacgcaatcataggttccaatctccgatgatcgggtgtctaaacatgagaacactgagcctagttaccagccactcacaaaatccctaattcgacactgttatcctctcagaacacgtggccccatgcatccttgcagaggcaaaggatcaaattaaaaagttccacaggatcagccatcattactcgttggaacgatctggtctgattctaaattcttacttatcctagacaaatatggagctgagcatgagtttgacaaaacgtccttgtgatctcatcaaacagttggaggcatctatacgccgtccttgtaccgagagtaattaattgaagtggagtggcgtatgcatgagctaagtagtaccaaatcactcatccatgaccatcagtacaatctgcccattaaatgctttctctagcgtctgtcctacttggaagaaacaactagcagtgactgctagtagcagtactccatcaaatctcccaaatctacacgccgaagcagcaaaggaagaagaacatactagtaggaataataataaaaaaagaagcacaagaagaagaaaaacctgaggttggagaggatctagtaagtcgcatcaggccagaatggtttttgggatgattaaatcattgaaattaaggggttgggaaagaagaagaagggggggggctgacccttcttgcggtcgcgggtggcggaggaggagccctggacgaagtcgtcggaggcgtagccgtcggcggcggtgggggcggcgtcggggccgtcggcgggggaggcgccgccgctggtggatccggcggcggaggagaggagggagaggttccccatgctggcgctcttgcggatggagccatcggtgaggcgcaccccgaagatcttgaccccgcggttggggcacgtccgcgagttgtgcccgttgtggctgcagtgcgagcaccgcctcgtcatccccccctccgtccctccaccttccaaagcttcccttcccccacctatggagatcgatcgatcgatcgagtggagacggagatggtggtggtggagacgacgaggagagggaggggggagaagaggaaggggaggagaggggttaactgctgtgtggtgattggttaaggtggtcggagagaggcgagggccgtccacgtggcggatattcgggggaaggggatatacgtgagacgagggaggcaagtagcggcggcttgtgggtcacgccttctttctatccgtccacgcggttgggcttccttccttcggctgctctcctcagcctcagcctctgcttcgatcgtttcgtgtggtgactggtgaacgatccacagcaaacggcccccaacaaactctctctcgctgctagctcgtcaaactgtcgtggtctttctttcttttcttgttttttttcttttgagcgatgtcatggtctggtttaactcttctactcgtaactaaacagacgttaactaaagatgaaaaatgcacggattattctacgccaaaaagtttatggattctaaatgtgttgcttcttggtgtaccatgtaaccctaatgtgccacgggtgaacgtaaatcctgaatagttgaggattagaggtttgtctcactataactatcaataccaggttttggttgattttatcagctaaatgccagctagataaggaagataaatcacacgtatctgattcctaaagacggagagttagttttgtgaacagtagaactaattcctaaccaaattggagataaccctcgagccccaccagcgcctatataaagagatgaaaggcaaaggagaagggatgtcgtactctttgcctaaaccctaaaacttgcactagaaaggattcgtgaggtgatctcgggaagccctcggtgatgaaaaaagaagagaagaaaagaaaccgaagaagaagagaaggaagaaacaaaaggagaaaattaacaccaatggcatctcaagcaggtcggtgagattacaattctacataggtgattttgtataggctaaagcattgagattgtaaatttgaactccaacacgaggatgtcaaatatttttgtagaacgctcactttgtttcacattagaagacaataatgctaatgacatttttacctatcgatcctattggagagacaatattaatatgatggtggagtccatccacgaggtccataaatatgcgtctttatagtagatgttgagtctaaagattatacaacctttatcaagttagtgtcatgtggtatgctatgattcgtttatatatgcatcaacctatactctatataaggaattatgcttcctatagagtaagggaaaggaattattgatgctatttgaatgtgtattacgaggacacgctgatagctatgtacgtgtatgtatttcatgggacctaaaatgtgcactcactctttctgcaagcataaatcgaggcttgttcagtttgctatcattttcaaccttatcaagttttggcaaagttacttaaaaaagtagctacatttagtttgttgccaaattttagtaagtacatataaaatcttgtcaaaatttgacaaccttgctaaaattttgataaccttaccaaaatttgataatgccaaaacttaataaggttaaaaataatagcaaagtgagcaggccctagatttatactccgtatatattttccatgtgggctgcaggcacacaactggtgaaacacatggtggcattggaggtttgggaaccagggcgagcatggtatcacttgagcgtgacccgtacgagcacggcagggatgacgatatcatcgatcggacccgtggcgcgcgcgtgcggaccaaaaatccaaaaatccggacgacaacgagacagccacacaaacgcgatgaggccgcaacttgcacacacaagcatgtaacgcacctgcctcgtccaacgcgaataacattcgtgcagctcaaggtgtggccgaccgtgcgcgtacctgtagtagagaaacgtacatggatttattttctggctagcttcacaagtggttagctaattgatctggattcaaagactcatctattctatttatttaatattaaatttttctctactattcgcgtttttttcgtacctgtatgtatacggagtacttatatataagggtagtctggtacacgaattcgtagacgttgcacaccagcttccacgacaaataaataatcctgcgagctgcagctgctcatcatcagctcatcctatcctacggactgcaacaaccaacacaaacacaagtcagtccatgccgaaagaagccaaagaaaaatgcatggaaaatgtatacaccacatcatcttgaaccaaatcaccagattaatcaaagccaacgaacgtacggcaaggtgatcatgataactatagcaaggatgtaaaaacaggagtattatattttcaagaacacgagcaatcaacggatctgaacctgaagtaattaacctgcaagtcaaaagggatccaccgcgagaggtggattattgtcggtctaccactcgtaaaaccgggggacaatgttgtcggtctactactgcattctgtattatcatattgctacaagcacgaaacagtgacagcttatctaagccaacaatatgctttctgctcgcaactaattaaaattgcatccatggggttgaacggaccaaagaggataagttaagaaaaagcgtggctaaacactcaaaaagtcggcaatcgatcagcatgcacctttatcccttatgcacggtaatcctaagccatgactatcacggaacgcgtcaaagaaaaatgacagtcacggatcaatcaagggcgcagttaataaaaatagcaaaaacttgaaggtgttaggataattttgacagtgacttgcttgttacagagatattaccttttttttatattctgtactaaagagtatttacctatttgaagtagaaaggcatcataatctaaagtaaaacagagtatgtaagcaactgagtgagcaatggcctatattattttcgtgtggagatattctcatctaatgtcatcaagattcaagacggaggttgcacttgcaccgatctagagagaggatgtgcttaccaacatccaaatcttgatgcctaattttgttgatgcagttggacaaaatatcccttgcaagatactagcatatatcttcaaattatcgaataaaatataagttaggatccatcagcagtgactggaccatatctttttttatatataaaaaaactgacactggagtacaggaccatatcaacaggtggatatatattgtttacgtgagtgataatctaaagaaagaacagaacttgatgaattaaaagttgtgaaaaagatagcatacctgcaggcaagggtagccattccatattggcatattccgaatgtgccgttgcaacagtttccatcatcagattcatatgcttcactggtattgaattgataaacaaatccatttcaataaaacaaagagataagatgtatggaaataaaagataaacttaaaaaagttgctcggctggatcaacaatgataaagaaacacagtcagttcattaaaaagaataagaagattcatgatttgttttctgtttatatctcattctctagtttaaaaacaactcagttgaacattgcacaaaacaacggtactccagagcccagaagcctacacgccttatatttatgttacctaatagatttaattttctcaatcatacgcacccagtatatggcagcaatataattaatctgaaacattagtaagaagattttgctgagatgctagtctgaacactgaaccaaccatatttatgttacctaatagatttaattttctcaatcatacgcacccagtatatggcagcaatataattaatctgaaacattagtaagaagattttgccgagctgctagtctgaacactgaaccaaccattttggaccttatggtttcttactaaactaaaaatgttctggcatgaagagttttagtatcatataaacactgtaatgcacagatatttagtaccaactaacaaatacacttgaaatggtgcacttatgactgcactgcattattgaccgaatagtgctgatcagcagtaacgtgcaccattgttctgaaagaattcagaatcaggtcccaaacttgaagggaaatataagcaacaacagtggagtaaacagttctctgaaacaagatatgaatgtgcaatgagcaagagtgatagaaagtgggttgtgaacttgtgatacagttctagaatgctgtagttgtttgcacaataccaaatcaaaaatgcctatggcagatttgcacagtacagtttcattgacgcctttcaagatggaaagtgttctaaagataatttggccggacaaatatagaaatattcttttgtccttttaagaagcaaagcttggaaaggacatcaaatcaactgaatgatgaacgtccaagtaaaaatgaacggttacatttgacaaatttatcagttgttgagaaatggcgaagcagacaagtaccttcagaaagcaattggtacacatcatcactcaaatccatcttccagaggcccaaatcagaaataccgcttgatgcatcctacacagacaatcaccaatcacaactgaaccactcaactgcatcgtagcaaccatcccaaaaaagtaaaatattcgaaaatatgatttttgtctcgaactacaggcagtatgaggatatgacaaaaggctctccaactacatctggctgacagagtcgcgcgtaacctgaacaaattaagcaataatcgaagcacacgccacggttgtcgacgatcccctcacactccaagctatcaccagttcaccacgagcccaagaggcaagcactgaaaaatccttacccctctttccccgagggccgcaccgccatcttcccctccggcgaaagctcgaagaactagtcgccatccccgaacgaacacaccctagtacataccataaccctacccagcaaaaacgcatacaaaatcaaattaaacggggacttcgcgagctggaacgcgagggaagaggagcaggatacttatctacctgcctccggtcggattccgctgcggcgcggagccggctgccggagggcgcctccccggcgtccccgccatctccggcttcgccgccgcccgacggcgacgcgcgcctctttttttcttcttttttgagcccgcgcgtctcttgctctatttcggtgtttcaaatgggccgagataggtgggccttaatgggcctgaatcaaatgcgaactatactgtaatattgtcgatttgggccgaaaattatccatccagtacagtcacctgacaagtaggccctacgcgccgcacttgtctcgcgctgctgtttttttccccctcctcggcggcgattccactgcctcgccgtcgccggagttggagaagaaggcggcggcggcggcggcgcagaaaggtgaggcctctcgaccgaatccctttccccttcccgtcttccgccccgcgcagtcagcagcaacagacgaaggaatgcggtgcgaatgcttgcgagtagagaaatcgatttctggctgccgttcatctgcgcgttttgttgcgcgcgcgcgcgcgcgagggagggagggagatccagtaaatggcgccttgtcccgttgcttgctcgatcctcctgccggccgtgggggtttttgcccccgattggttccgataatttgtcccgtgttgtagatggtgaatcggtgatgaccaagggttaccttagatgataggaaatgattaggagtagcgtatttcctcgtgattactggagctgatacaatgcaggatatttttagcgctgatttgtaacatggcaggattaatataccattgttgtgctgttgatcacaccatatttcccttatgcagggtattttgtattagggatataggcaatgcaaaactgcaagctgcaaagccatggccatccaagataaagttgagaacaacgacccaactgtgactgttgggttggccgtgagtagttccaaatccagtaagtacgccgtgcagtgggctgtgaaaaacttctgcaccaatgggatggttaggttcgtgcttatccatgtactgcagaggatcaccacggttccaacaccgagtgagtgcatatttgatgtgtttcctactgtgtagatgtatactttcgtttgtaaatcatgttgtcacttaaatatatctatttttcttgcttcttttgtagtgggcaactatatcccgattgataaagtacgggctgacattgccagcgcatatgtgaaagaagtcgaatgtaaggcccgaacgatgctccttttctacaagaacatgtgtgatgagaaggtatgacgttgccacttcaggccatcctttttttcttttccgttccaaaatgaacattcctaagggcacactggagccaaatataatgaaatacaactgaataagcacaattcacaacagtatttattcaggacatttcataatgttaattttgttcagaattgtactttcgtatagagtcagaaattatgagaacaggttagaactcagcaatgatactcatagttttaaacatcctgctgaacatgtgtatacattttctgatcttgttcaggctaaagctgaagtactggttgtcaaaggtgaagatgtggcagaaaccatttccaatgttgtttcaatgtacgaaatccacaagcttgttgtcggtgactcttctcagggcaactttattaggtacttaacatgttctgtaataaataatggtgaactgcatgcatcaaaatgctgattaatttggtggaaatgtcttaggaaatccaagggtactaggacatcttctcaaatttgcagaagtgttccaagcttttgtgcagtttatgttgtctcaaaaggtggtttatccgcagtttattctcctggatttgaaggtcacaagagttctgagctattcctgtccagtgatagctccaaaactgaaatccattcagatgataagccctcattatcaggtgaagttatctgtccgtaaaactggcactggaaattttcactgtgtactgtatagacgataacataatgactgcttccaactttgaaccttttcgtccttggtactctttgaagctgatatagaatggatctttgctagtctttgagaagtttgtagcacctagcttccttttcaaatgtttgcttggttctttgcattcaataagaatttggaatcgaggtcgtttggttttgaaattcagcaaaaaagaaaagaaaaaaaaacagtgcaagaaatttatcccttttgtccaatgcagatgccacaccttcgagaagctttagatcaaacttgacatgggagaatctggaaagtttatcatccgcagaccatgatagaccgcgctccttacatgagtatcttactgaaagcacttcagcatctgttggtgataataacagtaattctccatgtgctagcggtcaaacccctcgaccaagtaacgtgcttatctcagataaagctccaatgacaagcagtcccctgcaggaattgatgctttcagaggacatggtgagccatttgattttttcacagtaaaactgtaataaattttttcacagtagtataattttgcaaatgatacatctttgatgaattgaggatgagccttcactgtttaaacttcttagataagaatagttccttttttttctgaatatacagtaacttaattttctcaatgcaggatgatgtaaatagcgagcttgaaaagctgaggcttgaacttaggcatattaaaggagtgtgcaaacttgttcaggatgagtccatcaatgcttctcagcatgtaagtttgggagtactgtgtttcaacataattagttggttactttatctccaatagtcagcaacttaattgtcatcttgacaatcatatgttaggtgactgacttagctgcaaaacgtgctgaagaggaagcccggctcagcgaggtctactccaggatcaacagagtcaatgagcaagcacatcaagagaaggaacaactgaacgctttggaggctcagtgcaggcatgtgagggatcttgcaagaaaagaagctttgcagaagcagattttgcagctgaggacttcgaaggaggctgataagatgcaaaggctggaaaaacttcttgaattagatgggatgtcatactcaacatttacatgggaagacattgaatctgctacatcatcgttttcagaggcacttaaaattggatcaggatctaacggaacagtgtacaagggcaatctacgtcagacatctgttgccataaaagtcctcacttctgacgacagccacaggatcaaacatttcaaacaagaggtattccttgaaccattaaaggttgagcagtcaagtcctaatatcatcatgatctccggatcttcagatatattcataggctaagaagtaaattgcgataactttgctatgttcaaatatgcagtgctactcttcttgcatatataatgcaagatgccatcattgttatctctaggaaattcttataagatgcccctgttctgcagcttgaggttttgggtaagatccgtcacccacatctgctgctgctcataggtgcctgtctggacagaccatgcttggtgtacgagtacatggagaatggcagccttgaggatcgcttgcaactcaaaggaggcacggccccactcccatggtaccaacgtcttcgcattgcttgggaaatagccctggcccttgtctacctccacagctcgaagccgaagccaatcatccatcgtgacctcaagcctgcaaacatactccttgatagcaatttcaccagcaagattggcgatgtgggcctttcaacattgcttccgctgggggatgccttgtcgacaacgcgcacaattttcaaggacacagatctagttggcacactgttttacatggacccagagtaccaaaggacaggccaagtgtcaacaaaatctgacacatacgccttgggcatggttttattgcagctgctcactggaaagccacctgtggggctagcggaccttgtggagcaagcagtagaaaatggtcaccttgttgacatcttggacaagagtgctgggaagtggcctgcacaagaagcacatgagctagcgcagcttggcctaagctgtttggaaatgcgaagcaagcatagaccagatctgaagtgtaaggttcttgtggagctggaacggctgaaaaaaattgccagtgctgtctctgaccctgtacggccagtgatatctggaccaccaagccattttatctgcccaatactcaaggtattttttggcttattgcaatacatcagctttaagtgaattacatcacaactacctgtagctcattgtcttgtaagaatgtttctgtttcagaatttgaactatattacacttcaaggtggtctgtaattcaactttttactcttaccttgttgtatccatttttttcgaagggtctgaggtgaaacttcattttgctttttttcctccctgtagaggataatgcaggacccatgcattgcatctgacgggtactcgtacgaccgggtcgctattgagatgtggttgtgcgagaatgacaagtcaccgattacaaaatcgcggcttcctaacaaggatttggttcccaaccatgctctgttatgtgcaattacaagttggaaggcagaagcaagggactgattgagtgattgtgctaggtaacttctctaacttcacatggatacggcactcgaaggctgatgatgtacatgtttttgccttggtgatggcctccttaatctctaatactgtagatactgcggtaatgttcttgtaaagcagcagttttgcagcattttcatagaccatctctgagataaattttgaagggtttagagtaggagtatcaagaaggtcattttgtaggttggaccagcagaaagtacagtagtacacttctacagtattgctttgtgatagtttatacatatacatcgaaaggataggaaattcctcttactttcttatcttagtattgtgatgactactctataaatttaagagttgagacaaatttccggcatagactccatgttaccgttgtgactatgatggctataaacttagtatttcttccgtcccaaaatatagcaagttttaattatgaatttagataaacacttattcagatttataattaaaagctgttaatgtatattttgggatggaggtgataatatttaaactacctctgagagtaaagggttagcaggtggtcgtcgtatcccatagtgttttgctagtactattattattgttacgaaccatatttatagagtaaggtatttgctgtacttagcatgttctgttagtattagcaaacttggacatgtggtcttcagctgtacatccatgtagccttgttcaactcgatcagctccaggtgatgagatgatcatatctgaccaataatttggacacatcaggtttaactaaaccacttaggaaaaaaaaacatagcttgagctgcgtgtaagtggatgatgccagcagctgttcaaactactccaagtactactccagtaagaaaagaaaaatgattaaggagagatgagttagcagcagtggcatgacgagctaggaggccggattgtcggggctttggggttacgtgctagtgacgtgtgggccccaagcacggatgacgtggacactttcacgtgtatatgcagctagctagcttagcactactagataagtataagtgtggcacacttgtgatagtgtgaaggttaagagtaggaggaggagtactaattataatcatcatggtgtcatcatcaggcaaggtagagtcccccgacagcatgccggtttggtgtcaccaccgccacgagtccatgagtgacatttattagggccaatgcattgcacgcacgcatgattgctcacattctgttgcactaacagataaatttagtactgtatgacaaaatgacaaaattagtccatgagtagtaccaatgcatgcacgcacgcatgattgatcacatattgttcccctcttgtatcaagatttgattgattccaaatctagtgatcatcataaatatggcgtagtatgaaaatcaaacattgctactccctccctccgttctataataggtgatgtttttaactttttatttgcaatgtttgatcattcgttttatttaaaaaattaatacaaatataaaaaaagataagtcatatgtaaagtacttttaataataaagtaattgacaaacaaaataaataataattcaatttttttttgaatatgataaatgattaaacattgaaaaaaaacttaaaaagataagtaatatggacggaggtaggatgttcttggcctcttaattaattgttctttcttggtatctcctgacatagtatagtaacacactttaactaatactaatggttggccattgactgagtacgtagcatatacgcatttgatcatgttactcatagctgctacgtcgtcacgtcaacgtgcatgtagttaacttaacaaacaatcagttggttatccatttccattaggtgcatgattacattattattatttattggatcaaccatgaattcgcggctacctccggcatgatcgacacacctacctgcatgcatggaagccggggtcgcgccacgtgcgcacgacgtggcatgctcgaacgccatggaagctgggatttaaccacgcacgactaaacaacaaagtagagtagtatacttagggcacccacaatggttatctataagctctctacaagagatctatgtcagcatattttcctacttggaagagattaaatgaagagagagcaaagctatctactaacatggagatagtctatagagaaaaacgaggcaatggattagagagctatagatacccatgtagacataccattgaagtggtttactattaatctagtctattgttgaggtgtacatgttttatagatagtaccttactttaccattgcgggtgctctaaagcaattaaagaagtaattaatgctgttgacaagagctaaataattataatcaacacgcacctattattggaacttgaattgcaagtctctccctcgttcgtttccggagatttttgtttttttaaataatctccgctagtacgggatctagcatgtataaaagttttaaaaaaatcaaataaatatattttaaattataataattaatacttaactaatcatatgttaataagctatcccttttttcgtcgggtcggctttgctgatcaaacattgaattaagaaggagaaaatttagaactgtacagatcaaaaaaaacaaaagatagcaaacacacaccccgaaaaaatcagaggtgacacagctcctactaacagagcagaagctcacacacacccttgttctgctaactagctgatccctatggatatggggcttcttgcttcaatttcgcacagcagaccggccgctttccaagcttcccattcttccacaattgtggcacaaagatggcccgctgaggttgctcttccatcaaacactctagcattattacgttccttccatatgaggcatgtcacaaggatcaccccggcgtcaaatgtctttctgtcttgcttgcgcactgattttcggaccgaacaccaccaagaggaaagatcttctaccggcaccgacaggggcggatctacccattaggcatggtgggtcgaccatcccagctatgactcatatcgccccacacccccaagaccctccccacccccttataatagttataggccatcaaaattatgtataataaggtttggacgtctgtctcttcacaatgcatgcacgccataaacaatgatcaagataattatacgattgatatataaatatgatatgtgttatgttcgattgcttatcgagtaaacatcttcattcttcgtcccatctatattttaaaactgcgtccgccactgggcaccgaacaggaaaggctaagccgatctcgaatccttgtccaaacctgctttgtgaagggacaatcatggaagatgtgggagcaggactcgccgtcgtttgcacaaaggtgacagatcgaggccatttgccaaccccggcgctggaggttgtcggtagttaaacatgcaccacgcatcgaagctatcccgttttacatgctgctaattaggagtaatatgcttctccaaattgaaggttcaaacggctagcactataaatctgaagcaagtcgttcgtagcaacgctaatatgcatgcatattaaaagtcggaaggaataattggcatggatctatcgctaatgatcgatccatcgtttaatctgacgctcacggaagcaagctactcctactaacccataaaaaaataatatagtaatgtaccccctccatcctaaaatatttgacgccgttgacctttttaaaaatgtttgaccgttcgtcttattaaaaaaattaagtaattattaattcttttcccttcatttgatttattgttaaatatatttttatgtatacatatagttttacatatttcacaaagtttttgaataaaatgaatggtcaaatatgtttaaaaaaatcaacggtgtcaaacatttaggaagtatatgatatattctactactacaaatctagatatatttttgattttttttgtctatatttatgtaatagaatgtgtcacgtctaatcgtatatttgttttatgtggaacagaggaagtagctaggtcactcgcatgcaccatttctataatcaacattcaacaaggacctaggaagacagtcctgtagccatcgacggacgatacatggatggatgcatcaggccagctagcgatcgatcgatctggcgtcagcgtatatgactctgacctactactaagtagcagaaagacctagtagtattcgtagctggctgtccagttcacacatacgagatcaactgatgattgatcgattaacacgtgtacaaccatgcatgcatgcttggcgatagatgaatgatcatgcatgcatcaggtcgtcactcgtaatctctggtcatctttcgaccacaaatataataatttctaagttatttataagaggttatgtttaagaaaaaaataatttgttgtccttgatggtttgtgattaaattatggttggaggaaattaaaacgagaggtgactgtcaggggcggctctaccttggtccatggggattagggccttagggcccgatggaggctcgagctttcattattgacgcgagaaccatataagcctctatttttctttgccatatataagatagaaaagggttataattttgtctagtttgtttacacctagcccagctgctatttctttatggatctctgtcacttgtgactattaaaattaacaaacaacatcatagaaatgcttatgattcataaaattttaaaacttaaaacgtttatatttatagataaagagagtagcacatgctgtatatgtggtgcgcgtgcagtgtgtccacatgcatgcatgagcatgacggcaacacggcatgcatgcaacgcatacaggcaggcagcttaattggtcgacggatggtcaatggatggatcgatggaaccatccagcacaagtgccctcgcgtccaagttactccaatttgtcattactagtatcacgtacacggtccaatcgattgattcttgtcaactcgatcgatcgatcgatctcatgggccaagctatctatctattctagtattagtcttccaaaacataatgaatcattgattgattgattgattggtcgatgcctccatggatcatactagtatacttctttcttaaaaaaaaaaactagacctattacttttatcgtcaagattaaaaagaaattaacttattttatacgtgacaaaaattaaagagtatatatatcaagatgactcatcgagttctggtctcaaatatttgatttgtcctttcatttaaatcttatatgcatagagactctaaatcttgtggaggaagctaagtatgggagaagatggtggaattgctaatattgatgacatgaaattgcacgtacactacgtgcatccgttcgtgcagcgggccacgtacgcgccgacgtggcgagcttggccaccagggagaatgcatgcaggtacaagtgtatatggtaaagtacacgtctagatgcacaacgacttgctaatccagtgacccatccatggttacacacgtatacatgttactggagtactacgcgtgagtgtgatagatagatagaacatctcggtcgtatgtatataccggtacacgtccgatcgacgggacagactaattaactactagtcaaagcttgaaatatatggaaaatagtaattaattaatccacagttgattagtttgggtacgtgattgataagagtacagatatatatcacatcaccaggagaaaaaccgaagaatgcattcatgctacacgtttgtactcatggtcgattggtcctcagctgctgctgcttacaagttggtcagtatgctctctccgtgctagtaaaaaaagtcgtttatgacaatatttaagtcaaaccttgaaaatataaattataaataattttgaagttattgagtttaaaaatataaaaattatatgaatagatttgtcttaaaaaatactttcataaaagtatacatatatcactttttaataaatattttttatagaataaagttgtattttggagaccgtgtcgctgtccaaaacgacttcctttacaagtacggagagagtatactttttttcttctctttgattaatcgactgttgactcaaaatatccaaataaaagatttgtattaaacaaatttacatactattcccgcaatatatcaacctggtactaaatgatatatatcttaatactaccattatggacggactctccatccagattcacagtagtatgacatgtttcatctagtactatattcttatatttttatatggagggaatatcaagttatgtatgttttagaaaattcagacaagtatattttttcttttttccaactttctttctttttttttctttctttttgtgtggagacaaaccaaatatgtactggaatttactttatggatcgggagagaatgtcaaactgaaaaaaagctatgaataaaccgcgagcgtcgacgacgatgccaccagagagagagagatgaaaaaaaaaagtgaataaagaaaaagaaacaaggagaggaaaagaaagaaatgggtgatgagtggctccaatgattggaagcaaagcaggtgtgcgttgtcgggggaaggcgaggcaggggaggcccacgtggaagcctgccgcgtccgacgtggcccctcccgcccacgtgagtaggtgggccctcccaccccggtttcccctcctgctttcccgcctcggcccacgtgacccctgggcccactagcccactactaccggctgctgctcccggctcggctcggcttaaaatcgagcttggcttgtcgagttccaaaaaaaaatcaacttaaaaggaaatgtgtcctctcctaagtttatgtatgtggatatatgaggtgtccatgtacattgatctaggaggggtcacatcatcccctcttaggccgagtttagatccaaagtttttctttaaacttctaacttttctatcacatcaaaactttttgacacataaattttcaacttttccgtcacatcgttccaattttaactaaacttctaattttagcgcgaactaaatacaccattgattctttttgggagtggaggatgtaatcggattggcgtgggggcaatgcagtgatgggcatgattggggtgatgatggcggcggcggcagggagaggggaggagatgatggttgggtggaaggggacagcgtggccgcacgcctcgcgtcggcgaccggcagcacgcaccatggtccatgggccacgtacgacccaactgtagtgcatcgccgccgcgccggattgtgccacgtcgtcgatcttgctctcgttcatcagcgactagttcatgtcttttgttgaaatgcgtaaatttcactataagaaatataaaaagtggctgctgagaatggtttctgatccaggtttatgtttttaatggaaaccatgttcaatctgggtgcccaccgtaactgccgtggcggatttatgccacgccttgctcgtagaatctaggcataccacatactattgatactaaggtcgtgttatttccccttttttttcccgttcgtaccttttcaaacggctaaacagtggagtatgacttttgcaaaagttttttatatacaaaagttactttaaaaaattatattaatccatttatcaagtctttaagctaatacttaattagtcacgtattaatgggtaacaccggaaaccacggggaactccaccttccaaactcagcctaagtttagacgcaaacgcttgtataaacacacttatactcactcctgtaaacaaatgcatgcgtgtacatctatctctatgagtatctctcaagatagaatctgcatgttataagagttatgaagtcacaacagatttataccgacattgttaaaaggataattagctgtaaatacgagcatccatataactgatctcatgatttcgttggaacacatgtttttgtacgtacccctccgtcaaaaaaatttaatcctagctatgaacctggacatatacgtatccaggttcgtagccagtttttggacatagtagtaagcaataggaatcggtttaatcgataatggacttgatcgatacaattagctctattgtcgtatatatggctggctgctgcaatacacggttgttgccgacactctcgactattaattaccaggtttgttatcgcattcgaggatgtgcacatgttgtgttattagtgatggattgcttcaatgtggcttacttatttcactctcatcttttcttaggaatatgcggaagatttgtaagccttttttttttttgaggttgcaaccaattgtccatactttcggtacggactacggagactattccactgataggagtacatctgttatctttctctttttctctttttctttgtggcatctgtgtcacatcttgggctatatcttcataaaagaaaataggcaccccaaaagtcaacagcttaagatggagcaatgtactactgcttatactacctccgtcccaaaataagtgcagtcgtagatatccgtgcccaacgtttgatcatccgtcttatttgaaaaatttgtgaaaaatttaaaaatatttagtcacacataaagtactattcataatttatcatctaatagcaataaaaatactaatcataaaaaattttcaaataagacgaacgatcaaacgttgaacatgaataatgcaaaactacacttattttgggatggagggagtaccattttaagctgtctagttgcttcgtccgtccttaaagagatataggtcctgcttggggagctaagggtgtggttggttgcctggctcgtccctggctcgcatctcggatgcaacttgtagactgtttggttgactgcacgtgtcccacagccaggccgaatagatgcaaaaagtctctcgcagccaggctgagcaggaacgaccgaatcgagcttcgctgctcatcctggctccacgcatgcagcggcgccgcacccgcgcatgcaagcgctgcacccgcgcgtgcagggagagccggagaaacgatggggtccccgacaccaccctaccttcttcctcatttcttctatcttctcttctcttcgctatcgccggtcatggccactagcggcgaccatctccatcttcgccggccagatcaggctagctgcaagtcctgctcctccctctcttcttcagcaagggctcaccaagagctctccgccggcggatccggagggcatgagctcgccactgccagatctacctgcacggagatgtcgaagtatgagcttggcttaagctcgtcgtcgtcgccagcggcaccactttcctcgccggcttgagctcgtcgctgcgcggacaccctcgccgccacggacagctacctcaaatccatctcctactcacctttttttttcgccagattcagaggttagaagctcgggcctgccagatccgagtaaccacaacaccctcccggccgctggacccgctgcaccgacggcggcgaacatgcctagctgggtggcacgagcggctaggtaccggtggcggcaagttcctctgcgagctctgttctcctttttttttctttcttttttccaccgaatgtcattaaccactgataaatatggtttatgtactgctgtgcaactgtatatgctcatccgatactgttttcaattattgttgtcaggagctccgaaatcaatgctttgtatattttgcatgtactattaaatctgatatatataccataaataaatacgctttttatttcgtagatggtaagaattttcaatattaattctaagtgaggtaatctctccttcaaagaaagaaaatacttatacctactatccatacaaccaaccaaacaaagtctctttcaagccgtatctttggtgcaagcagccaagcagaatctcacgctaacctggctaaaccaatacaaccaaccaaacggttgcatatgtatctacctagccaggccaaactcagccttgatggaagagatgggccaagctaaaacaatgcaagcaaccaaacacaccctgattctgagaagccaacttctgagaatctgaaaaagatatgttttccagtttttgacttctagtttacaactacagctttagaatctagaaaaaacttagactgtttggggagcttctgatttctaagagaagctgcaacagttagaaactcccctaaactggtccatagttttcagtggtcaaaagtgagattatacatgaggttaaacaaataatatactattcattaatacttggagagaacaaggagaggagaaaactaggggaatgagagagtattattagttcgatggttaaaaaaataaataaaaagatgaaatagtaaatagtattaaggaagaaaaatattttttgtgagctaaaattttaaactataattagattttcttttggacaaggagattagagattaatgtttgggaaagactctgctggtatctctcatttacggaggaattgagggtgattggataagataaaaagaaagataatcaaatagacaaataatactactctctatttaagatataatagtacatagaaaaatagggttaggggagtataaaaaaatcttaacatttgtgaataaacataacacacactaggaaaaatgttttactatattagtagacaaagtggataagcctcaggagatatacttgatagtccagtgataaaaagactgtggtttcaaccttaagaatcctcaacacgattataatttctttttaaaaaatatttgaaggggcgtttctctctatatattttttttattttttagcgtaaagccgtaaaacctcaggctgcgagctatgggcaggctcaactgaaggcatggccaggaaccagggtcaaaggagcaacaagtcatgtccggtgggccccacccggccccaaccccgggggacaagtcaatgagtgcccccgctccctccgaacaggaaaagctgctcatcatttgcgctgcgacgctgacgcgtgcgcccattccacgcaaaagaatactcgcagcccatgcatgcacaatactactactactagtattttctttgacttttcctgcaccccacaaaatatcgcttttgatctaatctcctccttaattaccccctctaatcaagctcccctgtctcccccacgctttaaaagcttcctcctcctcctcgccaaccaccaccctcagtccctcacctccatttccatcaagcccaagaacgaactcaccacgctagtgttgagaagtggagagagttgagaggaatcaatggagatgatggttcatgggaggagagacgagcagtatggcgggctcaggctcgggcttgggcttgggctcagcctcggcgtcgccggtggtgcagccgacgacgagcagccgccgccgcgccgtggtgccgccccgccgccgcagcagcagctgtgcggctggaacggcggcggtctcttctcctcgtcttcctccggtgagtatagatggacggacttacgtcgaagtcgtgcgtgcatgcatggatgcatggatcgatcttacgaaggttagtttgcgtgcagatcatcgggggaggtcggcgatgatggcgtgccacgacgtcatcgagatgccgttcctgcgggggatcgacgtgaaccgtgcgccggcggcagagacgaccacgacgacggcgagggggcccagctgcagcgaggaagacgaggagcccggcgcgtcctcccccaacagcacgctctccagcctcagcggcaagcgcggcgcaccatctgccgccaccgccgccgccgccgccgccagcgacgacgaggactccggcggcggatcccgcaagaagctccgcctctccaaggaccaagccgccgtcctcgaggacaccttcaaagagcacaacaccctcaatcccgtaagcaaaacaatcaatcaatcaaactaattaccaatccaccatgaaatcgatcaagaacaatccgattgacttgttcttgctggattgatcagaagcagaaggcggcgctggcgaggcagctgaatctgaagccgcggcaggtggaggtgtggttccagaacaggagggcgaggacgaagctgaagcagacggaggtggactgcgagctgctcaagcgctgctgcgagacgctcaccgacgagaaccgccgcctccaccgcgagctccaggagctccgcgccctcaagctcgccaccgccgccgccgcgccgcaccacctctacggcgcccgcgtcccgccgcccaccaccctcaccatgtgcccctcctgcgagcgcgtcgcctccgcagccaccaccacccgcaacaactccggcgccgcccccgcgcggccggtgcccacccgcccgtggccgccggcggcggcgcagaggtcgtcggcgtagagaccccactactgattaattagttaattagagatgagtagtggctttttcttaattagcagggtattaattaattacttaattagggttggacccctgtagttttcttgtttatactacgtgtataatttagctctggttttgaactttttaattagtttcataatctttttttttcctatctctcacttcaccctgtttgttgtttactcagcaaagaatatggtgtctttgtataaagtgatgcatgaaatggatcataaaagttttcaatattaattccttcatatctgtagtgttcttggactactaattactgccaaaagaatgatatgattactactgtattgatgcttactatccctcttgtggcacttgagatctcaggataacgatggctgattttccttgctttgttttgttaatctcctcatatgtataagaccagagtaattaattaattaattaacaggggtcgaactgtcaacggtgcaattattaacatctccgagtgcaggcatcagtgaggatgaattccaaagaggaaatcttctccttttctttccattccctgtgatcttatctttgaagcattctaagcttcctgacaggaacatctagctaagctatagctaacttcagagatgcaaaacttgcaagaaacaaaaggggaccagatcaagaaactgaagctgaatctgaagcaacaataacaacagtctctgcaaatcaattaatcagtctctgaacatgtgtgtcgctgttaaacaggcagtcaattaatcagtcagaaggtttagtggtagctgccgtctgaaccgggcaagaaaagatgagcagaatttgacctcttccaacacacaatctgcagcaacttttggctcatatgttctctggccatcttggcgaagctactactagtagtacggtgattgcaggggaaatatctcatcaaatctggatgaaagctactgaagatgagatcattggaacaagacgaagtttcctggaccttactgaacttgcgccagacagatcataccaatccagtatcactggaataaggccctatatattctaaacatgtttttgcacggattattgagacggattttgtttactttgatgataaatcaatattttgagaaataaacttcagtgatttataaatagcttaaaacaagtgatctaaataatgcagtagaagatcttttttatgagaaattgtatagacaaaagataagctgaaaatagcatgccctaatacttgggattaacatagaaaagcaagcaatggcttaattagtagtactcgtagattatgtgtgagttgtcgctactattagttaagtaatccatagcttaattagtagtaggtgcaggtgtgcacgcatgatttggtctggtgatgcaatgcaatcttggttagatttgcgcctaacataatcaggatcattagcctccccagccagcatgccatgtgcaggatgccactaaactactaaaaatcatttggcatcatcatcatccaacagaggcataatgcgtgcgaggtgatgcatcattgtttaaccaaagtgattaattatctcattaggtgtactactcttgtgtgcagggcttagatgtggagggatcacgaagcaaacaggtcccacgcggagcccctcagcttaaatccgggagcaaaagctgcagagatgagaagaaaatttgctaattcatgggacacctttgctccctgcttttgctaacacctagtacagtatactatacccctcttttgctgaaccttgctttgcttgatgaagttttcaaagctggtaatcaatgatgatgcctgtcagtttacaatactttaattgtacactaattgtgttttgtgcagttgtggacttgtggtgtgcaaatgcaaagttgcttggtgatcaatgattgtgctagtattgcctgcacaaagtccctgattagaaaggctgaaatgttgtgcttactaagtagtgttcattactggggccaatgctactgtcttttcaattcttttttctctctcttttctttttcacatgctttcctggagcagagtgtagttagtcagagcagagaaagcgaggttaatacgagtttattagcaggattagtactcaggaactgcacttttactgttgctgcgactgttcagtccaatacatattcagaagggttaggtaggacatccagattccagttgtgaatttcttttctgttcctgagccagcaggtcagctcctgcgcgtgcacgtagcatctgatctgatacggtgaagcattgttcgcttctgcctctgaattctgatccttccttggcgtagaatggaagcaattcagaagaccaactcgcgttgctcaactgattcatcagcaattcgcatgtagatccttctgtctgaatatgtgatcaagccaatggaaatacactaagctacatcgagctccggccatggtcaggtccaagggttgaacttctgacctcatagatgacgctaaggacctgtttagttcgtgaaaagaaaatttttgggtgtcacattggatgtttgaccggatgttggaaggggtttttggacacgaatgaaaaaactaatttcataactcgcctggaaaccgcgagaagaatcttttgagcctaattaatccgtcattagcatatgtaggttactgtagcacttatgactaatcatggactaattaggctcaaaagattcgtctcacgacttctccccaactgcgcaattagtttttttaatatatatttaatgctccatacatatgtccaagaattcgatgtgatgtttttggggaaaaaaatttagaaactaaaacaggcctaacacaaacaaacaaacaagagtaaatcacaaaaccccaggttttgagacacatacaacataaaacctcgggtattatgacttgtttcgagtaacactagattttgaggcaaaatgtttcaaaaagccatatgtttacatcaaatactcatagttttattattgtatatgttcacattagtaaactcaaaatacatataccactcgtgtactttatcttcttcctcacttttgtattacaccatttaaaaagtgcaacacaagtacacaaccccttaataatgacacattaaccagttacttatatacataaacagccatactaccaataaccgatgctcgttaaaataagtccaaacacgtatatcatggaaaatactttcataatatataattagtcaaaaacaatgatattagcttaaacatggggtttcttgaaacattttgccccaaaacctagggttattcgaaacaaatcttaatacctaggggttttgcgttacgggtgcctcaaaacctgggttttgtgaaatttactcaacaaacaaagatgcattactctctccgtttcataatattcgcactatgttaaactatgtgattattactctctctgtttcatattataatcacatagttttatacgaaatcaaacacttttactttttaccattaatttttaaaaacatgtataattcaacatgataatttaccattaatttttaaaaacttgtatagtttaacagcgtgggaataattatatagtttaacatctatatttttagaataatcatgagaaatactttcataatatataattattcgcacgctgttaaactatgtgattttttaggaattaatggtcaaagataagaattttttttatttacaacaaatctaatttaatacggagggaggacatcatatgcatagaggccattgacctgaacaagatgcagttcagtaatccgtatgcatgtgtggttgacagcacgatgcatgcagaagcagttcagaagacgaaaatttgttggtttggttggtctcgtctctgtactgaacttcacacagatgatggctttatgtcactgacttatttgtgctttctgaaaaccaacacacactacagaaatgtcaaacgaggagaaaaaaaggatgttcagatcgaagaaaactcatccatggtgcccattttgacccggaaatcaactgacgatgatgtgtgctgctgaattctcatcaccatgtaccatttcaggaggcatgaccggttggttgatcaatgcagcgatcaaccattgcacgtgtgcatctgaattctcttcctgcattgcagcctgatctctccttcattgagaaatctgaagcagtagcacaggccaaacttgcgtttgtgatgtactgaactttctcagaagcgatagctacttggtcagacaaatctgttaggatctttagtggttatttctgcacgtttgttgaggatcgagttcgcatgaataaacaggacaaatgattgatccagttagaaggaattaacaggtcaagatattatgtttttcttttccaacacatggaatggcttgtctgaacatctggaagaaactgtacttctgaagaacagaacaggaaactgtcgattaagttaaatttcaattagaagaagcatgtttagtgcatcaaatccataaccagtgatgttgctgtatttaatacatgcaaataaagcatatggagactggagctaaatacaatcacatttcagcaacctcagtacaaacttacatgagcagtaaatacaggtagaacagaacccactggtagtttcttggcaaaacttctagacaaatttgtcaggatcttcttgggtgaatatcttcaagttttgtgaagattcgagttcgcataaatcgacaggaaaaatgatgaatccagttagaattataagtcaagatattctgttattttccaacacatggaatggcttgtctgaagctctgaaactctagatgaaacaacattaaaaattctgaagaacaggacaggaagaagtcgatcaagttactttcatgcacaatgcaaatccagataactaaatcggctgaagaatatttggtgcaattgtatgcctcttctcaaaatgaataaagaaggcataaattcattcttggacagagaaaattcagaaaaagcatccagtaaaacatgtggagtgaaaatgccaaactgccagcttaacttgaaagcaagcacaaataatgacaaaatacattattcctctgatataaaaacaaataaaatggcaacttggacagcacatttgtctacaggcatcatgctgaaaaataacgttgtcagtcaaagtcaataaaaaagtagttagtggttagtatatttactagtagttgatagttccccttcttttttcagttgggtttgcaactttgcatagctactgctggttcctgaacgttcacactgcaaagcaaaatggataaaagcacgtcattatttttttaaaaaaagaattcagctatcaacaatagaacacagttcagtcggcactttattcacaagtaagaaagggttaatttaatctatgccattacaaatatgacatattagaaaaatataacattacaattcgtgttatcggctcggtgccactgagaatttttaaaatcggaaccatgccaatcccgtcactatttccgtcctcctctctcacgccgacaacctcaccgtcatagcccacccaccccacccccccaacttcagagaattttcttcagtctaattttctgatttatgctctgaagaatttgtcagtctttgttccgaagaagttttaaccgcagttctcatggtgaaacgcagagagattcagacggacgtgcggtggcgagacggatctaagtgggccgacacggcccaggatgacgtgggtgacatgtgggccgcatttggcccatcatgtccgcgtcagatatgcaagcagattgaggagtccgttccgttcactcgtcgccgtcgccgagatgagcagcaaccgcaaacgcgagctcgagcgcctccgaggcgcggcgcggtggctccttctgcaacgacgccgacgccgtcgtttccctctcattaattacagatcggtagagcggatacctcatacattgttccatcgtcaccgtcctgaagttgtcgtccatcggggtggacactggacagcagaggatatcctccagacaaataggatggaatgtggaaactccaagacaggaaactatgaaatagtatgggcaaatcaattctattagctcgttcaaacaaaaaaaaacatggaaaattaagcttgggtgttgctatgcaatgaaaaaagtgccacgacttagatttcaccgttttgttatataagactttatttgaattatttcactgtttgtattgcacttctgataaattaggcttgaattgtgttatgtgcttgaggtttttggattgtctttacccttttgaactagatgggcacacccatgataaaaatcctgggtctgtcactggtcgacggccgccgggatcgcgtccatgtccgacgatgccagccggagtcgctcgccggtggtcttgcagcagcttgaggtgttgatacgatcgatgtattgccgctaaactgcactgtaccagactcctctggtatttgctcatttctagtaacagaaatggtggcttcatgccctagttcaaaaaaaaaaaaagatcatgtattgccggtttctgatactatccatagatgttcacagaatcacagttagctccgtttgtaacgttgtctcacgtttggatccaatcatcccattcaagggggtttcggagactaaaactccgaccttttttgcgacggcccatgaagaactgtacgttccgtgcgttccccgtgtgtgtaacaacgaagatacatgggttggcttggtttgtagcctaaatagagcttaccaaaattttgtcaatgccaaattttggcaaattttgatatgactaattttgataaggcaaagttgtgtttgaattgaagccaaaatagacaaaattcactattgaaataacccattttcttaggcatgctaaaatttggcttcaaatcaaatattgttaagcctattttatatctcaaaccaaaccagccctatatgactatatacggtagaaactacaaagatgtccttgatgctgttaatccattcattatacagtgggcatgaattcatggagtttcttcctattagacgagagccaacacttccatgtcttcatcggagaaacttttagctactaatcacattcaatattctcttcgagcaatgcacagcagttgcgtggaagttaagaggaaaaatatatgatagtttccaccgaataatcaagtgggctagttgggacacatggtcagcgatttgagataccttgtcatttacctctgtacatgtagaagtcaacttattacagatatgtacatacccaagcaactgcactctttgcttgctgaggagactggagttaaggacttcacattgcatttgcatgttcttggctttaatatatacggatgacatgccagacaaaaagttaaaagaaaggtcgcggcgaatgcaagtcgaacgatcatggattaaccatgacaccttgaagcaaacatgggtgaggtttggcgagttgctctgcctcaagggagcagctctcgctccccacgctattgttactctcagggacagggagtgcctccttgttcttacggggggcacggcatcgtacccacaggtatgagaaccctgcaaaggccgcctggctcgcaaactgcacgcggtatactaggcttatctcccacaagccactgcccacgttaacggccaaggtatccgcatcatacccttcgaggtccgatttggaaaccatgacgaatgtcttctcgtcaaatgcaatgaggttgcgagtggcaaggaacagcggtggtttcattattgggctgtccaggcaaatggatttcccagatttcttcaccctaagctggtagaattgctcaacagcctacaaaatatggcatgcgacacatcagcgttaatgaagtctgactgttgaatatgaacaaaggagacaaaaacataaaggtgttccttgcatactgtaaagtatctccaaacatctaaatctaaaagattgagttgaaccggttcacaaaacaaaaggtaggggcagcttgatagccacagtgtctattactatcatgaatagtggacaaaaccttatctcttttctggaactagcaaaaatgtaaggagctccttgaccactaaaaatcatttcaaatatccaataataagttgcatatattagtgtctaacaattttttttcaagatggaagtcatataaatgggtccagttgatattgaaagcagtcctatttaattctgaatgcataatattttttttcacaataagagcattctgaatttaagagaaacacagccatgaaatcattctgcccacaagcacagaattttttttgtggcagcttacctgccgctgtgcagaagctaatagcacccttggcctgcgcaagcgaacatgttcataagcttcagccggagtcatttgtttgtattgcacctaagtacagagttaatggtcagtatcaaatttcgattatataattaagtcgtatctgcatggccaaataacctaacataccaagtagcaaagaacaactgttgtgctccgtccacgtccagctttgcagtgaacatatgtcaacttcccacacaaagcatttccttccaagattaaaacaacataaataaatacacgagacaaacctagttaaaaatcacaattgcaacagcacaataggatctctacgaaattaatgaacttaaatttttgtctacctccccattagaggaagtgaatatcacaacatgcacgaaaagtaaaaatgtagaagagcaagcagagcaaaaaaggcagtaaataaaaggtcttaaattttttgtatccacaacgtagcagcatattcagtcaagtttcaagaggaaactgcagtagcatactgcaaaaccaaatggcgacggccattatattggtagagttaagtacaatgcacaaattatttattacagggtgttgggaccaacaaacataaaaaacatctcttactacaaacaaaccaaaccaaacataaggtatcaaatcacaagttctgatatctactcatgcaatgaacagtacagtcaaaaacaaactagaatatacatagtgattccgtcgtattataggatatgcaatttgagtagattcttactgtggatgaagtcagcagcccggcaaaggttctcaaatgatggtgcataaagataatctctagttggtaacaccaggttttcaattccatgagcctaaaaaacaaaaagaccatttcagttgtgtgacctagaactgctagttatttgaacattcgctcatgaccagcaggcagaaacagatatatgtaaaatttagggaagttagcatggacatggcacatcagttgtaaattacaaaaaaacagcgccagcgtgattagattacatgtaaagattgcaccaaatgtacagtttaacgtagaagaaagcagaatgttaaaaaaggagcatgttgcatgaacatttcaatgcctaattagatttcttttttctgaactaacacaatgtttgctataaccttgtcatttaggttgaccatgagtagtttacatatcactgacctaggatcttcaatctaccttaactaccacagtcaggtaataacaatatagtacctaacaaacagcgatttgtggtcccatcagctaaacaaaagggcgcttctagtatttttctcaaacccttgatctgatgggtgggcatctagatggcaaacacagaaatctccagtaattgctctcttcacattgcagtattgcaccactgagaccactggaacctgattatgctatatgccagtgtggtttacaacaaggccgtgcacctcctcgttatcagagtaacaacaaataatatgcaggagccatactcgcaggaaggaattaacaaacagaagcagcaaaacttacagaactacatattattcagcacatttgatcagtcatttagtggaatgatttggccgtgtgactacctcatacaggcacctgggaaccagcctctcgtaggattcattcagtgtcacaacaccgcaaactccaagctccttcagccgtagaacatcgctggggaaaggaacagcaccgagcagaacatgctgatcgaagcaaaagaaaagtacacaattagagcagagtaaactataactctaaacagatcgagaaatcaatactgcagaaaaggtagtgccaatcacccacatacaggtccaaaacactaaacgaatcgaaattgaaacaaaaatccaaatacagcaagaactataaacgaagaaaatctcttctccactatgcatatgcagtaggaaagacctaaccctaaacgtttggagtgcaaactgccatgatggtcagcaaaccaccgtaagaagctacattacagggcaaaatccgtcggcggcacaagatgaacgcgaaagccacggcgatcaacaaccagaagaggggggaaaacctccaaaaacaaccgaaatcaaaagagggggtaggaaattttccccacctcgtcgacctgatcccaccagtggaagtgcggctcgaatcggttcctgacgacgttgtacaccagcgtcgggtagaacagcatccgcgcgccgacgcccaccgccgcgcgcttcgcgtcgaaagccacacgcatcaccaccccaccctcctcctccaccgccgccgccgccgccgccgccccacgacgcagctgcagcagcgccccgccgccaccaccaccaccaccatccccacctcctccgccggaatcacccggaagctcctcgatccgcatctcccccttccctccacctcctccaccccgcccaaatcgacccgatctggaccgatccgatcgggaaaaaaaacacacacaccagaaaaaaatcccccccaaaaaacaacgaatcaatcgatcagcgggtggaaaaagggaagctccgcagcgcgaatcggagcagctgggcggcgcgaggtggtggtggtggagcggaatcgaattgaattcgcgattccgcaaccgcgcggaagaaatcgagaaaccccctccccttccctcgcgctcacgcctccccaccctctcctctccaaaaagtcgaaactgcccaaaccgagcagcaacccccgcgcatccgattagtagtacacccggccgcgcgcgaccccttcgtctgacatgtggggcccacttccaccgacagatggggcagggtaacggggcgggggcgggggcgggggcgggggcgtgggtcccctagaggtgacatggcggccgttgatttgtggatgggcttggatccgagcactgactcgaggacgcggacgccacgtggatttgcagaggtggggttaaggagatcgtgtggggggttaaaccgctaatccggtaaagtggatagttccatgcttgtataggacgttaatcgcttaatccattgcttcatctcgcagtgccttctgtgtgtttatgtcattatctttcttttttgtttgtttgtttcgttttggaacaaatgcacgtatagctatagatttcttcacgaaaataaaagtagagatgtctaatgtaatggacatgagttatggtgtgatgtagtcactcaaagtataaggcgaattagttgttacgtgcctaaaaagaaacattcttcttaagaaatttttcttgtgccgtattgcttatggggtgttaagattcagggtgtaaagtttttgcacgtcacatcatgtattatatagggtgtcgcatagggtgtttgggcactaataaaaaactaattacagaatccgtaagtaaaccgcgagacgaatttattaagcttgattaatccatcattagcaaatgtttattgtagcaccatattgtcaaatcatgaagcaattaagcttaaaagattcgtctcgcaaattagtcgcaatctgtgcaattagttatttttctaatctatatttaatacttcatacatgtgttcaaacgttcgatgtgagagggtgtaaagtttctttttccaaaaaaattgttaatttaccaaaatattcattttatatctacaaccgtgtagataatgcatcacagacgctcggttaataatctatgtcaagttatgcctatttcaatctgtttcaaattgagcctatttcaatctattactaattggaaatccaaataactcgtgagtttcaaaagtagcatttgtaaagttgaaaacaattaacatgatgatgacctgttgatattcctcctaactttttgcctacctgttctttccagcgtaacacctcactccttcactcatgtctacacattcttggaagcacaacaacccatggacattgggcattcctttcgatgccttgatatggtgtattgtttgtttgttttcagagcaaaacttatccccaaatcaatttcagcatgatgccaggatgataactgacaaaacaaccgacaacgatgcgtcagcaacgcaccaagattagcctagcgtgcttccaacaaccaaccgatctaatctagttctcaacaagctgacatagtatacagtagagagaaaagtacagagaaatgcagtactgaatgcagcttggtcaccacaggaaagaaactctcaagttaattaattacaggcttaattacagctactggtgcaactgggtaaatttggaccactcatccaaccaaggattggaatcaaaccagcaagctaaagtctaaagggtagcctctgatcaggatcagattcttcaccagctaactgaagctgaatgctgaatgcttagattgcttgctgctgtaaagggaactgaactgaactgaatgaattacaggctgaaacctgaagttgtttcagttaagttcagaagaagatacagtagaagtaacagattactgctatgttttactagcagattagctcatggcaagatttttagataatggaacagatatccagtttgattgccagatgcaacagtcgatctccttgcccagaaattgagcatgaacatgcactcactctcattcatcatctacatgaatgtaatttgtttacaggtggttcttgataactactaattagctatcacaaatacaaatagtaccgtactatctatctctgctcaaaacgagaacaaaaaaaaaagtaaaaaagtggcgccggtgatcgccggcggcgggcggcgggcgagctacttgccgtgcttgacaccacgcggccccgcggatttctttatcgactcgattctctgcagcctgatctgctccctgaacctggcgatgaactcctccgccttcttgtccacctcgttctcgtccacctccggcgacgactccctcctcggcgagttccccctcgtcgagagctcgccgtcgccgtcgacgtcgctgtcgtcgtcgtcgctgctctccgaggacaccgtcacgttgcccaggatggggtcgctgctgcctctctcgtactggaacctgggaatggattggtacgccctgtagccaccgtacggatcgtctgaatccgatccgtgaagaagagccggcgcgtcgccggcgacggcgacgtcgggttgttcttggctctggctctggagtgattctcttcctcctctgattgttctcaccgatttggcaactgggtagtacgacgaggaggaggaggagctatctatggagattcttggcttcgccgacgaggagttgctgctgctacggctgaattcggaggtagtgaagctgtgggaggtttgctcctgcagctcctccttgaagctcttcgccgccgtgcggcgttcggccgccggcggatggtagccgtggacgaggaacggaggtggcggcggaggcggcgccggtggggatgacttgtacgggctcctccgcctggaggagtagtcctcactggccttggctagtgtctccttggacagggacgacgccggggagagcctcttcggcgacggcgaaggggggctcggcgccgacgcgtcgaacctccccgaccgtgaccgccacgggatcggcgaagggagcacggtttcatggccgccgccgcctccgccgggcgtgtcctgtgagatcctgcgcggccgcgccgcccacggctcgccgccgtcgccgtagcccgcgctggaggacgactcgccctgcggcttcagtgttcttacgggcagcgacagcggcggcgcctgctgcgccgcctccacggcgtggctccggccgcctcctgcgccgccggtcgccaccaccaccacaggctcgtcggggtggtgcatcgcgctccacgaccgcaccctgttgccacccgggctgtcgagcgccacgtcgccgccaccgtcgtcgaacaccagcgagtcgtggatcatctgcgacacgtacccggcggagtccgccttcgcctgcgccgcggcatccttctcgtcgccccgcctcccggcgttgttccggcggctgaacagcccgtacgacacggcgatcccgacgacgagcaggtggagcagctcccacaccttggcaagaaacgcctccccacggccgccgccgccgccaccatctccccccgccgccggcgcctgcggcgacggcacgagggggagcagcagtacgcacgccgcgaacaccgccgccctgaacgggaagctctgcagcagcgacgcctgcgccaccgccattggaggaagaagaagaagacgaagagggggaagcgggaggcagcgtgacgacgctgtttttaagctgcttttgctaagtttttctcttcttcttctctctctttgatagcttttcgcgcgcaaaataaaagttgtatcaaattctctcaccctttggcttgggctttatggccaaccatgcgttggagatgcatcgagattactagagatggtatctcttctcatctcatctattatctctttttattttgtgtttttcttcccctctactctcctaggcaagtgtgtgtagtttgagatggtgagggaggcttgaggaaaatggtataacttagctagtaagggaggaattttgtgtgagaaaaaggaatatatgcacttctctcttggtcttcttttgtttttcacgtttatcagtctcggcctctgtatcatgtgatgcaagtaacacaccgtttaatacgcgtgagtcaaaaacataaagaacatatgaaagaatatgcatttttttcgagaacggcgaaataagatgtttgtcctaacaatgatattttatttttacaatacatatgtattatgattggcagattcctaacaaaattcctattatccaaatgcacatgcgctgcatatatgagagttgttctttttgaataaaagaaaaaaaaagagctctaaacacgcgagttggaacacgcaaaaatatgaaggaatatgcatttttgtgagaacgacaaaagaaacgaactgaaacaaaaaaaagatgttgtacaaactatggtcctttatttttgcagcacatgcattatgattatcagattttataacaaaatccacaatatccaaatgcacatgccctgcatatatatatgagacttgtttctttttttttataggaaaaaagtgagcaagtactcaaaatcataaaatatgttatatcagataaacatagcatttacactacaagtacgcctttgattcgctcgtggatgttacgcgaatattgtgctgcttcaacgtgatcgagctctttgtcttctctcactgacgcgtctctgacgaaatgctgatcgagcatgcatatgcattaaccaccctgcagctgttaatctcttttcaggacaggacagtaaatccaggtaaaactgcaaaggtttttttttaatcgaactgcatttcattttattaagaagtaaattcaggtaaaactgcaaatatttttttttaaaaaaaatgcagaagagcttcatttcatttcagtgagaagtcagtttaggtaaaactgcaaatatcataactactgcgagattacaatgttagtttccatgaaatgggaattaacataacatatacttcagtcatcaagcagctgcttactctgcacactagtcatcagtgaagtcagctgcagaacgtacgtatccaccagctggacagtgtacctgatcgtcagttgagcactaaagttactcttgtacatatccaaactaaaggttcatgaaaaaaatacatctttgtggattaagacgaatataagctcgttcaacactttgcagtaaactacacctaatcctgcataagctaggagtagtaatttaaagacacatcataaagtagagccaattaaccagcacacagtatggattggtgattagatgagttcgatacttcgatggtgattggaacaacaaagatttttcacacaactgaaactctgtaccaactagaacatcggatatgcagacagagagagagcaatgcaatgcaaggtgatctggagacctgaaaaaaagaagaagaaagaacatgaacatttgcgtggttaaaaaccaaagattcctcactcttttgggtggcgtacgcaactactgcttctgctgctgatagcttttctgcaagcttaggtgggtttctgaatgctgatggtagtgtggcgttcatgcatgcatgtggtgggattagttgcgttgatcttgtttttgagggcagcatgagatgctcctactcatctcggttcccttttggctttgagcatcttttctccttttctttttcaaatggtttgggaattcagctgctctttactgactcatcaccgcacgccaactttgattttttttttcgtactacatcagtcaaatttttgtaagcgagtgtcacacttcagttgatgcgtgaatcgacagaatctgttgctcttggtattgtgaagcaggcaagcagccatggcacatggcagtgactaaagttcagtcttgacttccagtgctcgaactgctctagcaactttcagaaaacctctcaaactgaaaaaaatgtacatcctcttggctcttctccttagtattttttccgcgaacatgcaaaagacttgcatatctctgtacgctctttagtaatagaaaatagaacgttcacaagatacaaatgatgaaattattcaagatcctttaggccttgttcggttaatctccatgagggagggattggagggaatttatcaattttgctatatatttgtcgacaaattttaccccaaaaatttgacagatgtaattacagtacaatcgtagtgtaattacattgtaacttgcatgtaattacactgtaactatagtgtaacttgtatgtaactttcaaaaatctctccgtaacatgttatttcgataaaatggaggttgtgggaataaattctttcgcatatgtgtgtgctatgatttgttttcttcatcaccaaaataaatcttgtaatagatctaacgattcaaaattatgtgaaacttacatataagttacactgtagttacatgcaagttacagtgtaattacatataagttacagtgtaattacactacgattgtactataattacatctgtcaaatttttaggagaaaatttatcgacaaatgtataggtggtcccgaatttattccacacctaatatggtgtggaattatttcccttcaatcctctccaatctccttcgatccctccaaaccaaacaaggacttattgatatttttcagcgaggtatatgtgctggattaggcatgggccaagagtattgttgggcttctgaatgggttttgtggcccacgttcagtccctatgtgtgctagaaactatatgggcccgcgtaacagtgacatacgagtgtgggcagctgttgggcccacgttcaggtccatagtatccaacggccacatgaaatctggcccataaaatggccatattgatcgagctagtggataggaggccaattgggcgtcccagcccaacacggcacgggcccgctaagacacggcaactgtagcgggccgtgccttgctggtccgtcggtgccagcccatgggctaaacctctgccgccggctcttgccccttaccgggcttctgttgcatcgctgggttgggacgcggatctgcttgttcatctcatagatgagacgagatgagatgagccttcaccgattgatggttttgagagaagtccttgagagcgtttctgaataatggatggaatttctgagcaccaaacgggttttgactggcgtcctgcgatatcaaatgctaagatttctggagaagctagctgcaatcatcccatttgttaagatgagaagatcaattgataatgacacctgtgtagatgatcaattgataatgtctcgttgcacatttgcaactttcagaaaaattcagagtccaggccatgccatcctactccatccgtttcaggttataaaatatttttgactttagtcaaaatcaaactattttaagtttgaccaagtttatagaacaaaatagtactcccttcgtctcataatatagcaacctagtactggtctactggatgtgacatttcatagtacaataaatctagacaccatcctatctatccagattcgttgtactatgaaatatccaattggtactaggttgttatattatgggacggagggagtaatatttttgacccaagataaatttattataaaaatatatttaattattaatttctataaacttagtcaaatttaaagcagtttgactttgaccaaagtaaaaatatcttataacctgaaacggagagggtacttttcagtgattcagtccatccaagatgagagggcaagacctacaattagttgcatctttatgtttctgaatctggtttgcttcaaaattttctcactgtcggactaacacatatgtatgttcagaaatttcagattcagtgctgcagcgccgcagactgaattttcacggctcattttgactgaaactagggtgaaatgaaacaaagtcaacacctgggcacttcaagcaaagataagtcttgttccttcccatgaattcaattgaaatagctacaagtaaagcaccctgtgctgtgataatttcctatgaaatttcactagtagaatggagtgtagtacagataaactactcatgactcatcctttctgcatccattctactagtgtttgtagtttatctgtactacactccattcctatgaaatttcactctgtagtgttcgtaattcttcactcttcccaagcttctcggtaagtaacttgttgactgaaaacaaaaaaaaaatgctagagaatcagtcgatgagcaggcaagagcttgggaattaggaggaaatgctgccatgctttcgttggccgtagcaatttcttgactagattcttgtactaggaagctgctcgctagcgtaatcacaaagacacgacttgacctcgtacttaaggaatactactactaaacctacttcaagtaccaatcttccaatacattaactcaagatatcatcagaatctttggtactcaactcgtgcaagtggctggattttgaccagatggtcggttgctgtttgccaatttccttggctcttcttgctgatgcgcaagttaggccaaactaggatctatctatctgtctgtctacttatttatggctaattcttttttcctgatcagaaacgatccacctcgagatcttgtcaataatttgcagccgcaatatctccaacgaggttagcaccaacaaaataacaatatcatctcctatgctagtgacattattccattgatttgccacctcgagaaacaaaaagttgtgacaaccctgaaaagaagaaaacaactgcagaaaaggatctccactccaccttatctctgaagatcatatttcccaatcctatgatccatttctttattcctgcatctctctctttccttccttttgtcgacgacaggttgccgtcgactctgcaccagcaacggtgggggcatgcaggcaccgcaccgacgacggcgatcgaagaggccaagaggcaaagttttgcagtgattttggtgagtttcaagcatgcaaaccaagcagcagcagagagattcagttgggagccacctaggcatgccatgcatctttctttgcaaaggttgagacccagcagcagtgcagcgtgcttgacatctccttgtgtttttctcctcatcatggaccacttatcctatcgagatccacatatcctggcctagattcgaccacatcccatccatctcccttttcccttcctatgcagctccagagacctgcagtagacagactctgcgtagcatatggcatgatttctgcatatccattatcttgctaggcctagagatcttaacagttgggccattattgatgcaaagaaagctggtgctttgcttctttgtggagtagctgtagttcactgttgtgtttgagttcttagcatgcaaagcaagcataagtgaccagcatgtcctgacagtaaaaaaaaaaagaagaaagaaactgaattctgcatgattcttcactggctttcattctctgctgttagaagcaagcataagtctggaatgaatgcatgatgacaagagagattgttgtgttttttacgagagtggcatgaatggattggctgggaccaatggtcacaaggacatgaaggggaagggtccaattattgaagcactggaagaagctcagagccacacaagaagatgtcccagctgcctcctgtgacaggaacaggaaacaaactagacttatgaacaagatggagacccttcatgatctctgcatcaatatactccaattttgcaaccgtacaatacagacaggctactatctggttttcttttcaccaacttataccaaccaaccaaggcttaattaaacatgtctcggaaggtactgacattctcactgtattatataagactgctgaaagaaacgccacatgacccaaatacaaagttagcatgacaactacaacaacaacaacaacaaacaacccccgcaaaaaaaaaaaaaaaacaacaacaacaaacaacaacagcggcgacgaagaacagtagctgaagccgatccagattccttcggtggagaattgcgtctggatcacagcaccttgatggccgcctcgatcgcgcaatgaggaggcgcgatactgagctctagactgctgatggatgatgatgccatttccagtccagagatcatggagagcgacatgtcctcggcggcctttaatctcttcacatattcagttagttcatcaacctgacagaaggatcagtttgtgttagttttggtcagactgttgctgggttccatgaagatgttctcagatgctgattttacctgcacgctatcgcctctaaagcctctagcaactggatagcttagtatctgcagcaatattaaagattcagtcttcagataggattgtttgtctcaagttacaaccagtaatcatctaagggtaattacaactcagcttgtggctacaaagaagaaaaaatggaagcaaagtagaaaattaccgggacatcgccgcgatctgtatgaattatatcctgggtaggaggcttagttccaacactctgaggacttggaagctgcaacagaaggtttcagacaagagcattagctgcaagatcccaacatgcgtggatctgatcaaagaagtgcactgtcactgacctgatcatcactgcactcagcaacaacatcaaagaggctggcccggcgcttctttttgccagggttggtctgccggaggaagtacttctgggcgtggctggccacctgagtcgccgtcctgctggtcacaaagttcttggagatgcctctccagtcccctttccccagctgcctcagcccttccaggaatttcttgtgctcctcctcagtccatggtaccccttcacagattaatcaatcaaaggcaattaagtgtcacatgatcttcacaggaagcaacaaacagggaataattaattactcctaactagtaaaaagtttttcaggtctgagaacctgcttgtggattgttatcgatgtgttgttgaccaattgactgacacacaaaaggttaatcatttttctctctcttttggaagaggggattttcaaccaattttgttggttgctcaatcaaagatattttttttgttttttttttgctttcacggatcatcaaattgcgtcaagaattaacagtgagttggaagtttcagagtaaaaaaaaaggaatcaggtgatggaacaagtaatgaacagtagatacaagaacagacaaaaagggtggttgctcacctttcttcctctcctgcaccttgcggcggcggcgcttctgctggccggaggcgagctcggagtcgtcggaggcgcgccgtttgccgccgtcggccggcaccggcagcgggtcgatggaggtgaggttgggcatactggagctcttcttgatgaacaatccaccctccacctcctcctcctcgtactcctcctcgtcaactccgccgccgccgccgcggacctcgacgccgaacagccggaatatcaccggcggcgaaggcttcctctccgctgcctcctcatgctgctccatctcgatcggtggccggtcgctgcgtggtcgcttttggtggtgagaatgagatgaaaatggcgggtatcgtcgccgcgatgaaaaggggggattattattgttgggctctcgacggtttggaggagactactgctcccactcctcttctctgtttatttatagagggggtttatttttcttataaaatgcatatgtatttgaaaagaataataataaaaaattaaattattttaacagcaaaaaaggacgaaaattttagtccttttgttggtactccctcagttttgacttattttactagtcaaatttcttttaactttatcaattttatagaaaagtttagcaatttctacaacacaaaattagtttcattaaaactaacatttattatgcagtaaaatatatggagggtcatttaacttgtttatgtgtgtcgtgtatatcattctactttcaaaatacacatttagattactaatatgagttaagtaaatcatttgattatcaaactatccacgtgagcgcatcttgtacatatggtatgtcacctacgattgaaaaaaacacttttggaaatatgaaaaaaaaaacgtgtgtgtatttttccctttctcacagcactaacatttagaaatacacaaaattagaggaacacaatcatttcacttctacctgttattatgtttgttttgtgttgaaaaatattactaaatttttatataaattagttaaatttaaagtagtcaaaataactagcactataaaacggagggagtattaaattgttaattgacgaatcagatggtttccctgcaactacaggactcgttgacctcatctctggcatgcccaaggctaaagggaagagatgccatccctctcatttccctgtcttccagtgacgtcggtacttacgtctaaaatcttcttgaaatgctcagagaaaaaaagatctccttggttgtgcctgtggtagcatatcgaactaaatctaattgttggcaggagttttcgcgtcaatttcttggcaacgatcagagactgaacctggctacgtgtacatgtatagtgtcagtaactcagaatcttctcttctttttttttttcagggcatcattgtgtcattgcctgggtagccacactggacagaaagaacattgcaattgcgacaaaaaaagaaagaaataactgtttgccagttgggttgcaatttgcctgcagcttcgaatattccacgtgttgatcgatgaacaacagattcagatattcagatcgtacattcgtacgtacgcaggtacgttcattcgtttctgttcagcattactatatatctcgtcgatcgatgaatgaattattagctcatggttgcatatatatgtgggcataaatatctctcatcacattggaaatatcttgcattgctagctagcccttgaatgtatcgatcgatgatggcataggcataacgtatggtcgagaatactccctccgtttcaaaatgtttgacaccgttgactttttagcacttgtttgaccattcgtcttattcaaaaaattttgtgaaatatgtaaaactatatgtgtacatgaaagtatatttaacaatgaatcaaatgatatgaaaagaataaataattacttaaattttttaaataagacgaatggtcaaacacatactaaaaagtcaacagtgtcaaacattttgaaacggagggagtatataggtatagcaggacaatcgagcagctagctagcatacagatatcagtagtatttttcctcttgcatccttttctttttctgaagaagaatagatatcatcatcgacttgtttgtctttttttttttgaaacttcatcgacttgtttgtcaatggaatgcacagcaacatgcatcgatcgtcaaatccgtagtttcgtaaccaatcatcaaattaatcaaatcatgcatcgatgtgcaattgtgtatagttactccatttacgaggtagtactccaattaggactagtagtgcttttaactgtttttatcttcgttatgagtcatgaccgtggataagttcaattcacattttaaatcgatggattttcatcggtctctcctcgaggtgacaaattatgagcaaattgcagacgagagaagctagggtcttttgacagagagtgaaaaacggcaaccctggaattctcattttctcctcgtatttgtcaacctcccggtttttctacctcgtatggtatcacctatccaaacctccttaattttttactcagtagtagatagatagatgatcttagtaactgaagtggatttactgacttaactctagtgtttactcttgttcgtctgaaactaggaatatcatacagccgccgcagtacaaaactgagttaaaaaacgcacgcctacgtagaacaaaactgcactggtaaagtgggccacttgaatagataaagaaatggcccagctagtcctaatgactgaacgggaaagtccatttgacgtccctcaactatggtttgtctaggttagtccactattacagcccacaatgccttctttgaactgggctggtctttacattctccaaacacaaaaaactagtgaaagtttcgaagttgggggtatgtttttttagataatagttagggatatgttttagctgaatgaatggtgattgatactccaaaattgtatgtgctgtggtcatgacttggacaaattcgaggttgcttaaaaaaagacagggaaaatcagtgtttggcagaaatagtgtgaattcaagactcaggccttgtttagttcgcgaaaaaaaaaattttgggtgttacatcggacgtttgaccggatgtcggaaggggttttcagatacgaatgaaaaaaactaatttcataactcgcctggaaaccaagagacgaatttattaaacctaattaatctgttattagcatatgtgggttactgtagcatttatgggtaatcatggactaattaggctcaaaagattcatctcgcgattttcatgcaaactgtgcaattagtttttcattttatctatatttaatgctccatgcatgtgtccgaagattcgatgtgatgtttttcggaaaaaaattttgggaactaaacaaggcctcaatagatacttatggaggatcttttgagtggcttgcgtttctgcaatgttgttggacggtcgaccttctgctaaagtgtggtatcgacagtcactcgacattgcctcctctgcacccaataacagaagacggcgaaccacatccatcttaactatgttttttcttgccaagtatggtaccatgttctgtctcctcctggttggcccgacctcgctcttttctgtggttgttctctctaggtttggtgaccgtctgctagggctcgtttacctgagtatcttcgcaagggcttcgactctttggtcctcctggtctcctgacaactgtggaatgagcagaactttagagtattcgatcgctcactctcttcggttttcaatggtgctagagtctatcctccaggaaggccgtatgtggtcatctgctggaactgctgcttttgaggacttttgctaggagtttagtgggactccgccctctaggagtttttcatcttttttaagttgtctataagttgtcttttcttttcggttttttatttctcgtcccccgacaataacactttagttgtttgtgttatgtaattaaaacgttgttttcttctaatatattgtcgtgtaacttttttctatgttggggaaaatacttacataggatgatggtgtaatagtatgtttcctgtttcacgatttaggtcggcatgcgatgcgatgcgactcagtgactaaactttacttcgacttgacttgacttagtttacgaccttgtatttcccagtcttggacggtgatctccattgcttttgtgattttgcttaatcattttttaagttggcttttcaaaagggctccaataagtgaggtaaattagtcagacttaatgacacaaatttccgtagcctgacaaagtacacacatacacagtacacgctcgtatgcacacatgatgcacatgtcgcgcgcgctgcctcgccacgccacgccgcgccgcgcggcttataagccagacaccggcgcgcgcgccctcgccactcgcgagcttctactgctgtctctgagatactgtcagtgcactgtctgtgcgttcccggccatgtccgccgccgcggtcaccgccacgccgcgccacgcccggccgtctcctctcaacccgaacgccagggccgcggcggcggcggccgccgcggcgccgccgaacgccgtgtccaccaccaggacgcacctcgccaacctcgaccgcctcctcgtccggccgccgccgctccccctgccgctccagaacaagggggcgccgccggccgatgacctcggcgacggcggcggcgccgccaccaccgacgaccggagcggccgctgcgggctgctcaacgcgctcaacctgtccacgttcctgcccttcgtccgcaagccggccgtcgacgagatgtcgccgcgcagcctcgcgcacctgcagcgcctcctcacgctgtcgccgcggccctcgccgaaaggctccatcgccggcgagtggcggaggtatcacagcgagggcggctgggacgggctgctcgacccgctcgaccagaacctccgccgcgaggtcctccgctacggcgacttcgtgcaggccgcgtacacggcgttccactccatgccgtcgtcgtcgtcggcggcggcgtcgcagcacagccagcaccggacgctcgtgctccccgaccggtcgtaccggccgacgcgcagcctgttcgccacgtcgtcgctgtccatcccggcgtgggcgcggcggcggtcggcgcccgggtggctcacgcagcgctccagcttcgtcggctacgtcgccgtctgcgacaacgagggcgaggtccagcgcatgggccgccgggacatcgccatcgtcctgcgcggcacggcgacgtgccccgagtgggcggagaacctccgcgccggcctcgtgccggtcgacgacgacgacgacgacgacgtcggctcgccgcagaacgcgccgaaggtggcgaaggggttcttgagcctgtacaagacggccggcgaccacgtccccagcctctccgacgccatagtcgacgaggtgaggcgcctcgtcgaggtcttcgagggggaggagctgagcatcacggtggtgggacacagcctcggcgcgtcgctcgccgtcctcgccgccgacgagctcagcgcttgcctgtccgcggacgtggctgaacatcgccggcggccaccgccgatcgccgtggtgtccttcggcggcccgaagaccgggaaccgcgcgttcgccgaccgcctccagaacggccgcggcgtgaacgtgctccgcgtggtgaacgccggcgacgtggtgacgcgggtgccggcgccggcgatggcgcgggagggggaggggcacgtgcacgccggcgcggagctgaggctggacagccgcgactcgccgtgcctccgcccggacgccgggccggcgtgctgccacgacctggaggcgtacctccacctgctcgacggcttcgccggctccggccggccgttccgcgccgacgcgagccgcagcgtggcgcggctgctgacctaccagcgtcccaacgtgaggggcgcctacgtcgagcgcgccagggtgctcggcttcgagccggcgacgccgcggaccgccaccgccaacggcgccggcggcggagccgaggggcattacggctacttggctagcccaacatgatcgttgcgtactactaccactgtagcatgcatgcattgtcgtgtaccaccttaattgttataggagtaaattgtatcgatagtacaagaacttgttatgtgggtgcaatctaatgtatggacttgtaaaatgcttgttttgatacgtgaacttttcttgctcatatgaattaaagtcaaaaggacattatataactaatttgttgatttagatgctgattaggatactacgtagagacatacacttgttcaataaaaagatagaatgatatatagtgatcgtagagaaagatataaaataccgagcaatgattcatgggttagaaacatatgaaattcaagataaagtagagaacaaatttataaatataacatattttatgcatactcactattcgtatggacgccacatcctaatcaacatcagctaggtaaaattaaccttgctaagccattttagacctagatcacacgtattagataagttcgtgtaaaaaaagaacattttacaagttcatatactaaattgcacacacctaacaagtttatataccaccaatgtaatttactcgggaatggtatttaactcgtaattgagatgtatctgcacgtgtttcttgatgtgcattaattctactgcatatatgatcaagaggtgatgcggttgagtcaacttaacggtgaactttttttgagaactaacgatgaacttgttggtgtagtcgtacgttatgcgtatgctttttggtggcaaattaggtggtcgttatcaaatgactggtttctggacattacgaaatctgtcaaccatcagtggcaaagctatatagtgtttggggtacacatgaaccccccaattcctaatttctcacttaaaaagactaaaatatatagtgttgtattaaaattttctatattctcaatggtagtgcaccctcttattttgatgctagcttcgcccctgtcaaccactcatgatcgtgcatcattgggtgcatatgtgcatcatcaggcacaagcatatgtgacatacagtaccgatttgatgcttgaactactgaagttcgtacctcaaataccattattattatttagacaagagctccaggactatttgttactccctctataaataaaaaacgaattccctgtcaggggcggatcccatgtgattcatgggtattcacctgaatacccatagaatttttaaaaaaataactatatataggtatgttatgcatatatacatgagaaattagaaggaagtacagcatgtatagcccaaatgaaaagaagcccatttattcgcagcagaccatacattcctccccatcttggcccaacgaataggcccactggcccaaaaacgaacaaaaccctagtccctatcccccggtcagctagtccccacgccttctgtcgtcccagccccaatccgccgcgcctccactcatccccaccgacgggcgacggggcatcgagagctcgacgctcggcggcgccggccgccggctcggcgcgtcgccagaatcgccaccagcctcatctccctggaccctggtccctgggcctgctgctgcggaggcggcgtggcctgcgacgacgccgccgcctcctcggggacgggcgacgctgagcagctgaggttcgcacggacggcggcggcgctgcggcgcacggcggcagccggttgcggcgacgcacccccgcgtcggcgcgtccccttggtccctagacagctggacagtggactggcactggtaaaataaatcctcttgtcaaattccccaagcgattggccattgcttaattgctattgcttagaagttaaattagtcagaaatttgaactgtaggtcttgaaatttgaaaaatgaagaagaagaagacaatagatttgaagtctttgtgggaaaggtcaaccaagtctcagaaagtagcttccacctctgatccaaaaccattaaccattgagagtgaagttcagatcccagaaaatgccccttctagtcctattcagctactacttgaagcacccaatgcctatgatagtgatatgtccccaagtgtgcagttggagatagacatcttgactattgtgctactgtttgtacctttaaggctttaaacatgtcattaccactcctgtatgattttcccagtccaattttttgagttctgtatgatttttttttcagctttgaataccctttgctcaaatcctggatccgccactgttccctgtgtccagatttatattcatgagctattcttttactacgatgaagagagtgccaaagaggttaagcaagcaatgtgcaaactttcgttcaaatgcttgagccgctgaaatccatgttggattcaccccccattcgtacaagataggtcatatattcacatgagtttcgtaacttcgttcagaggcttgtttctgaaaatccgtagaaagaaaatctactccatatatataatatgcatcactctttgaggaaaacaatacattccatccgtccaaaaacataactatttttggaatttagttttttttttccaaaatttaaaatatttcatcacctatttcatctcaactaatcataattttctcctatttaatgtcccgctacgttttcttatcaaccaataacaatctttcatcattttatttgacctactttttagatttatataaagtctctataaatacattttaagatatgataagtggatgtttctttctttttatatgtgtgtggggggtggctgaatgtaatatgggcaacaaggacagtgacaggagtggcaacatgcagggacaaaccggcctctctctaccacgttcacagcgagaatgcaagtggatctgtggatgcatgcctcggtggcgtgcgtgtcaacagtggtcagtgtagtggatgacacattctttctccccttgcactgtcggagacgatatatatgattccatcagttaacttctctcaaatcaaaattttcgtttaaatattttaacttttattcaagttataacaaaagctgtacagttgtagattaaaaaaactataagtgatcatttccacatctattttatattctcactagctatttctccgaatccaaaactctccaaacaaatctagtttttctcaaacgtgtaattggaatgcacgtcaatatattaaaagaaaagaatatttgttacgcaatgcaatcagcccaaacaaaccttgtcgcacactatgctgctggatggatcacgcaaatgcaccttagtggtagtggagtagataagcagccaactatcaaaccgcaacgtgctcaatgctaacgacgtgctagcctatggcttattttaccttttagctctaataaaaataaaaaaatatatctaactgcttcagcagacacacctgcttgttgtcctgctgtggcttgcgttagatttgtaataatatagtttattatatggttgattgattaattaaattattagcagtcccttaaaaaataatgtagcagtacttgtgtagtacggactatgtatatattttgatgtcagtgtatgcatgtatgggagttgaaagaagcttagatttttaaaatgaagtcgtcatactgtgtaaatcatgttgtattaccgtaaccacttgccgttgcctcgggatataagtttactttagatccctcaatttatcattgaatctgaaatccgtcctgaaccgtactaccagatatgacgtgtccatcaactttcaaaaccaatacaaataagattccaaagcggtttcaacggtagtttcggctgacgtagtgctaaaccgggtccccttctccgccaaccttgtggctcctcggcatggagaaggatggcggtccatgggtggctgttggatgccgggaaggagaagaagcaagaaaggagaaaagagaaagaaaataaaaggaaggcgatacccactgcatttttttatttttaatcagacactcactgacatgtcgaccccatggtttttcttgactttaagtgccatgccaatgtcatgtaggcgccacatcagccgaaccaccatattgggatcttatttgtattggttttgaaagtctagggatgcgccatatgtattgcggttaggtataaattttagactcgacgacaaattaagggatccaatgtaaacttatttcttgtcttggtgaactactgggccaagatacccagtctgaccaaaaggcccatttacaggtcggcctgccttgtctcgctgcgttgcaattgaatacggcccaacatggaggccattactggcaggcctgctcgcggttcagcaaaacggcccattaaatactcggcccaattaatcttggtgagttcgaggctatcccattccggcccaaactgctggtgaattgctcctgggaatacggcccaaattgttcggccgcgcttagggccgtcggatcaagacggatggcctgcgatgctccacgtagtcgaccagccatcctccgccctcgtcgccgtttccgccaccgttcccggcgagctccgccgcctccttcgccgacgatctggtcttccatggccagcaagggaaattctgtagatctcaggatctctcaaccccccctcgaattcgtccaacccgagtggaaccgctcgctgagaggagagatcaagaggttggtggtggtgctctgctcggcggcgatggtatcctcctcctccccaacctgcttggtccacgccgcctccgatcgattccgcggagatatctatgggctttcctctcgcctccccgcgccgccacggcagcgcacactaggtcatcaacgggcggatcgctgggcgggatcagccgcccccatcgatctcgccatggcggcgaggcgagtcgtcagcaccctcactacgctgcgctgcgccacccacttctcgtctgacgaatctgccgtcatcggttgggattgggatttggtagtgcgattgttggtgttcgtttatgttcagggtgtgccatttcttcagtccttcgatacatggaagttcatgtgtgccaatgaatgtactgttaacagttttgctgcaggtccaatacatgttctctaccacgatgccgcaattcgtgtggatggtgattaagggcaatgctgaattgctgatgcatttcttgtttgaatttcagaaggcgattggagccggtgatcatttgcttggggttttacgtgaataagatgggccaatgtgctttggataacgcccttcagactcagactcttcagtggtaaggacattggttcaaacctatctaatgttttgtaattgatagaactgtccggtttgacaatagatttcaagcattagctcaaatatttatatttctgtagatttctgtagattacattgatctagctggctaatgatttgctcttgcatttcttgtccttgtttgcaacttgcatcctgattattaatttgtccttggtgaagtcttaagtgatgatcgtactgttaaaagtcaaaaactatatgctcatggatcttcccgactgtgccaccactccacggtagtggcacaaaaacacgagttatcatcaatcaaaacacctagtgcaactgagttagtctgcaaagccatgcgcatacatgtgttcctttggtttgatgaagtaatggagtaatcgaagtgttgaatgtgatgaacatctctctgtttaggtctcttgtcagaatgaagatctgttttttccccagcaaaccaacacctaaatggtgctgtgtgccaactgccgtaaggctcatccagtgctcgtcttttttgttacacacactatttcatggtcaacaaaaaccacaacaacaaccagctctcttgcagacgttgttcccagagaagattattttggctcttcttctacataggagtagtacgttgcaggcttgcagctgatgtctcttcttctttgatggttacaggtcaaaagctatttgtcatttctctggcttattcacagaaagcattcttccaactactgctgcaatgctgctgctactccactacaaacaaaactagggaaaaaagaagcaaggatgcatcatcagattgtgtgccatgatccaagccgaagctccatcgatccctacacgaagcagcagcaacaaacttgtagcacaccactaaactaaactctgatgactgacaaagtgaaatcggcgcatcaaagaacgagacacacaggtaagcaccacataccccctttgaccgatcttgcctcagctacaaaagacatgctcgcttggatcaaatctacaaaaaaaaatgcaacttcaatctctcttggatcaaatcatcaaaagacatgctcgcttctttcaagaaagaaagggaaaggaatctggtgatggtctcctttccccttttttttcacccttttctagaataaagggaatgttggttttgaacaagatgatccctaggaaggacagtttaggaggtaaagaatatgctactcatagcaatgacattgagtaagatagaatgctcaatgtatagaaactgaaacacaacgcaaagttctataggttaggtgcagagtaagtaagccacagcatcatgccattaaaatgtgccaatacataaggttaccgctccatccaaacaatgagtagatgagtactagagtagtactattgtatagtaataccttcgtgttgtacaatattaatagtagttggtttgaacaaattagaagatgtcctgaaaattcaggattagtccccattgagtgctcaaagactttgtcatgactatataatctcgagtactcgtagaaaatagagtttgtagactaaagtaaagtggtttagtcatctaatttgggtccacaatataaacaataatattagttcactcacatattcaactccaggaatttttgaagcaagagatatatctagctaaaaaaaacttgaagttggagttgccagtccatagagagaacaaatttgtgaatcactgcctcttatatatagttaaggtctcctttggagcgtatgattttcgaaggaatttcataggaactgaactgttttctaccaagaacccataaaaatcctgctttttaaaggattcccaaacctgtttggaacatgagaactgaaccatttcaagcgaaacccgctccaaaaccggtatagcatacccattccttaggcccacgacactgacagccgcagcttatcaaccaaaccctctagtactactgtacctgttcttcactaacggtaatataagcattgcaatcaaacagcaacatctaagcagccgaagcagaggaagaagacagcagcaacagcagcagcagcagttcttcggttcttcctctgttcctctgcagctcactcggattctctctctctcctctgcaaagcctgcaacgcctgctgctgctgctgcagtttggtttctctctccatctgcatcctgcagcttctgtcctttctccccaacctcttttgtccgttgcatttcacctccattaatccaagcacagagagaggagatgcatccgtcacgctcactgcacgccaagccgccaagaagccacggtcaccacgcgcgctcgcgctcccagctgcccaccgccatttctgcgcccaaccaagatttccagttccagttccagcttctccccaaggtgttccagttccacatggacgtcggcggcggcggcggcggtggtggtgaagggaagtcgtcggagaagaaggttcttgctcagctggagcaggtgaggctcagcattgcgtcgagcgaggacgaggaggacggggacgcgccgcccaggagctccttctccggggcgagccacccgccggagccggtggatgagatggatacggtgttcgttgccgtggatggccgggacaaggcggccaagccggtgatcatgtgggacgcgtcgccgccgcagagcggcgcggcgagcccgcacagcagcatcgacagctccggcgcggcggccacggtgacgagcatcgcgcccagctgcaccgtcaccagcctcagcgccaagaccagcgtcagcagcagcgcggccagcgacggcagcgggtggagcaacagcacggccggcgccggcagcgccgccggcggaggcttcggcgggaagccgcacaaggggggcgacccgaggtggaaggcgatcctcgcggcgcgagcccgggacgggccgctcgccatgggcaacttccgcctcctccggcgcctcgggtgcggcgacatcgggacggtgtacctgtccgagctcagcaacgtcgccgtcggcggcggcggcggcgcggcgagggcgtggttcgccatgaaggtgatggacaaggcgtcgctggagagccggcggaagctgagccgggcgcagacggagcgggagatcctccagctgctcgaccaccccttcctgcccaccctgtacgcgcacttcgagaccgacaggttcgcctgcctcgtcatggagttctgccccggcggcgacctccatgctctccggcagcgccagcccggcaagcacttccccgagcacgcggcgaggtaattttcactccactttaattccatctcttgctctaggctcctaatcttgataggattagcattcagcaagaaaccatactctgtttaaagtgacaagatcaggtatggcagttcagagctgtcactggagaaatctttcagtattgcagaaattttcttctctaaaaaattaatcttgccaagcctgaagctggaactgatgcatgattgacacattaacaaaatggcttagttttttttttcagcatttcaattgacattagtgtattaatagtatagtgaatggattatgctccgacttctcgagtggggcattttgcctgtctgctgctttttctatgttgtggaacaggatatctaaaattaacaaatctagcagaccacaaagcatgtgtcagttgtcatgctaaaggttgatagtagcattttccccactaacccattttgtgttcgaattaggtatctcaaacatagacatcttttccgatctgtccctgaattaacaaacatgattatcctacttgtttttcccaatatttctgatgtatcatgtaatcttcttcatgacgtttgtttgatccgccatattcttctcttcatcagctcatcttaaactgaagcatacgatttattcttttcttttccggggctttgcaggttctacgccgcggaggtgctcctcgcgctggagtatctccacatgctcggagtggtgtaccgagacctcaagccggagaacgtcctggtgagggacgacggccacatcatgctctccgacttcgacctctcgctccgctgcgccgtctcgccgacgctggtgatgtcgtcatccctgggctccgatcccaagaggggcaacaatgcgcagtcgtgcgccgcccagccagccgcctgcatccagccgacgtgcttcatgcccaagctgttcggcaagaaacccaagagcagccagccgaggcagaggtatcatcatcagcagcagcagcagctggccgccgcggcgttgccggaggtggtggtggagccgacgggggcgcggtcgatgtcgttcgtggggacgcacgagtacctggcgccggagatcatcaagggggaagggcacggcagcgcggtggactggtggacgttcggggtgttcctgcacgagctcatgtacggcaggacgccgttcaaggggcagacgaaccgggccacgctgttcaacgtcgtcggccagcagctccggttcccggaccacccgccgacgagcaacgccggcagggacctcatcagggggctgctcgccaaggagccgcaggggcggctcggcgtgaagcgcggcgcggcggagatcaagcagcaccccttcttcgacggcgtcaactgggcgctcatccggtgcagcaccccgcccggcgtgcccagggctgtcgagcccgtcgccgtcgccgcggcggtgccggcgacggtgatgtccaagccgccgccggtggacaccgtcgagatggcaatccacagcaattgcaacagcaccaacagcagcaaaagaatggcagggcctccagaggtagagtctggaggcaagtacctagactttgagttcttctagcaaggtgaatgcaaagatctgccaaatattgcatcaggcagctgagaaaatatgaagtttttaaccatatacttgttttagtttgagttgtaactgtagtcactagtcagtgagtcccatactttcaacatttgggcaaaaggcattatctgaatctgaccaaccagttgtactactgtgttttcccctctgctgttgcaattctatcacagatgaactagttagcacttagcacctataaatactccaatagtaggcttaatggagtagcaaaaagtttccatgtacagcatgttagtgacatgcataatcacacattagttcttgccatgattatatacaaaaatgttactatcttttacaagagcaagcatagatgttcttttacaagagcaagcatagatgtgggaagcattgcgtatcaaaatgtgaatgcccagagacacataagggcaatagattgtgaagaacaagagaaggaattatggagacacttcacaagtcatcacagcattagtagtacatcattagttagtaagcattagtaactctagattagtgggttacaggacgaggttatgggaggcggcggcggcggcggcggcgaggccgacgccggcgggagggttgcggtggcgggagagggtgcgcagctgcgcgcgctggcactcgaggttggagacgagatccaccctctcctcccgcggcagccgcacgcgcaccgccctcgggaactccacgaaccccttgatccccctcgcgatgtgcgggttctcgc

SEQ ID NO: 66366 - DNA, 31956 bp, Oryza sativa
gatgatatcatctttggttgttcaactcacgctttggttgtagagtttgctgagactatgcgcagggaatttgagatgagcatgatgggtgagttatcgtacacgaaagatcttttgagatggttcaggatggagaattgcaaggcaatttcaacaccaattggttctatagttgtgttggatcctgatgaagatggtgaagctgttgatcagaaggagtatagaagtatgattggaccattattgtatctaactgcttctaggccagccatataatttgctgtgtgtttgtgtgcgtgctttcaagcttctcctcatgcttcacatcgtcaagcggtcaagcgaataataaggtatttaaatcatatacttgagtttggaatttggtattctacttcattttctatatgcttgagtggatattctgatgctgattttgttggttgtaaaattgataggaaaagtactagtggaacatgtcattttcttggtacatcattgattgcatggtcttctacgaaacaatttagtgttgctcaatcaactgctgaatcagaataagttgctgctgctagttgttgttcttagattctttggcttatatcaactttgaaagattatggtcttacttttgagaaagtttctctcttttgtgataatactaggaaagaaatttgaaaatatactttattttttcatattttgcgtttatatacctgactgtaattaatttgcaaaaatatacccaatccgcggaacggttgtgcgggagcgaggataaaccaaccggtcccgctagccggggacgcggtaccgcgccggtcgcgcgggctgggtgagtgcggcaatgctcccgcatgccggatgtgcgggaccggcgctcccacatgccgcccctcatctcggttcccaaattggatccgatgtcctatgcacgaaaaacggagcaggccattagcacataattaattaagtattaggtaattttttttaagaaaatagattaatatgatttttttaaacaactttcgtatagaaactttttacaaaaaatacaccgtttaggagtttgaaaagcgtgcgcgcggatgagttggtaatattaggggaagaacacatctccaacaacacgcggcctgctcggttccgcgcgttggaacctcgggacagcctcggtcccgcgccgctgttatgcggcaccgactcgctatcccgtgggctccatcgctcccgctcaatggcatcgccgtaccgactcggtcccgcagtccagtcgtgcgggaccggctcggtcgcgcatcccggttccgcgtgactggctcgggtttcgctcccgcatccccagtctgcgatttgtcctcgctcctacgcacccgtttcgcggattgggtatagttttgcaaattaatcacagccaggtatataaacgcaaaatatgaaaaaataaactatattttcaaatttcttccataatactagtgctatcaatattgctaagaatcatgtacaatactcacgcataaagcacattgatattcactttcactctttgagggatcatgttgagaaaggatatgttcaattgacgtttttggatacaagttgcaacttgcagatattttcactaaacctttggattctaatcgctttgcttttcttcgtggagaattgggaataattcatccttttggcatgatttgagggggagtttttgtacctcatggttttattaagcaaaatttcataataagaaaaattgagaaaagagtgttttgttttatacatatagtatatttttgtgcatgctagcaatactatgaaggtttatttgtctctagcatagcttgtatgtattttagtctttttatgaggcttagatattggttttaagggagatgatgcatgacacttaaactctatacttgaattaagaaaatatgcaatattaatgttagtatatggtttgatttataaatgcttatatgtatatgctttattgattttttattcctcaaatagcttcgtaatttctcattgtacaagagaataaaatatctatgagagaaaaaaatgaataccgaatccttggaaacagtcttgatgacaaggacgtattcgatgtgggcaaaaattatggctgccgaatcctcggaaacagtctcgacgacaaggatgtacccggaataattgagagaaaaaaatatgagcaaaaaggttcaaataaaagataaaaattctcttggttgttttgtgctaaagctaatttgagaaagaatgctaaatgcaataggtatatatatatagtgtttatttttcaacctatgtgcttgtaaagatgttgcattataaatcgtatgaaatcttaaattttgattgttgaattgatcttatttgtaatatatttgattcatgattgtactttaatgcatgcttgctatattacagatgggttcatcttctttttattacaacacatgacttgatgtgctatatgtatgctaagctcttaaatattaatgaatataatttctatgcttgatgaattcattgttaaaagggggagaagagaagtttttcagaagagcatgtttttctgtttttcggacaagggagaatttctttctcttcaaaagtgagagaagttttcttttagattttgagcacgacgtgtacttttgtacgaagtgtgctttttactatttttgtttttattttttcaaacaacaaaacatttttgatgagtttgccaatgtgttcatgaagggggagattgtaaaatcaaagtattttttattcttattttgtgatgaataattggcatatgagattattggttttggagatgattgattttcaggtgatgaacagtgttgctgtttttgtcaggaccggtcaaaccgggctgtgcttgccggtcagaccggatttatgtgcatggcgcggtctgaccggccgactctgtgtcagttttggtttcaggttgtttgtttggatatccgtgattgttccatgtttatggcttctagatagatactatgcatatgtaatactgttgtttgcaaataatgagtcaagttggagatagcttggtcttggaatatggtttcttggtttgattcatgtgtaggtgacttgatgcctcgggagagtattgccggtgatggatcaggagtcgacttggggataaggcgatgtccgtgatggtcagatatcatgcgggatacttaggctacagttcaatgcacgtggttggtgaagattccatatggcatacgatggaggtattgtctgcgtatgggatgcggagtcgaatttggaaggagtccaaatttggtatgattgttgtttgtaaagtttgtttcttgtacgagaagatttcctaggtggattaggacttctagtatgagtttggttcgtgactttaggctgcctacctcatgtataaatagagagggagtgtgaggcttcccggtatcgcttttgagagcatcgaattgtgaagaagttaggatttcgagtttagtcgagattttcatgaggagtgctgttgttgcactttataaacacagagagaagtaataaagttgtgatctattttgagagtgcggcggtcagaccagcggatcaacggtgatcagaccggcagcggcgacaggaggtggcgacaggttttggtggttagaccgagtgatctataccggtcagaccgacggcttccaggcagtcagaccggcgcatctactttggtcagaccgcgatccgtcgaatttgagggtaacttttaattccgaaaaaattgggtttttgggtatagcaaccattcacccggccctctggttggcttatttcttgtgtttcgattctacacttacatggatttgtaactaaccctggcagggtgctatctttgggctattaagttgcaggtctctcaaccaattaatactagttaatcaaagtataacaatactttgctgaaagtagtagtttagccattctacggagctgcctggtacaaattgcatgatctatacatgaccccaggaaaacaaacatccccacaaacttgttaaagcaccaactgaagaaagttagattgaaagtctagttatcctttatcatcgacatcctaatgatgttgatgtagtgtcgcacagccagaagtaagccaaccaagggagtacccaaaaacaaaacttttagcgcaattaaaagttaccccataaatcgatagggatcggtctgaccggagtagccgatctaaccgctcgaagagcttcggtctgtccggtgtagtcactcgggtctgaccgcacgatgcaccgatgtaaacgtcgttgctgccggtctgaccatcggtgtcctaccggtggactgccgaacccgagcaaacacaaattaaagttctctcatagtagattgaaaatttattatttttgttcatgtttataaagtgcaacaacatcactcttcacaaaaaatctcgattaaactcaaaacctaacttcactctaaactcaactatctctaaaatcgatatcgggaggctacaccctccctttatatttataaccgaggtaggcagccaaaagctatgaaccaaacttgcacaaaagtcctaatcccctaggaaaccttcccgtacaagaagcaatatttactaactccaatgataccaaattcggactccttcgaaattcgactccgcatccaatacgcacacaatatctccatcgtatgccatatggaatcttcacgaaccatgtgcattgatttttagcctaagcatcccgcatgttatcctgatcgtccggacgtcatcttctcccaagttgactctccatccatcaccgacaacgctctcccgaagcatcaagactcacctacatatgaaccaacaaagaaaccatatccgagcacaagttatctccaacttgactcaacattaatacacaatactattacatacgcatagtatccatttggaaatcataaacatgatttaatcacggatatccaaagaaacaatccaaaatcgaaaccgagacaaaatcggatggttagaccgtcgggttggccagtctgaccgcacaacatatgccggtcttaccggcaacacctgcccatttgactagactacactgtcaacaatctctttttcgtcatctgaaagtcacacatctctaaaactgtgaagtgtttcacgttggttgtgtaagggtaaaggtcctaatatataagtgggagagcccctcacctcatttgttagcttttggggtgggaaaagccctttacgattctacaattggtatcagagtctggcttgttcaaccttcgacccgagggcaaagtgtgtgatgcccttatggaccgaccgtgtgtgcttgcggagcctgtatgcttgaggaaccatggggatacgatgaaggggcggggaatagctaaggaacaccaatgtgaagggggagattgtttaatagtcctacattggttaaggaagggtaaatgacctaatatataagtgggggagcccctcacctcgttggctaggttttggggtgggaaatgtcctttactatccttaaaaaaccacttcgtcaataatttctgaatatcaaaaccaataatttcatatgccaattattcatcacaaaataacaatcaaacattttgatgttacagctgacaatgtgggaagctcttggccatggttagaacgcaatgttgcctttcagcagccatctgacaaccattcactagttgacatacagtgtcttaagaatttgccgtcacttcttaacaccagggttacatttggtcttggcacagtactacctatgctttcctaatgcctcgtacgcccagagagaggatacattcagcctcctcccttcgtctgtaaaaaaactgtattttcagctagtcaaaggcagattaaggaggtaaaacactactatgctcttcattaatgtccaaggagaggatgtattgccgttttgatatagcccctcgtcacattccctagtttgttttcttggacggagtgggatgtagacagaggtaatgagcagtactgttggaggagatgaatgatataaagactgagaggtggaaactcctaacattcatgaatgatcaacgattcgttatttaatgtagcaacaggtgtgaatggtaactctgatcctgggaatggggatgatgatgttgatgacttgggtgatgataagaaggatgataagcaaaaggataagaagggggatgatagcgcaggtgataaaaaaaaaacccaagaaaatgcctcctggtcagagctatactggtagtgaaaagatgaaaggggcgcaatctgcacccccacctaccagaccagggaaaggttgtgttggtagtagcactatctctgctatggattgcaaaggggttgctagagtttgtgttgaatatgtgtacgtagtcggttacagtttaggacttggagttgtaataggtattaggactagagtatgagtcagactctatcctaggatctctcataaatagagaggcgtgcctgttgtaaccgcatggtgacttagcatagcgtccggccgtaagtagttgtaacactgatacgatgtatatgctggatcggggaggagcgcccataatcagtgcttccgagatgtaggctacggcggaactccgttatcaaatatcatgcctcggtgtcgtcatcgtgtttggatcgcctatggcatttctttcgcgtttggtttccgatgtgatttcggggccggttttgtaacaggggttgtaaccaaagaccaagggacaaaaaagctgagggagatctaaataaagctatagttgggtggaaaggagagagtgagttctctcaacctgagctgtttgagtctgaatctcaggagtctgattataaagagggtgaactgatgactctcatggatcttgacctcaaacatggggagatggaggtgggagcccaggcaggaaaagaacagaagtgcggtattcccactgactctgacatcgagaatatgagatcagaggaagataaacacgttagtgtgctagaaaggacaatcatcttttgtgctagaaaagaaacgttatgaacaacaaacttgcatattgatttgatagtaaggatgtgtcactagaacggataccctcatctcaattgggcggtaagccccatctcaatcaggcatggcgtccgtcacaggctagaagtcactgatgtgaagacctatctcaatcgggcaaacggtcgtcacggatgatcctatctcaatcgggccctaagtaaagcccgtcaccgatagctttgacccagacgaccagtcaaactatagcccgtcacagatgacctatctcaatcgggccacaactagcgcctgtcacagataacccttatctttgacgggcattaactatagcccgtcacagataagtcatctgtgacgggcattaattatagcccgtcacagatgagtcatctgtgatgagtattaacttatgcataagttaatgcccgtcacatatgagtgtaatccaaaaataaataaattttattttttggctagccctcactcgtgtgcacccacgcccgaaattgctccagaccaagcacacttaatgtcaaagttctttggagattggcttctagaaaagtagtagtaacatgttggtatgagtattctattaatcctattatgccctaggccaggatgtcaaattagggttattaaatgatttcaaatggaaaagtcaccagaaccaaagttgtagaactcatcgaggtgcaaaatttttattttggtcatttctccatctgactctatttaaacaattcgaaatttgaaattcgaagtttgaaaagttcaaatagaattttagaacagtgaacgacatcaactgaaaaaatcatcaacaacaaagttgtataactcatcaaaatctataacttttattttggtcatttttctatataacattttttgaaccgtttgagtttgaatttgaaaatatgacaaattcaaacaacattttcaaatactaaatgatataaactaaaaaagtcatcaacaacaaagttgaataactcatcaatatctaaaacttttattttggacatttcttcatacgacaaagtgatagtaacattgttcacaaaattgacatatctcttatctggttttataaactataacacctatatgtaaaatttgtgaataatattactaacatttcgtcggatgaagaaataacaaaaataaaagttttagatcttaatgagttattcaactttgctgttgatgactttttcaattgaaatcatttagtatttgaaaatattgtttgaagttgtcatatttttactttcaaattcaaattgttcaaaaaaaatgttatattgaaaaatgaccaaactaaaagttgtaaatattgataagttatacaactttgttgttgacattttttctatttgaaatcatttactatccgtaaaattattttgactcataaaatgaattattatactgcactaaattattttgctatagtcaacttacaaatataaacatttcatatgaaaaatggaaaagtagtcatcggtgacgggctttagttaatgtccgatagagattaagtatatagcccgtcaccgatgagtcatctgtgacgggcctaattgttatctcaaacgggcctcaagttggtgcacatcacagatgatggtcattgtgacgggccacaacttgaagcccatttgagataacattcattatctcaaacgggtctaaagttgcggcccgtcacagatgatggtctaaagttgagatatggaatgttatctcaatcgggcctaaagttgtggcccgtcactgataggtgtcatccgtgacgggcttaagttttatgctcatctaacatgtctgtgcgaccatatctcaatcgggcacttttcagcccgattaagatgacttccttgtgacggcccgctatttctaaacatattagagcccgtcacagatagaaggatctgtactagtgtgtttagtttacgtcaaaatttgaagtttgattaaaattggaatgatgtgacggaaaagttggaagtttgtgtgtaggaaagttttgatgtgatggaaaagttgaaagtttgaagaaaaagttggaaactaaagcaagcctaagtagttcaatagaacatacaaaatataagtaaaaggaatgttgtgtctctgttatatactttgtccaaagctttgtcacgatttctagagctttgtgcatccgggggtgagtaatatggccctgaacctatccctccaacaaatgataatcactaatattccataatagaataattaaaacttatcacctaaagctacatttttccaaatatattgtcaccttatgcttcactagaagataaaatcaaaatttacacctacttgctcacaactaaattaactgtaattgaaacacacttccctccccaagttccccctccagattaattgcctcatccattgagcacacttccctaccgaagcactccagattaattgcatgtttgtaatttaaacttcattccattaattttttaaacgaagaaatctacttcacaacccatgcaatcctttacgtttaaccttggtttgtgatctgtaaagaaaatataacatctaatatcaaatgacagtgaagtatcatctaatattatttaacagtgatgaatttttaatcctaaagttaaagattatgattttttaatgttgatgaaatataattaattcatgatttctaaatacaaaagtttgtaagtttgtctctttgggaatatgtatatgtaaaacatcatattcatatgagtggtgtaagcaatcacattcttgaagtcatgtcgtacggtgtatcccatataacgagctagttgctatattagggagcatgattgcttacaccacttatactagtaatatgtccgtgctaaacgctacggtgtaattatatttgcttttaataatttttaaaatttcatgttagcaaaaatttatttttatatggtctgtgctgtgcatgtgagcaaaatcaattaatgccgaacatcaaatatattaacatatttacatccaactcaccgccagtaatccaactcatatttacaatacttccagatgcaccatttaggtacaaatatagatcaaaataaaggaactatacagcacaccggcaaccatgtaacagattcttaataaaatatgcatagataagcccacctcacaattgcttattaacatgtgctctatattaaacaccatcgtaatatctaacaccatatagtttatttacatattggagtgcagaaaacactaaatatgcatccatggtgctgaaaaatattgattatacaaacaaattggaaatatgagctctgagtcttgtatgttcagaagctaggaaggaatcaatttggaagtacttgaatgttaaatgacactgaaaaatgtaccatcaacagaagaaatggcaagtacatgacatgctctttataagtggtcatgacatcaaaatagcaaaattcttaatgacagtacctatctcactaatttatctctcgatacaactggagagaaggtgacacagcttcagctccccaatcaccctatcccttgtatatgagaaacaactaaacgaatcagtatagaaaatcacaagcatctttcataacagtaaatccacatgcagagatgcgtaaattacagtgaaattcccagattaattcccatatcccgttaagctgcattgccagtggcaatgtaatataggatgtgtggcaatgtaatacagcccacctcataggatccgtggccatgtaatataggccatgacgtggattactaacagatcaaagaccttgacggctgggatattacttgtgacacaaaagagagatcatgctattttgtctaaatagcaaatatagggtaaataaatgaataaatttcagaagtgaaataaccctaccaaaggtagctaaacaacagaagaaatttctattaaacagagtctagttagcaataccaacagcaagtaacatgaacattgacggaggaaaatcatgatgtttattgctcagaaagtgatcacctgtacataaatagaattgaaaaccaccacgaacctcatgagatggtacctgccaagtcataaaaggagtggagcaagcagtgaagcatgggaataggacaaaacgtgggctgagaaaatattatctaattgtttgctcatgaaatctcagccccttctgattatgtcaagacatatcttctcattgattatgtcaaaaataataaaggtaaagagaatgttagtaaggtaatatatccactaattaatcaataggaaagttttttttttaaaaaataatcaatagatcagttggcatttttaattacagaagcactacaaaattttgctcagttttcatcttggggagacacctattataagtccctcatattgtcgaactcagccattgcccatgaatcctacactaagtttccccatcaaacaatatatgattaattacatacagaaaatgtaaatttagttgctactgactatatgcagattgatttcatttcgttcttgagtaagttctttcatgaaaaggacctgcaattagcatgaggagatgtattccgtttattagttgactatgaatacttgtacctagctacagccagccaagtcaggcactgaactgcaactgtcccctccagttgccaattctggtttagtcaacatgccatgcaagttaagcgaacagttaccaaaatgaccaaatacatactccctccgttttttaatagatgacaccgttgactttttctcacatgttttaccattcgtcttattcaaatattttatgcaaatgtataagatataaatcacacttaaagtactatgagtgataaaacaactcataacaaaataaattataattacgtaatttttctgaataagacaaatggtcaaacatgtgagaaaaagttaacggcgtcatctattaaaaacggaggtagtatttagtttctttcacatagaaacataattgttatgtaaatcaaaatgtatcttaagagcatatgagatggtatacaacagaaaaatctcttttcattaccaaagggacataaaaatcatttagttcagccagcctgatgcaaaaactcactgtttttcctttttttccacttactgtcatgttaagtcctaagggctgagtgcacgctaccaaatcctatacaggttaaagaatcaaatatccccaacctagctcgacaactcgagcattgaagtttcctggaatgatggaggtataccaaaatgaactatcatttagatagagaaaccaacaggcacatgaatcatgtatgcagattacctcgtaatgtggaagcctgtgtactcctcactcctaccggccatgagcaacggatcaggccaagacccccctcgacactgtcacattagctggtttaataaaaagcatgagattttcttcagtagttgtttgtctacaagcagacgaagacgatatggaaaatgtaaagttttgatggtaaaaaagccataatttaagaatgttcaatgaatccaaattccaaccaaccaaatctaaaactgcatggataagccttcaacttctggaattttagcatctaaaactactaaaatgtattgaaagatttttctaaccctcaagaacagtagagatacgcggacggcggtggaggcagcgacagcgacgttcggacggaggatcggcagcggcggcggcggcgcgtggacgatggaccagcagcgtgggcagcgtggggtcggtgcagacggaggttgtggcatcgtcgcggatggaggtggtggtggcgacgtcttcctagccgcggagggggcagcgtcgaggatggagggggccaagtgaggagagcgcgaggaacgggccggtctgcagcgggacgacggcgcccctcccctcccctcccatgctctgcttgcgagttgcccgactcgcaatatggggatcggagcggaggcggcgatgggggcgatggcgccggtctacagcggcctggaaggggtggcagccttgtgggatttgagcggagatcgcgggcgcgatgattagggctgcgacgcggttaagggagggagcgaggaaggtgagagggcgcgcgggttgcgggatgagggggagatcgatgtgcgtggggctgggggatgcagaggtggggagttggagatgatctgatgcgttggattttacacggatgatctaaacccttgagtgatgaatgaaataatgaaagaatgagtgaaagtatttgttgaactatagggtagattactccccccttgtttctacattgcaaaaattactggcacactgtttatatggctagttgctatctatttcgccatacagacattgaagtccctgagtcgtatgctctgttttaaaggaaaaaaattccctcagtgcttttagaattgagaccctcggccctataatgcacacgagggcagcctaacaccattcatcccatgttctgaatccagagactcttagatactccttactcctccatgctggatggcactggaaacactatagagcaggtagcatttttatctatcacaaaccttttcctcgtcttttccaagacaaaatcattcctcatcaacatcacttggcgctcctctttgtcttttattcatggttgcaagagaggtgagtgaatctcatctaactttataagatggcagtggtcttaaggtttggagtggaaagcattaggaaaaggtaggaaatagggtctgcaatccttccatatcgaagtgatgagcaggtggtaatgtagccctgagttgcagttgcatagaagggcctttgcggcaagccttgtacgggccagtgagtagagattgtgatcagcagcaccacagaatatgaaggttgcatgacatgatgcatctcctccattagctagcaataatattacttccaataatgttataaagtgtggaataaaataagatatacactcatgaattcatgattatccgaagtgtacatcaaacgatgtagctgctgttgtcttggcttgaacttaaatgatgaagaaggccggcctgaagccaattagccaaagcagctgttattgagtgctcaaatacatcctcctattcaactacatcaaccgttgaaagaaaagagactaacatatgtattttttctgcctagtattgttttaatgactctagtcaagtacaaacaacatctctattggcagtttacaaataagtacattttgcattatctgtgcaagtttatatattaacttcatcttaagaaatatgaagttaacaatgcgcctccgtggcgttcagccccagcatgagaaacgggcacattgtatgccacgtccaccacaagcggagtccaatgacgaacgcgtagcaaatgttggtcactagttcttcccactgaaaagcctgaaaaagctgggcacagcggctgggaagaggggagagagagtgtgaacgctgtcgatctgcagccaccgtcgtcgaggccgcccactccatggagggggcgcgggatggatgtcgttgagctgttcctgcagtcgagccgccgccgccgcctttgagttgatgctcctgcagtcgagcctccaccaccgccgccacccaaggccagatctggcgaccttaaggccggatttggccaggaggggcacgaagtggccgtcgtcgagccgccgccggtgttgtcgagctgtagatgggaagggagagtggcaaagttggggagggagatagcggtgaaaatggagctttgggcgctggtagccagcgtagagggggcggcacggaggaaggcccacccgacgtcgtcatcgctgtccttcgctcgggcctccccgtcacctagcgccgtcgcctccactcgacccacctctggcgccgctgccgctcgagccgggcggctgccgccctttggggtgccctgttgcccggcgtcgtcgcctccactcgacccacctccgccgccgccgccgctcgagccgggtggcctccgccgtttgcgccgctccgtcgcccgatgccgtcccctccgctcgacctgcctctagcgtcgccgccgctctagccgggcggcagccgctgtttaggccctcctcccccgtctcctggcgccatcgccaccgctccttggctacctgtgggagacgcagagagcagagagagaggggaaagaagcagataggaaagaaaggagattgaaaatactggtgggacccattataaaatagtatgcactgtgggacgcactataaaggactacgagctggatggcccatttagaagaaacaaagcactgcacggcagatcggacggcaatgaacacaaaagaggccacgttttgacgggaaaaacaataggtttattactccgtccatttcgaagacactgttgactttttaacgactgtttgtcttattaaaaaacttttgtgaaatatgtaaaattatatgcctacataaaaatatatttaatcatgagttaaatgatagaaaaagaattaataaatacttaaattttttaaataagacaaatggtcaagtatataataaaaagtcaacggcgttaaatatttcgaaacagagagagtacgatgcaacgaggtggcggggacgcatgcatggccggacgttggaaaaaggctatatgtacagatgggcggacggcggtaacgggagagcgtacgagatggcaccagcacaagaaaaaggctacatggagccagaagggagcacgccggcggaggttcagcggcgacgtcggcgtgaaggaggcgccgtcgatcacatccgacttttggaaagaaatatgtaatgtgcatagctatagataaaatagctttatacccttttaaatcaacggttcatcttatttatactggtagtagtatactacagctcttacaagaataaatataagttgtgaaaaacattataggaactatactttttatcttatttgtttaagttcaccccttcttgttatctaattaggttgtcaaacatgaccatgaagatatggcgatcaactgtctctggtgagcaatgagcaatgtagcagaagctcttcacgacatcgaggaatgttctattggacaatctgtcagcagcattataattctgaagaacaagcagggctagtttttgcatctccatgtccacttgtcggtctagctcctcagctttctgcagatctggaccctcctattttgatcattaacgaagaaaaaacttttgttagaccaccagtattaaatagcacatagaaattaattgaaaacattgtacactgggtaataaatgtgtgataacgtgtgatgctatttgttactccctccatctacttttgatagtcatattttccaaatctaaaaattttatttttgataggcatatttcaattcaacaacctatcatcttaatgactttctcggatttaatacatgactctccattctttcacacaagattggctacatgggcatcgagaaatgtaaatattaatgaatcgcttgtttacgaagaatgattagtagcatgtttaaatggatggtaagtagaattacttatccttagtctgtgtgccaagatgaaatttgactataaaaagtagatggagggagtattacttgtgcaattactctggccgcgagtctgcagcagattgaagatgtgatctgctcaagctgagaatactcgagattcagcgtatgatcgtctggatcatatctggtggagacaatctctaccgtccgaactatcagaagtgctgtattctcttcaggaagtgcattatggcatcccatgtgattcatgggtattcacctgaatacccatataatttaaaaaaaaataactatatatataggtatgttatgcatatatacatgagaaattagaaggaagtacagcatgtatatcccaaatgaaaagaagcccatttattcgcagcagaccatacattcctctccatcttggccaaacgaataggcccactggcccaaaaacgaacaaaaccctagtccctatcccccggtcagccagtccccaccccttctctcgtcccagccccaatccgccgcgcctctagtcatccccaccgacgggcgacggggcatcgagagctcgacgctcggcggcgccggccgccggctcggcgcgtcgccagaatcgccactgcggaggcggcgtggcttgcgacgacgccgccgcctcctcggggacgggcgacgctgagcagctgaggttcgcacggacggcggcggcgctgcggcgcacggtggcagccggttccggcgacgcacccccgcgtcggcgcgtccccttggtccctagacagctggatagtggactggcactggtaaaataaatcctcttgtcaaattccccaagcgattggccattgcttaattgctattgcttagaagttaaattagtcagaaatttgaactggaggtcttgaaatttgaaaaatgaagaagaagaagacaatagatttgaagtctttgtgggaaaggtcaaccaagtctcagaaagtagcttccacctctgatccaaaaccattaaccattgagagtgaagttcagatcccagaaaataccccttctagtcctattcagctactacttgaagcacccaatgcccatgatagtgatatgtccccaagtatacagttggagatagacatcttgactattgtgctactgtttgtacctttaaggctttaaacatgtcattaccactcctgtatgattttcctagtccaattttttgagttctgtatgatttttttttcaactttgaatacccttcgctcaaatcctggatccgccactggagacgctcatctgctcggtttggttcgaagatgtttgctgccgctaggaagaaggccgttaacgcgctcttgtgagtcacaccatatacctcaagatcgttctcggcataccacctgcatgcacatatatattgcaattaattattacgcactctgaatgtactctctctatcccataatataagacgcggtcaaataagacgcggtcaaataaagttgtagttgcacaatctctaaaactaatttttagcttataactagaaaggtagcccacgcacatgcacgggcacgttgctgatgccttgtttaatgttgcttaaatttttatgaataatattaacatgtgggtgattttttttggtaatatttttttattatattctaaatctgtttttgtccatgatttgtttaggattgctttgaatgttggtcatgattttcttctaactaccatatcaacatataaattctacactaaaattatttgaattcataaaatcttgagtttatgagaaaatatcgtatcgtggaaatggagttgattcacatggacctatcatttgtactatacgtgtttttaatatttagtataacttatttttggagtttctaaactttaagtaatagcttttcttgtgtactatagatatctttattgaatttaggatattttaatggaacaaacgttcaattaagatatatggtaagaggaaaattgtatccaattatgacaaatttatagttacttctactgcctcctttttttcatatgcttactatgttcttggaaaaatgaatttaaaattgaaataagagagcaattatataaataaaattagtatatgtagagtatttataaataaaattgttgatgacatttgttgaaattgggcattggtcaatagcatttttggattttgtcatcctatttggtcgtaaatatttgtcaactgataatatatataatgatatactttctactgtcatttgttatataattttcatgtatgtttggattacatgaaaagaatcaaaatgcgacctaaaatataattttattttataagttgaaatatattcaaaacagatagtaaaatataatttaatggtaaataatatgatggtctaaacttcattttcaattgtagagagaatttagttatgcatgtttgtaaaagtgatatatgataaaataatatatgtcgccatttgtttgtcatatatgatgaaaggggtcaatatacgacccaaaaaacatttatttatttattataatttaaaatatgtcagcaccagtttaatcctgtctcaactattacattatatgtatgtaaaaattgtatgcgtaattttgaatttatagttgtttagaatttattatgataaataacaaatattatctcagctactataaaaaagattaaaggaaagggaagaaaacgtgaggagggtcggttgcgtgcatgcagtatgaagatattttataagggttaatgggatccatgccactacaaatatgccattttagaaaaatatcattattattcacgatattggctacgtgccattagaatttgagaaaattagaaccatgccactccatcacgttatccgtcaaaaatctccgttagccccaactgcaagtgggacctaactgtctgtttcatcttcacctccctcccatcttttctctttcctcttcctctctctccaccattgtcgtcgaccaccactgacgctgccgccgtcatcgaccacctccgtgaaggcctccggagccactgccgtcgccgatatcatcggccctatccacggtgggaggcttggtagctgtcgccgccgctaccatctgtagtaggaggctcgggagcagccgtcctcaacgccatccacgtgggagggctcaggagcccccgccgttgttactatcctcgaccctatccacgacgggaggactcggaacatgcagccgccgccgccgccgctatcctttacgccatccgcgtgggagggctcgggagccaccaccaccgtctctgtcctcgatcgcatccacaatgggaggtcttgggtgccgtcgccgccaccatccttgacgccatctgcaatatcgtgaatagtagtggcatttttctaaaatgacatatttgtagtggcacaaaatataagtgattttggttgaatgggatatcatattactacgaatctaaatctatgtccatgcatccaacaaaaatgtcttatattttgggacgggggaatatgtattttctaattaagttcttattattttaatcttattaatttgttttatgtgttttatattgtctagtgtaaactacgtgttgttaatcacatggtttaaaaatctatgtgttaaaaatctatgtgtttttccattcaaaatgtgtattgagtggccaataggtggtccaaagcaatgtatttcttttacttgttaaatacagttaatttgggatttgaattataagttttgttataaatgatctaatagtatacatggataaaaaaaattagctatatagaaaaattttatagttattcaagaaaaattttacaacaaaaatatgtttcaatgtaataaggcatgaaaatagaaaagaggagatgcaccggccggttatgggtgtacgtatgtacagtttgcagcacacgtacatgtacaggccccatgggccttttcttttattattaaagtaaatgcaacgaaggaaaatagtgggtcctttgttaaataaaaaaaattggtgggtccaccttatttaaaagtgtcacgtgtcgaatcaagagcgtttgtaggaagacatatggcggcttaggagtgtttataggaagtttgatgcacttttaggatataatagatagatagatagatagatttctcatgtacacaaaattataaccatatgaaattaaattcaaatcttaatctaataatataatttttaacaaataaaattcattttatattatactaagtgtcagtcaaatgctttattggatggagtagtatatttgacccggtaattattacgcactttggatgtagtacatatgacccggtacttctttcgtccctaatagttgtccttttgtttagcatagattaatatttaagaagagaactctatataacacccatcattattgagtatggtttgggagtagaaggtggtttgggttaaaaagaagagaaatttgaatataatgtaattaatgagacaatagtttaaaaaattgcaaagtagatttaaactattttaggacaattttaatcctataaacacaactattttaggagggggtagtacgtagtaattctttgtttatttccattccaaattaaagtagatcagtcggatggagaggcaggaggcagctcacttgttgatgccatgccactcaagttggcagcgcctctggaaacacttgaaatcagcttttgccatgttgtgatagagatcattgttcacgagtggcagcctgcagaaaggtttaagaccgtgtacgtccagtatatatgaggatgatgacatgataaagagagagtatttcacaattgttggttaattaccgtgcttttacctgtaaagcgacttaccgatccacacatctctgccggcgccatattgctccagatacattcttgtttcaacacgtggcagacttgctttccaggggaagtctagggcgtaaccaatctacgtgtcgacattgatcaatacaatcaatcgacagacattaaattactaattttacacatagtttttggtctctataaatacgtacgtttgtcgtagtgttaattagttgtatacaacctcaatcaaacagtacctctaaagatagattcccatcgctttatgctatagtaagaaggaggcattcctcggttgcaaatgttatgtcttctgttctactgaatgtctcttttgaaagagctttagtaggttagaatttgtttaattggcataatttgagtgctttaattgttcatattcatttgacagaggataatgacgtattttgatggaatttcttcaaaatggtcaattttcagtccattatatgtatttagccttaattaataatagctacattgaaaggaataagtttttatggaaacttaaaatgtctcttaaaattaagatttttatgtggtacttgcttaaaggggtcgtgttaacaaaggacaatttagcaaggaggaattggtatggtagtttgaaatgttgtttctgcatgaaaaacgagtctattcaacatatatttgtgaaatgtcactatgcaagatttctttggagaactctacaattttcttctggtttaaatactccgcttagtatatctcatatgtttgagaattggctgatgggggttgataaaaaaaactagcaaacttatttttgttgtagcatccgctatttgttgggctatatggttgtgtagaaatgatatggtttttgacaagtcaccatctatatcttatatgcagattcttttcagagcaacataccggctccggtcttgggctcaactactaaagtgtgatgaagatataaagttagtgaagactgcatgtcgcaatcttgagtcgacgattatgcagtttttcaccaactttagatcgagattcacaaatagaatttaataattttgttaacttctcatgttgtgtgcgtttttagtagttagtgtgttcctgttttttttaagactgtttttttattctgttgaattgttgtaataattggctgtagctctctgagcaacggctggaattctattccattataaaaaaatcaaaccgtcacattccgagacaactttagtggtaaattaagaggagaaataatacgatgttcctaacagaaatctaatctagttttcacggatggatagataaaacttttcgaatcgtggacagaggataggtattctaatgaaatgttagttcaagtttttttaaaaaaaaacttttaccgtacttctgtgtataaattgtgatggtagtttcagccttcatataccatttttcgtacttttactgtatttgatatatgtgtggttatgggcaattttagatttcactgactctgccactggagcaatatatatgtatagtgtaactttaccattcaacatttggtacctcgaaatacctgatactactctctctccacctcatccatgcacacatgcatgtattttagcaagcttcaaaataatttttcttttaaattatttattcaatccatgatccgatcacaccattatattcgttttaattaaatctttacaataagatatcgcatgattatattttgttaaaagaaaaacacatgtttcaatccgttaatacttgttgtttcatacgtgacagtgacatgtttcaacgtgtatcttcaccatgtttcataaaatatttaaatgtttcagttgctgatttttttatttcaccatatataacttaatgttttacttgttggtgaactgcaatatttgatcgttcaattttttttaggcatcggacgtccgataggtagcttcctccatacactactacagaaatggatatacaagtcagcactataagtgtcgaaaatagcataactagcacctatagtattttttccacctccacaggctgaaaacacacacaaaaaaaactaacaccttcaagcgactataggtgccggttctttagaaaaaccaacacctatacaatagatgctgctttttttaaaaccggaacctctagtgtattataggtgttggttctttaaaaacctggcacccttaaaatcaggtcgagctgaactggtagcctcctgtccttagcttctccttctcctcatctctctattattacgctccaccacaccctttcctctctctcggctctcactctctctctcgtctctctctcttggcgccagcgggaggggaggagcaggcaacgtcgtgcagcagcgggggggggggggaggtgatggcagtggtgggaatggcttcggcagtggtgagaacggcttcggcagtggtgggaacggaggcaacggcagccggtgacgtcctctcctccgccagaccggcagtaggggagatggtgacagcagcgttcggtgatgggaaggagctagcaacaacgacgtgcggcagcgggatggaggtggccgcagcggcggacgacggcagcaggcagcttcgccctaccctgtgccagatctggcaggaggataggcggcgggagtgatgtgcaacagcgggaggtaggaggtggcaacggcgagcggtgccctcccctccgctagatcaggcgggagggaagctggcgggagcgacttgctatggtgggcggctcccctccaccaaatccggcgagagaggaagcagtggcgccctccgcgatgtcggtcagcccattcttaatgttttactgttccttttgttcttgagttgttgaatgttcttgtgttcttgtattttcttggattggtcgggggtgagggtacgaaggggagctgctcgatgcattggctcgtctacttttttttttatattcgtggaacctcaaagatgcgctatggtatgatcgctcatacacatgaagcgtgggtgtacgttgccgccgtcgccgccatcgtcgccactggagtgtgtcgtccatgactacgagacctcactagtgacggatgtaatgagatgatcctcaaagatgggagcactcatctgtgactgggtcattattactagcattgatggagaacattatcggtgaagcttggtagttacaaaacgttatgaatgagggaaaatttaaatttttgaatttttcaagcaacctcgtatagagatatacttcacatgaaagttgtaaatctcaacgagctgagctctgcagcgcatcaccttgttctgttcagtcaccggtgccaatcacagcaattcttcgccatatggccatatcccagtgtgtccttccatatcttgcatctgcatatatcttaattacctagaccatagctccgatttcactatccaacatccatactccacataccaagtctgttggttcaaaactaggagacattggtctaactaggagaaagctttactacacccaaaaactagctcaagagataaagaaactcttctacttttaagttggttcaatccctaatcaacaaatatgagactattcccgacataggaaagcttgcatgctgacaagaccgagcacgatggccaaccacttcgcctgtttcctgttgtgtaacaaggctttgaaatggatcatgtacttggaccttccaacatcacaaatttaacccaaccaccacacccagctgccaggctccatccatccaaaatctgcaaataacgctgcctccctcttacttaattattcatcatgtgaacgttcttatctgtgtttatgttatggatgtgtggctagctgtagataacgggactatatgatatacactcgagcagggacgaattgaacatcggtgcagggcggctcgagccacacctaccccattatattggatccccatggagaggagagaggggatgggtaagtaaagtatatgggctcgacgaggaagcagatgatgagctttcctcctaacttattctagatccacccctgcactcgattattcgggaattcagtcccaaagtgccaatgacgatcaaagtcagatatcaaaagaattaaagaaccaacagcatcagttgagaaataacagaaacatcagttgcctgttgcttacttggagagacactatagccatgcaaccggagtagacgaaaagccattgacccggtatcaatatccttcacagagctgtgccagttgtatgtcacgccttccttagtccaatgcctgttccattagatttataacattaatttgacaagtcaaaatacgtattttggtacacaatgtggtcaaatgatcacctgaaggtgtattctaagcagtactcatcaatttcagttttgaagtagtaagatatgcctagccgctccaaccggtcgactgcccatacgcgctcaaatatttcgataggatagagaaatggtactcaaaacattgaacagagaaacaaacaatactctattaacgactgtttgggtggatcataataccgtcatttggtcgattcacagaaaggttaatgctacaataatttttttcatatctggggcagtatgaattgaatgcatatctggacaaatccgattgaataatgttacggctatcaaaaatgatatccatttttttcaattctggaactgtacagaaacgaactttgcatcaaataggttctattcaactagaaattaaatgaagtctcgaatgagaatttatttataattgaaagatcattatttacctcccccatggaatttgctaacaattccatcaaggaactcgagacatttcttgtcgcccgtttgcatcaaaacataggccgttgcagcgggtgaggataggaaggatccatctgaaagttggagcttgaggagcctcttccagtccaagcctcgcagtccctctatgctaagaagcaaacttgttggtagggagtgaagtatttctcttgggatcctacgcaaatgtaacaaaattattaatgtgtgtgtgtaaattaaatacatatgaataaattggagcctttccctattagaaacaggtatgcagattacttcttaagctttagctccctttgggcatatatcttgtgcaaagcagggtcatcataagggatgtcaagagccaagtccttggctatctctaaaagtgaggggaaggtgatctcaaaaccaactggcatccatgcctcttcctcttgggccagcctccatatattttcccgaataaacgacaaacctaaaatcaaatggaacagtcttaaactctctgaaaattaagatcacaatacagttacaccgaaaacctcaaaaagcctctcatcgtaaacagattgatctgccaacactatggtacctttctcacgcttgtcaccatgaaccttccactccatcagcgcaatcacacaagctagggtgttgaggagcctatcatgaactagaaagcacaagtcatcaccccatgaaccatctggcagctgattgtgagagatccaatcaatggtcgaggggaattgtgggctgtcgctgccgttatgattcttcacaagtgcgacccacgcggtgtcataggcagaagcacttatctccccatcgcccattgtccttagcattactctgatggtattgaccatttcttccatgtcccgcggttcgtcctggataaatatgcaaatcatttctttttcttaattttctatatttttatgactatataattagaacaaacaattaatgatcaaatatatgtataggtaactatgttaatgttctaaacttcatgaaaaaaatccaagggtctatatttatttttaataatagaaaacaatataatccagcctactccatcggccaaaaaaaactcaaccaacccctcctaggataatgaatctagactagttagctctaggttaagtttttttgggacggagggagtacatcaaccaaccttcattttttataatcaagaatattaagttgagaactgaaaaaagaatcaagaaataccattaacatttgtgtacgcctgcactaatcctattacaaaacagaaaggaagtataacatagagctgtaaaggaaaaaaagatgggaaaagtagtctgtgcaacattaatatattacttttccaccgctcctcctgtcaactgtttcttgtgtttctttggctttgcaatatactattccctttgattgctctttatctacgtatatatatagagacaaaaatgttagaataccaatagtagtttagaaaattaagtaaacgaaaccactagctatattgatcggattcactatcccttggtatatcttctactgagacaaaacaagggatgagtgttgttaaagacaatgtcgtcctcgttaaaacgatttagttaattaaactccatttatatagtggtagagcatgtagtgcgaattgcatgactgcatacaccctttatgaacaaaaacaaacattaaagagccgtctcatctaatcaattttccaatgaactaaattgacttcctactacacccagaatgcctagagctaccttgaatgaatcaatgaatgaaaacatcacaaatcacagaaaccgaatcataagttttggcacgatacacaattgcgtcactcctcaagttagaattaatctactacccaattaccacttttccatacacacaaatcatttacaagcatcaaccactagtacagaaacctctatagttatcgattgggaactggctataggtgctggtttcccaaccgacacttattgatcggcgcctatacctcaatcttattagtgccggttaacaatggcacctatacttccgctggctgccaccttgcccatacgctgcactgaaggagggggaggtcccccaggagaggggaggccagcgagatccggcgactgcgccggccgccaccacacgttgtactagaggaggagaagggaaggggggaggtccccctggagagaggaggccagcttgtcaaaattactgataaaactaaatatattcagtcatcagctgcccgtgtcgccgtcggctgccgctacacgcgtcctacgtggcgctctccgccccaccagcccacctgcctgcgtggtttccccgccggccgccaccacaactcgtggtcgcaagccatggccgagccaagtcctgccgcctagtaccagccctagccgaacgagctattaggattgggctaaaacagatggcccaactgctgttggagtgagcttgtgttatgtcccatgtcgtccccatctccccaatcagcgtccttactgttcttccccgaccactcaacgttgccatgactgattttgctttgctatgagtatgggatattctttttttaaaaaaaaatcagaggataggctagagcctgatggagcctacctactagattcatccctgcttagtaggttccatgacgacccaacatcatcatttatccgctttgctacgtggcatgtccagaacggttcagacttctgcactgccaccatggattcagactccatggatccatctggagtcggtaggactgctgattcggcaacttggaacagcatgactgttgcacgatcaagatgaagtggcgcctgtgccttatagttagcgagtggcacttgtgaatcggcgggaatcttaccggggagcgggagtggggagtgcgtcaagggaggacgagttggattctcatgttagagcatagccccaatcacaatcagtccaaaacatagcaagcaccacaagaaaatacctaaaaaagtcccaaaatccagaacacctagacgaaccctagacctaaaaaacagatcaagaaatctttcgccttaaatcaagggttaatagatcaggcaagatatatctattgcataaatacaattggcaaatatcaaattatttaagtgggatctacgggatggcacattaaaaccaccggattgcaggaggaaggcggcctgtgattttcctgtgcggttcttttattttgttttctttccgtgcggcaaaaattccgaatttgctcgcgttgactgggctgaaaaccaccctaccgtggacggggatggatcgcgtggattgggccggctgcaagttagcagaggacggacgaaagtctgataatgcgtgcgcgatcacgatgagacggacgaaaaagatgtgtgacgaacaattttgctatatatttatcgataaattttctctcaaaaaattaatagatgtaaccacagtacaattatattataattatactgtaacttatatgtaattacactataatttacatgtaactttcacataattttgaaccgtttgatttgttttaatatttgtgtaagtgaagaaggaaaaaaatcactgcacgcatatatgtgagagaatttgttcccacgacctccatttcatgaaaataatatgttatggaaagatttttggaacttacgtgcaagttacatataagttacaatgtaattacatcatgattatactataattatatctgtcaaatttttaggataaaatttatcgataaatgtaaaagtgatcccattttttaattagttaagattgcggggcatcacaactgataagcatggtatgttgtcggatgcagaggggttaaattggcgacccatgtataaacatttttgatacaaactttgctatagattgaatttcagtcgttcactttgcaatcaagataaataagattggacaatggtagcggtgaagaaaataccttatacgaatctctatctctactattataaaaattaaaaatgtttctgccggtactttggtatgtcatccgtgtatggatcggtttttaaattcattcgcttttagaaatacagaaggagtcgtataagaaaactcgcatactaaccttagacgaatggactcctaactgcagctggtgatttttaaaaaatatatgtatccaagtgaattcccacagtaaatttcatcttaactaaaccatataaaaataataagattaaaatgattttcatccgttgcaacgaacgggcttctttttagtaattctaaaatcgaattcttacaaaaaaaaacataagtaaaaatccttttagaaaacgtagtgccaagccttaaaagtttgcaaggatgttttggttaccacgtggacgcggagcgtgcatacgcgtatgatgatctggtcgccggcgatcccacgccggggaccaccgccggcggtcgagcaacgccaagtgcggcggtgcatttgcacaaattagtatctgcatgggcaatatccgagaaagtccgtatggtcgtaagtttagtgagcaggatccgtcaactggagggcccgtacttaaaaaggcaatcgtccaagctactaggcaaattgatcaacccaccagtgaacgtaagagactacgagccacacgtatggcccactagcgaacgtacgacacacgtatgtcggcccactggtgaacgtacgacgcacttatgggtcttttcatcgcgacgtacataactttgactgaggactagagcgtccaacggataagttccaagagctatatatattgtcgtttgttgattactttgatatactccctctgttttagcttataaaacatttcgactttagttaaaatcaaagtgctttaagtttaactaaatttgtagaaaaaaatagtaacattttcaacctaaagacaaatttattatgaaaatatatttaattatgattcgatgaaactaatttagtattataaatattaactatatttgtctataaacatagttaaacttagaaacaatttgtctataacctgaaacacggaaggagttgattttttaagataatggaatagaacatccctacatttgctcaaaagagctacaatcacaacctaacacatgtagttcaaataaatataaaaagacaccaaacataaataagaaacaaaccaaaacaaccaatcaagataaggagtgcacatttattgaattctatttgtgacactccatttgaaattggcaaacagttatataactgttatctcaaggttacgacagtcaacttttagaaactctcgatattcatcacactatgatatagatatgctacctcggtcccaaaataagtatagccgtgggtatccatgtccaacgtttgaccgtccgtcgatggtgatgatgtcagcgacgatggcggcaggcgaggtccggcggcgacggaagggctagtgcagcgagggcaagtgtgga

SEQ ID NO: 66367 - DNA, 2217 bp, Oryza sativa
  unsure (1)..(2217): unsure at all n locations
ggctagcgctcggcggtcgcggccaaagcggcaacagggaggagggaggtggatgacgccggcgggagggaaaaaggggaaaagaggaagagaaaagggggcttgtccccttgcctcttcgggaaaaggaggagggagagggggcgtcgcggcagagggaggagggaggctctgcctccgtcccttggaggctagcgcgggagtggtggggccgaggcgatgacaacggcgatgacggcggggcggtttggagcggcgcgacgtcacgggcgacaggcgcgggctggcgcggcagagggtgacggcggcggcgaccatgcggtcggccactcggcacgcgcgcgtgggaaacaatgggcggcgcggctgggcacgcgcgctggctcgcggggccgagcggctgcaggcgcggcagagcagcggggccgggcgacgcggacggcgcagacgacacggctcgggcggggaaccacgcgggcgcgcgcgcgaacgacggcgcgcgggggccgtcttcgcgagcgggaagctcgccagggagaggagaaggagagcgaggggaaggggcgctcggcgcggcgcttgcgcatgcgcgggcagagcgaggggaaagggagggggcgctcggcgcggcgctcgcgcacacgcgcgcgtggcgcgcgggcggggcggagcggagcggagggagaaggggagagggagcgcgccgggggaggggagggggcgagagagagagagagagagagagagggagagcgggagcgcgccgggggagagtagagggccgggggagaggggnagatgggccnngagaaagnnngncnatnnaccccgggggaggcaaaatagacttttgcggaggaatttgatttggaaagatttggattcggatttgaacttgacgatagatcggggattgagatcttgagatggcacggaccctagacgacaagcgaagaaacaaatttcgcaattagggtttttaagagataattttcccgctaggcgccacgacggaacgggcgctacaaatggcgggcgaaccacggcgatacaggcgaaagcgagcacaccgggtgcttgtacgagacgaggggagacgagtcaatggctcggattcgccggagggagttcgtcggtggaggattgcggcggcctccactagcggcgagagaagaggggaacgacgacgaggcgactagggttcgattcctccggactagagcatctacatgacctcgagattgcattcctagcaccggattgggcggagctacgccgagagaagctggcgacgagcggcggtttgcggcggcgagcggcaacggcggcgaggccgcgccgggcggtggcaaggttttgggcggcgcctgcgagcttctaggggtactacgagtgctaccacacaatctaaggggaggatgaggagcgaagagggagaacggaggagagctctaccgagacgggacggggcgctgtgacgagaggccgacggcacgggagtgatctctccggtctcgggccggggaagaagaagaagacgagctcccggagtccccttccgcgtccacgaacgcgccggctcctccggcacgcgtggcaacgtaaggcggcggcgaacagagcacgggaggcggcgacaatggagtggaggcgatgggacaaacaagaggagaaggaagggagggcgcctgggctttataggatggcaatgtcgattcggaaaccaaccttgggtggtcaaggagcgagctggcgctccgacgctcgcggccaaaatggcggcagagggcatgacgccggcgggaagagaaaagggaaaaaagagggaagaaaggggggcttgccccttgctactttgggaaaagcaggagggagagagagaacgatggggcagtgggaggagggctctgcctccatcccttggaagcttgcgcggaggtggtggggccgggtcgtgacgacggcaatgacggcgggggcggtgtggagcggagcggcgacacgggcggcaggcgcgggcaggcgcggcaggcgctgatggcggcggcgaccaggcgatcggccaccacggtgcgtgcgcgtgggaagcaacggtgcgcggcgatttgagcggcggtggcgggaagcggcagcgagagcggagagggagggcgcttggctcgacgccgctcacgcgcacgcgcgcgcggcgcacgggcagagcgagggagagagaga

SEQ ID NO: 66368 - DNA, 972 bp, Oryza sativa
tgtactgttaaacagatggcaactatacagtacatcatattttcaggccgcattcttttttagcctaaattcgcattccgctacattttctatctatattcatattcgtatcaacatgtttctggccgatctgtagtatttagcaatttgttccaacttatacgaactaattaaccggatctggttttttgtttatattatccatttcggatgttgaaggtgcattcgtgtatacacatatatacgttaggattggcaatatatatatatatatacacacacacacacacacccgatatgtatatactctatccgtcccatttaagtgcagccatgattttccgtgcccaattttgatcgtctatcttatttatcatctcataacaataaaaatactaattataaaaacatttcaaataagacagacgattaaagtttttggcacgaaaacttatagttgcacttaaaataggacggacggagtaccctgcgaggctctctgatgatcagaatctatggaaaagaagcgaacctacaatattccgaacacaagtgcgcgagcaaattaaaagaacgaagagcatatatcggcgcgcgtacttctgaccgaactgatgatctgtacctttgtcgcgcaaaagaaccagcccagccgcgcgcacggacacagccactcacgtacacattcagagctactcgagcaaacaagcttaagcccgaccagtcgcgtgcctgctgaggccggcatatcgatctataggtggtccacgtgccggagtccgaaaacccaaagccggtgggtagctagtaggcacgcatgacaagctgccgaacgcccgcgtgtgcaggtggggtgggaggtgtgcaggtggtgggaggctgcgtgcgcgggggcgccagcgaagcttcggacggtggcagggagagatcgagcgaatcgcgagatcgctctccgacacggcgaaatcgcgc

SEQ ID NO: 66369 - DNA, 2194 bp, Oryza sativa
cggcttcccattgacataatcatttatatacaatggcttaagatgccgattctctgccccctctggcttctcaaaaaccgcttgctctggcgacaaaatcaatttagccgattcttcttcaacttcatcaacatcggcttgcttgctcccaaactcagccggcaatgtgaaaaccatgttaatcgaagcagttacgacacttttcccttagctaacctttttgcctcatcggctgcggcctcatcggctgcaggaacctgattattaacacgccactcctacctcggctttggtttcttcagccgatggttaatttcctgtttcttgttcaacctcctgaaagcgctccctgttcctcaatctttgaacccttcttttctgattcttcatgaaaataccagaaggacaccactgatttttcctgatttcattgtcctcttggtcatgatcttgattcactggacccaatctttgatgaacaggaactcttgtctgccttagccgactacccctaccatatgatcggcttgaattctcggcaatatcactgcacccaggacagtcttcaatagaaggcagcctcatactttcattccaacaaaatctaaaaaactcgcaactccaatgaggatcaaagccatcatcgtctgctttataatgcttccctactgcttgtcatacttcctctgatatttgttgataatcttagccgaattcatctgaaaaccccttacacggcccctatcggctgtttggccagctgtatgcaccatattaacaggaaaaggattgccatcaaccttcatcggcctcttagagtcgtcaaacttaattttgccctcttcaatagcctcttggatttgctgcctgaagaccttgcaatcattagtcatatgagacccagagttgtgccacttgcaataccttttcttgcccaattcttcagccgatggaattatgtgatcgggaggaaattgaatctgcttctctcgaagtaacaagtcaaaaatcttatcggccttggttatgtcaaagtcatatctctcttcttttccagaactctttacccattggcacgatatgacctttttactcctcacccattcggctgcagctatttcagagtcatcctcatcatcatcatccgacccatatatgtaaggacaaacatgattaaccttcttagagcttttcctagcttccacagacctatgctcgtgcaaggttaccttctgtatcagatatgacaagctatcaaagtcttcagacgagaatttctccttaatcggagcaatcataccctgaaaggccagatcggctaactgggcgtcagttaaactcaagctgaagcatttgttcctcatctccctgaatctctgaatatactcgtgcacaggttcatcatgccactgcttaatcaccgtcaagtcagataatttcatctcatgaaccccactgtagaaatagctgtggaattgcttctccaaatcggcccaactattgatcgacccatacgacaaagaggaaaaccaagaaaaagccgatctagacaaagataactggaacaacctaaccctcagagcgtccacagccgatgcttcaccacactaagctaaaaatcggctaatgtgctcataagttgacacaccatcttgtcctgaaaatttggagaagtctggaactttgaaccgattgggaagaggaactctctcgaaccactcagggtaaggctgccgatacaagtttccagtctcttttggtttaagcccaaattgttccctcattacgtcggcaatcacatcggcccacagtcgttgctgaactgctccctgtgactgttgttgcatgggttagaactgaccgtactaagacgcaaactagggttgagccaatccccctggctgatattgggcttgcggggaaggaggctgatattgataattcaagttgcccccctggtaattatgaaggttcggctgaatattatgtgccaagtgctcgggaacaacttgaggcattactatgccatctggctgtacatggtgaaccaagtgttctgggacaacttgatttaaaaattgttgtacaggctgtccaccaggcgtcgcaaacccggccgatgcgctcatcgagccttggtgctgaatcggctgaacgatttgctgttttaacggcgtctgctgaatcggtcgcg

SEQ ID NO: 66370 - DNA, 4319 bp, Oryza sativa
  unsure (1)..(4319): unsure at all n locations
atgctgtggctgctctcttattaacaaccgagggttcaccagctggcctggtgccaacgctgacggagcagataggggagtcgatgcaggcgccgtcggctgagctgatggtgcaatggggggaactgcctgaatagatggttgagcttcagtgatcaaaggccgataatttggaaagacacctccttgcaaataaactgggcctgcagcctgatgctcacctattgaaccatcggctattgatttcatcatgtttgataaggtattaactagcaccccagactgattgatcaaagcatggtgcacagcatagtcgacccgatcctggaagttattaaaaaattcctgtgatgcatttccatcctgattaaaatttcctccctgcaacccctgagccatcactttgaactccatgcgccccatcaccttgaaccccatggactacctgagaattgtcaccttgacctcctagagaaccgtctgtagcacctttgtcactcggttgagctgagccgtccggagcttgtttcccgtgttcacctttagaagaactggtcccaggatcatcggcaactacctttactttatacttctgaaccaatgttcccttgcgagtctgcatgaatgagttcaagaactgatcccgtgcctgctgcatcatcgcgtcgaaatctttcttctgatcaggtgtgaatttttctggttcaatgggcacgacgtttccttcattgacgtccgtcaatcccaacttctggatcttttccttaacagtgcctggactagcctgggatggcgacagcggtggtttctcaaccatgaggaagaattgcttgctgacttcttatctgtcccactgggcgtgccaaatgcgtgttgacgtaaaacacgaggcctgggagatctgcttaactccattgcaggtccaaagctcaccttcaggtgtgttagcgtgccagttgatttgatcctgcaatcaacaagaaatagaaacaaagagatcgcagttaaatctataaatgattgctgatcggctaagtgccgatgacatatcatttatctttgagtcgatgttatatgtgaatcgatcggcgagtataaatagataataaagaactaaacctactcgatcggctgtagatattaccaatatatagttcttatatcgatatatatttaaatcaagtgattgggatagatcggtcgccatgccaagatagtaaaaatcacttggatcgaaatatatattaataacaggactatatatgtttatagcatagccgatcatatagatctagcatgtattggctaatactccgatactactctatatcaggatattaaaacaagtataatatatcaaacaaaagcttaatatacttaaatgcaataagatcttgacagaaagggcggatttaacatgtcacttaagcatatagagcgaatatggttaaatcagataagatcggctgaaactccgatactaccctaatcggcaaccagaaggcaggctagagattgatattctaagcacgacttaatagatcaaactcaactgatgcagcattaagtatgaaaagaagaacaatatctagacaatcaagccgttggaagtttcatagagtggtggatatcttatataatctaaatcaacatcaaaatctaacctaatcggctgccctctactaacagatgttagccgattgtaggttagataatgatattgccagagattatgtacgatatatgataactcgacgaattacgtaaacaagattagagtatcataaagatggaagcactaatcccgataacacaagccatcataacaagttttacctcttgttgaagatcaaaaccgatgcagctcaacccaaaagtaagaactcgtcgaaataaaactaaagcaaaaaggtggcgatgcgccgaaattgtattgaacattgtgtgtttaattacatagggctcggagtctatttatacccgagaattacaagatatgtccataccggacacgactattatctctaacaaactctaagataccacaagtctttacgacagacttttgcctaagcatatctctgagaaaattacataaaatgtcctaattaatagatacaattgccttcccaggactctatccatgcgtggcaatcatcttgaagcacctcaactcaacccgatgtcgtacaccaagtcgtattgttggaatcggctgtatcacctaaccaagtctgactctaacttagccgatccaatcgtagccgatccggacttcagccgattcttactctgtttccgcgacaatcttcatcttcgaccccgcttcaatctaatcttcatctccgatacagatattaccaaatttgatcgttaccaacgggctactcccttagcagttgcctggcgttgctagcgagcttgttgttggtggcgagcagcattttctgcccgaaggctctgcttcccttgatcacgttcggtgagccatcagtgttctgcagcaggcagcgcgtggtggccgggcttggcgtcggtgagggccatgttctatccgtggtaaattggccccatgcattctcctagcattaccttgccatgccgtcgctctcctcaagcgcctcaacggcgtgctccgcaaccatccttgcctcaacaaccaaccgagccacgtcatcgccaccattgcgtagctagttgtacttgtaaccatagttgtggtctactgccattgcgccatgtgtgagttggttagagttcgcgtgcagcggctgcggcacggttgtgagtgatgctaggctcggaggcgacctcgaggctgtttatgctcgacgcctacctcctccacctcctcatcccggcctcctcctcgtctcatgtgccgatgtcggccatcgcacacgagatacatgcacgtgctggttagcatgtgtttgccgctatcgctgtctcccttcgtgtgtggacaggcggtcgagcgcgagctcgctcggggctcctcctgagtcctgactgtcgtcgccattgttttccttcacgcgcggatgggtggacatacgggatgaggaggaaactgattttttttttttgttttttccccttattacttatagtctttttggcatggctctagctccagctccacctctactgaatctatagtctagccaaatagtttcagctccatctggatggaatattgtcacaaaataaactagatatgtgaagctgagtttgggctctccataactccactctagacccaactcctgaagttaaatttaggagttggagctttaccaaatgatccctaaatatgtggtcatatgcgtatttttttttatttctttgatttgatgactaggtggcacgtaggcgccaagtcagcaaaaactaccgtcaatactaataccaccgaggaagtcattttgcaaggttttaagtattagaggggtagatatacccagttttgcggataaggaatatgaagcatatttagattatggagtatttgagggagtcgtattgcacttttccgcatgtgaagcacaacacgttcacgggccgaacgcgtggcccattagatccaccctgagttggggcttagagaattcgcagtctactttctagaatcggcctgttccttttccattgattttcacagtctttcttgtttttttttcctcttaacaaaaatcccaatcccacaaatatcaatcaatagctttgcggcgacgcccttcctcgcgcggcctttttttaagcttatctctatcactcgctcttnnnccacgcctcatccgccatggccgcctccttcctccgccctctcctccccccgaaacccttcctctccgccactcctaaaccccacatccccgccgctacccccagtgccatcgtgcgctgcaccgcggcgcccaagccggccaccggctctatcgccaagcccagccaagaagaggccaacaacaaccaggagcaagaacccaacgccgccgccgccgccactccggacgaggccggcgccaacccgcaccgcatccccgacgacgagaccccgccgtctgcgacggcgaccacgtcgttcgccgtggcgcggcgcgtgccgtcggccatctcccccgaccgccggcgccggacggcgctgacgcagggggagccgccgaactacgagatcgggtggaagcgcaccaagaagctgccgctggagaagcccaaggggtgggccatcgcggacttcatggagaagctggaggggctgatggcgcgcgggcggtacgggtccggggagctgctgggcacagtggccggcgtgg

SEQ ID NO: 66371 - DNA, 1743 bp, Oryza sativa
aaatggatgggatagccaactacgtgcacttattatgctgcataatttcaaccggcaagcatgacaagcagaggaaacactagctaagttttgcgacattttgcagttatcctatctctttttagttaccagatgatttcctgcgcgttattgtgaggattgattcatatggagcaaacaaatagtttgagcaaatgactataaatagcatgggagaatgaataggaaccatcaaaatcaaatctatcggctcaacttgttgattgatgatacggtgtgtcatggatgtgcttatttgtaggagttagacagttagtaggatatagttataactcattcactgtcgctactgctacaaagtagccaccaagaagccgcctaatcacttatctttgttctacttcaataatagagtcagcatcacatgtactcctaaatcctaaaaatagttgagttaaaagttttaaaatttgtgtagagtttcttttttcaagtgctgagctgaaaagttcaaattttgggtagttttttttaaaaaaatatttgagttgaaagtttcaaattttgattaattatatttgaattttgagatcaaagttttaatttttttcatagaagtttttttatttaaaaaaatgagcttgacactttccgtttaaaaaagtcagataaaccgtatagatgaaacctatatatatatggtggttgcatcgcatactgcttcctacatcgacactcgaaatcagcacgtaccatgttccttgagtgggccttatatgggtcaaaaccatgtgttccaacacagctacgctaattagaccgaggacggcgacgatcaatggcgaggaggaagccattacgccatttgccaatagcgatggagatgcccttggcttcaaagggggtgttcagataaagtttgagcgtgacacatcgaatattatatagggtgtcacatagggtgtttgggcactaacaaaagaattaattacagaattcgttagtaaaccgcgagacgaatttattaagtcttaattcgtcattagcaaatgtttactgtagcataatattgtcaaatcatggagcaattaggcttaaaagattcgttttgcaaattagtcacaatctgtgcaattagttatttttttaagtatatctatactttatatatgtgttcaaacgtttaatatgataaggcataaagttttaccgtgggatataaacagagccaaagtctatctttgcctcccctttcgatcgctaccaggaggcagggaccctcccctccgcgccaccattctcctccggtgcgtgctcctgcgcatgctaagatggcactggttttgatagtttgagtttgcggttaatggatgaaaaagaagctcgatccataatggagggcctaaagtggactttatacattagtaaatacgcacggcaggtcacgttctcttccaagatgggctttgtgtcagtgttctgggccttggtagctcagccttctattgtatcttggcccggtgtggcggtgcctccggtgtgaagtttaccctcaaacattcttaaaaggaaaaagttcatcgaaggtccctcaacttaacagcgagattttttaaggtcccctaaccacaaaaccagaaatatgtacccctaaactcactcaaaccgttcaaacaaggtcccatggcagtatttttgcccggttttactggtgttgcatcctagtcagcaaaaaataaaaaa

SEQ ID NO: 66372 - DNA, 36108 bp, Oryza sativa
aaaaatagataactaaagactacgacccgttggaatatgcctcagaaaaaaatttccgtcccttgtcctgctgtacatatacctcctttgatcctctcgccttattatttttaactaacaacctaatatttaaaaaacatagctaaatgacttataatttctaaaattatattttatttttaatttgttttaactattgttttatttacagttaattaaataattcaatatccattatagttgtattttactatatagaaattaaaatactcctatgcagggcaactgaatgaaattgaaaaattataacagaatgaaaacatgtattattttatattaaacaatctacgcaataaaaaccaattaaagacctttagagcacacttaagtcaccatatgtcacattttaaaattataaaatatttcatttaaatcgatggacccattattttcaaccattagatttaatttacgaaaaatcttacgctgccacgtgtcatgtcctgaaaatcataaataatcttaaaaattttgagaaaaaattaaacctatcatcattggttttaagttacattatttggagaagttataaaaataaatcgcatctacctcctcgcccccttcacatgcgcgcagaccactgccaatcccatccctatttttgggtaggagtaaactaaaagagaaataatcaatatgttaaaacaaccatagtttttaagctacatgtctgatttctaatataattattgctctatttataattaaactaggaatttaagatccgtatccttatattttcctatatacaaaatatggcattcgaccacattgttgacgacgaacccagaagtaagatttaggatctgcactggagttaagcagatctcctaggccagtgtgtgtttttcacatcaacacacattcagcccatgtgctttgcataccatccaaatatgattcaaataccttaaacaagttggctgcacatattacatcactatacatcattctgcaaacatgtatagctaaattaaatcaatagttatccaaacaaaaattacaaagtgaactatgaaacaatttttttattaagggagaacaccctgcccttttacgtgtgatttgaattgctgtaaaagaattacgaaataatccaatacaggttgcatcatcatatgttgtttgtcaaacatgcatagctaaattagatatacattgtctcagcaaatacaactaactaaaatatgaagtccaaaccaccaatgcatagaaaatccaatggctttagttagagaaaatccgattacttcatgatttttttaaaaaatatgtgctaaaataatccaagcaagctaaatgatcttccgtgtatttgctttaaactatgttaccatctaattgactttagatggtgcttaatgcacttttagtatatcattgatatatgttcaagcgtgttgttttggccttctaagcattctgggtaactccgtttattttctttgctcatagaccattcaaaaggtgaatcatccctatatataaacattaatcatctgcaaatatattttgttgtatatatatacttaaatgattaactttggagtccatttagattttatgatataacaagacatggaaatatgagtaactaagctccaccaaaaatgtgatcacaactgcgatgaatcacaaggcaacctctgtaggtgcaatgaccacatctcaacacggtgactaggagctgcataaaaccgtatggcgagggaaaaggaacaatgaatttagctaggtcttacattttcatcaatagggcccatagcattcaacaaacaaagaaaaaaaacaccttgcttttaattaaataaacatgttttctaaacaaactaggtctaactcctttttagatgatgatgaagattatatataattgcttatacatattaattaaatactatatagtatatagcatagagaaattatcaaagtgatgcaacgaagaatatttgctgaggaaatgcacttccaaaacatggcggaggctctctgataaatatgatccgttttcaaatacagtgcacgatacatgcccgcgcattcgcgcgggctaccttcctagttatgataatattgatttatatcaaaatcttccataactttaacgctttcttatctctacgaatatatctcctatatatgtacgtaccgccccccagacttatacaacgtgtctaacaattcgcattgtatctctcaccctaattaggccccaaaagattcaaacattctctgcacctacgttcatccctagtcatgcaattcaagctagtttccacgatcagttcccttcatcggaacaagcattcgccaaaagagatagcactaggtgcacacacaaggtgcaacgttttccaaaagacaagatttctgcgcttgttagggctgggagacatcatgaagccgccagagttgtagcatgtagggaaggttaaatccatttgggtatgatgaagtgttattcgaaaggctagacgattggcagcacatcttgctgctaatttgccattttttagataaaaaagccaagccttctaaaaggaatgtttgatgtacctagagaagtcactaccaaacagaagaatttgactgtaataacagctgcagattgatccttaaaattctgtaaaagtgctcaacgaagtggtgatcggccatgttttctaaacggggcagctggatttaatcttgcctgtcatacttgcagacaaatgataaccagggagaaagaagcaagtaattctgactttaaaggtgttaagaaagattatattgaacaaagataaactatagagtaaactcaatactctatagttttagcagagatgcacaagctatagagtaaactcaatactctataccaacgttaaaaactgtgcctatatgctttgttgtagcagagatgcacaaatttgagacattccagaataatactgcacaatacactgaattttgttgtccgttggttggaaagaagatactgaaaacagaaacagcagaagacttacaagaggcaagagctttcatttgatcactgtccaacagggtgataacactctttttttaacactcagggcctgtttagatcccaccctgaaattttacatcctttcacatcgaacatttgaacacatgtataaagtattaaatataggctaaaaaataaataattatacagattgcgactaatttctattagtgtccgaataccccatgtgacacgccaaaactttacacccatgaatgtatacaccccctcataaactcagagacattgtgccctgccattgtcctttttgattccattacattctttgtttctcagcctttgggcctgtttgggaagctttagattttgaaaagcagctgtttggtagccagaaactaagaatctggaaaagctctgaaacccagcttctccagcttatggcttcttagtgaactgtttggggcagtttctatagtttatctttgttcaatataatctttcttaacacctttaaagtcagaattacttgcttcttagtgaacagctgggacagctcccccaaaccgggcctttgtctcggtgactccacatccatatataccatatgcatagtcacgaacacatactcgtatgcttctagccttgcatcgccttcttccatatttgtatatataaattgttaggttaccattgttctcacttaattcactcgacgtttcttcttatattgaagcaaccttgcattttggcttggaagttatcaggaaaaggaaaacgaattagttcttaactcacagtactgatgtgccatctacgtccattgctacggaagcttgctgcatgcaaaagatgccctgaaaggtctgtctaacagaacttgtactatcagccataaacagctttgccttgatgattgtggctgtcatgtgcctgctatatatcttccatgaacagattggattaattggtgcaattaagtcttacatttgttgattgtatgcacaatttaaaccagtgacgctccttcgatccgtgatctgcaaattttcacttgtaaattaactggtaattttgaagaaaatcctgaataacctcagattctaagattcgaacgtgtggcttttaccagaattggccaagctaattctgtttcgaaagcaggatcgggaattttatgttttgttcttgtataatttctttgagatccgaagcaattgtttaatggatgttcgtcgaaagcattcacatctgcatataagtttgacattgatgaaactacacgagcaagataacccatgcattgcagttaagcactacagaaatggtaccttcagacttaattcagtacatctgtatagataaataatattctcaggccctgtttagttcacaaaaataaaaatttttggatatcacatcggatgttttaccggatgtcgaaagggttttccggacacgaatgaaaaaactaatttcataactcgcgtgaaaaccacaagaagaatcttttgagcctaattaagccgtcattagcacatatgggttactgtagcactcatagctaatcatgaactaattaggcttaaaagattagcacttatagtttttgtttttatctatatttaatgcttcatacatgtgtcaaagattcgagaggtttttacctgtgtgccattaaaatagatgacccctgcctctatgccactaaaaagttcgagccaccctctatgccattgtcgaactttatcgcgcccttcacaccattccgtctatttttggctctaacggtgtcaaacaacgcagccaaatgacattgttgcccttaggcttgagagagaagagagaatagagaagagagaagagagaagagagagaaggaaagagagatagagagagagccgagacggcggccgcagatgccacggcccccatggcggtgagctggagggcttccggcgcctgtccggcctcgccttcgacgagctctcccggcgggaccactctcctccgcctccggcccgccacctatcgacctccccacgctcctccgcctctgctttgccgccgcgcccctccttcttcctccgggcttgtcccgcacgccgcagctcctcggctggccgccgcgccgccgagcgctaccccgcccctcggctttcccgccacgcccctccttcctcttcctcctcctcctcctcctccgccgccaccgccgctgccgccgccaccgggcttgtcccgcacgccgcggcgccgccgagcgctgcctcggctggccgccgcgctagtcgcctgcctcatcgccggcctagccgcaccggctggcctctctttacaaggaagcagacactggaagggcaagagcgacattttttgtgcccaggcccacatgtcagaggtgccaaacagttgaatccactcagaatagcgacggaatggcgtggagggcgcgataaagttcgacgatggcatagagggaggctcgaacttttagtgccattgaggcaggggtcatcttttttaatggcacacaggtaaaacctcaagattcgatgtgacgttttgaggaaagaaaatttgggaactaaaccaggcctaagagtgttcttggaaaaagcatttctgtgccaggtagatatattaaaagttgtactaaaattgtattaatttcccctaggcttccagctatttaagcaacaaagcaacgaaaatgacaatgaagtacaacattgtggacaaaccgttgtgcataagctctatttctctgaaaacaatcacgccccttttctatcattttgcccaactacaaatcatcctatattttaaaacaatatcttaaaagcttaaatatagcaaacagccattcggccattccctcgtcttcatttcattccttcaattcctagtcatgcgatgctactaattttcacaatcagttcccatggccgaaacaaccattcccaaaagtttagctctggttgcactcaattaatcagtgtgaaacattttacaaaagccaagcatatatattttcttcacttgttaggagtgggtgtcatcagggagcagcgctagagcatatagaaaaggatgaatacaaaagggtaagaagggctatagtcagcaataacaggcgaccgtataagcctaccaagaggcaataagaacagactagattttgaacgaagaggacgatgctgattgcaaaatactccattaatttcaatctaattacatctgtatcttcctgctgtgtgagagcagagatgcacaaacttgaaataattttccaggataataccacataacgcaaaaactaagtattgttggtttcctgaaataatattattgaaagttgcaatagcagaacaattgcaaggcaagatcatgaggcgctgttttaatcctcaacctctgctaccgttgtgctcagttctctcgatggtcaccactttaatccattactacctttacggtggtttcaattaatttcttatagagcataccacaagtattatcaccagtaaaagtgatctaattcattgatttataagatctagtagataacgtgatagtataaattaatagacatattccatttaattagaaaaataaaatgccaatattattctagtacgaagagattaatcgtaaaaattagttgtttcatttctcccttcttgcaacttaagtcaatttttttactagcctctaattaacaaacatgcttaccacagaatgaatcatgctatgtttgaagaccatctcacacacactccccagtgtacgtagtttcggcattttcaagcatccaagaagaaaataaatagtggtcaaccacctcaacagtagtatacaaaattgagcacattaaaagatcattagaagtgatgatatgaaaattgatttaatttcctttggatgaaaatgaccccaaactaaacctctcagtatataaagcatcgatcgtcccacgagtcgatcaatatttgtacatccagtgaagactaccaaaatagaagtacgacttccaaaacgaagataaataaagcatgttttccagtatgatgacctttcagcattaaattgattattgtgttattattgttggtatgctggtctgcatgcatgactcatcaaaatagaagggtctatccaggattaaattacgattgggaggagttgggaaatacttggtgtcttggtgatgggggtgccgaaagtggtgttccataggtaaaatcaaagttgtttttgattattattgtatgatgaacaattgggcattggagattattggttttgttatttggaatttattcacgaagtggttttggagatgattggatttacaggtgaatcgcaggtttattatttcatgtggaccggtcagaccgggccggtgcggccggtcagaccggcgcagcccgcggtctgaccggccgacgctgtgtcggtttcggtttcaggttgtttatttggatatccgtgattatttcatgattatggcttctagatggatactgttgttcgctaacaataagtaaagttggagatagcttggtctcagaatatggtttctttgtttgtttcatgtgtatgtgagtcgatgcctcgggagagtatttgcggtgatggaccgggagtcgacttggggataagacgacgtccgtggtggtcagagatcatgcgggatacttaggctagagttgatacacgtggttgatggagattccatatggcatacgatggagttattgtgtgcgtatgggatgcggaatcgaatttggaaggagtccaaatttggtacgattggttatgtaaagtttctttctggtactagagggtttccaaaggtgtttaggactcctagtatgagtttggttcgtggctttaggctgcctacctcgagtataaatagagggggagcgtgaggcttcccggtatcgcttttgagagcaattgagttgagttttgagttagggtttcgagtttagtcgaaatttttgtaaggagtgctgtttgtgtactttctaaacatagagagaagtaataaagttgtcatccactttaagagttcttcgatttgtgtttcaccgggtttcggcggtccaaccggcgatataccggcggttagaccggtggcaaggcggcggtcagaccggcgggagtgaggcggtcagaccggcggcatccactcggtcagaccggcagatcaatctcggtcagaccgatctccgttgatttcgagggtaacttttatttctgctaaaagttttaggtttttgggtatatcaacttgtcacaccctaaaaatcctagatatataaattgttgtttaattggaattattagaatttattttaaaagcctagaagagaagatctagttttaattaataaattccaatataaaatggggccagataaaatttcatgaaatactttgcttaattctataattccgagatttttctgggatttatttgagctaagaaagtatttttaataaatggaattgcatttcatgaataatttaaattgacaaaggtttttaaaagtcttcttttggctttgggccgaaagtcggcccaaaacctctctctctccctcggcccagtcggcccagtccggcagcagccgcccgcgcacgcgtccgcccgctgacaagtggggcccacctgtcaggcctgtcgtctacctccggccggccgccgcccgaaccccagcgccgcgccgccgtcgtctctttccaaattcggccgcccctttccttttccggtgaaatcaatagaggggaaatgatcttcgggatctcctctaccttttgtcttttggaatcgtcggctaaaatcgtttggaaatccgtgaattcgatctcgaatcggattcgtctctctccccgaaccctagaccttccttcgccatcgccggtcgccgtgagccttcgccgccgcctccttgcccctataaaaggacccccatgcccgccgctacctgccgccaccctcgccttcgtctctcgtcgccggtagaaccctagcaccgtgtagcctcgcgccgccgtcgtcgccgccgctccagccgtgcgccgccgtcgctccagtcgtcgccgtcgctcgggaaggccgccgtcgtggtcgccgtcgcgttgccgtcctcgtccgcccctccatcgttgctgtagaccgccggagcaccgccgtcatcgtcaagccgaaggttgccaccgcttcttcctcgacgccgtcgccgtccgttgatcttctgccgccgttttggtcaccggtgagttcgccgcgtcgttctctacgtgctggtgccctccgttcgcgtcgtcgtgccgtcgttcgccggcgagcttgtgcgcccgagccgccgccggtggtgacgtcaccgctgacgtcatcgttgccgtccgtcgtggtccagccgtggaccggtcgatctcggccgttcgttttggttaggatcgatctcggccgttcgtttccgtgagccgccgccgtgcacccggtccaccgcaaaccctagccgctgacgcaataaacccctttttccttttcaaaaataattcattattgcgtcataattcaattaaaatccacataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgttttggtgtttttgctcttttttgtttaggttccgacgtttccggagagttcgttttcgcaggagaagaatttgaagagttccaagggcagcaaggcaagtcacacagatcccaaataaccctttgaacatgttgatcccgtttaaagctattgtttctattcaactattgcatttattctcgaatgtcattgggtggaattaacctattgtttattatagtccttttgttcttgattactttattccttgataccttggattattataacttgactagttgagctttatatattggttcagctagatattagatataattacttagccatgcttagaaacattagcacacaattgggataactaatgtttcactattacttaatgatggatatttaatggtagctcatgatggttaatcatgattggttaattaattaaattgccaactaaaacttgataatggtgggttgtgagcacatggttttgatggtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatctaggaatggtgcactgtggtggattgtgttgtgtgaggggtactgtcacagctcctttccgaggtaccgtggtggtattaaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataataaaagatgctataactggtaataatttgtttagctcctggtttggaatggtatattcctggtttggagatagaactgtgcagccaggattggttgtacagaatggttgggcctatgcaacagggtatgttgtatagcgttggattaatattgtttaaattactacttaactattttattaaattctgaaatgtttattaaatgctgtttatgcaaatgaaaccctactatgccatcctttgttatcctgagcacttgcatatttgctgcgtggcttgctgagtatgtcatatactcaccttgcaatcattcatcagaggaagagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgattatttattagagtaataattgtactctattatcaatttgttattgtgtgcctcggctgattcctggacgagggttcacacacatgtaagcgtttggaattttggatagaaattccgggcgtgacacaactgttgtcgaaatgacaactgcatacgtcgaaagacgtggttactcaacagtggttggaaggaaacgaagtgtattgaatcttgaatttcttcctttttctcctcctcccattacatggccctaggggactatttatagtctcattacgggttcttactactagggtttaggttatacaggggaatttacatgattacccttacgaaagggacatttacaggggtacataatgttataggggctcatgggcccctgatgggccgtccggcgatcgccggccctatagcccctaggcttgatgggccggaaaggcttcttcggccctcgcgggtgcgaacttgctatggcgaagtcgtcttccttcggcagatagtcttcaccttgcacccttcgcctgagacgcctctgacctggcaaggcactagtacgactcttcgcctcacgccgttcttgctccatagcctttgccacgggtttcggcagatgtggtcgcagggcctcatgccatccgccaacaagctcctcacgggcaagggtgagattggagcttcggccgagaccgtgcaaaccatgtggtatggtatgcggcaccacctttcgactgatgctcctgccgaaacctacattattcccgcgcttcgcctcctgcgattggtggttatatattttcttttcccgggccgaacggaacagtattgggctttcccttcgtgggctttttactgtgccgctcggtcggtgggaatttaccgtttcgcctacccttgcgacacgtggcgctttattactggtgggtaggcgaacagtcgcccgggtgagctatatattcccaccgctctttccttttcaccgccacacttgccattttaccgcgtgcactctcttcctccgtttctttcttccacagcatctctccacccctcaagcgtttcgcccattctctttcttcgccaccgcaaacgcaccattctccatggcccctcgcaagccaaaccctgcttcggcgaaagggccggatcccggccgagtcgatgacgacagcaccgcctttttaggggtctctcttgtggatgacgtcgagctggcgaagctggacagctctggggcgttggttgaggggtaggctttcaccccagggaaagccatggtgccgaaacctatcgacaatcggacggtggtattcgccgtcttttttgaggcagggctacggtttccctgcaacgtgttgttgccggagatccttcgcctcttccaggtggaacttccacagctaagcccgtcggcgcttgttcggatcgctatcttcgactgggcgtgccggacttccgggtttgagcctaacgccgagctcttcggcgccatatttttcgccaccgtgaactcgaagacggtgattaccccggcttcaacgaagaagacagtgttcgggagcgtgaactttaacattcgtcccgagcggtccgatctctggccggtgaatgctgccatgtcgaagtgggaccgccattggatggctaggtggttctatcacaccatcccttcgaggctggcactgactcggcgaaagccctccattgccggcgtagggcgatcgcgcctaaccggaaacccaagatcgtcgtggacggctctatggaggtgcggttcgttctgctgcggaaggtttgctctcgccttagctgccgtgacttggtggaggaattctgtatgcttcgcatctttctcctctcccagtcatggcaagtcagagttgatcaaggcgaagaggttgacggtttgccgaacctggttcttcctgaggggacgaacagtaagactgttctcttgctatacactgctgtgctttgttatcttgccttctctgactgttaacatagctacacactttacttttgcagcgttgaccctcgaccaggctaaaaacgaggcccgcaggatgatcggcgatgtgtcggtcctcgagtatagccagttgctaacacgacaagcggctgggcgggcgaaccgggtttacaacggcgaattgcctcctcgggcaaacccccacaaagctgaccacggtgcagggccttcacgaaagcgaatgcgcggacaagtgaagcttgcccctaggaagcgaagggttcctgcttcatcggactccgacgccgatgacgaggacgatgtcgaagaacgcgacggcgaggaggaaggagaggaggaagaggaggaggccgtggccgataaggccgcgaacgaggcgatcgaagatcgcgtcgacacccccggctacaatgagaccggggtggagtcgaacactccccccttcgacggaaggatttggaaggggtgaaggccctagttgcgttctcctcgggcaaggcggcgaagggaggtccggtgcagaaggtctaaaaagaaaggacttgtcgacatcgcccgcgttttcagcgatgacaaatcttctgacgggactccaacttcgcccgctggccgcagtttggtcctttcgactcaaggggaaagaggccagggccgaggttgatcgcctcaaggccgaactggagaaggagaaggcccattcggcggtgctcatcgattactacaaccttactgagccaaagatggaggctctttgccagaaggctagcagggccgaagcgagcgccgcggaggagtcgcagcgtttttcgcgggagatggcgaagaccaccgaatccacgagaatggcttgcgaaacgctccgcctcgcccttaccgacatgggcgcgaaggtgcggggggtccctgccgtggatgcctcagccttcgacttctccgagtggacccagcaggctggcggatcggtttcggactgcgccaccgcgtacgacgattgctgtgcgagtgtatcggcggccttcacattaggccttttgcaacagttcggctgcgagcacatcgccgagttccttacctatgcgaagggggactgggagattagtgcgcagaacatttcgcccgctcttcgcgcatggcgaaaacagttctggcagaaagatggccggtccgctgccaaagcgcaccttctggagcaactggcgaaggcggaggcggcagatcggggcgaaggagagggcgcggcaggcgaagaggttggaggcgatgcccaggttcacccagaggtgtgaggccctccgccctttccttagatatttgtagttttccaccctcttttgcgtttgcctggagaggcgaatgatgtacattcggcaggctaccgccaaaccttaaaaaaggctttttttgtacatttggaatgtatgacacaatcttaactactttttgatgatcaaagtctttggcatattattatttcgctcatctcacattatgccatacctcccccttcttctgcctattcttactatgttagctgtgttttgcttttactgcactatccatcagggggttcgccgaaagtcgtgcatccggcccccttccgggagctggcgaagtcaaaacgagaaatttgtggcaatgaagggtctgccgaaggtgcgatgtccatttcggcctatttatcgcgaaatggagataaacggtcgcagctataaggttttcaaggttgccgactggctgcgggcgcaccccgggcgaaccttagaagattacattcttgttcattcaagacgtctggaggatatggctcgcttttggcgaatccatcagaagactaaacgtcaggaaacgatctttcagcgtcgttacagtttagtctgtttttcgccccctactcctcttaaggttgtgtatgatattagtagtgatgacgaacctagttcgcctgatcatgccttagggagggatagtgattatggggacaaagatgtaatttacttgtaaggtgaattgtatcgtgttgtgaattgtatcattttcgatctgtagcgttctatgtcgagagaaacacttttgcttttatgctgatcgaacgtaacgtcgttcggctatttattttccgagacaagctgttgcggtttcaacgttcagcgagcgatgcttcggccgattcgtttcgcccccctggcctttttcgctgatcaggcgtttgccttggggtttttccacaaattatcaatcacacgagaaataaaaagaaggcggaggacacagagattttatactggttcgggcctccatggtggataatagccctacatccagttttttttttctttttcctctctttcttctttttttttcttgccgaaaggctttcatagtgctgaagggcttacatagtgccgaagggcttacatgacagtatgtacatttttacaagttggcaatttgggtgccacccattctaggcatagaagcgcttgagagagacggtgttccaggaatggtcgaactcctcgccttcgagtgtcgctaggcgaaaagatcccgtcctggacttgtgtttgatgaggtacggtccttcccactttgattcaagcttaccaatcactagtgggttcgccttcttccttagaacaagatgaccaggcatcagctccgcgagttgaacttttttgttgtaagttgccgaagtgcttgtggcgtatttgtgcatgtgctcgagcgcttcgactcttactccttccaagagttcgagcgatactccgcgtccctcttcgcccccagagaacatcacccttggtgagttagcccctagctctgctggggtcattgcctcatcaccataaagaagcataaacgggctaaacttggttggtcttgtgggggtcgtccgaagggcccagagaaccaatagcaattcctctggccatttgactttcgctgccccctcgagacttttctttagtgcttctaggatcttgccatttgtatgttcggccgccccatttgactgcgggtgtgcgaccgacgcgaactgatttccaggttaagcccttcgcacatttctttgaacttatcagagtcaaactacttgccgttgtcagtaatgaactcttttggcaccccgaaacggcaaacaatgtttttccatacaaacttctgtactgctgccgaagtgattgccccaaggggttcggcttcaatccatcaagagaaatattccacagctacaattgcgaatttatacccgtttcgcgaaaccgggaacggcccaatgatgtcctgtccccatctggcaaagggccatattggcgcaatgggctgcaaatcatactggggcgtggcttggcttcggccatgacgctggcaactttcgcacttcttgatttgctcaacacagactttcaacatagtgggccaataaactccttgtctaaatactttggaggccactgttcttgcagcctggtgcacgccacatagcccctggtgtatctccttttccatttcttcgccttcggcaaaagagatgcaacgaagtaagggttaaagtaccccggagcagtaaagctaacccgagaccatcttatacttcgtggctctgagttgcaaacgcttcgcttctacttcgtctaccggaagccagccagtttgaaggtgtttcacaaatggggctcgccagtcatatgggtcttcgcccagtttctcctggtcgattgccatgacttccgagctgtccatgggcacacttggagcatgtaggacttcgaaaaagatgccaggcgaatatgggccaccacaagcaacggatttcgccaaggcgtctacttcctcgttctggtctctaggcaagtgttcgaccgttatgccggtgaagcatttttcatggatcgaatagcctccagatacctctttattccctcttcttttgcctcgaagaatttttcaacatggcctgctaccaacttggagtcagttcgaattagcaggcgccggactccctttcttaggcccaggagaacggcttcgtattctgctgcattgttggttgtgtcgaactgcagtcttgctgcgtaccgcattggcacaccatttggtgaaaataggactgccgcaatgcctgctcccctgtgcgaccacgagccgtcagagcacatcacccagaattgttcggcgggctcggggtcgggggcaagtaccggtgtccattcagctacgaagtcggctagcgcttgagacttgatagcagagcgtgcaacaaaatgtaagtcgaacggggatagctctgcagcccacttgctgagccggccagtgacttccttgcctcggagtatttcgcacaaggggtactgtgatggcattatgactttgtgggcctagaagtagtgcttaagcttgcgcgaagccatcactagggcgtaagcgagcttttccatttcaatgtaccttgtcttcactccttgcagtgcttcggagacgaagtagaccgatttttgtctgaactctgtttcttggacgagggcagcactgactgccaccggcaaagctgctaagtataatagcagttcgcttcctgggggtgggcttatcagagctggcgggctttgcaagtattgctttagctcgtcgaatgctgcttggcactctggtgtccaattaaactttcctgcgccccggagggtcttgaagaagggcaaacctctttcggctgcctttgagaggaatcgactgagtgccgcaattcggcctgcaagcttttgtacttcatgtacgcttgacggaggcttcatttgctggatggcatcgattttctcgggattcgcctcgatgcctctttcggaaacaaggaaacccaacaacttgcctgcgcggacgctgaaaacgcacttctccagattcagccttatgcctgctgtgcgcaagctgtcgaatgtctcctgcaggtcgatcgcatggtcgaaagccttgcggctttttacgactatgtcgtcgacgtaagcttccacattccgccccaactgcttgccaaggaccttgtacaccaacctggcgaaagttgctcctgcgttccttaagccaaaaggcatcctaaggtgacaaaatgtgccgaatggagtgatgaaggatgttttggggatgtcgagcgggttcatgtggatctggtggtaaccggaatatgcatccaggaaactgatgagctcgcatccagctattgaatccacgagctggtcgattcgcagcaaggggaagtcgtctttcggacacgctttgttcaggtctgtgaaatcgacacacatgcgccatttgccgtttgacttccgcaccagcactggattcgccaaccactccggatggttaatctcttggataacccccgccctgagcaatttttgtacttcggctttcgccgcttcttagcgatcggcagacatcttgcgcaacttttgttttcttggcttaatgtccggcttgactgctaggtgatgcatgatgagatccgccgggacaccccccacctcgtcagggctccaagcgaagatatcgatgttctttttgagcacctctaggatactctcaacttcttcttcgcccatgtcgccccctagtgatatgagctttgtggggttagcatcatcaatctgcacttttgttatcttgccatgaggggtaggctttggcgtgtgcttcggccgttcatgcggttcggtctcaatactgtgcactgctctgttgattatggctagatcgccttttgaaacagccgaaggatgaagccccttgactactatcacccctatcgggccggacatcttgagcttgagataattgtggtgggaaatagcttcgaacttgttcagggttgcacggccgaagatggcgttgtagttgtacgggatgtcgacgacgtcgaacagtatttgctcttcgcgtttgttctcccccgagccaaaggctatcagcaaaagtgcttggccgagaacttgaactgcttctccgtcgaaaccgtggagcgatgctggtgctggggtaagggcttgggtaggcaaccccatcttggcatatgcttcggcgaagataacatcggccgaactccctccgtcgaccaggattcgttggacttcggaaccagctatctcagctgagattaccaggggatcttgatgcgggaacataactccttctgcgtcttccggcccaaaagaaattaactagttcagatattgcggcgccacttcgcccgccgaagtgatgctgtggaccatacggttctgcatcttcttctgccgtttggacaactggcttggcgggtcggcccttgtaatcacttggattatccttcgttgtgcatcttggcgttgttcggctggaggtgtttactcctgaactgcttcgcggggtgcttccacagttgttccctgctgcggccttgggtcttgcgcgttgccacgttgcctaatgtttcggcattgctccgtggtgtgcgaagagctttcgtgaaaggcgcaatagaggtcttttcggaccttcttgcgggctggctgctgatggttgcttgcttgctgggcgtcgaactccttgcgaagggcttgcacttctttgacagccatcacagtcttgcccgcacggtctgttctgaactttctccaagtcatgggggcttggccttgccttggctgctgtccttggatcgccggctgagactggcgaacagagaggggaggtggttcggcaacttgaacttgtgcttgagcttgagcagcggcgacagaggctttgtcgtactcagcttgtatagcttgtcatcgcttggaatcctcctcgccccttgcgaacccgtcaatgatgcgaagtaggtgctcgagcgtctgtggctccttgttggcgatttttcttgtgagttcgccctcgagcagaccggccgaagcggcgtttataaccgacacctcagttatgtcttgaacttggcaccgggcttgcgagaagcgaggcatgtactcccttatcaactcccccggcctttggcgaatgccgagaaggtgttgctgcgtcttcggctcctcataggtgcctcgaaagttaaggacaaaaacatcgcgcaattgctcccatgagtaaatgctattggctggtaaattgaaataccaagaacgggcgatgccgtctagagcgagatgtattacctttgccttggtattttcgtcaccatgagccgcttcgatcactgactcgtagatggagaggaactccttcgggtcagtttcgcctgaatagcgcgggacgggtgggaacttgaactggggtgggattggacgagtcttgattcccccactcagcggttgccccttttctcctcccgccctgtttaccgcactttgcggcgggtacggtgtggcgaagggcaaaatcgcagcttgtgcgtgaggttgggccctggcattcgactgcccggctccaactggaggtacttgctgagccgccatggacaggtcaaaaattggctgcgaccacgtcgtggcagcttggattggtgcttggtttgttccgaagcctggagttggagcttgctgccgaacggttggtgcctgagcagcgttgacgaagtcggactgcggtccttgattccatggcgaaactcccaggcccggctgaatcggtggcaaccaattaggcgcaccttgacttgtattcccctccgggtgggccgatggggttgtacttgaaatgcagtggggttggttgagttgctgaaggaaagcttggagttgcgcctgcagagccgaagccccttccgccattgtttgtggtgcttggccaggtggttgatggtgtacttgggcagcgactggttgagcttgcagttgcacgtgaggggccggatgcactgctgcggccgattgctgcccggcgaagtacactggcacctgtgcagcttgtggcggaatgggctgggtcgtcacttgcggatggacttgaggtgggacaaaacctaccgaatactgaaggattggagccgacgtggccttggtccgccttgccgcctcgtatgcttgttgttgttcttgcatttggcgaagcatgtcttggagccgtgtcatcttctgtcgcatggcttccatgtcagcttcggcttgagtttcggggtcagggctgacttgggcctgcacaacggcgagcgcagttggggctgctgccggctgcgatggagcggcttggggcaccaccagtcggcttgttgaaaggatctccgccctggtctggagtgcccttgccgccacagccgcctttgccacgtcggccgcgttcggcacttgcacagaggttgcaggggccaaaggcggttgtgatggcgctggtcctcctccatcttcggccacgggcgccgaaggctctgctccgtcctcggcggccatgtccggtccggcgtcgctttccttccgcctggcaaccttctccttcacgaccctcttcggtggcattcgctctcagtggtttcactcggaggtccccacggtcggcgccagctgttgtcgaaatgacaactgcatacgtcgaaagatgtggttactcaacagtggttggaaggaaacgaagtgtgttgaatcttgaatttctttctttttctcccccccattacatggccctaggggactatttatagccccattacgagttcttactactagggtttaggttatacaggggaatttacataattacccttacgaaagggacatttacaggggtacataatgttataggggctcataggcctctgatgggccgtctggcgatcgccggccctatagcccctaggcttgatgggccggaaaggcttcttcggccctcgcgggggcgaactagccatggcgaagtcgtcttccttcggcagatagtcttcgccttgcatccttcgcctgagacgcctctggcctggcaaggcactcgtacgactcttcgcctcacgccgttcttgctccatagacttcgccacgggtttcggcagatttggtcgaagggcctcatgccattttattaggaaacttatgggcttgggcccttgatggcccagcacatatacatttattgggcccacatctaaattttccatatatgaaatacggctatataaggagaaggggagctacttattgtacacttggtcctatgggaatgaatgagaagagagcctcaccccatatcttgtttctccaacttatgtagatattatgcaaccctttttggactacgcgtgtagcacaggggttgcataatatgtatagaactagaaatattatgacctttcctagcagcagcagttgaatttattggcctagaaagtgccacgctcatattacctatggaacagttatgcactttatagaaacatctattgtataccccttgaactctctaaaagtatgatgatttgggccacactaccttttatcaacggattgtccatattcgtcttagatttataagaataaacattagaacttgtatgatcatagcacatatatgcatcattttcctaagagaaaatcccttgtatacccctcaaattttacctaatcccttctatacccctgaattttgcttacttccttgtatacccctaaaatttgattttgatctcttccatacccctcccgtcagttgaccgttagttgaccgtctattttccataaaaatgaccattttactcttggatgaacaaagaaattcatgagttacattattaaaaatataaaagcttctcgcatgagactattatagttatgagtttgttgttcgatgcattatttatcccaaaaaatattgttagataatgaaataaaaaatacatatttatttttttaaaaaaagtcataaaaatgaggagcattcatataaaaatagaactaccaatgttcacaacattcttttaatgaatgctcctgataaaaaaaaatccattgtcctattaaaatttcaaataaaaattttaatttattacatttattttattttcaaaatttatgtcaaaattttctgcactaattatttagtctctttagttttataaaatgcacatactgtacactcaaacaaaatttttaattgtttttcaagcttatatttgaacctaaagcatcaagggcaaaaaggacatttgcaaccaaatgtaacagtgaaatgatggaaaatgtaacggtaggggcatggaagggatcaaattgaaatttcaggggtatagaagggatcagataaatttcaggggtatgaaagagattgagtgagctttcaggggtacacaggaaatttactcttttcctaaatctcgaagatgatataaagtttgggagatgcagtgatggtgattatacggttagtcgtgaaatcaaagagggagctcatgggaatggggatacaaatgtatattcataacttgactccttagcgggttgaatccgattccatcatggatctgattgccaaggacacctcttcggtccccgcctcccccctccccccccaacctaggtcggtcgttcatgaggtgggctatgggagggcaacatgtgtctccatctcgctcgatctcccgatccctgtctacacaaatgtggaatgatacattagtatcatgtatccctggccatgttgtataaaatggttctcccaagtaaaggttaaaacggcaacagttttgaatgttcaggttacacaatgcctattctttatagaaataaatatttgtttccgaaccattacttttacatcgtacaaactacatttgtgatccacgaatctatctatctattatatgtacgaagtccattaaactttctataaatgctcctaagccaccacatggcatcctataaacgcttataagctgccacatggcattctaataaatcggtagacccactatttttaactactatattagatttcttttagaaaacaataaagccccataatcaatctctctcctttttccgttgggccatatggtacatacaatcctccagttctcctgccggtggccccgagagaaaaaaagccaagaaaaataatatgcacgtatgtatatatgtacacgtattcacggcaaaaaaaaggaaaataagatatttacgtacgtacatatgcacctatcatcaaaaacaagaacaaaagcaagcacagtatcgatgggaaaaaaaaaagaacatctacgtacatatgcacctaccatcaagaaaaacaagcatcaataaaacatagcacatctatgttatctataataacagaagaaaaatactacatcacatattaaagatattttcaaaagatcatttttaatacatttttatgcctttttgtcaccaaatagtgttaataaaaactgaacaccacattgatttacaaacatttcgatcaacttcatcctcctgtgaacccaataaacatatctcagagaaaacaaaggtccttcatctccacttcacctccccttcccctcacatacgtatatcactgtctgcttctccctctgtctcgaattggcaatattcattcctctccccattcctaatatttagtaatccaactaaaagagaaataattagtaattgtaattttcaaatgatgataatttttaagccacatgctacacatcttatgtctaatattaaaatttctctatttataattaaaaaaacaaattaacatatatatacctacatttttatatataagattagtcgatccatgttttctatatggcagtcaaatagcaaaaaaaaatatgataataaataacaacaaatattacatcattatatagatcattttataaatatgcatagataaactaaatcagtagaatccaaaaaatatataaattcaagtatgaaaaatatttttatcgatagagaacacttgcctttttgcatgttgtctgaattgctataaaatgctataaaataattcaacaacacatgttgcgccatcatatatcatatgtagatattcttctacaacttttaggtatgaacacaatttcatttatttttttgtccatgaaccattaaaaacaattgtcatatataagacacacacaaattataataaatttattcagactttggaaaccaaacattttcttgcgcaaacgagtgcatgggagagaaagagaagtacagagagagttagcagaccagtcttaacgagctaagaacaatgtatcaatattaagtgggacatggcacaacgagcgtatttttaaggcatggaacatatttactaggaattattcctacgagaggatcctatagcaaccaaataattttcatgctagaaatgaaaaaaaatgaaatattttttttggtcttgggaaaacagggattttctatggtctttgatacgatacaacataattatagcaactggataggtattataggctttatataataatctaaatgcacttgataaatgccaggtacaagctagctaaataaaaatttaaattacaaagtagtcgatctcaagtaaaaaaattcctaatattaaattattttttatggaaaaatatttaaatcatgtaaacaatcatagtgtaccacattttaaaaataatgatgcatgcacaattatataattttagttgttcgattgtgttcacgctaggttgcatgaagcctctcacaccacgcaaatagtgttcataaatagattgtgtgtcacaccacataatcatattggactctacaaacccatgtatatagtgtagtcttatgtcctatccaatccactaattattgaccaatgagaatatatatcggccttaccaacttatataaaatgtcattgaaagttccatgaaagttgaaaaaaaagtgtaatgctctgttactatttatcatatcacaaattttatacttaaaataagacttgtataaaataaaatataaaatacaaaaatatcaacagggagtaaatttaaccaattggagaaattttgcttcttacttcacacctaaattgaaacgactattgcaataaccatttcataataattgccttagataattagaacaattctaacaggttaaaaaaaatatctaagcaatgccaagaacaaaatttatgaagaaataatacttttgaagcatatggcatacaaatattatccagttaatataatgaatcttatgatgcaagcccgcgtatttgcgtgggctttctagttgctaggaacatgtatgattgtaccatcatcccagcttcgaatttcttggcttgctcatcacggatgtaactaaggtcacaagaggccactatatgatgaagacgaagagctccgaaatagttttacaggatgggagatatgggcttggaatacaacggtggcatgcattatttgtctagaactttgattttagtttcttggatgaattacacgtcacccgctctttctgtgcaaaatatgttttgcagatagagattttattggcgttatgtcctacagtgagatagtatgatccatgttctcttcaatgattttttatctactgccttattctttattttgttcagatataaagctagctccagctcataaaaccatgtccggcatgaagggaacactacactacactataagggctcttttgatttgtaggaaaagtgtaggaaatttgaaagattttaatcgtatggaaaaatttccgatgaaatcctttgaaacaaaggattgaatcctatactatcctttaaaattcctatgaaatgagtaatcctatagagattttagaggaaagttagcaagaggtccaacctcttgaaaaattcctttgagtctctctctcatccgattcctacatttttcctgtggtccaatcaaatagtcattcatgtgttttccaatcctctgttttacacctgcattcctgttagaatactgcgtttttcctattcctccgtttttacattcatgctattcaaaggggccctaaaagaagggtttatgatctgtaaagtggatatatagtccaatattacgcctataccttgttgttgctagccattaattcttcagatatgcctttcatcgccatgaacactacgctctgtttttgaatgaaaggttccctcatgattgcagagttgagagttgagaccttgagcacaatagtgcatagcagtccagcccaacacccccatttgctcaatgcatgttttcctggaaggtcgtctgcgatggcatataaagtagtatcatttttgtttcacacaaacattttcttcatatatacctcccaagcccaaatagtaatatgtaaccagaatcaggttcactgctccctggttggcagagtggcgattgaatctcgtccaactttctatgctggcaacgtacgttcaactgctttgaagtggaaggcattaggaaaatggtggaaacaaggtctgcaatcctaggttggagatatgtgcaggtcacataatagctccgagttgcgatggcatggaaaatccattgaaacaagtcgagtaaatcaaagtatgccgctgctatcttattctgcaatttaaaagacgaaaaggccttgaatcgatcgaaaccaacagattttgtgtactatgatactatctcgcatatataaccattggtagagccaaggcccggccagcatgggcaggtgtccatgctccgacgcatgcagccttgcattagagctaaatacggtgcttagccattagcatagctgcacatacaccattagattagcactaattattgtacttagccattagccagcagcccaagtttgcttttgtccatgataaaatgctatatgtatctgtgtttacttataatttgttatctatcgttaggtttgcctaggctaaaaaaatttttagatccgctactgtatataactacagaatggcgctaaaagtaaagagggacttaaatgtatttcctatcgttcccaatctattattgctttgatccatctagtttagcttagaacaaaagacatctgtaatggcagactaatgtttcatctaatggaagatgttcatctttatattgagagatttcgaaaggagtctttttggacagggaggtatcaggttgcaccatagagttctaggcaatctctgtagaacttcctcttgcaatatctggggaatggtgatcatgatatttttccagaaagtccttcatgaccatcgcccgtacgttatggctttaatttggtgcttgttgttagttttcagtagagcagaggagctctgcgctgcaaaattttggcaccgatactgttgtgatcatatgctcagagaacttgagaacttagtggtgtcctggtctaatgcagtacaaactctagtactctctccttctctaaatgtttgacgccgttgacttttttaaatatgtttgaccgttcgtcttattcaaaaacttttgtgaaatatgtcatactatatgtatacataaaagtatatttaacaataaatcaaatgataagaaaagaatcaaatgaacggtcaaacatctatctattatatactaaaagttaattaaacttcctataaacgctcctaaaccgccacatggcatgctacaaacgctcataggctgccacttggcattatcaaatctcaccgtcgattttcacttaaattggtggacccgttattttataccattggattatatctattattaaaaaatttcaactttctctgtatatgatttaagagctactactgttgtcatgtacgtacaggtttatacgatgtcttctcccgtacgtacttatgtgcacaaaaacaaaacaatagtttacgtactattcgctggaaagaaaagaaaaaaaccatgcgcatgtacataaaaaagatgacaaaaaaatacatcataaaaatcgatgatctttaaataaaatatgattttctaaaatatattacatcacaaatataaatatatatagttaaactaagatctataataataatataaaatatccaaccaatgttccttgaaccatcttccaaattatttttaaattatatatctaatttctgattccgttgttttcctttaattaaattataagttatattgtggtcttaaatatatcacgacacatggggctgatatataatagttagtttttgataatctattatatactaaaaggctattaagcatccttaaaacattctcaaaccgttatatggcattctacaaacactctcatctcaccatgtatcactctagaaaaattatagaaaaaacaaaacatctagctatcgattttcactaatatacggtgcacccgtattttctaccctcggatttccttaaagaaaaaaaaaagaaagacccacaccccaccgcttccatccattacgttacattaggtatatgtacgtagttacgtactccctctgtttcacaatgtaattcattctatcatttctcacattcatattgatgttaatgaatttagacatatatatttatctagattcattaacatcaatatgaatgtgaaaaatgctagaatgacttacattgtgaaacggaggaagtatcatatatccctgccctcaccctaatatataagggcaacatgccctcctattttcaagcattttcttaattaatattggaaaacatactttgtaataaattattttaaacaactatatcatctaaatagctattttttattcgtgcatgggacgagattatttacaataaaatttagaattcaatacctacattaaatatattttaaaagtaaaataaatgtatttctttgggtcatataatgctagagactacctattggtcactcgatatatattaagaaaaatcacatagatcagtgcacgatacatgcccgcgcattcgcgcgggctaccttcctagtttttaaaaaagtcaacggcgttaaatattttaggatggaggaagtatatatgtttgtcacagagaacttgacctgctatgcaggtggctagctatgggaagagccccagcatgaacagcattgttgtacttccgagacctatgtggtatgcacgatgcgttggaacttgacggccttatctcgattatacttatggttagcaaccaaaatttaaattttcaatcttcgagttgattttagagttttcctcatcatacagcctttgcttttagaacatatatatatatatatatatattttatttataaattattttttgtttacaaatatattgtttggattttcgtcgaagaagccgaacgatgaggctgttagtgcgataggcaaggttttttcttaacgaatatccatgcgtcaggcatgtcatggtgacatcaaagcagtttaatttatttttttttgtctaggaattaaagtacgacttaacatggccatctgaattctgaaaatatggtcctgttttgataccaccctataattttttatccagtcacattaaacgtttgagcacctacatgaagcattagatgtaggcaaaaaaaaataacacttgtacagattgcgactaatttgcgagattaatcttttaagcctaattgctccatgatttgacaatgttgtgctacagtaaatatttactaatgatggattaattagacttaataaattcgtctcactgattactgacagattctgtaattagttttttagtttgtgtccgaacacctcatgcgataccctatataataccagatgtgacagacccaaactttacacccctggatcgaaacaccccatatgtcgaggaaatgctaagattgcttcttagaagtgcagtttgtaatttatatctatttaaagtggttctggtgttacatatgaagatctgtcgtacgtctgtatctactcaatataacagctagtcccagctgcaagtatttgtaaagccataacctttcgatgtttacaaaggaaaacactatttttaccaggtgtaaagagtgcagatgcctacatgtacacagcttcgtgaaatccgacacctatgcatgcaattcgatgatccaacctacataatgttcagtccaatgagcttttggagctccggtttttggcttggaaggcgtcaggaaagggaagatcatagtaaagatgaacatcctcactgcatgcctatcagcatctcctattggaaggctggagacggtagtctacattgcaaatagaaggccaggttatgacgcttccaccaactggaacgtaacaatagtcaagaacaccatcattttatagactgatctgttaccagcttgtagtgaaacaagggccaaactcaaaaaacctaatatttgtttgaccgggctcaaaacctagttaatatttagtggttatagatgtgcaagcactattattaatttgtaatagttttgaaaataaatattgtaccttgtatatatattagtatgcacaggttggtatcacaaaagatttagatttgaggataattagttgtatattccattttaattgcctttagacttataatatgttcagttggtatccattgtaatgcatggatttctgatgctaggtatatattgaaaacattattcgaaaaatatgtagcttgtcattcaagcttttatttacactagggtggtagcccacgcatatgcgcgggcatgtgcgtgaaattttattgtgaatgtccatgtgtgggtggttttctataaaaaatattcttttgattcatcataaactaaaaatgaatttatttaacatgctttgtgtaaaatcaaaggtgtttttgattattattctgtaatgaacaattggcattggagattatcggttttgttatttggaatttattctcgaagtggttttgaagataattggatttcacaggtgatatacaggatactgctagatttgtgtccggtcagaccgggctctggtagccggtcagactgttggtatatgcgcggtcagaccggcgcagtccgcggtctgaccggccgacgctatgtcggtttcgatttcgggttgtttctttggatatccgtgattatttcatgattatgacttctagatggatactatacgtatgtaatactgttgtttgctactaatgagtcaagttggagatagcttcgtctcggaatatggtttcagagatcatacaggatacttaggctagagttgatgtacgtggttgatggagattccatattgcatacgatggaggtattgtgtacgtatgggatgcggagtcgaatttggaaggagtccaaatttggtacgattggttatataaagtttctttcttgtactagagggtttcctaaggtgtttaggactcttagtatgagtttggttcgtggctttaggcttcctacctcgggtataaatagagggggagcgtgaggcttcccggtatcgcttttgagagcaattgagttgagttttgagttagggtttcgagtttaatcgaaatttttgtaaggagtgttgttggtgcactttgtaaacacagagagaatcaataaagtcgtcatccactttaagagttcttcgatttgtgtttaccgggtttcggcggtctaaccggcgatataccggcggtcagaccggcggcacgcggcggtcagaccggcggcatacgggcggtccgaccggcggcggcggcaggcgacttcggcggttcgaccgatcgatctacatcggtcagaccgacattcatctagcggtcagaccggcaatacaacttcggtcagaccgcgatccgtcgaatttgagggtaacttttattccagctaaaagttttcggtttttgggtatactaaccattcaccccccctctggttggcttagttcttgtatttcgatcctacaagtggtatcagagccttgttttcttctttggatttttatcgatctagagtttttgccatggctactcctgctaggtttttaactaagcctcatgttttcgatggaacagatttttctcattggtgtagtgggatgcaatattatattatggctgaagattatgatatttggagaaaagtttcttatccttatgtgattcatgaagctattaatactgctgctaaaaaaactgcgtttgaacaaaattgcaaagctcgcaacattcttttgagtggtatttctcgttcggattatgatcgtgttgcgcattttcgaactgctcatgagatttggaatgctttgagtaactttcatcaaggaacaaataacatttaagaacttcgtcatgatattttcaaaaaggagtatattgaatttgagatgaaacctagagaagctttggatgactatcttcctaggtttaataaaattttgtgtgatcttagatctgttgattcttcttatgatactaattatccacaatctgagatttctcaacactttttaaatggccttgatatgtcaatttgggggatgaaagttacatctattcaggagtctgttaacatgtctactttgactttggattcactttacacaaaattgaaaacacatgagatgaacgttctttctcgtaaagttgattctaagtcgagtgctttgatttctttttcttcttctttggatgttgatgctctttcatcgaagccttcctttcttgctgtttttaatgccacatccgatgatcaactcaaacagattgaggaggaggatttggctttggttgttaacagaattgcttgagctatgaataatgccaggaacaggaaaagaggtggtccaaatcgttgctttgaatatggttgaattgatcatcttcattcgcattatcctaagcttggaagaggcaaaagagaagacaaagatggtgagaagaccaacaacaacaagccgaagggttcatgccaagggaggaagatgaaggagaatctcaggaaggcttttgaacaagccgaagggttcatcccaaatgatgtagatggtgagagtggagatgatgataagggaaagaacatctctggtgtttgcttcatggcgcgtggtgaatcggatatagagtatgaagatcatgaggtaagtgcttttgaggaagttactaatatcttaagtgcaaaaaataagaagtgtgagaagatgtatagaaaacaggaatttatcattgaatctcttaattctgaaattgctagattaaaatctcttattcctaatgatgatgattggaaaaattgtgaggttttaatgaatgagatttcaaaaattagagatgttaatgctgcacataatttgaaaaatagatcttctcttgcttgtagttttgctttgcacacacgcactttggatgagttgtttttaactaaaaagttgttgcaaaaatatcaaattgcttttcatgctagtttgatgtttaacatgatttctgctaaaaagttaaaacaacctcatgatgttttggattgctcaacatgtaatttgaataagatgaaactgaaagatgctttaggtcgtgttgagtacatggaagatgttgtgaaaaacaatgaagtgctttcttgccctaaatgtcataaaagcaaaggtgtcatggtagattgtgaaaattgtgctaatttggaaaaagaggtctcttatttgaaaaattctttgctaagattttctgatggtaaaaagaatctcaacatgattttagatcaatctaaggttagcacacataaccatggtttaggttttaatcctaatactcataattctatacatccacctgttgtgttaggtgctggtgctagagatggtgagattttggttaaacctgatactaactaaactgtgtttaaatctgctagtatcatgtctaccttgagtgcatcttcttcaaaatccaatattgtgcatgcaaaacctcctgttgttgcttgtgttgctaaatcttctagttctaccaatgtgtctaatcatcgtgaaatatatacttgttctttttgtggcaaagatggacatcttgtcggtttttgttttagattagctcataaacagaaaaaggagagagagattgcttttgcaaaatcaaagtggcaaaaattgggttttccctcgaggaaaccgatcagaccgcagtgggtcccgcggtcggaccggcgaccggtcagaccggctactgagcatcagtcagaccggcggtgcagcggcggtcagaccggaccccggtcagaccggccactgtacctcggtcagaccggcctcggaggaatttttctgaaaattctaatattgattttgcacgtggatatatgcctattggatcttctggtcatgtgtctcagtactggattcctaaatttttattatcatctaaccccagtactgaggcttcgacttctgcttgtgtgtaggctttggtggcaaggaaggagaacgtgtagatcgtggattccggttgttcgcggcacatgaccagtgataaaaattggttctcctctctcaagaaggcatccaagactgaatcgattatctttggtgatgcttctacaagtgccgttctcgctacaggtttggttaaggtaaatgaaaattttgaattgaagaatgtagctttggttgaggacttaaagtacaatttgctttcggtttcacaaattgttgatgaaaattttgaggttcactttaagaaaactggaagtaaagtttttgattcttgtggtgattctgtgttgaatatttctcgctatggaagagtgtttaaagctgattttgaaaatcctatttcacctgtgataacatgtttggttgctaagtttgataaagatgtgatgttttggtatcgtagacttggacatgttggttttgatcatctcacttggttaagtcatttggatcttgttcgtggtttgcctaagcttaagaaagatcttgatttggtttgta

SEQ ID NO: 66373 - DNA, 43924 bp, Oryza sativa
  unsure (1)..(43924): unsure at all n locations
agttcttgatcctaataagttcatttgcttcattttctattttatcagcctgcagggaaaaaagtgggcaaaaaaccaattcaattcaaagctgtgttgccagacactcccaactttaaccacttagcaaaccatctacgaaaaaccccgacctgccctcgagctgctccagcaggtgactgaagtgaaatccggcaaagaggcatacccgtacgtgaacccttatcataaaaaagggcaagaaaatgagtataatgacttagcatactcaagacaaattccaaaatgaggttgatattagagtagtgataccttttcaccagctgcaagaataaatcctgccaagttgaatgcaaagcccaggcaatgagtaccaataggactttttaggcttagcattgtatcatataatgccatgcatggtgtaagctgcaacatcattgatgaatacagtttagaaagtcactcccccagaaaaaaatgcagtgtgcgacatagattagctaacagtaagttgacttggttagatatctcggttaactagttggaacattgaaacaaacatttgacatattgataaggtatacttgaggaacataggttttaaagtactcttgttatgctcagtgagcattgcgcacattgatttccagttgattttgaattccaataaactttctttccataccaggtctgatatatatcatctaaagtaaaacaattttccaaacaattgaaggatcatgttgtcataactttcccccgtcctagattatcatgactagagtggccctctttccaggataagtgttttgatccaatataaatagttagatacataagtttttgtatcggttttgtcaacatgtacaacactgaaaaataagatcatatattcggacaatcccaaacattctaacttacaaaccacaaagtagcactggaacgcaggaagccccttcaatgagctatacatgcggtgttagcaactgattagttcatcccagttttattaaacttttgaaataacaccccggttcaatttcttaaagtgacaatgctacttgaaaatcacaaaatcatggcctggcatatccacatatataaaaatagagtaaattgcgccagttgtacaaaaacttggcaggtgggtgcgatttagtgtaaaaacttgtaaaatgagcaaaccggtacataaacttaacaatcacgtgcattttgataaaaacactgttacataccaatgattcatcgtattttattggttgtattgtaaacatatataactgctagattaattgttggcaatgagaatgttttgcagtgctcatcaccgattttttttattagttggatcgctcagaaattttgttagttggcatgcacttagttttgataatcattatttttttccaattttaaatagtagattatttagtatgataaccaagcaaatgcaatacatctaaaaccttgttcagaactcaagatgatctaactggctgctttttctttacatagctgaaaaagtatggtttggaagagagatcttttaaccaaaatgcacgcactaaccaagttgttacacctgtataatcatttttcaaattcttgcactagatcgcacccacttaccaagtttgtgtactatagacgcaatttactcataaaaataagtggcataaaaaaaaggctaattgaagctaacacaaggtgtggtatgttaagttcttacatctcctcctggaccattaatgtatagaagaatctttttagtgttatcaacgctgtcaagatacaacatgctcgccaatacttggttactaaactcttcatctatactgtccccaatgaagataattcgttcgcgatactgcacatgaacaatttgaattagataaacattaatacagtcacacagatagaaatagatgcaccacttcaaggaagcatcatactccattaggcattgtgtagtcttactagagcattccatatatcaagccattgccaagttccttcaccaggtgttctgtaaggcacccgtggtgtaccaacaggcatcattgaaatgcgcgccctggtagccctcttgtttgataatctagcaaattttaatttgaagtgcaatgagataaaataagtgaacaaacaattcagacaaactacaccgacattattcagatattctttggctacctcaagcgctaacaaacatacatattattgttagaacaaaatattgcctataaacctgatgggtgttgaaaattggcttttgaaaattgcaaaattatccatcaacacagacaaatgcccagagctattagattttacaaaaagtatcctttcacatactaacaaacctacagacacttgcatgaaaagtgcgacgcataacaaaaaaaattgaactagcacaacaagcataatcagcacccagaatgaagagttgctgaactctgaagattgtgcagtatcacaatcccatttatccttcccacattataacacatacacgatgccccccaacatcaagttgagcatatcgatggctgcgcacttgtgacgtaccccagagagatcctccggttgacggcggtgtaaaacccggcggtgacattcgggcacgacgactccgacgagcctgcaccgcaatttccaaccccacaaacaccaaaaatcaaacaatcgacaacaatgaggacgaatccgacataaattcgagaattaatctttttagctcctcgctcacctagcttggtctgggccttcaacccgacgaagaccttggtgcccacgctgcaaaaaggggagagatattaaaatgaaaaaaaacgaagagcagaagttgcagggagggttagggttttgggggtttggggatcggagaaacggggaggagttagcgggaggcggctgacctgaaagatgagggcgcgctgcggcgccggcgcgcgggtggaagcaggaggagttcgccggcgccgccgcggacagcgccatcggagtgatggggaggagagcttagctcgcggggagtgactgacgcagtagtggataacgaagatgcgcgttgagattcgtgcgtcgctcgatcaccgtaggtgcagaaaaggaagcgtgctgtcgtttgtctcgtttctcaacagtgaatttcgtagttatatgctggttattttaggatgaaaacaaaataaatttcacatttgaatgttcgcattagagagaaatttatgtggtcaaaatgtaaaaaaaaaatcgattataagcataatacaggacgtgctggaggcagcagtaatctactcgtctactccatccgttcaatatgccataagtacatagaaaaaacataataatatgtataacaatcaaatggatttttattaaatctagtataaatatattttaatagtatgtttgtttccttttcaaaatattgatatatatttatataaatttggtttcacttagttaaagtgttttatgatacggaacaaaaggaatgccttattacaagttggcaaatataagatgtacagtcatttgacaacggaacaatatgaaaaccatgtttttcttttgagtcgtgaccaccatttatagtacgtttttactgaattttcacttcagatgttgagaaagaaaaccatgaacatttaaaggttattattacagtgcaattcaccttcacatccagtgatccaggcatccagcattgcatgagttctctcccatgtttcttttttttgtcaggactgaactaagttaaaactcaataaatatagcaaggccagatgtttgtcaactacactaaggtcagatgattcagtagttcttctctgaattctttgttaggtttcatgcaaaaaatactcaacgacctatgcaaagtacattaggcaacaaaatagaagtgttgtgccatcaggtaatttcatctcaatactgttctagcaagcctgaatagacattctataagctcaatttcctgcatgtagcgcgtccccttgtcaacaccaccctgtcaggcaaattaggcaagttcaggagaagagatcagccatgcaattcctatggaggatgcaacgtgatatgaacgtatcatcagaaataaacgataaatcaagcaccttttgctgctctgtcctaacaggtggacttgagcgccagagtttcagactgacaaagctagctccgctcgtgtttctatcggttttcttgtcgtccctgtcctttgcctctccttccaattttgcttttgtggaagcgaaccaattgagttcatcaaatgagttatcttgctccaaaaccttagtgccatcacattggaaatgattaacagaagcaagatagaacgttcatatacgttaatctgggagcaagaacttgtgtgcagagggaagaagccttgtatcagaaactgaataaattaccagcagggtaataccgacaacaagaacatgttcatagatgttcctgtaaaataaactggaaggaaatgaaaactgcatctgaacaatgttaccttgaggacaaaagcaactccaagtaggaaaccatcgtaagtatgtgtgtatctcttgtcttcatgcccccgtcttaataatttatccttgagaagaagtctacattccatcatgtgggcaattacggatggaacaatttgaaagaaatccttcatttcgtgaagtttattgctctggagcttctacaagcatacaagaaaagtatgctgtcagtgataaagaaataacaaatcttcggttggtatcctacgcagtggaccttaggaagcaactaggtgcgagcggatcttatccatcggattacaagtacacgatttagatttggtgggctgcatgagtgcacggttcacttaaactcaaaatggcttctcacttcttcaatattttctcgttttcacttcaaccactgactacccaagtgagccttcggctgctatgctccatggactaccaaataccagctagcactctggccataaccgctgattgcaaatacgacataacagcaagcatcaccctgaacttggaattcttgcatccactactagcattgacctgaactagtaaccatgcttttaacagtacaaaagtgcacactacacataatggaacttgtccagatttcaagtgtacagggtaaaagatggaacatcagttccctagtcgttgagaaacagatctccgacaccctagagctttggagtctcagagccaacgtgatagccaggcagaaaattcgctcctggtgttcgaggcttccctaaggaacagtctcatgtatatacctcttgtaaatccacccccatccctctccttctctctgtctctcttctctcttgtttctttctttctataaccttgtaatcttttaaaaaaaccctgtaaacttcatttctatcaatgaaatgactataaggtagagccagctctaccttcttacgtcaaaaaaaaaagaaaaagaaaaagaaacaatgttacaggtgaatgatgcaaataccaaaccacaggaaaaatcatatgaaagtttggagttattcccttgtataactgttccaaaacattgtccaaacaaatataaccacagacagaatgcgtcacaactaatgcggtaaaatttgcttgttaactggaatatcatattttcaattggcatggaggtagaatatactaaagaactaaagatagtacctttgaaaagttggttgctaatattgaaaatggctgaattctatcgtctgatggatcattgtttcttgtgcccatgtccaaaactttactaatttcaacaatgtcatcatcccaccccagcagcttgcaacttgtcgtgtatctcaagtcaaatttgggttttctcacatatctacgattgaaaagaaggtcctgctgatgaagaaaaacacacaataataacctctacagatgaagttttgtacatcataccgtgacatgttgttcaaataacgggtgcggccagccgtaagtaccatcatgagacctagtacgctacctattctagtaacagcagcttgtacttgttcaagcaagtctagagcatggtctccaagcccaagctttcctagggcaaatttcatgtctccttgggtagcaggatgggcatcggacactccagtgttctgttgtaaagctacaagagttgattaaatttggtagcttaaatagtgcttatgaaaaacacatgcatgtgttctgaacaggatgaagtgcctaaggacaaactgtgacaacttcagtgacagaaatagtatgttttaccctgtaaactacgagtaacacgttgcgaataatttggaacagtggtagtaaatattacctctgattgtttgaaatcccttaataaatcaatttcaatgttgctttgaagcaaagcatgaagatctacaaacatccggtttaagaaaacaaaaatggaatctatatatgcagaaattcgctgtaaattgcacatggcagctgaagatgcaatatgatccacacataaaactctcaagttttttcggccttggccacccagatcattctcaataaacatctgcatgaaataaaacattagaaaagatcagttcgaaaaaaggagggaaagagagggagggagtggggatgaggaaagagggggctggacattacattaattagaaaaatatcctaatcaagtatgttacatgctaatacatcagtgcaggtgcaaaatatgtgaaatctatctttttcacagactagataaaggggatttgtgggctatcatcattctggtcagaaatacgaaattatgacctccacaggaatccatatgaaccatgatcactaaagcatccaattttcagggtacaaggggcattagtacccacctgcttgacaatgttgtaggaatatgcctcactaaatgaatcaagattttccatggattgttttagatcaaaatcttgatccgcggtatccacagtaagatggaaatcttccagttcaacaccatatttcagctctcctagttgatgcatctctgcatacatctagaatatactcaacaccagtcataagaaagtatttggaaatatatttaagtttcatacagttcttatctatacatgaaaagtatggtgcataactgcgtaccctgttgtcatagttagacatcactgagtaagtatagaacgcagaatttagatggttctccacaagaaatttaatatcaacaaacttggaaggtagtctcaagggcttcattcttaagtaccacgaaagattacgaaccccagtctggccaacagtataagcacagatagtgtcaccataagaaaataaatggcacactgctcaattaatttagggaccattaatttaatgcacttcataacctttgttgggttcacaaagactgatccttttaagtgagtggaatgaacatggagtcggaggtctgtctcaatatctctacacagtggggcaacaacctcctacagagtaagatagaatgaagttaagtataccctccaaagagaacctgcaaaagctagaaaatgttttaaggcattgcccgtgccctgatttttttagtatgaatattctgcaagtgcatttgctactttttttttagaaacaacatagtagtagagtactgactttattttgcaaggaacggtgttgtacttatgctagtgacaaactgcttttataggattacaattacaccaaaaacaggccttcatttggttcttatacaaaatggaattgcctagcttgtccacaccacaaaattacaacagtacacgagcaaaagaaccttggtccatacctttcgcagagcattctcaatttcttcctcatagtgctgaagagtaacagttcccacattcccaagtgtaagaagtgacattccatcagaaaatgcatcaatgatgttcctgtcaactcaaaataatgaatgccaagaaaaaccagtgataatggagatttctcaaaaaggttgaacaagtaaaaaaaaatcttttgatgttcggttcaaacttatgttcagctatcaattacgagaattaattccatgactggaacaactatcatccaacattccaacttatgttgtaaaatcaaacaagaacattagggcatcatcttcatgattatctgtacttactgtagccaagataatttgcaggcatctccatataccattgataaccaagtcacaagcatctcttttctccaatacaaaaagctgcagttcgtcctttcatcaatcagagaccagaaattcgaaagaatgctgaacttcgatataagctttctcacaccaaccaactcaatatccaagtaaccctgtttcatggctaagacattagtgtcacaaacatcagagaaatcaggctatgcattaaataacaccagcaataaagaaacacataatagcatttactgaagttcaagagaagtctgcaatcaaatcgttttacaagaactctaaaagattagttcgcaatctgctccaacttcagactaaatggagatgtgcagatgtaaattctacatatcttaacaatatcccattttggttataatatgtgctagctccctaacttaattagttcatgtgctatacactgcactcgcataggaaccacaaaaggctaactgttttcccttggaacaccctctaaccagctaaaccaagatggtaataaaggttggatttgaatgtgtagtgtaccagactgtgcagaatatccattgtaatagaaagtgtcagttgcctctgagaactcccacctccttcaagcaattgcaaggacatcagaacctggagtaactcagagatgaacccatgagcaaactaaaatttgaaattggttccaaaatgaaaatcttcttcaaaacaaatggactacaaccaatttaataacttaaagggaaaaatgatgattttgacgtttgaatctgacaattagctgaaaaagggtccatgtcaatacttgagtacaaacacttgagtgcgtcaacactaaacaactactagtcccctaattaatcattaacaaacataagatgaatagctgcaggaaatatctcccaacttgttatattttcctagtaacaaacaattaaacatcataaacattttgaaacactttcctcttcaatcaagagataaccaggaacaggacaggctggttcatatcgcaatgattaggcagaggaaacagacaaaggaaaataatagatgcctttaatgtgaacaaatagataaaaataggacctcattgaacattacatttctgcatttgctgcaatcctcataccatgaaggcaaacaagcagcattacagactcgacaaaatttgcatgtttatctatatgggtaattgttccaagatgtattaccaacgaaagtgaatcaataagccttgtctccgtgtctgtaccacctaaaagtcaatggaattttatatcaggagtatcaaaaaggaaataaatgagcaaataagtgcattatatggtatacaaagaaagtatgtctggacgcgttctttatgttctatcacaaatttctggaacactaccaatcatcgcttcccatagtcattgtaaaaattgaaggatcaagtagcacgctaagaagaaattaagctatatatgatgatccgttatacccttttgttcaaactgaagaagactttttagttgaatatgtgtaccctaaacggcacaatgtttcaaacagctatagttctaaactgctacatctagagctaaacatctttcgatggacagaagttcacaatgcaaggctgaatgatgcttctcatttccatgtataagaagcttctgaaaatagtattgtatgattctttttcacagaacacataaaaagaattgcttcacataccacgtatcaatgaactaagaaatcctgtcttgactgcctgactccccttggctatttcattttgtaatttagtctgcttaacacaagcaaagcaataaggacaatcagcactgtaaaaacaaataaaaaaattgtatagttcaggcagttggtgaatggaccttcaatgatattatgagttgttcaatatcagattgaatgatgttgattatgtgaggaagactgcgcactaagctagaccctttcatgtggaacaagtctcctatggcctaatacaagagagttagtacgatgttaaataacagagccacttgatatttcaaggaaaagccttgttcaggaaaaaaaaattccaaggatatgttggtagctttctactaccttcaatgacacaatcatttggcaaagagacttggctttctcccttctcagtggaaccttccaacgaggcaatgatcatcacagaaattagtccatataattcataaaaaaaaaatactacgtagtacaaaaaggaggtagtggtacagatgttaaagtctctgaaaaagtaatgctcgaacaaataattacaaatactaagttctctgttggtagtataaaggttatagtgtaatagtatgtatgtgtcaaggctatttgttatattctagtggtaggctaggattagagctctcctcctcttttttattttcccattgggctctcacaatgttctctaatagaaccgtgtcttcctcaaatgttatcaagttggacaatcaacttagctacatacaaaaataaaattataaattgatgacagctccaagtaacaattgaagaaacaatgagcccaaattggtattgcgtgattcaaagcagggtaataaaatttaaatggataggtcacaggatccacatggtaatcagtaaagactgacaaggcaaaatataaagagtgcaaaaggaaaagtgagaagtgtaggtacctcaagatgcatatgcaagtcaagcattgataggacaagcatatgtattctatctgcaagcactactccctgcaccgaagagcaagcaaaaataaacatgggctacttaactcatcaggaaagtgtctgttatcttacatcgcaacaatcgatatgtatgtaaatgggaagcagttttggcccactcacccaaagtgttaactcttatcaacttacagaacagcaaaattatattcttcgtaaaggatcaaaaggcattcatgctcaacaatcatgcctcagaaatactaattaagccacataaaacacaaagaacttgatgaaagtaagaaaccattttgcaggtcaacaagggcagcaaagttcttctatcctctgtattttggaaatttagcggtctcaatggatttacatgacagcattaggaaagagtcaaaacacaaagcagaataaaagttagaatatgacctgcaaaatttgtttctggagatgtcgaacccactcttcagtcagcatctgcgactgaaaccatgaaagatcaaaacacataatctagtacagttcccagaaatgtaaaaaaattttaccgatggatgaatggctgactggaatgaaacagaccagcatgataacgaatcatttatggcttgaatatccctgcacatgacaaacaacacttacagtaaaactgaagtgcccgaaattatactgaacacttagcagaaagggccatttggaaggatgtcatgttgagatgacaggctaatgctaaattggtcctggcagaagagcaaaataggcaaggcatgtaacccatccaaatgttccctctctgatgattatctcccaaaatatacttatgtaagtcaatgagacatacagcttcaatatttaaatattccacaggtaaagaaaatagtaattgtagtggctaagaatgtcgagcgaaagggatcctgttaagattgatatgtaaagatgaccaaatagtcctaccttgaatgcatttcatttaaccgtgccagatagctattcttcatgataccaaaagcttcacaagcttccttaatgggtggcaacaaagaaagtgatggagagcaatgaaacctaattaagtcagatagcacaatacgctttccaccttcaacatagaccactggaaccaactgaaatatctccactaacaggttcattgatttcttatcaggagcttcacctaacaaaatatgaaatttcagaacattgtaaatcttagcaatcttattatgaggcacaatgataggttgacttgaattattggttaaaaaattaagctgaatagaaaggcaaaaggaatgtacaaataatagtgtatacagtatctaagacaagaagaattatttcacggagaaggcaaaataagaaatgcatgcaagaggactagaaaagaacatatataatggtattaataaccaagaacattcatcaagtaccagttgtcgttgtgaagaacaaaaaaaggcctagaagatggagtatagtccttcgatcaatggggagttccttcaaagaacctgaagtgtaaaaatcaatattggtcctattggataacataactaacaggcatttgaaacatacaagtaaatgtactgaactaaaaaaaattgcacgctgctcaccgatgcgttgaatgatctcagaactgctctcagagaagaaagaataaaatgtgtctaacagtttcttattagatctaacgagggttattgaagagcacaaaggtgaatcttcttgcaccaaccgctgacatagaaataaaaatacagtgacatgaacataagaataatttaagctatatgtttataaaagaaaataatgaaagaacatgaaggtgatgcagcaacactcacttggaagaagccaatgtcaaaaagtttctgtaagttgtgtacaacttgatcaaggaaatctacatcctcgaatgacatactaaatacatcgacctcagatttcaccttgtccagcatcctatgaggaaaccaaaggtcaattttctgaacatattgatgcatgatgataatgagttgcatgggtggatagcatatcatttgatattatattttctcaatggaccaagcaaaagtagaagactttggctatagcattaagaaaatacttcaatgatagctcaccaagatccacaacaatttttttaagctatccattgacacataactgaaacactttggagtcaatctttatctagatatcttaagaaattttacctgttttataacaattaatactccgtattttaactttcaagacaccaattataagtgtttaatgaatgttaaaagacaccacttatcagtgttggtaagttatggatggttctttgaacatattgtccattgaaaaattatatccccaccgagaaactaaaagatgtgctttcagtgttacatatgtaattaatactcccaggctgcatgtgtagaatgacccagaccaaatgaacctaataaactagagaccattaataccttgagaatagagataggtaactcctggtattgccattgtgcctcaaaatttcatctaccaaaaggaacaccataagcccctcgccaagtgatccaaatacggttgtcaaatctaaacccttaaatgagttcaatggacgcacattcttgtcacggactgagcagattgcgtccagctgccggagcaggttcccaaggatcatcaccagcccattgatgatttcatacacctcaagtaacaatggaattgagtgtgcaaatgtcttttgtggctccccctccagaagtgcctcatttggtccctctgcagtgtgcccaaagaggagcagttgccgatagagattacttgacgcctagaaaagaaatggaaaataaggtagcaatcacatactgtatttatcgcttgcattccttgcatgtgttcaacattgtaacaataacatttcaaaaggaaaaggtaataaagcagcaatcacccatcatttatggcttgcatttgacatcatttagatagtggatatttcattaagcacttgcaatcatttcagaaagtaacatttctcatttgacgcatttgaattgactttgcatcctagtatcgccactgatactaaattgactacaaaattactccaaaagtgagtcccataattgaatagcaaaaatcaaagatcatggaacataatcgacaagaagtaatcctacacaagcttaaaattgagtaacacgtcacatttaaattcgagataaacggatcaactttagcgcgcttacagcatcagagaggcgggatatctcaaggcacgagtgggagagcacggcaacgaacttggagacgtcgacgttgtcctcggccgccgccgcggcggtcaagagggacgcggcgcccacaccgacgccggggtcggtgggggccacccggagcctgaccgaggcggaggacaccgaggtggacgcggagcggggcccgatctcggcgacggccgcgcggcaccggaaccgccactcgtcgacgtgccgccgcagcttctcctgctgctcgagtaagactgccgccgggagcaagagcaggcagagttaggggagtgagtccaaccgtggtacggagagagagagagggaggggaaccagcgaggtgcttacgtgacgccatcgccggcggcgagcggtggtcgccggccgtcgagcagatgccgcgaggggaggggaggggagtgtgaggaaatcttacatccaagcccctgcaatctccccaattcttcttctgctttgtgttttattcagatgaacccccaaaattacgagaaattgtaagcgtggctctatcctttgatgcgagtgggccgataaggcccgtgaattgtttgggctctttctcgaaatttccagccgattgggccgaaacaagtctcccgtcacggttgccacaggccatccagtttgtccgattgggtcccttttgagttttttttgttcacgtccctcaacctcaaaatcggattcaaagatccaaaaacttatgaaaccattgcaaaatgagtcccttaacggtttggatggcgttttcgtgctacgtgatgcttacgtggtgttgttgtcctggtctttaactgacatggcataggttatcgaaggcccaaagcccatcttgatttttaccaaaaaaagatcaaacgaaattacaaatgcaaagtcaaaatcgttcaaaaaaagaattttcgtttataatggtgctgtttgttgatgtaacagaaagtattgcatttgtttcatttttttttgtccgaactttgtctgaaccaaccttgaaatggacgatcacatgagaatgacctcggttacgtcaatagaataaaagtgaccgaggacgaaagaattgcggttgacctgagcagcatttttgacaaagttttgaccctaagttgttatgttgtttcattggcatctgtcagctttgattcttgcctttgagttgagaatcaacccaatatacatgcatggaacggtacgatcgagtattattagtttattacaataccttctaaatttttattttttctttttatttgaaaaggtaaaaaaacacaagcgctcataccacgcacacactcacacatattttttcaactctgatatcgtttgcttcgtgaagcacggatacagcaacttaattactaaacaaacagtgccaggtgtgcagtatttctagacaaagcaaaggcgcatttgtccaaaggaggggagattaattaacttaagctctctggatgatctgttcctgcttcctggacagaattctcttgccgattggaacaacctagctagcatttttcttttaaatttctatcagcattattcgttgtcaaaatcgtcatcttggtttggacgatcaaatgccacttcgcctccttctcgtacctgctaaattcgtgcacacacatggacaaatactaatagttataatttgccgaatgatttgcagcctaatactcgtagattagcttgggaagaaatcaaatgatgtgagctccaggaaatcatcggatttcttccccctcctccaagaaaatcaaagctaccactccgtacatcaagagacactgacatgtgggccctacagagaaaaaaaatctccgcgcgccaagtggccccacgccatcctagcttcctctcctcttgaaatagccgccgctgctcgtctcagttcgactcttcaggtggaagccacaaaacgaacgcgaactcgagcggcgaagaagaagagagagagagataaggcggcggcagcgagatggcggtgacgatccagtccgtgaaggcgaggcagatcttcgacagccgcgggaaccccacggtggaggtatacgcgagacattcattcgatcccctggaattggaatttcaaattttgttgcgtcgattcggttctgtttttgtatctatccggttcttgattttgaagcgctgagaagttttctgtttgtgttcaaatctggggtttgcgctgtgcgcaggtggacgtgggactcagcgatggcagcttcgcgaggggcgccgtgccgagcggtgcttccaccggtaagcagatggctgaggcactggctcttccattctgaagaacaatgggtgtttttttttgtagtgataattcgttatatgttaataccatttgatcttcgatttccaagaaacgcgtatcttcgatatcatcgaatggttggtcccaataattcttgggcatggcagtaatgaattggtgtgtgcgtggaaagagatgtttgcatagttatttagatgggacaggggattgatgatttttgaaaacactcaaacagtaatagtaacacgatcatctctgtctgtcaaggctgtgtattgaaattcattagctcatcgcccaaagcacttgcaatgtggaccgtaactgaaacaagagaaacctcttcagtttttgtttttttaagaaagttgaaatatcttcagtttgttataaacttatagagatgacaatattagcacgttattcaagcgctgatggtttccttcttaaagatcttagttcatgtgtttttttacgctgatcttagatttgtcgtttaccttggcaaaggtgtacttaaaattcattagatttttctgtttcctgctttgactgtaggaatatatgaggccttggagttaagagatggaggatccgactatcttggcaaaggtgtactcaaggttagcttattggctttccctcgaatgttaggactattttacaatctataaataacttgttcgtttatattgcattttgattgagcagatcatatttcagctgaacagttaacaatccaaagtctctgtaatttatgtttaagtaaggcagcgtgtacgaagataaccgtcatatgtttgtctatctcttgtgtgggtcacaaaattggttcaaaggaactatttggacctgcatttttcaatttgcaagtgcgagaaaatcattgaacttttgttggaaaaactgattgttaggtgttttctaccattttctaacaactgatggcacctatgtatgccaatcaagtaagtcctccatgtctaatggtgataatgtcctcttttggcaggctgtgagcaatgtaaacactattattgggccagcactcatcggaaaggtatgcatcccatactacatgattttattgatatcatacacacacacacacacacacacaacaaagaaaaaaaaaggatagctttcttaactaatggtgttttttgttgcaggatcccactgagcaagttgacattgataacttcatggttcaacagcttgatggaacctccaacaactggggctggtgcaaacaaaaggtattactccattacttgtgtagtaacaatgcttttggatctaattgcatcagacactgtactctttgcgctgacttcctttgatgtggtaaaaacaatgacagcttggagcaaatgctattcttgctgtttcacttgctgtgtgcaaagcaggagccatggtgaagaagattcccctttaccaggtctgttaaacaactgcatcggtatataactttgttcttctgaaacttcagaacctatgctaaaacatcaagaaattgcagcacattgcaaatcttgctggaaacaagactctcgtgctgcctgtacccgctttcaatgtgatcaatggaggatcccatgctggaaacaaacttgccatgcaggtaaaatattgcttgaataacaagaccatgtcgatgcatgattcagtcatattctctgctcatttagctgctgtacaggagttcatgatcctccctactggtgcatcctctttcaaggaggccatgaagatgggagttgaggtgtaccaccacttgaaggtgaaaaaaaaaaatcaaccttttcattttgtatctgaaacttcagaatgtgttatctgaacttctttatacagagtataatcaagaaaaagtatggccaagatgccacaaatgtgggggatgaaggtggctttgctcctaacattcaggtaatcctccataaatctctgcacggctttcaagtcaataaaacttcttagaatgtcccagtattttttaggcaaatctgacgggtttctcattatgaagtagtagaagtgtagaactgatcgtaaacataagcagttaacgtcacttaagatgttctgagaatatgagtaaagctaaactattcagatactatcaactaaacaacatctgtattagtaaaactaagtagctttatttaaaagttttgacaagagttttcaaatgttttaaataaggtggtggtattggttccgttcagaatactttattagagtagtagtacagcgagttggaccgtacgtacttgggccgtctacggctaatttcggccggatgtacacaaaccagcccaactaatatgagccaggaccgcaccctgttctgggcctagtggtatgggccgcataaacaccactgatcccattcaggtccaactaatatgggccgcaccatcacaccggaggaataagttcactttggctcccttaactattggccgaatctgatttatacccctaaaccacgataccggaatctcgttccagccgaagtagtatggactatggacaaaacattaatctgggccggatacgtggatctaacgatggatggtagtcggggcccactggtcagtctcatgtgtccaaaattgtgcgaccccttggatcttagtgaagcaatatttgcagttacttttcatttttgttgcatacatgaactgaaatattcatgtgcaggaaaacaaagagggcctcgaactgttgaaggccgcaatagctaaggctggctacacaggcaaagtaattcccttttttctcttaatttagctcataattcaagcatctctttgattgtatttgcgtgatcattatgattcatcaatatctattgatttcgtttatatggcaggtggtcataggaatggatgttgcagcttctgaattttacagtgaaaaggacaagacttacgatcttaacttcaaggaggatgtaagatcggcctgcaacttcttgtcaaatctttatctgcacatagttctttgtgttgttccatgaaactacaataagaaataaaactcagtgtgtattaacatgtcttaaatttcttgaccagaacaacgacggttcacacaaaatttcaggtgacagcctgaaagatgtgtacaagtcctttgtttctgagtaccctattgtgtcgatcgaagatccattcgatcaggatgactgggctacctatgccaagcttactgatgagattggacagcaagtgcagattgttggggatgaccttcttgttactaatcccacagtaagttacagttagttaattaattaattgctactaatctcagttagttctctcgaagtttatgttttaacaatgcaatacttgccttttacagagggttgccaaggcaattagtgaaaagacttgcaatgctcttctcttgaaggtattgtatgctgttcagagttgctagttcttttgctaggacattgaatgtagtgcaatattgattataccatctgtttatgctgtcaggtgaatcaaataggctcagttactgagagcattgaggctgttagaatgtccaagcgtgctggatggggagtgatggcaagccataggaggtaagagttgcaagttgtaactctttcagctgttttcattgtttgtaggatttgtttcatttaactatttttgtcatcttttcagtggtgagacagaggataccttcattgctgacctctcagttggtctgtctacggtatgggttttggttaaacttgaatttgattgttctgagtaccttcaatggtaataacatcatatcccacaattttgtttcagggtcaaattaagacaggagctccctgtcggtcagagcgtctggctaaatacaaccaggtaagcctcttgcctcaaacccaaattagtcattactacctcctttgcagccaaatacactttgaatctctgcttgttttcatggagccttactcactagccactactagtaattcatccgacaagaccattaaaatactccttttgctgtgtgattttgtaatctatagtggaagtgattatgtgtgtgaattaaattacatttcatttagcatggcttgatagtttaagcaggaatctatgatagaacactgggcaaagaacggcgatttgcaaacttgtcactaggtagtattatgtttcagcgggagtctgtttgcttgtcctggaaggagcatcattttttttttccagagaattattttagactttttttcccagaaaattcaatgaagaggttccacacaacactattgttttggtgatatatacaatttgtgtcgttgcttgcttgtggttgcagctgctcaggatagaagaagagctgggcgatgctgcagtttacgctggagaaaaattcagagcccctgtggagccgtactaaaccttggcaccttgcggtgatcttgtgcctatggaccatggtgccatcaatctactactgcgtttttacacgagtctacaagggcaataaaattagtacttcttgacagtcccagaaattgcttagttaccctcgctttttcgttaatggccagattgtttgcttactactgtgttgacacacttgagcaccaatatgtaagatcaataaaagagcaaatcgcttgatttttcatcataaagtatttttttccccactcaacaagttgaattcgttgtgctgacttgtgctgtgaagctcagagttggaagtgaaatggaattggtgttgccaagctgagagtgagattatttttggttttatagcaccgagagatcaccgtttagtaatgaaaaggctaatctgttgatgtagtggatagatagcttcagggttcaagttttcgacaaaaatcgatcaaaaactgtgaaattttgaggttttgacgtgggatggaagtagatcccgagtgaattttgaagcagatcctagttttcaagaatacaaatttgaagcagtaaatttgatcaaaatttggcaaaaaaagaagtcgtaccactaagggtcaggatccagcactcaatcggaaaggggatagcacgaagttcacacaaaatttcaggagcaagttcggataagagcattggacacatgctcagctctggggctgatagcacctggcatttcccttcgtgtttgcatttcagaccgacaacaaaagatgagaacatcaagtttagaggaaatgatcttgctaaacaaaaatcaaaccacacaaaatcaacataaaatcaaggccgttctgcagtgcaaggcaagacaacgcacgcacaacgacgaagttaatccctttgcccccacgagaactgatgcccagtagctcctaatttacatgttacatgcgacaataataggagcttcactataaatcggagaaaaaacagctccacaagccaacaatacttttggggcacaatgtttttcacttgtcttgcttctccagatgacctgcatttgacgaaaacaattttggtatcgattaataggactgcaacagggtgttcagcatgcaatgaggataatgttgtagtaatacctaactaatggttggaacttggaacgccaatatgagctaccatagtgttttttttttcattctactcatcctcctccaataatacagtccagatcatcctgaaggcaaaacatgcaaacaattggtagttataatctactctgtttgttgctgacttgcagtaaatatcaaatggttgtttgttgcttgtttaccaaaacaaggacaagaataggagaataatgagaccaactatcttaaaaaggcggcgtttcttctcccggccaagatgattaaatatttctgttacatctacaagatgttgtcgtcgctggtacctgcagcatgcaaagaccataaaaatgttcccagtcaagtcgacaaactgtttttgatttcttttaagtagcagacaagtataaaatcatcaacagaaaacctagacctatagagtggtgacagttcagggaaccttagctcaagtttatcactcatgtttctttctgaaaaaaactgctaaacctagctctatagaatggtgacagttctgggaaccttaactcatgtttcagtcatgtttctttcttcaaaaggaaaaaactaagtgacaagggatgatctgactacagttctaatggaaatatacaatacactgacaaagttcaagcccttgaaatttgcacttttgtgatacagccatatctcgctatagtgctgatactctgacaccagcatgttcacatctgttccattaatagcgcatgctgtttacatccgatattgaacatgataacatatatgttgattggttggaattaaagatttgcattcctggataatcaaataatagttaacaacaaaagttgagcaatatgctgccttctaaaaccatatttacccattaccttctaagtgattctaacttctaagacctcaattcaaaaccaacctaaaatcaggcaagaatctttaaccatgatgtcacatactacaccaatatgcttacaggaaaattacaatatttagtttctcagtagctccctgacatggttaaatctgactgtatgctattagatccaccctagttctctcagtcccatgttgttgttttttatcacgaacacaccaataacagtcaaatttcgtgatttcatcactacatcatcaaccacaagcaacaccatagcatggaaaacatgcaacgaacatgggtccgggtgggtgggaaggaattaattcatctgggacaaacattaaacagcacgagactgaataatctcaccatactagtacatggggtcccaagcatcaatatacaggtcgtctaagaatttagcatagcatctgctttgtaaattccctcttcttctttgttttttttttttgtaaataactttcttttatctaatctaatatatatagcacagtaggagcctctgcctctcctgctgtttttcgtcaaagaggaaaagggttggctaagaaaagatattcacaaagttaggaagggtatatagattgtgctttctataggactatgaaatatgatggttttgcagatgtttgtaggaactacttttcagttttcaggcattcttgtagatactgcatgcaggagccagcattatcccttcatttgttcaaatataagatataagaagttatacacctatattatcgatcataagaccacttaccctataaaacttagtacaacaagaggcacaaaaaagctacatagaaattcagagttatcaaataaagtaaaatcatggtccaaaacaagcatgcctgacacacatatcagaacttagtgcttcctgaatgcagataagaaaatacagtaagatattagaaggatgtctagtaagttacactaataaagatccagacgtgtgcagtattaaggtatatcaaaagtcagaaatcagggcaatgcaaaagtaggtcatataccatattatgtgtaaagtacaaaacttgttttctgaaggagaccaagaacttcactgaccattttaatctaaaattttctgaacaaacagcctaaacagctttataaaaggtatctcaaccttgaacacccatttccattttcaaattattgttttggttctcacataatagacatgaatgactgtaccatttctaactttcagttcatctgtttatactagtcatggcaaaataataacttaggacaaagaagacagcagtcccggacttttcatttggtccattttgcactataaaatgttttaaagactgaaaggcggatagaagacagcagcacttacagcgtatagttatagtacaccatcggggcagaaagtaagaacattgcccaatgccccgataggaggaataatacacttagagctgcttgcaatacgaattctggaataaccactttatttatccgggaggatgaatcgaatggattgatatagtcaaactccagatctgccaagcacatcagctgcaaaacaaaagaaaagggtagaactaaaacatcaggaaatgattctctaaaccaaattccacagccaaagggatgaataatgtaaccaaaattgtaagttactaaaccataatttactacacccaaacaagaacaaagggatatcgaccacggtgatcgcacattgaacagtatcgcgctagaacacgcaacatataaaagcaaaggaattcctcagcccttctcgactgaccaagaatacccaccaaaccccagcaatttggaatcatgagtcgctctaaccccccaaaatcattcgagaatttctcctcaatcgatccacaaatccgcagccctctccatccaaacgaaatcccgtacgggtcagacccggagacgggcggagataccgaggaggcggggggtagctagctatctccctccctccctcacctggtagatgacgagcacgatgagcgccacgacgaggaagaacgcggtgagccacacgaaaaccatctctccctggccctccacaggcggcggcggctcgctctgggggaggtggaggtggaggtggggggtgggcgttggcctcgccggaaccctaaccgaaataaccgtagcgccgcctactgcggcggccggcgaggcggtaaatcggagcggaatggaggggggaggggagaggcgagtggaccagtgcgatggacgcggcccacaagatgcagattctcttagaagcttgtcacaaaataaacggctctgattctcttagggtctcttttggcttgcagccacagtttaccacgtctaataagtactccatccatcttataatatactctctccgttttgttttatttgacaccgttgactttttagcacatgtttgaccgctcgtcttattcaaaaaatttaaataattattaattcttttcctatcatttgattcattgttaaatatacttttatgcatacgtatagttttacatattttacaaaagtttttgaataagacgaacggtcaaacgtgtgataaaaagtcaacgacgtcaaataaaacgaaacggagggagtagtaacctaataccaaataaaacgtatcataatactataaatctatatagggagcatgtccagattcatagtaatagattgctttattacgatacggagggagtatgcaaatttcttttcttttaacttcaaactacaacttacgcatttttcattattatcatacattttaaaatgttaaatggcggtacgtttctttaaatactttctatatacaagttattttcaaaagtcaaataaacctatttttaaagtttgtaataattaatacttaattatttatgtgctaatgatttaccctaattttacgtatggttgataagctaaatcaagtgaagatttgtcaacaactcagcaaagtgtaacaaaaattctcttaaatttgtcaagatgcggcaaagatttttagcacctaacattaagcaatgttagcaagtttttggtggaaaacggtgacaatactagtacctgaactaaatagaggcgagctgtaatacataatttttttgtgtaacatgaaccttagtatgatcgaatctgccaatcagtggcaaggtgggctgtttggttgactctgtcaaatggaattggataagctggaagcctggagtggtgttttttcttgccgttcactgaatgttcttgtttccaggaaactatattgagagtttcagacgttttacacgcattctgcattcatcgtttctcttatatgttaagactgtttgagcattcagcattcacagatcgcgtcccctccacgaaatgtaatataattaaagtgaatggcaccattaccctgtgaatgctgaaattaaattttaaccaaacatctaattttaacgtgaactaaacacaccattcacagctaaaattaaagtaaatggcaccattaccctattcctgttcgagtgtttgataagtatatactacacttgcatgatcatgagcagcttcagcttactagttatattgtagactgctctgacctctgagcctgacaaatcaggaacaactatattgttatattttaagagacggatcgagggagttacttcgaaaagaaaaggtcacaataattcagttcagtttcaggttttcagtctgttcagaaccctacgtacggcgcctacctgatcgaatcaatcaaagagagacgacaaagaaagccatgaaacaacacgtatcaccagctcccgtgttccacttccacgtgcgtgcggcagcgcaagaagcaaagcctactcctacgacacagcttctttcagatagaagcaagacgaggaagatatgtgttgggtccgtgcagaagtttcgttgatagctagccaactgttgcctgccacggatgctatgaatcgtactagcggactatatacatccaagaataacaatgatctcgcactaaaccaaaaaatgacataatgcatcaaaaactagttacttgatgtagtacatgggatcgtccaaaacgcgtctgatatgtacgatggacgatctttttaaacagactattacagtattatgtttctttgctttcatataaagctggatcaatcactcaatcatcaatgcaatgatatatccgttcttaaaaaagcttagactaactcaacagggtctccacgtcgtactcgaccttgtcccacttcgccggcgccgccgatgaggagccgacgtggcagtaccacagcgcggagccctccggcggctcgatgatgaccaccgtgaacccgccgccgtcggtgggatcgccggagagcgtgcagctcgaaccgtccgccggcggcgtccgcccgaacgacggcaggacgacgaccatcttgcgccgcccggcgccgccgccgccgccgttgctgctgcacctgcacagggcggtggcgagggtctccgcgtcgtaggtgatcacccagccgtcctgcgatgtcgcccacatccgcttcgtctcgccgccgccgccgccgtggaggacgtcgccgtggccgaggacgatcatgtacatctcctcctcctcctccggccacgacgccatatggtttcgcggtggcgcgttacgtacgtacgtgaattcgcgtggatggattcgagtttggtttagagagtttgtggtggttggcacgatcgatcgatcgatctagcgtacgtacgcgacagattatatttgcgctggtacgtacgtacgggaatcggtgttggactgccggtgatcacgaggatttcagaccggaagagggttagccgtgtccgtatgtgatttgcactgatctctcaaccgtgcgagcgcgtacgggatggagtcggagaccgataccgaaaataacttgagaccgaaactgaaatgatggagaccaaaattttcggttagaaatttgctcgggctttaattcaaataagaccgttgctttgaaatgtcacttttaaaattggatacatgtattacgagcatatatcttaaagagtgaggcctttcaataattttggaatgtatttagcacgaggtgttgtttcagttttagtttcagcaacacgaggaagcacaaaaacgcagccagtgcgtacgtacgaggtgaacatatgtaacttactaagttggccatgtgggacttaggggagagcggttacatcttctctcaccccctctttctctctctcaatcccaaagagaggtggatagagtggtggtgtttagtgtcggttgttagggttaagttttagacgatctcggttgtagttccatgatggcctagcggcggctggtcatgcttagcggcaactgattcggtactagtcttctcccgggtatatgtattgatgctgtcggtacttgggtggttttttttttcctgattacggcctcccacagttataattttattttttttcctattctattaatatgaacattgcacgtctggtgtgagtcgtaaaaaaaaaaggcgaacagtttcagtttcagcctcgatcgttctggggaatcaagagagagacagtgcatgttgcctagttctaccgcaacttaggtggtgtgtgaatccagggacttaactttagtctctgtatttagagactaatttagagattaatatagaatacttacaaaactaattacataattgaaagctaatttgtgagacaaattttttaagcctaattaatctataattagggaatgtttactgtagcatcacataggctaatcatggattaattaggctcaatagattcgtctcgcgaattagtccaagattatatatgtgttttattaatagtctacgtttaatatttataattagtgtttaaacatccgatgtgatagggacttaaaagttttagtcccatctaaacagggtattattatgtttttcctgcactccaacagctagcagtacaaacatgatcttcagaaaagaagagaaaaggaaaaaaaaaagtacaagttcagtctctccacggctctgaagatccatcaaagatgaacagtagaggcgacgtcgcgatgagctagccgacggcatgtcaagcacaacacgtatgatcacgagctcgtgatgcagcagctcgtgacgagcaggtgatcagttgcatgctctgctcgcttgaatcaattaaggtcgtgtttagttcacactgaaattttaaaatttagaagcttggttgaaattgatacgatgtgatagaaaagttgcgtgtgtataaaatgttcgatgtgatggaaaattggaagtttgacaaaaaaaaaatttggaactaaacaagtcctaagcagcagagcagaaagcagatgcttaacaaaaacgaaagcagattgaaaattaagcagcaggtgttctccgtgcgcaaaggaagaagttacgagagcccagatccaccagcttctcctccggccttagacctgccaagaatcgaatcagtccgcgatgaatttgctccaacaggtcagaacaaatcgaaattctcaagcttaatccatgaatgaatcgaaattttcaagccgactccatggcctcgtgctctgaagaaaccactctgtcacgatgacaatacgaaaatggagcttgaaaaataagagaaaaggcaatagaaagacgcactttcgagcgagtacttggagaaatgcagctcgaacccggccgccgcgtcgccgccgccgccggcggaagggagcggcgggcggcggccctcgcgcacgtacgcgtcgacggcggcgcggacgaggtcggccacggtgcagtccgcgccgatcacgacgtggacgggccacaggctctgctccaccgtcacgttcagcagcagccgcgtcagccgccgcctctgccccgccgccaccatcgccgccgcggcgccgtggctcgacgacatcgcctgcacggcgctcggcgccatggccgctctctcgccttggctgtgtgtgctctgtggcgtacgtgtgcttgcttgtgcggtgcacagcgttggtggtggtgagtacggacagagacggggaggaggatatgggggtaagatatatagcgtggaggaacaagatacttggcgggtaaaaagcagcagattgttaggcacgcgtgacgtttacagccacagcagccatagcttccggatatatcaaatatcactgcaaaatcaaagcataaacgcacaatccacgtgtgaaataagtgttcgtgtcaaattagtgcaaactactccctcctccgtttcaactttgatcaaactcaaattgttttaaatttaattaaagaaaataatatttttaactcaagacaaatttattatgaaaatatatttaattattgatttgatggaactaatttagtattataaatattactatatttatctataaatttagttaaatataaaacagtttaattttaactaaagttaaaacgctttgcaacctttagagggagtatatattttgattgagattaacccagttgtacgtagttcaggtcatcacagattaacagtagcagtagcagtagaaggaggagaggagagaggaagaagagagattgaccattgagagcaggtacaatagcaggctataagccagctgaaaacatattttaaggagataaatgaggagagagaagggcagcgggttacagatttgtagccagctgtagcacggactctaagacgcagcgtgtgtatgacatgtgggaccaggtattaatagtgtaatatgtaactattgtatgaatgagctattagattgactatagatgaattggagctagtagttggctatactattaaacttgctctgatgtgtggctgtgcgcagacgtggcacggatgcgccgcgcgcctgcgccgcatatgcagagggaacagcgggaggcaacacgtgggcgcttgtgcagacgtcagtcaggctagagcaagtcggaatccaggcggggcggcggaaaacgcctgaaccagttgcggccgcgccgaacgggcggctctcgtcgcgcgacgcgacggggacggtcgggagcattcgcatcttgtgcctcatcgagccgccaaggcacacatggactactctcacttctcgatcggattacttttgtcttaacatctatgaaatatatcgaaaatatgtacaccctacgataacttaaatatggtacaataataattatatttgatcaaagtagtatatcgaaaagcagaagaatattgatgagggttcacgacaaaaagtgccttaaaaataagggatcctaatatttttatatattttaatctatgttgatactattcaacgtgtttaaaggtctctttctattgcacttcttttcttttattgatttggctataatatgcttgttttctaagaccccgataaacatttgattgtagttatggtcaactcaaagagctacgagcttatgactcataactatgaaataaatgtacgtcccatgcatcaaagattacatcttttcacttagtaaaaaaataattcaacatattagaaaacctttatttttccaatatctacttagtagaaagccaacactaattcattctttcatttcttgacatcctcctgcgggacgacgatgagatggcgggaagggagatgcggtcgcctcgcgcgtgtcagtgagacgacaacatgacaacccacgtcttgccctgattcacaattacagtaagttgctgtcgcactatgcgtgtgggccacatcatgcacgacagcgcagtgctattgtgatttctggctcgctaccttttttttttaaaacacacaaacattgcacgttgttgctctcactgcgtgcatgtgcgaagtgttaaagtgggggggcgcaaaatgtaaggattgcggggtagacaattttataccttttttaggcggagctagaacgaaatagaagagggtgtctcttgtttaatttactctactttagatcaagtttaagttgatgcgtgcttttcagtttgtattgggagaggtgtacacatggtaaaaatcgataagttataaataaaaaaatttcttgaccgagtttatgggcaccctcctcccatactctacctccgcccgtgtctttttagataatagaaatggacgacgccttcagcctttgtctatgggcacacaaccaacaagtctcaaagtaaaaaaagaaagaaatttaaaaaaaagacgtgaaaggataacccccaactttcactaataaaaggatcaactgaaaaaacgttttcaaaatcacatggattttatacctacggtttagtttgttaggccactcattgttcagagctaggcttgcaggtaattttaccaacgagttaaacggtgtgcgggtgatcatccgatgtgtagggtttatgtctattagtagaccgatgtgtataagtattggattgtattttactttgttgataggttttttaacccatggggtctcaagtcactaggccctattgtcaattgtcaactctagctaagaatgtctcgtgtgtgtgatcatggaaactgaggcactcaatttggggcggtggctgtatacatgtagtacactttatccaatttcaatgtgacgttgaggtgcaaaattcttactgcaacccatcggcacaaagccacaaaactagttgttcgctttcgccacctctgatcgatgccaacctgaattgagaacaattgcttgatgccgggcatgcaaagcagaagacgcaagcctgcaggagagcacacacatccaaatgactcacaatataattctccactaatctccttgtacgtacaattgtcgtttgaacaccgaattattcagtgttaatttgaatcaaaggccaaacgtccgctgcaaagaacaaaatgaatcgcgggcttcacgatgaactcatgaacctcacgtgagttcatggatgccaagcgccgagcagatagtcccaaggattggaggcgccaggggttcggagaattattccccaaaccccagtttggttaacaggaaccgttcgatcgagaatgcgcggtcaaaagtcatgcggttagaaagagtgcggtgatgctggggcaggagggtttggagaataattctcctagcccgcgttgagtccatgaaatctgttggatcgtgatcgtgcggtcggtaggggtggacaaaatgcttggactcgtgagcaggctcgggtttagctcgagctcgcaaagctcggctcagcttgaaacctaaacgagccgagctcaagccgtatgcgcagctcgtttctaaatcgagccgagcccaagctggctcgttcaacttgtcaagcttttgcataaaaatggcctggcccattattgtcgctggtgtggcccaaggcccataaaaaacactaagggagcgttcggcaggaggagattgtgagtgagtttgtctcgtttcccgcgctcacgtttcccgaactactaaacggtgtgttttttgcaaaaagtttctatacgaaagttgctttaaaaatcatattaatccatttttgaaatttaaaataattaatactcaactaatcatactctaatagctcacctcgttttgcgtatcttcccaatcttctcaatctcctcccactcaaactcagccttagtccctaactattattttcctaatctcccacccaccccactcgtaggtgctatcttctccccttcccaccacgcgagtccgccaccgacgcctttcaacgagtccgctcgcctccttcaacgtgaagtcgtgccgcgaccgcatgagaaactgaggagggaggacgtcgaggcgctgcactgcgtcatctccttcctcccctgcggtacctcttccctccgctacaccgccggtccgccgcctccctcccctacggcgtcgcctccatccctgcgccgtcaggccaccatctccgtcccctgcgtggctacgccgcggccttgctcccctacggtgccgcttccatccccagcggccagcgccgccggtccaccacctccctcatctacggcatcgccggcctgccggctccgtcccagtgccgccggtccaccgcgtccctcccctatggcgtcgacgccatccatcgtctcgctgcttgtatctaaaccaagctagctcgagcttcgaaacgagccgaaccgagcggctattttacctcgtttcattaatcaagccaagccaaaccaagccgagcctgttctttgtcaagctttcacgaagccgacccctaaacaaggccataatcgcgagacaagtcaagcgggttcgttccgttccggagtcgggaagacaaaccgacgtgctttgagattcgaattggtcgcaactagcaatcgcattgtagggagagatataaagcatggaggtcctccccaacctcaattccgctcccaaccggattggaggattttagccctaaaaatcgcaagatcccacatcgaacccaaattccgaacctccaatcgaattcctccgattccccggcgacgcagaacccgatgctctgccaacaagcggtgccaatccaccgcgggcgcaggagcgcccggcggcggtggccgctggccgtccggcggccgccgtcgccggctgcccggctgcttccggagtcgtcctcaaccacagcaggtgcccttgacctccttcgctacgggcggaacttccgtcgagcctcgccgccgccgcgcccaccgtatgtgcatcccctctcctctctctctctcgctccttccttttcccgcgatttagttcgcttttgctatgcgtgtattgattttactgctagtctccacgtattgttatctctcgacgctatttgtgatttaagtacttcgattttctatgtgtgatttaggcagcgttcgttctgggagattggagatagattgcacatcgttttccgcgtgcacgcttccaaactattaaacggtgcgttttttgcaaaaaaaattctataagaaagttgctttaaaaaatcatattagtctatttttgaaatttaaaataattaatacttgattaatcatgcacctcgttttgcgtatcttcccaatcttctctatctcccctttctcaaacacagccttaggcaccgttcgttccagggtgtttggggagattgagtctcgttttccgcgcgcacgcttttcaaactactaaacggtgcgttttttgcaaaaaatttctataggaaagttgctttaaaaaaccatattaatccatttttgaaatttaaaatagttaatacttaattaatcatgagctaatggctcacctcgttttgcgtatctttccaatctcctcaatccccttcccctcaaacacacccttagtgtcgttcgggaggatagaacagtgtattttataagactgatagacagtatacgtcttctgtaagacttgcgatggattagtggaagtagcagtttgtgacactagattcttgggagtggagaggcaggacaggggggaaaagcgctgtttgctagcacaaacataaccggtgtattcatatgtgatttctagggattaatgtaacaaattggtaaagtctatatagtttttgacccctgctaacttggccactgcaaaatgatccttctgcaatatttatttagaatgaataaatatgttttgattgagatccttccagaataaaattatttctcttactcattgagcttgtttgctacaggttggtaaattctgctgagccttcgtctgcacaagtgctgcgagaaccagatgtttccttctctgtggggttgctcagtaatacagcatcgaaagaaccgataactgcacacacctcttcctcttcctctccacttactgtgcagcatgacgacactgaaacttcgacgccatcacagtgctgcctgtggtcatctcctgggtcatccattttggtcaggagacctcgtggttggtattttgtattctacatcaggatggatcctggggggtgtttccacatgtatcccgatgtgggttgtgggccatatcagagtctgtcagaagttgatgatgctataaaccaacatcttcatgacctgcggattccagaaatgtgaggcttcttaactttgttttatcttgttatctgtttatttgttgcaaactcttgtggttggatacttggatgtatttatttagggcagacagtaactgccttttatatttcggtgcatgtttcatctcatggagcttcaggttgatttaggatcatagtaataattaggacacacatatacacttcaaaatcagttgaattgatttgacaacaaaaaacttttgagagcttgaatcagaatataatagtatttgagaaaaaaatcagaatataatggatgacccagaccctagttatagaaaagatgactagttctcgtttacaaaaataccgggcttccataatttctgatgttatattctgaattgctgcatgttagtctaattaattgctcaaaacagtgtcccatgttccaagtgagttagaaatctgaaatttaatgatgctttgagagtatataatctaggcatggaaacaactatcactctccattgttttatcatgtgctgtgttaaatttatctttctacgtgaactaattgaggaacaccagacttggtaacatgtgcaaacaactttatagcacattgtatcgacaactttgagaaagtacagcatactaatcatacatgatcttcattgatctaattaggggtgaggagcttgataggctccctctaatggagaagatgatacggcaagcgatgtactggcctgacggcaagcggaaacgttgcaagtcagctgggtattttgaaaaagacaagtgccatttgatccaagctttagtggagaagtataatgaggatcataatcttttgggggtatgttctttctctctccacacacacaaatatatattatctatatcttatgtcttactattttaacatttgtttatctgatccatgcgttttgttttaggattttgcgtatgaacttaaggattttttgcaacatggagtaatttatgaggatcaaaggcagtaccaccatttgaatttcactgcgaaggtgaaaagagctgatgggtgtggtgtggagaacctattctttgctgaaatatcacatatgcaaggagaatatgaatgggtggtcagctgttgctgcataattaaacctagtgctaacggtaatatatcttctgcacaattttagttcaaatttcttatcctatataactttctgcttaaaaaattgtatgtaacagcaaattggtaagttgtgcatgccttttggcttaggatatatgctgtagtgcatgtgccccttcagcaacttgtatcaaaacactacctcagtgttcacgtttgaaatagtctgtctagctcacactaatagggagtactgtttcttttcgatataattgaaaatttctataggatgtgattcattatccttgtactgaagacatgccttatttaccattgatcacttatcagcatggtaaccatctgcccagttactttggctgttaaaactgacaaatatccccatttttgaaggtcattgctatggctgtaggaataatggttatgttggcatgaagcaccctaacaatgatgcatacagtggtggtcatttggatggatatttaccttttggggtcaattcctatgcgcgcaataatgatgaggaactcagtgtatgacaatttatttctgacaagcatctatcattgttgtattgctctaagtactcaacagttaatagcctgatcttctcttttacaggtcaaggatgaggaagatatgctaagacgtatgtacaaggtaataacacaacaagatctacttccacctgtacacatgttgctcggttcattgttgattgagtgctccttgtttttattttttagggcctagataagccaggcggattcaagagacccatccctaaatttgcaacacgaattgtgtggaaaactgaggaggaagctggtgtggaagctggttgaagctggaaccttgcatttttctactagatgtgttaggcaaatgtgctatcgtatacattcatgtaacacaagttaaacttatcaccatcgaacttgtccaccagtgccccagcagtagaagcgcatcttatcacaattggtggtaaatttagtggaatggatgaacatccacgctaatggttgctgaaagctgaaatgacaatttgcataacatttcagtatttcttctcaagttctccaataagacccctctttaaaaatgtggttttacctgcaaccaaatatggcataccatcacactcaatccaagaatcttacagcaaggcagtcggtaaacttttgatatgaaaatgaagctatttcagccatgttgcctggctgaaatattcagactgcaacaactgtttttgcctgatcttgtactgacaacaagcaacatgcaacactttaatttactcctttgaaggaaatcatagtattttactttttccttaaatgtagcaccctcatgcatgctccatgttacgtttgtgaatcttagaattaaaatagtagcttatagcaagatggttcattctttgttttttttttaaaaaaatggttcattctgaaaagacaatttttattataggatatttggactttacgattttagctataagacaccacatgaagtaacttttaggaaaatacattctcaaaatatagaattttgctgctaaagaccgcacccattagagcattcattttctgattcaatagaaaagagaaaccatgtgaaacatatatcaaatatccatttcctcctctctcaatgcctattgatatgggtattcttctcatcactgcataaattcaatatagtaaaactaatggtattagacaggggcggagacaagggtgggacaattagggcttgggccctaggcttaggaccaaattcctattaaaatcttattcaaaatattgtaaaaagttgaagatataaagagttttgttaagaacacattaactcagccctgcttggccctagacgtgatcaattcttggcgattaaaatattaggtcgaggagctccgccacaagcggcgctaccgtttgtggaacaaggtttggggccttaggggtgattgttcaccgttgatatttttcatgactttttaaactatataagtatatataggatatgagcacatagctacagtgtttctgtattaggccgaaacattcgatcctcccggataccggcccaatgctggaaaattaaaacgggccgtgatcccctcgagaaaattctacaatgggcctcataaggccccttttcaccgtgaaacatcactaaaccgcttacctttcctaaaagtccacgcggacactgacacgtcatcatcgtgttcgtttcctcgtcaaaagggcaaaaagaacacgaagaagaggggcgtccaaatccgccgccgaattccccacccgtcgcgtccaaaatccaaatccgccgccgcgatcgaggccgacgaggagaggttgaggttgaggtgagagccatggtgagcgccttcttcctgctgtgcgggtgcgtggaccaggcgagcgtcgcggtggtggagaagtggggccgcttcctccgcctcgccgagccgggcctccacttcttcaacccgttcgccggcgagttcgtcgccgggacgctctccacccgcgtccagtcgctcgacgtccgcgtcgagaccaagaccaaggtttcccttctcggtcacgctacctcgcgagtttcttctgtttgttttggatttctagtgtagcccccatggccattatccaatgttaaggttcaatactaggcagaccatggaattattcgtaattctccacctgagcccactgattggggatttggttcaaagtatgtattcgatcagttctctcggtgcgccagattagtatctaattgttgaaccagacagggtccattttgtcctaattactgatgggagtaacagagctggtatgcttgtgatgggtgtgcgtgatggtggaaaaaaagtaattagtcaatgctaattgggcatatttcattgtgtctgctgggtgatgcttaacgatgtcatgctaagtgaaccaagggaattactgttactctgtaaatttagttggttcatgagatgaagttgtcgagcaacattatttgaggatcagtgatatgcagatttttcctttttccttttattgggagatgctttgccaggacagcaatggaaacgcaattaataacatgttatatccttgtgatgctcttgctatatagcgcttacaaatgaaatgaaatatttgctatggaatgacaattttacttaatgctagcacttggttgtttctttgcttgatgaaacattggatgatgtgcttttcccctgcaggataatgtctttgttcagcttatctgcacaatccaatatcgggttgttaaggaacatgctgatgatgcattctatgagttgcagaatccccaacagcaaattcaggcctacgtctttgatggtaaaattattaatattgaacaattcagctgttgctcatagcaaattactgactcaaaaatctaaccactttttccttgaaatcagtggtccgagctatagttccgagaatgaatcttgatgatctttttgagcaaaagaatgatgtggcgaaagctgtacttcaggagctagaaaaggtaaccgtatgccaattaacttgatcttttagttgtgaaaattccagtatacatctaatcaatattttaggtttctacatgtattgcttgcttctattgtttcatggtaaacacttcatgtgtttaaacaattctgccaggattctaactgccgtcacccatctgttttgtggttgttgcagtattctttttgttatttttcccctttgttccttttgcatgtttcgagagttgggaattttctttggttcattctaaacatgccgtttggtttctgtcagttcatttttttttaaaaaaagtattggttttaagttttaacatacttatttattgggacaagggatagttccaggatactacttggtggaacgttgttgtttgtacaacttgcatcacaaagaactttgatattgtgttgtatgctgcaatgagttctgctcaggaaactaaagtgtttactaacttttggacacccgtgtttctttcttccacaggtgattggtaataaatatgataaaaataaaattgtttctggttatccaatgctatcattgtttatccaagtttcattgctaaagtctagttttgtcatgaaaattctgttgcctcttattgtcagtgataagcaatttcttgtatactatatagtttctcttccccccaaaagaatcacaatgtccatggtctgttcatctttttcttcgatggtcttctcgtactgtagtttctgtcgtcttgcaatttgataaatcctagatgcttccaggtgatgggagattatggttacagcattgagcacattctcatggttgacatcatccctgatgctgctgtacgcagagcaatgaatgaaataaatgcaggtatggtgccctatatgtcgtacttctttcatagtgtacagtccggaggaccttttctcggtttattggatgccgcaatgttttctcgaagtcaaaacctatcacagttcttatagttatctaatgcttttatgttatcttttctactcatgcttcattttctgtttcttgtaatgttggaagaaagttgaatgacgatgacttgagttaaaacagtgaaagcagggaataggttggggaagaaacatatgtaaaatatatgatcagggaaagaccattgcaatattgaaaggaataggattagtttattcatgcttgcttaattcaacctacgaatgagtctaccctctattttaggtcttgcaacctatctatctcaatctgaacttaaattatgccaactgtcttgtactgactctgtcctggttcattgctcatagttacatattgtacaaaccacaccacaattatagcaacgtctgatgttaagacaatttctgttttgtgcatgtgtgctcactcaactattaaattcttataacagcacaaaggcttcagcttgcaagtgtctacaaaggagaggcggagaagattcttctggtgaagaaagcagaagcagaggcagaggcaaaacacctttccggtgtcggcattgctagacagcggcaggcgataactgatggcctgagagagaacatcctgaacttctcgcactcggtttcaggcacctcagcaaaagaagtcatggatctcatcatggtcacgcagtacttcgacaccatcaaagaacttggggatggctcgaagaacaccacggtgttcatacctcatggcccaggccatgtcagggatatcagcgagcaaatccggaatggtatgatggaagcgtcctgcagcaacgtgtaaatcggtatcgaatgcggaaccaaggttgggggtggttcagatgggaggtcctgtttatagtgaatagtacgaatgaatgctagtagcatgtgttgtttgcacgcgcgccctggagttgtatgcagtggtagatagagttcgagttttggcataataatattgtctgaattttatgtaaaagaaaatcacatgtcttccttttgtgagttaaaagttgcaccgatttatgcatggcaatatctcaactgcaaaaaactggtgagttactgaaatgctgatggttagacaccgggaatcctttgcgtcattctgcagtaaagttgtggcatttgggttcttaaatcctgtagctctagctcacaagaagtcgtctccataacttaatccgctatacgacctattatctgctctgttctataaaaaactcaaacctagttatatatgtgtattgaggtttgtagctaggatttgcttttttttaaggataaagtagtaccatttttttagctttaacagtagcatcaaaggaatgtttggtactttggtttgctatcaattttttgtccgcactaagttaaatcctaaactatcaaaattttagtagtaggataattggctaaaaaaaaagaaaactaaaactgacgagtgcgacgtgatgtcacgaattatagctgcaagtgcaacggcagccgcgagcggcgggacgtgcatgcgacgaagcagcaactctctctctctctctctctgcgccaccgccaccatggcagcggcagcgcaggccgcgtgctcccatggcgtcgtgcggtcgtgccctctcttcgatccccgcgggaatcgcggccccccggttcctcctgcggagaggccccccacgctccgtctccctcctccacaaaggtgcattccagctaaatcgggtgagaggaaaccggggggggggggggggggggggnnananngananggaggagaggagtggaggtagaggggatcaactacgcgtgggggagggatgtcgatgtcggggtcggacttcggcgccccgtgcgacgaccccaagatcttccgcaacatctgccgggatcgtaagctcgctcctcccaccccccacctcttctctgatcctcgtgtctatctatgtctgtatcatctgatcgctgatgccgcgcgaatcgatcgcttgctgctcttctcacaggtatactcaaggacttgctgcatccggacaaagataaggagaccaatagctcatggaaggtagtacaaaagaaatgcattccttttaccctttcttttttggctccatctattcacatttctgttaattcatattttttttcctaa

SEQ ID NO: 66374 - DNA, 35397 bp, Oryza sativa
cgcggagtgtggaggagcgccggcgcgcagagtgaggagacctccggcgccgcggccgctccgccctaaccctcccaccgccgccggacctcacctgccgccatcgttgctgacatgttggatagagagagaagagatgagagagagaagaggaggggatagagagaagagagataggaaagctaacatgtgggccgaaggctatttttgacatttcacacgatttctctctccaattcaaccataaattattatattaatggttgcgatgtccaccagcaaatatcaaacttttgggagtgttttcccccaaaagtcaattcatgccatatcctgtagcaaatttgtcaaatatttaacggagtcgctaacagggctgatttaaagatcacagcagtgtcaaatttgacttagattgatttggagataacctccatcttgtgggagaatcacaaggtttacgtaacaaacttacgaatgatttacaactcaaagcgacaaaattgggagagctaaggtaaagtagaaaacatggctaaaaagtaaaaagtaaaggtaaaagaacttgattggagtgcaaactattcaattgggtatcaagaacaaaattgaccagttgaccaaggaagtaaacatgcaaactagctgatttggactcggtccgatgttcggaccggccccatatggaaggctcaaattctttccaaatatgaccaaactttgccatattttgttcttgatacccaattttattgttaacactaactttagcgcactaatctgaatagttttatttaaaatatagatgggggcagagaacaaagatgttcactcaataagaacaatcaaacacaacacatattgcatttatagttcaatcacataactgcgattgttattgtttacagtatgcgtgtgttgtaaagagacggtctaatctgttagacgttcacaccttgttattactaattttaatggtccatgactactttaagggtgtaatggggtcttggaggtatggtgttggaacaaattccaatagccccaacgagcatagcaggggctcccccatctatcagagagagccctagctttgtctccctgaggagaagatccgagaaggagagtccttgtataatggatggaatgggcgagatcctcctctcccttgcaagatggcaatgaggacccacgacccgatacccgatgggtttttaccctattaagagctaatcatgtcctaaatcttatacccatgggtctactaacgggtaaaaactcttacctattgggtccattctttacccacccgtacccactgttggtaattcttacgatcacaggaaaaatctgcaagcgcacggatataccgatgtagcacttcccccacggagtattccaagggtatcgaatcaaagggaacgtgtgtggtcagatcttcctccggttcatccaaggacaccaagcaaaggatatgacaggatggagaggatttactggtgagaaacagtgtctaggaaaagcttaagtttaatcctaacgcaatacttcaggcactggcaacccgctgtttccagatgtcgctctactacgtacccggacagcgagggcttaagtgatctcgatggctgtcaacatctctacacatatctcaaacgtactgtggaatacacaacaattattggataacaattacctaaacaccacgtctaagcaattaatatctactttagtttttataactcaccaaagcaatcactatattttagttgattatagtgaacaataatcctgtatgctatttacgaactaaccaagagataatcctcacaagataaatctaaattactcacgaagaatattatattgaaattagagtaataaacagaataaaagaaatgagagaagattaacgacaactccggaattcttccgacttcttctactctactctcttcctattatagtatataatatagtacagtaaaacatcttataattcagctcaagcttggaaatatgtgtgagtgaaggaatgaagctccttatatagaggtaggtatgacggttatccctatgtgaattgtctgaattgccccgcaaccgccatcaggagtgcattctggaccgtccctgccaaaccccaggatcaacggcgattagaggggttcggccgaacctgggctgggcccctctggcctggcttttggcccatctcctcccctggtctttttctatccatttctcagagttttgggctgattctctggtattttgatgaagtccacaacccatccctgtatggatacatattttctctcactttagtatgattttcctcccaactttggggttcattacctgcatacaaatatacaccaacatttgtggaatatgtgagattaaagttctatcactgtgttggatattttattatctgaactttatgcagatgttggcggtatagaatcggcatttaataaccgctaacacccaccgacccgtgggtgaaaaaaacccataagttgagcctaaaactatgagtaacacaagtctcaacgactactaaatcatagcataaaactcttttcacatcttaagcattgttctagtctagttatatgaaattattatttgatttattgattatgtagcgtggttctagaaatttttttactcgcctttgaatgctaatgttaacaacattgttgctagagaaaatattgatggtttacagttctaatatggctaattaaattacaaaattataaattctataagtcaattatatgggtaagagtactcgttggatacctattacccgcacaggtgtgggtatggggatgattttgcacccgcgatggatgtgggtatttaaatgggaatatttagccatcgcgggtgtgggtatggggtaagggaacccgatgggtatgcacccattgccatcttgcctttggagggctccttttattcatatgtagtaggaaattacagtattacccttaatcggttacattgaaagggtattgccttaggggtgtttttgtccattactatactagtttatacaacaccctagctatgagggtcttttccaacgatgcaccctaggcatggggttattccccaacatgtggggtgacacgggtcgtagtagggtcggtcaacccatcttgtcaaatgggtaggtccacccctgctcgaggaaacataattagagaccactcaaaaggattttccgttaggctcttcatcttatactgtcgtcatatactgtaatggttctgaactagctagcaatgcacgacatattccaacaatttttagcatgcaactttccaagtcttccgctttcagactctcaaactttagcaatacactaacagatttatcaaattctgaaagctttagaaacaggtttttttcttttactgtgatgattgttcattctacattgaattaagcatccgaggaaaataaacttatgaagataaatagagcaatgcgtaaatagacttgcgactagtctttgatatcagtcatcgctgctcaccccaagctattcaacttggactttcagttagattgtgtagttgatctcatcaacttccacatcaaagctttgttcatgatgaacatcgagattatcgatcgtcaacgtgcacattggtcctgagtagttcaagattgagttggattgaaccggttcaaagatctctagtcccttcttgagatccttcgatggtttagaggtcatgtctctttgtacccgatagccacttctctcctaatgcctcccatgccaacattgcagatatgtatgtattatgtaaacaaagtaagttcatgtttgggttaccattttgtatgtaagagatattaatagatgtgtggttcttcagatcaacatactaaaaagatgactgatatgcaactagctagaaataggtatatggctatatgccttgacagtaataaatgtgggatttcaatatttgtctagcatgtttatgttacagagattctagatgtttaagaatgagaggaaaaaataaaaaaaaggaagagaaggatggaggaggaaagagataggggactaggaagaaaaattgttgggggagctaggaagatatagtttcagcattttcttccagaacaaagaatacttgggttgtattatgtagcttgatagttaattacatctagttgggttggaaggaaggaccatgtttactgtgtaggtaactacacaagtgaacaggaaaaatgatatatacgagtataggctgatatggattaagtgtattcgtgaaaagggatgtagcctagtggttgcagtgaccttgagtagcagacaaggttctgagtccaaatgttgcagtatagtaattgtagtgcagtcaaattttttgtttaaaaaggcagcagtcaaaatttttgtttaaaaacctgcatatatccagttggatatagaggctaattatagtgcagtcaaaattatcgagcagggcactttctgttccaccctaaggctgtgttcgggagtaagggttgggctccctagcacgcaaaacggagcagcatttaacgcgtgactaattaagtattagtttttttacaaaaatagatcaatatgattttttaaacaactttcgtatagaaactttttttaaaaaaaacacatcgtttagtagtttgaaaagggctatgtggagaacgagggagaggggttggaaacttcctataccgaacgcagcctttcgttacctcctgttcccaacttctctccctcgttttccacgtgcacacttttcaaactgctaaacggtgcgttttttgtaaaaaaaaattctatacgaaagttgcttaaaaaattatattaatctatttttaaaaaaattagcaaatacttaattaatcacccgctataaaaaaattctatacgaaagttgcttaaaaaatcatattaatccatttttgaaaaaattctagcaaatacttaaaatcactcgctaatcgctgctccgttttccgtgctaggtagtgagagttcccacccctcactcccgaaagcagcctaattgtgtaaagtaatcgttcttaacaaaccagaactgtgcaacacactgcaacatttttatctgatttatcgaagtatcttccacttaatttgcagactaaaaaaataatgcaataaaaattatattatctgatttatcattattggaaacttttacaaatagatgatgtgtttatctggtacttgtgagtgcatgagacaatgagttatagtatcttcaaaggaccgtaaaaatgtggcacaatcactgccaagtgccaacaatctttctagatgccggacaagtgcagaatatatgcagcgtcattccaaccctcaaattttgatactgttatactactcccactactggaaaaagaatttttcccgatgtgcggtctttttttcatagacagacataacccttggagtcaaatgaccgcctacaaaaatataaattggggtgaagttcgttgaccacttaagcggcgcttgcgaaaataattttcgcaggcagacaatatattttcacaggcgcaccttatgtgatccgcctgcaaaaatcgtacctacccaaaaaaaataaaaaaaactttaatacttatctactcctccaacccctccccaccactcatttccccacacttatcttctcaactctctctctccctccctccactggattctcagctccccatcccctcccctcccttcccctctctccctccaccggcggcggcggcggtggcagcgcgtgcggacgaggcggcggcgacgacggagcgcgcggacgcggtggcggcagagcgcgcggacgcggcggcgacccggtgtggcggcggcggctccctggcctcccctcccagatccggctagagggtgaccgggggagggcggcggcgacgtgggcggctcctctcccctcccagatccggccggagggaggccgggggagggcggtggcggctcccagagcggcggcagcgatatgggcggctcccctcccctcccctcccagatccgaccggaggccgggggagggcggtggcggcgactcccggtgcggcggcgaggcaattttttttattttttcattggattttcgcgggcgggccattgccccgcctgcgaaaatggatgattttcaccgtcgttggtctgcaggcggttctcccctctacttgcaaaaattgcttttggcagcccgcgaaaatgctttttcagtagtgtccttcaacagacttgatgcgatcttctatacaatgattctactgcgcttcagtacatatcttcagcaaatgtacgcaatgcttgcttcgcacttgggccgatgcattatttatactagtttcatgcccgcgtgttgctgcaggattttgtggtaatgataaacaactttataaatatgtgcttataaacataattgaagaattgaacattctaaaattataaagcgtaaagttggcatgtgagtagtagatggacaagggacacagcagtggcttaatatgggggatgcatgcatgaccggagcacttaagtgggtcatccattgatgtgtttaattacccatgacagtttgcttacttaaagcctgcatggctgttcactatgctagatcctcacacctttgatgacatacctaggacgggcatatataagtgctggtcagtgatgagggtcacctttaacgagttctacgggatgccgtcatcggtgagccatccggctatggcccgttacaggtatctagtcactagtgacgggccatatagatccagcccgtcaaagatgttatgaaaccatctttaacgggtccgagaccacccaacccaatccttatctatcacccaccgacagtctgagaccactcatctctcgtttttttctttcttccttatccatccctctctctctcttttctttctttcttcctcctccgcacgcaccgagcttgcatgctccaagcaccgggtctggcggcggcctctgactccacgcgctaatagcggccacggccggccgcttcctcctccgcctcccgaccgccggccggcactgcctaccccgaccgcctcccgaccgccggccggcactgcatacccggccgcctttcgaccgccggccaccggatctggcttacgaggcgcggatccggccaccgcgggctctccccccaccgccagccacttcctcctctgtctcccgaccgccggccggcgctgcctcccccgcttccgaccgccagccgccggatctggcctatagggcgcagatctggccaccgcggcttctccctccacccccggccgcttcctcctacgcctcccgatcgcaggccggcgccgcctcccccccgccttgcggccgccggccgccggatctggcctacagggcgcgaatttggccaccgcggcctctgccccaaccgccggccacttcctcctccgcgtcctgaccgccggccgcagccacctcccccgcctaacgaccgatggcctcgacacgtttgggggacacagatccggcgcctctcccccgaccgccagtcgcctcctcctccgccaccccacctccacctgctagatccgacggcagcctcctccaccgcaccaccaaccgttggatccggcggcctctaccaccgaccgccggtgtcgtccaccgtctccttcacccgctagctccgccaccatttccaactcttgtaggttgagcaaattttcgttgccaaatttcagattgggttatactcatggttgcttgtgtggatttgtagtttattactaaatgttgtctggatttgtgatatatattacttgtgtggatgtgcttcatgtgtcaacatatctatcaataaaatgcaaagttattgtgtcatgagatcttgagatgttcttcatgtcatgagatatggcctgagggctgagagctgagagctagaggctgagggcttttgaattgtttttttggttgattttccacacctatgacggctggtaagttgaacctatcagaggtgtttgtcacctttgacgggctgaaaagatccactcgtcacaggtgagacagtctcacctgtgacgggttattttattcggtacatcagaggttccaatcatcattgacaagctttcacccgtttgagatgaggtgtagtcatcagtgaccactaatctgtgaccaaaaccaaatccgtcaaagctgagggttagagcccgtcacagatgacgggatctggcctagtggttgaaggaacaaatgcatgccagttaaacaaagaaagatgcacttgatctgacggctattggttattgatgacatggcttaacctagaggcttctttatagtgttaatgcttgtagtgggtaccaactatataggaagaatggatacacgggcgtgagaagttgtcatttggtttgtgcttctattttccttgttcttacccatacccgttatggcatggtcaaacatctccgatgacagggcattatggatccctggttcactgtgcctccccttcctagctagctgatgttctgatatgtacccttgttgtatgacgcgtccgtattgggacacggtctacaccaaagtgaagttgtatgcatctgccatgtaagttgtgagctgtctgtgcatggaccactaggagagatatgatttttaataccggttctcaacccctattaattctggttgtagcaattgagagaagaaaaccgagacaaacaagaaaatggagactaaagttgttgatttttagtaccggttgaaagaaccttttcaaccgatactaagatatatactaagtcaaaaaaatatgtaggatgtgggattccaactcacgatctcttatcattgcccttaagagcattaccatcgcacatactacacacatctgagttctctagtagtggacccttaagtaaggggtcattgtaacagtcctaattcatttaaagcccctgcagtagtggtgtggttttggcccaagtgaccgaggagtagatcgattagtcacatacttttgctagtttcatcagtcgtgtgggcatgaattctagcaaacattatcatcctgatcttttggcttatgcttatacttataagccaaaattttaatttttaaccttaaatttagagttgattttagggcttttttatcgtagtttatttgttagcctttgctttaaataactaataacatgtagataaaagtttcatttataaatcactttccgttgcaaatttgccgttttgcttattctgtcgataagcaaaacgatggagtcctaccaatatgtatatggtaacacacattccaaacaaatttctatgcatattgaggtttccgaggaaatgtttctaatttatcaaatgctaccagcctgcgagctttagatatcagactacgaaaatacgatgttttctatggttctttgggtgtgaaagtgatattatgtttgatgaaatgtagaaatgatgtaattaatggcattgctaataatcatgctaactaaaataatcgatatgcatagttcttgcacaacacaatatcatcaacacaagtacattgtacgaccctgtgccacagtattctcaaagccttctctatccgtcggtgccgatgcatgaccattttggccccatcgccttgtatttcctaggtccgcccagtcctagatcctattttttgtggcatgcatctagagcacatgtttattgatcttagttttgaaaaccgtagtactcattcttcatcattgtaccactcttgctcgactcttgggacaatgatttatatagctgaaaagtttagtccggctttatatttttgtgcaaatgaaaatcgatatcaatgtcatcacatgttaccttttaaagtgctcaattttgtatattacttgtagagttacttatatggacctttcattcaacagtgttttcgattaatataaagcatgacttattggtggctgactgctacttagttatctctataaattactagtgctttgagatttgtaaaactatacttggagaatatgagagcatcattaaagtcaataaagggccagccaagatatgtgtaaacatcgggtaaggattctctaacataatatcattatcattacagtcactagtatatatgtgaatctcaccctttgtggtgtgtgtagtttttacctttcctacacttttcgtatcaattcctccctctttccactttcaacattttgggagttttatcatataattgaattaaattgtcttagcattttgcatttgctctcttttgggacctaaaatccccgggctatcctactaaacatatattcccaccatacggaaaaccaactcaatcttcaatcaaaatgacccatcagatttgttaaggtggtcacgttagaactcactttttagtttcagtattttcttcagaataacatcctttattaatcttggtttaggaaaccgcactactgctttggcattcttcaccagtgaaaaaactattgctcaattattgggagttgggacaatgctttatatagctgaaaagtttagttttgtgccatttttctccaaacaaaaattaatattaatatcatcacctttctatgctttaaagagctcaattttgtatattgtttaaagacttgcttctatggtcctttaatttaaccatgctttggattaaattaaaacatgatttaggagtgactgagtgctacccttttctttagataatggaaataggttacatctctagcctctgcccgtaggcacacaacaaaaaagtctagaagtgaacagaaaagagctcaaaaaaggcgagatgggacaaacccccaatttcagccgattatatgatctacaaaaataatgttttttaaaatcacgtagattcaaacaaaattctgtaggtactacaccatccaaacaggaataaaagttccttggctaccaattccaagcgtgtagcaccattgcgcatagtatcctgttgttcctgtaaaagcatcatacaccaagaggtggagccaattggaatacatgaagataacctgcatgatgttagcctttttttatgtttaaaaactatatcattacggcaacaccaaattgactaacatagagcactagctccaaataaaatcatttttttgtgggtctaggcactccccttagccagttgccaaaaatatcttttgcattgtggggagggggggtattgaaggcaaagaagacacatcgccaagcaaaacatgcaacattacagtcaaagaaaatatgttggatggtctcttgtgtattacaaaaacaacattgcttgtttcccctccattttctctttatgaggttatctttcgtcaagattacttttttgtgaagaaaccacataaaaacattgatttttagtggtacctttaccgcccataagatcgtcttgcggatccttacattaaaattgatgatcgcattaaacatggatttgaccgaaaaatagccatttttatgtagcgaccaaacaaagcaaaccttttcatttgacagggttatgttagctagtcgagaaatcaaatcattccactcaactaactttggtcctacaattgatcgtcggaatgaaacattcaacggtattgtgctcgtaacctctgccaaagtagaatgtctctttcgaaccacaatgtatagagaaggatattaatatttgacagattgcaagcccaaccatgtgtcttcccaaaatcttatgtccatcccattaccaagtttaaaagatccattttgaaaaaaatgatcttttactttcattaggccagcccaaaattgagatgttcctggtttgtgtgacatgtgggagaggggtttaccctttaagtacttgttgcgtaaaagatttttccataggccatcaccattaacaagcttgaatagccatttgctcaagaaaaatctattcatgatatcaagatttagtacacccagtccaccttgatcttttggtcggcatatataatcccattttgttaacctatatttcttttcctgcctatcactgctccagaaaaagctcgatcggtagtaatctagtctttgaagtacacctcaaggtatttcaaaaaaggataacataaacatgggaaggcttgaaagaactgagttaagaagaaccaatctccaaccataggagttatttttgcctatccatgtgctaagttttctttgaaacctatcctccacacatttccaatcagaatttctgagttttcgatagtgtatgggaattcctaagtatctgaatggaaaggaaccataattacaaccaaacagttgtctatattggtcctccatttccttagctccctcaaaacagaaaatttcgcttttatgaaagttgattttcagccccgagagatgttcaaacacacaaagaatggccttcatgttttttgcttgttaaaaatcatgttcaagaaatattattgtatcgtcggcatattggagaatggacaaaccatcatccactaagtgtggaattacccctctaatttggccatcggctttggctctttcaataagaatggctaacatatcagccactatgttaaaaagaaatggggacattggatccccttgtctcaagcctttgcatgttcggaaattttttcctacattatcattgactctgacacttacagttcctccttcaacctagttagaaatccaattgcaccacgattgtgagaaccctttcattcgtaatgtctgctgaaggaactgccatttaactttgtcataagcctttatgaagtcaattttgaatatgataccatcgatcttctttgtgtgtaactcatggacagtctcatgcaaaatcaccaccccttccatgatatttatatctggcaaaaacctcgtttgggttgggcgaattactttgtgagcaaccgttgtaatcctattggtgccaacttttgtacaaattttaaagctgacattcagtaggcaaataggcctatattgttgaatttgttttgcatcagccttttttggcagtagcacgatgatcccaaagtttaggcaataaaggggtaatgtccctttatgaaattctctgaatagagccatgagatcattcttaacgatctcccaaaagacctgataaaactctacaggaaagccatttggacctggggaggagttatgatccatttgaaaaattgcctctttgacttccttttatgaaaattcagcagtaaggatgttattttccaagtcagacacttgacgaatatcaccagtccatccctctgtcatggatacatgattatgatctggaggaccaaataaacctttataataattggttatatattctttgagattcccatcacccgttattatagtgtcctcttgttccaaccgactgctacttaagtacttatatcctaaaaatatagatgctttaatatggtatgatggacttccattcttttttacggaaaatggattaaaaatcccggcctctacatccatgattgacttccatgctttttcaatttcgattatgaggtaactagtaagaatgtctgatacttggacacataacctaactagaatctgataaaaaaaatgagttgtgcaagggagaaaggaaagaatatggagaatcacagcatggcataaccttaattaaatcagaacgtcgggaccttgctagagagtgatcaaatcaggatcttgctgtcttgtatgttgcgattattctattgtttataatgttaatcttttgattggttttattcttctcttcagtacttgttaacttagggatattttccccagtaaactaacaataaaataacacttaacgtaccagaattatcctattttagtatatatatatatttggatgaccaggatgtacaagcattaattaagacaagataaatcacatgagtagtcaagacagaaatttcacctgagtaatattgttattctatatgattcctctatgtgtgcaatactgttgtgtgctactgttgagtcaaattgggatgttggggtagaacttatgctcgaatatgatttgttgtttcattcatgtgtaggtgtgtcttgatgcatcgggagagagttgccagtgatggatcgggcgtcaactgagaagaagatatcatctaaacggtcaaagatatcatgtgggataattagattaaagaacaatgcatatgtgtcatggttatggataaggcatatcttctacctcacaacttacggaatatatggatacaacatacctctgtatgtacgatatgtttccgtatatgataagaaaatctacaagagattataaaaataatcctcgcaggcaagtgaataacagagtcccactcggtgaggattaggattgtactatatcgtgttgggttcggtatttacgagttctacttggagataaaggtaattcacggtataaatagcgccaacatcaccaccatagcctacaatccggaggacgtgaagtctactcgctaggagatctcgtcaaaaccatctcgacaaggatctcgctggtaatctcgggatcgccggtcttctattgtaatatgtggtttttccgtatcaatctcatataaactggattagggctattaccttatgatgggcctaaatcaatataatccttgccttcctatgtgcttgatattctatcgtgtagatcatcgtaccaacgtaccccaatatcctattcatccggtctacgggtactccccgtcgacaatatggttgatggagattccatgcttcatacgatgggagattgtgtgcatatgacatgagtcatgaaggagtccaaattttggaatactgaattttgaattgggaagagataagatagtttcttgtacgggaaggcttcctagtggactagaacttcttcaacaagttagatacatagttctagagatacatagttctagactgcttacttatctcggttacaaattgagggggttggggttgcactttctaaacacagatagaaacaataaagttaaatctacttttacaaaattattttacttttatttctattttttaccttattttatcctatttctgtttggtcctatgtacacaattaacctgagaagacaacaatgcaaatgttgcagaaacggctccggatgaccaggcctagagctgactggactatacaggccagcatgcatggtgtcaccagtgcacatgccaatgggggttgctagcgcgcgtgcgcgcgccaggaaaggagctggcgcagcgtccctacgtatttcttttgttaccttttttttcaatctcctattttggtgcatttcctttttttctctttttttttctcaatctcctattttgacgccaccgtttccttttttttgttttcttttcagatatttttaattgttagcatgcatatttttgaatgttttgaattttgttatgaaaattttcaaatttaagtaaaaaaatttgaaatttagggtgaaagtttataaatttgagttaaaagttttcgaacctgagttaagttttctaatcttgacttgaatttttaaaaatgtaagttgaaagttccaaatcttcagttgaaagttttcaaatccgagttgtaagtttttaaattcaagttgaaagttttcaaattcgagttgaaagtttttaaatccgtcctgaaaattttcaaatccgagttgaaagtttctaaatcttgaattgaaagcttttaaatccaagttgaaagttttcaaaaccgagttaaaagtttttaaatccgacttgaaattttttaaatccgagttaaaagtttttaaatatgagtttaaaatttcaaaaaatcttgagttgaaagttttaaatcttgacttctatacgcgtgcagtagtcaacagaaaaaaaaagaaacgcgacacttgcaagaaaaagaaaaaaaagaacacacgtgagagcgcgtgcgctcggaagatgggccgtgtgggccggcgcgtgcgcgccaattagcttttctgcatgccaatagccttttctttcttttgtttttctttcacggtgaaacgtctagactaatccagagagcaaagccatagcacattccctaaatcattaacaaactaatccagagttgccatgtggaccaatgaaacgctggcaaaatggccggctttggattgatacatagattaatacatgaaccaatgaattatacacatctgcaccaaatatatgtgtatagctgatatccaaggttttgggtgatacgacataatattgatgatcaaggagtaaacattattatgatctcagattgtacaagacacttcatccctctctatagaacatcgcccacactttcctcatgcttcccaaatcccaagccaaaattatttgtctcttcgactaagaaacagtgagaggtgggtgggtggggggtgggggggggttctgattgagctgtttttagtatgtagccgcatcagagatgacctaagcgagaattaagacagagcaagaatgcaaactaaagttgtaattggtgatactatgtttgttttattagtgtgttattactgtctttttcttactgatagttaggattgggttcgaagatagacagtcctagaagctagcagatggaagggcaaagaggaaagggcgaggctggagagaattgaagaccataagagacgcggtacacgtgagtgaaagggatcggttgttttggccatggattgtttacatcttatagctagctacaccatctatttatgcatggccttaagatgtatccataagagatagatactcctcctaaccatggttaatcatggtcttttcttgtaaaaataaaatcattgtgtctaccgatatggtgttaccatgcattcttagtttgtgtagaggatggaagttaaatatacttttatttttaaaaggaaaagataacatctaacaattaagatcgataaccctaagtataagcattaaaaaaactaaaccaatcgttcatgatattaacatcagtcaaaagtatactaatttcagcatacttattttcctgacacaaaaacagagttaattttcaatggtgcatgtgtaatttaaattcagtatgtgactgtacagtgtatgttggtcaattatccattacgttcctgatggctaaagtgcaaccgatggtgtgaacatgaagagaacaatattacagttaatacgagagctgtgctccaatattcataagctgataacagtgaattttctggaaacccaagtgtttcaagtggagcagaatgacctgatatcctttgtgtttttgttcgatgatcacgactgccaagcatctagctatctcccaatgtcgcccaatccaaaattttcatggtaccatagtgcgcagcaacggggaattcagaggtagtgcacataaactgcaaaactcagatgaattttacctttcgatatttggatgcatggcagtcaggaacaaacatatatgaaacattttgatctcactggaggctgacactagtcattgctgataaaggtgctccaagcgtggtacataaatagtagtggtgtaggaggatacaaaaggaaaaccttacatcgagatggatggaaatgtcagtcactatgctggactaggtcatctctgacgggcccaaacccttacctttgatgggtttggtcttggtcagtgattagtggtcactgatgacaaaattacctgtgacgggtgaaacacccgtcacagataacccatctctgactggtatataagtcatctctgacgggttaaaacttgtcacccgtcacagatgagttatcagtgacgtgtcgtaactacctggccgtcactgatgactcatctctgacgggttgtaacttacgacccgtcactgatgacaaagcaagaaatacaatttttgaattttaaacgcaatgaaaaaacgtcaaaaaaatattttgaattttactagccatcctatacatcgttacacatcactacctacaaattcacaatttttcacgcaatatagcctgcatgctacatatgagatttgaactccagacctcaaccttccataaattcacaatttttcatgcaatatagcctgcatgctacatgtgagatttgaactccagacctcaacctccataaagagctcccttaccaactcacctactcagcacatattgactactcacccaatgttattattttgtctatgcttgtctgaatcatttaaatatatttaacaccctaaatgacttcaaatgaaaatattatcaactaaatagttatagatctcatcgtgttttataacttttacatagaaaatatcttcatccgatgtgtttgaactttgaagaattcaaaatttcatttttcaaaatatatctcactttataacctgtattttgaacatgtaaactttgtgaaatgaaaatattttcaattataatgttgtaaatctggttgagttctatgactttgatatggggcatgtatccatccatgtccatttgaaaaaaaactcaaaattttgtttttaaaagtagatctgatcacttgtaatgcatgttcggggatgtaaacgatctctaatagaaatgttgttagttataaagttgtggatatcatcgagagctacaacttttatatatgacatatctcaatctgaggttttttgcaaaatttaaaattttgaattttcactcatcactgacgggtcataactacaacccgtcagagataacaatatctgtgacgtgtgttagttaaagacccgtcagagatgagtggtctcttttgtgatggttcataatactacacccgtcacagataacatgtcatctatgacgagccatggttgtgacccgtcacagatcgtcacagacgatctgtgacgggttccaagtgcaagccgtcacagatgacctcacatctatgacgggtcctccctggtagccatatattgaagaggatattttttcggcccgttagagatgactcatctttgacgagatgcgttgtcccgtcacagatgacctgccactgaagcccggatctgtagtagtgagttgtggtcacggtgacaggtaatccataattgattgtccattaattagcttatcaggctgggttgcaagcttttcagtcagattttgaagacaaattaaatttaaaactgaaatatacagtttatgacaattttagaagttttgatgaaaggatgtaatgtaaatcgtaaagttcaacaatacaatgtctgccaaagcccattttgttaagaggagaaaaacctccggagccatcgttccacttattcgcggcatatttgcaaacgaaaagtaatttgtgaaaaaaatatttatatatgtgtttttagcgatctaaaagtaaaggctgaaaaataaatttcgatgtaaaaacctcaaaatcgtgaggaggggaaaactaagagaagattgagagagaagtaaaacaagttgagtcattagtacatgatcaattgagtattaattatgttaaatttgataaatggattaatatgttttttaaaacaattatcgtttagaattttttgttgcaaaaacacaccgtctaaaagttcagaaagcatgcgcataaaaacaagagaaactttttacgtgggtttgtaactattaagttacaggactctcaaccaattaatactagttaatcaaagagcaattctacggtccttgataaggtgccaaaaatttagtgtaaaatttggtaccatataggacctatataacacgaggtatcaaatttacattaaaaaagttgtacctcgtgttacctacttaaggaccataaaattgctattaatcaaattataacaatactttgctgaaagtagtagtttagccattctacagagctgcttggtacaaatcacatgatctatacatgacccaggaaaaaacaactccacaaacttgttaaagcaccaactgaagaaagttagattttttttaagcatctgtagaaagttagattcaaactccactactccactcatcctttatcatcgatatcctaatgatatgctgacaatgtaggaagctcttggccatggttagaacttagtgttgcctttcagccgtcttctcaccagcattcactagtttccatacagcgtcttaagggtttgccgtaacttcttaacaccagggttagatttgatcttggcacaggaccacctatgctttcctaatgcctcatatgcccagagagaggatacattcagcctcctcccatcgtctctaataaaaaactgcatttttagctagtcaaagacagattaaggatgttaaaacactgctatgctcttcattactgtccaaggagaggatacatattcggcctcctgccattgtgatataagatgtagacagagctaaggagcagtactgctggaggagatgaatgatataaagactgagaggtggaaactccaaacattcatgaatgatatgcgatacattaatcaatgtagcaataggtcacctcgtcatcttttaatttgctgctccacttcttgttattggaaaattctgagatggcgattctgctttgagactgcttttggctcaacagttaacagtattagctcgaataaaaagatctgcaacttttaacagtaggagtcaacctaatactacaaagtgaacagtgaagtagggatgatggtatgtgatcactatattttgtacctttggacaattgaacttgggttttaactgtaagttcaagaaaaattcttgtggtaattaaactacagctcgagagtgaaaacaacactggtatatctaggggtgaaaacggtaacggtaattccaggccgaccggcgttcgttttcgattttctacgggccgagccatatggaaatggtaatcgaccgaaataaaaatagaaatggtaaaaaatatagaaatgaaaacggaaatggttttgctgttataccgatcgtttccgtatttaccgtattcttgtggaaattaccgtttcttattaatatggtaattaccatattctaaatatgtcaatatttataagccatatctctacttgacccatagcttacagattgattgactcttcaatcaaatctctaacttttatttttgtgcatggctaaaatggagttaatttataatttatatagtataagcttgaatttatgtatgtaaagttaaatatatgtttttatagtttaatattttcgtatttgttaccggtttccgctctgtaccgacctgtttccatccgtattgttccgtttccggttttccgatattttcgatatcgttttcgttttcgactttactgttttcgatttcgtttccgagaaaaatatggttccaaaatggttgaggctgttttccgatcgtttccgaccgttttcatccctaggtatatctagtagtagagatatccctgaatccatatggaacttggctatagctagtaacaattaattatcaggctctaatgaaagaagctacaactcactggattggtaccgatcctctgccaccggcaaggaaacagcaaggtcgccattgtgcctatccaccgtccaaatagattggatggctagaaaataacgccgaattcttttcagcaacttgaaacggcaacattcttcttttccattagcacacttctcgaacggataatcggtgtgttttgtaaaaaaaaagtagatttttttaaaatttatgttagttaataggtaaataatcatgcggtgattatccacacagttttccattttacggggcttatatcttgtttcttttggagtccaaccattcttctccatcgctaggaagagaaaacaagtatagaattgctagttggcgattacgcgccattagcttaagtcgcgtgcattttttttccccaaggctccgtatgcggtccacgtactcactagcagcccatccgattggttttttcctttttcgcgtggcaatagtcttccttttcttttttccccgtcgcgaagccgtgattagatccgataatcgggagaaaattgtgatcagctgcacttctacgtaattagatccgataatcacggtacttcctttttttcacataacattgttttccttttttactaaagatttgaaacctatcaacttgaattttaaaagctttcaacttttcatctcaaatttaaaaaacttttaacctagatttgaaaactttcaacccaggtttgaaaactttcaactcaaatttaaaaattttcaactcaaaaattgaaaactttcaacttttcatctaaaatttaaaaaactttcaagccatatttaaaaactttcgacccaggtttaaaagcattcaattcaaattataaactgtcaactcaaaatttaaaaaaattcaactcaaattttaaaactttcaagtcaaaattaaaaactttaaattatacatttgtaaagagatgtgtgaaagattagaagaaaaatgggaaaggaacggcgaaaaaaagtgcgaatagagaaaattaaaaagcgccaaaagaataaaagaaaaaggcccacaggaggggtccagctagcgcacgccagtgaaattgctggcgcttacgcgcgcattagcgccccccaaacaaatatgctactaccatatccttttcatttcttcaagttcgccaatataatataataaatctctttattctacagattttttttattctacagatgattccaacttagcaagctttcatacacagctaattgcggaattgcctaggaggtgttttctggtttcctgctattttctttattaagtattttctactccagcgttcatggcttcttgccagcatgtttatctttaatatgcatgatctgatcagccttttcctgaggccttccaagccaagacaataaaatatttgttttctttcgcaagcgagttgagtaccaaaatcttcattgcacgaaagaacagagagatagaaaagagctaggagtgtcgctaaattatataaggaattgaaagtagccagtaactcttcaagagtaactgcatgacctacaaatctctagcttcattctaacttcagtaatactactgtactcttttaacagtaactatacagctacagttttgagtccaatgtgtgtgcagcaagtgcttttcttttctggggcttctatctatgatgggaacatattgtgcaaattaattagtaggtttgcatgactatagatttttttttcttgaaaatgtaaatgctatgcatttcatttcattaaagagaagagaaagtatgtacaacagagcagaaaacacaaaaataaaagggtcgccgaagtgatgggcaacaactctcataagagctaatctcctaaggccttgttcggtttagaggggattatttagaggggattaaagaggattggagaggattgaggaggaatagttccacaccacaataggagtggaataaattccctctaatccctctctcctagggattaaccgaacatagcctaagtggggatcgaccagcccaagaattcgtgaaaagctcttcctacggcatcacaccataataaattctcctttgccactgcatccaaaacaaagtagtactaggtgtgggattgttaaaggcgcagtcattccagtgctttaaaatttcccaagccactaagataatcaaagagtatagcccttccttagcatcctgagagacacctctgcatgaccagggatgaatgtagatgcagagggaggtgggtcgatcactgcgagatttcagtttctttaaagaaacgtctataaaacagaggctacagatctagaagaaatatacaagaacaataaacaaaactcatgttgctgcttttgaaacagcaatttgatcaatttgtttttaaaacttgatgcttggatctagaaattgaggctgttctgcggtgctttgaaatttaccgagctacctgcaaccagaacctcaatccgtggaagactttggtgctccaatttgagtgtccatggaagacaggagaattacactatgatcgtaaatgtttcgtttgatgttccattggaccttctggtgtagtgagattcatcgacaatatcctcatcagtgccggttggaaggcctcatcagtacaagtttcccaaccggcactacaatttgggcgctgatgtggggtgccatcaattccagtttaggcaccggcaatgataaacctgtatgagcccaaaaaaaaagtaaagaccggctcgaaaaatcagctaattgagtcgattcttcgagccggcccctctcattccacatgccaatccatatccaaaaccattccatgttcaacaataagaacactcattccccattaaagaacggatcaagaacacaacaaatattgatttaacacattcgatgaacattatatacagattgggatgaacacatatataaccaacattggctcaacatacatattaatccatcccaatggtaaccatatcaagaatcccaattatcatcgaattgtaatatccccaatcaatccccaatttcaagagtagtaatatatattcaacagatcaagaacacataatctagtacctacacaaggtttgcctcaccgcagccatcccagaggatacaccaacgccttcgtcgatctccttcgctgccatcatctcccttcagccatcaacaccacctccggctcgctttcacgttcttccgctcggcaatgccttctccttcctcactggcttccccatcgagccgctcaatctaaactgcttccctgaatcccctctatctggacggagagaggaagaggaggaaggtgttagcggcagccctgtagttcactcaaaactcacactcgatcggaggttgaagacagtgaacagtagaaacatcaggtgttctacatgagaattttttgcactgcgtagaatgtgcagcattttctggtttatcatgaacttaaatagcaatcatacatgaagactcaaaacaaacaaaaagggaaagagtggagagaactggttgttaggaaacgataagcgaacaaacgataaaaaacaatagatcaatcacagaagacacgagatttaacgtggaaaaccctcccaaaacaggagaaaaaaaaccacgggtgccagccagcaaaatatcttcactatatctggggtgaggttacatcgccgcacggcggtttacaagaggtatatatatggtggaaccctaaaagggatgacaacgggccaagcctttattaagtacaaatgaatttggatcacaactcaacaaactccaccttgagacaaattccttcttatagcatgaaacaatccttcaccctgaacacaacaaagacaaaaacactttcggcgccaaatagcctcttgggctaaaccactataccaattaagcttgagcaaagctcaaacttagcaacaggaacaggctttgtcatcatatcagcaggattatcatgagtacttattttgcataccttcagcttaccttgcgcgactacatcgcgaacataatggttcttgatatcaatgtgctttgtcctctcatgaaacatctgatctttagtgaggcatatagcactttgactgtcacaaaacaagttaatgcaagaatcaactccacaaagctcagcaaacaatcctttcaaccaaactgattatttacatgcttcagcaatagccatgtattctgcttcagtggtagactgggcaacaacaggctacaatgttgccttccaactcacagcacaactaccaatggtaaacacataacctatgagtgagcttctcttatccaaatctgcagtaaaatcagaatccacatatccaacaagccccttatcagtcctgccaaacttcaagcaagcatcagctgtgcctctgaggtacctgaaaatccactgaacagctttccagtgttctttaccaggattagccatgtatctactaaccaaactcatagcatgagataaatttggacgggagcaaaccatggcatacatcaaagaactaatagcactagaatatggaactctagacatgtattccacatcctcatcagtactagcacattgtaaagctgataatttaaaatgaggtgcaataggagtagtaacaggctttgcatcatgcatgttaaaacgctaaagaacattcttaatgtagctttgctaactaagaaatagcaaaccagaatttctgtctctagtgatttccatacctagaattttcttagcagcaccaagatccttcatatcaaactcactactcaattgtttcttcaatgtactgatttgttccttgctcttggtagcaatcagcatatcatcaacttataacagcaagtatataggtgatccattaacaaatttaatatacacacagctatcaaattcagacctcttaaagccatgtgacaacataaatgaatcaaaccttttataccattgacgaggagactgtttcaaaccatacaaagatcttttcaacttgcaaacataatcctccttaccaggcactatgaacccttctggctggtccatgtatatctcctcctcaagctctccatgtaaaaatgctgtcttcacatctaactgctcaagctcaagatcatgcatagcaacaatactgaagaatgtgcgaattgaactatgctttacaactggagagaacacatcattataatcaacaccagcaatttgactgaaaccttttgctactaaccttgccttaaacctcggaggctcgctaggagataaaccctcctttctcttgaagatccatttacaacgaacaggcttcttctgttttggcaagtgcacaagctcccatgtgccattcttctcaagagattgcatctcctcctacatagctgagatccacttctcacggtctccagagacaacagcttcaatgtatgtggctggctcaagagtattctccacctgttcagcgcaactaaaagcataataaaccatatcacatttctcaataaggcggactggagctccacaactcctctttgttctgcgatgtgcaataggttcatcttctggctgcaaaataggaggtgagtgctgaacagtatcattaacatcattactaacaatttcagtttcctgatcatccacgtgctccacctgcacgctaacatattgctgctcctcatcagaaccacctggtatgacatctgtgggcaagctgtctttaaacataacagattcattgaaaacaacactcctgctcatgaatgtcttattagtttcaggattccataacttatatccttttactcctgaaccataaccaagaaacagacacttaatagctctaggctctaattttccgttatcaacatgagcataagcagtgcatccaaaaactctcaactatgaataatcagcaggcataccagaccatacctcaatgggagttttcttattaagtgggatagaaggcgacctgttgattaagtagcaggcggtgttagtagcctctgcccaaaaacgcttgctcatgcgagcgttggacagcatacaacgagccttggagatgatggttctattcatgcgctcagccacaccattctgctgtggagtgtacgggatggtgtgatgcctaacgatgccttccttcctgcagtaatcatcaaaagcatccgaacaaaattcaccaccattgtcagtgcgaaatacttttacctccttttcagtttgcctttctatcatgactttccactctttaaaagcagcaaatgtatcatctttatgtttcaggaaataagccacacttttctggagaaatcatcaataatggtaagcatataacgagcaccaccaagagagggcttacgagaaggcccccacaaatcagcatgtacataatcaagtatacctttggtgcgatgaactgaggtattgaattttaccctcttgtgcttaccaaaaacacagtgctcacagaacttcatgttaccctgagtgcagccatccagcaggttcctcttcatcaattatgccataccaagttcactcatatgtccaagacgcatatgccacaggtgagtcttactaggttcatctttagaaacagcagcagcggtaacagaaccatgtaatgtacttcctctaaggacaaataagtttgcagaattcatatcaccaatcatataaacgagagaaccttttgatacctttacaactccacctgaaccggagtatttgtatccttctgcatcaagtgtgctaagagagatgagatttctcgccatacctggtaagtgtctcacatctttcagcatgcgtgtcatgccatcatgtgtcttgatctaaacagagccaatgcccacgatctcacgtgggttatcatctcccatgcgcacaacatctccattctgcacagacttgtaagaactaaacccatctctgttaatgcaaatatgaaacgaacatgcagtatcaagtatccattcatcatgactagcaacacaaccagcaaaaacgacgagacaatcttctgaatcagagttatcagcactggtaataacagaggccttaccatcaaatttccttttctccttgttctgcagcttccaacattcttcaatgaagtgatttttctttttgcaatacttacagaactttttacctctagacttagaacggcctctactctggctcttgtcacgatcattgctgtcgttgtaggttctctgctcagatctgcctctgacctgcaatgcttcgcccttagaggacgatgcatcagactaaaccatacctctcatcttctccctgttttggagcgcctcatagacttctgctagggttagttcatcacagcttaaaagtatggtgtcatgaaaatttgcatatgaactagacagtgagcataatagtaaaagacctaaatcttcatcatcaaactgtacctccatcgacactaggtcggcaacgatctccttgaagaccgatatgtggttcaaaacagaaccactctcctgcaacttgtgcgagaacaacttcatcttgatatgcatcttactggttagatctttagacatgcagatcgattccagtttgagccaaagttctgcagcagtcttttcctgcaacacttcttgcaaaatatcattagatagatgaagttggatcagtgacagagccttacgatctttccgcttctcctcagcggtccattcagtcgatttcttcttcccgaagcttttcagcgcctcatcaagatccgaagtttgcgccagaacagcccgcatcttgacttgccacagcgagaatcttgtcttgtagtctagcagcggtagaacatacttcatcgacgccatcgcgaaaccctaatgtgggaacaagctctgataccacttgttaggaaacgataagcgaacaaacgataaagaacaatagatcaatcacagaagacacgagatttaacatggaaaatcctcccaaaacaggagagaaaaaaccacgggcaccagccagcaaaatatcttcactatatctggggtgaggttacattgccgcatggtggcttacaaaagatatatatatggtggaaccctaaaagggatgacgatccgttttgcgggggctccgtccccgcacccccgggcgtccccacgtgcacagcccaagcctcccggcaacgggcctccgctccactacggcagaagctggcctttattaagtgcaaatgaatttggatcacaactcaacactggtgagcgttcgccatgcacgccaccactccacgaagtcctggcacacagattactcctaaagactcgctccgcccttgaacatggctagagcacaacgcccacaaggcacgcaggtaggtgtacaacagaccgacaaatgaatgctacagttagcttcataggatacaaagtgactggcacgggattatgtaaagtcgaacagaagggagggcactgtgcagcatgtgtggagagagaaattggattggaggaggccacacagaggccgagcggcggtagcggtaaggagaaggcatattggtggcggcgacaattttgggagagagacaaagagagagcgagaggaactaagaagaatcgagaagcgaagaaaaaatacagagaaagagaaagagctagacttatctgaggagttcattggttggcttatgattatacttataagacaaaatttaaatgttagaacataattttgaatttaatttttttttcatcgtagtttattttacaacatttgattttagtcgctaaggacatgaatataaaaattttattcatgaatttgataggatctattcctatgaaacgaataatgcatatacggaaaaaatagtaaggttcaattcctacaacaatcctttagaaatcctttaaaccaaatgaactcttagtaccgggtttttttattgaaccgggactggtgtggtgtcatcagcgccggtgcttgcttttacagcgcactggtggttttcctggaacgggtttagtcgaaccggtactggtaatggcagcactgatatgctgttctgcagcggcggatgcagaaggatatattcctgataactcccaagctgatgcggtcgcttcaatagaagcagaaatgagtgaatttagtgagaagtgttgtatcctaggagtttaattactatcgtgcagagaaaagacgatgcaaaggctagaagcatcagagtgtgtggcttcaccttagcctacaatgacgtggtcatgtggccatatattcggtatggatgtggatagggctggcaaacaatgcaaccatacacgttatctaaaatatgacaacatgaaactggtttcattgtcaaaggcacgttatagcacactttgaaacaatgggatattaatatatggtaaactaggtaatgcagaccagtgttatgtatattcatttaagagaaagagtgtccaaacggttccaagtaggacagccaaatccaataaaaacactggaatgcccaaataatattacaatttccatgtaaaatcgtatgatttgtacaattattttattttcatttatgataaggtttctacttcaatgacagcaatcacatgggatgattgttggggcaagcaaactttatagatgttatcggggagcatttaaaaaagcatgattggaggtatagtaacactactgcaggatagggctgtagtaacacatcattatcagtaacacaaactagtatgcgttgctacaacatgatcttgtagcacatagcaattcctattgataaaaaaacgtgttacaatcattcagctagtaacatctctttttaggacctgtaacgcaaaagcatgtgttgccatagatcctaggaacacatattttttccaccagtaacacataaacaatatatgttcacataagtggtaacatcatttttaattataataaaaaatagtaatatcagtttaagattgcccagttatcacaaatgtaaataattattaaagatctttatcaagcatcacatattaacatgtttgaattacacggaaagtaactgtatattacatccattgagaacatacaaaataactcgatctagggagttggtccattaagaggccaactaccgaacaaccatttcatatttgagtatacttgtaattcgagcctcagccctcatgtgctatacaagtccctgcagttgacaaaaaaatattgacccatagaaattaatatgtactatactccgctgcacaaaaaagcatccgctgcacattgtgttgaattaaaatgaaagtatttaaggcttgtatagccgtagttttaaaaccatggttttgttaaaatgtcacgaaggctccaatatcagagtacaatacataaaaggatccggtagcatatatatatgattggacaattggaagaaaagcttacaaattacttactagtgatttcagaaaaaaaaaagtacaagtgtttttcttggaataggaactagcagcttatttatacggtcttgtaaagtaaagaattaagatcagagcagagtatttctacacaaacgataattttagtgcaaggcattgaactagtcagaagacgtatgaacaaaattgaattaaaacattctcatgattagtacatatatacaagctgtaactacatctttgatattataatagggtttgtgtgaactaaaattttgtgtttcattatttgcttcagacattgtatgcagatattgttgtatatatgcttctttaattcccatggttgtaaaacttataagtgattactaattgctttgttcatatctcccggccgtcagaattttcatttcattatctaataaaaaaatgatgaggagacgttgcataggggtacacacttacgagttacgatgtatatttgattcccaactacctgttactagtttacaatctagcaactttggagacatctcttggcatgggcaacctgtgagcccagaaaaggagacaagtaagtgtcgagtatcgagagatgttatgataggatggggatactaacagatttagaaagtacatatttttacttaaaaatataatatgttgcataaattaaagcatataaattgcttttagtaaatctaattgatttttatgtgaacttaagcatatttattcatactatttttaatccaccttattttaaataatattgtgtcagatcatagaattatgatactacctaaaattttgtagaatcatgtgtaaataatcatacatgcaaatttaaactctccaaaccaaggagcacattgcaaggaccggctatgctaagaaatgttggtaccaaagaatttgcaaggaccggctctatgcctctatgtagattaaaataataaaaaaacagtctgtcacatctttcttggagcatgcatgaagcatatgtccgcatttatgttatttttgcctctagtgggtcccaatacttagatggactggtgctaaaccatattgtacagaagcttagtatcttaaaacttctatgtggtgagtggcaaacttttagcttcccaaccgagcagttagatttaggcatatgtttggcacggctcgagttctagccccaactctactggagttaaagtcctaccaaacagtgagttgaccctaaaagagagtaaagcgggctgaaacagtgagttgaccctaaaagagagtagagcgggttgaagtaatctggaaaaaatactgaagaggagcgcattttaggcaccctattgtgtgacactcataaattagagaaacatccatccattgattttcacttaaatcgatagacacattattttacatcgatagacacattattttacatcgttattggatctttttttttaaaaaaaaacatcccataccatattcccttcctctccatccctatgtgcattaaagtacataaacattttgctaagctgctacttgtctcacttaaattagaagaaatcctaataattctgagaaaaaaaaataaaatccaaccatcggttttttacttaaacatcaacacatttcattattttatgtcatctgatcactcttttttttaataaagaaaacatccaaaccctccctccatccccgtccccgtgcggtgtgaggcgttacttttctctgtttttcctatatttatgataattaaaattaaaattatttttgtgggcaaagaaaagaccacaaacgaatctccacctattaggtctagccaactattatttttttaagtgatatcaataacttaatgcccaaattgactatatttaaatgctaacaaaaaattacattatggacccacatgcatattgaggcctccacttaataaagacaaaattttctacatgacattaaaaaaagtgtgattagctgggagacactacaagaatgtacatctactatgatacactgcaaaaatggtaataagctgcttggatacccgtgatattattttgttatatccaaagaaaaaggagatagaaacaatcacgaaagtatgattttgccccctttctgccatgtgcggctcgcatatagctctgacgccatggacgtcactacatgggtggcggagggtaccgctgcgagaccgactgcaatagcaagtgctctacggcaccctgctcaacatgaaccaggaggtggcccacgttgtgctctccccaagtgtggtgtgtggcggagcatcggcgccggcgtggctctcgcgctgcagcggcgacgagtgcgggaacgatgcggacccatgggcctaggcgcaaaggtcctcctcaaaaccttgcccccacagagccacctcaccggctgcaggtgcggttgtggtgtcagaggggaatgtgagacagacttggtaggcaggagcaaaaatcatacttttgtaattgtttttctctccatttcgtttggatattgtaaaataatatcacagatatccaacagctaattaccaattttttcgatgtcccactcataaattagaaactacacagtttacacagtttaaagtaattttagttcacaatttatatgttgcaagtaaccagtgttcaaagtgtaggatcgaaacacaagaacaaagccaaccagaggggggtgaatggttggtatacccaaaaaccgaaaacttttagcggaaataaaagttaccctcgaattcgatagatcgcggtctgaccgaagttgtattgccggtctgactgccagatgaatgtcggttcgaccgatgtagatcgatcgatcgaaccgccgaagtcgcctgccacgcctgccgccgccaccggtcagaccgcccgtatgccgctggtctgtccgccgcgtgccgccggtctgaccaccggtatatcgccggttagaccgccgaaacccggtaaacacaaatcgaagaactcttaaagtggatgacgactttattgattctctctgtgtttacaaagtgcaccaacagcactccttacaaaaatttcgactaaactcgaaaccctaactcaaaactcaactcaattgctttcaaaagcaataccgggaagcctcacgctccccctctatttgtacccgaggtaggcagcctaaatccacgaaccaaactcatactaagagtcctaaacaccttaggaaaccctctagtacaagaaagaaactttacataaccaatcgtaccaaacttggactccttccaa

SEQ ID NO: 66375 - DNA, 2751 bp, Oryza sativa
attgaagtttcttgggtgcgtccgtgtcgaaaattcactctgtgactcgcgcagtgaacttttatcacttaatgccaatattggcctatattagcacacgcggctgcgatatatttcaccggaatgaaaaggttcagaaagcaccaaaacatatttttgggcatactgtagagaattaggtgcgtccgtgtcaaaaaattactccgtgactcacgcggcgaagttttgacaattaatgtcaatattggcctatgttggcacacgtgggtgcaatgtttttcaccggaaaaaaaaacttcaaaaagcagcaaaacatgatttttggacatattggagtatgttgggtgagtccgtgttgaaaaatcactccgtgactcgcgcggcgaacttttgtcaattaatgccagtattggcatatattgccacacgtgggtgcgatgtttttcaccggaatgaagaacttcaaaaagcaccaaaacatgatttttggacatattggagtatgttgggtgagtccgtgtcgaaaaatcactccgtgactcgcgcggcgaacttttgtcaattaatgccaatattggcctatattgggacgcgtgggtgcgatgttttgcaccggaatgaaaaacttcaaaagccaccaaaacacgagttttggacatattggagtatggtgggagagtccgtgtcgaaaaatcactccgtgactcgcgcgacgaacttttgtcaattaatgccaacattggcttatattgacacacgtgggtgagttgtttttcaccggaatgaaaaagttcaaaaagaactgatttttggacatattggagtgtcttgggtgagtccgtgtcgaaaaatcactccgtgactcgcgcagtgaacttttatcacttaatgccaatattggcctatattagcacacgcgggtgcaatgtttttcaccggaatgaagaactttaaaaagcagcaaaacatgatttttggacatattggagtatgttgggtgagtccgtgtcgaaaaatcactccgtgactcgcgcggcgaacttttgtcaattaatgccaatattggcctatgttgggacacgtgggtgcgatgttttgcaccggaatgaaaaagttcaaaaagcaccaaaacactagttttggacatattggagtatggtaggtgagtccatgtcgaaaaattactccgtaactcgcgcagcgaacttttgtcacttaatgccaaattgtcctatattagcacacgtggttgcgatgtatttcaccggaatgaaaaagttcagaaagcaccgaaacataattttggacatactgtagagaattgggtgcgtccgtgtcgaaaaattactccgtgactcacgcggcgaacttttgtaaattaatgccagtattgggatatattgctacacatgggtgcgatgtttttcaccggaatgaagaacttcaaaaagcagcaaaacatgtttttggacatattggagtatgttgggtgagtccgtgtcgaaaaatcactccgtgactcgcacggcgaacttttgtcaattaatgccaacattggcctatattggcatacgtgggtgagttgtttttcaccggaatgaaaaatttcataaagcattgatttttggacatattggagtgtactgggtgcgtccgtgtcgaaaaatcactccgtgactcacgcggcgaagttttgtcacttaatgccaatattggcctatattagcagacgtgggtgcgatgtatttcatcggaatgaaaatgtttagaaagcaccaaaacatgtttttggacatactgaagagaattgggtgcgtctatgtcgaaaaattcctcagtgactcacgcggcgaagttttgtcaattaatgccaatattggcatatattagcacacgtgggtgcgatgtttttcaccggaatgaaaaacttcaaaaagcaccaaaacgtgatttttggacatattggagtatgttgggtcagtccgtgtcaaaaaatcactccgtgactcgcgcgacgaactgtcaaaaatgaatgccaatattggcatatattgccacacgtgggtgcgatgtatttcaccggaacgaaaaagcaccaaaacatggtttttgtacgtactgtagagcattgggagcgtccgtatccaaaaatcactctgtgactcgcacggcgaacttttgtcaattaatccaaatattggcctatattggcacacgtgggtgttttcaccgaaatgaaaatcttcacaaagcagcaaaacatgatttttggacatattggcgtatgttgggtgagttcgtgtcgaaaaatcacttcgtgactcgagaggcgaaaacttttgtcaattaatgccaaattggcctatattggcacacgtgggtgcgatgtttttcaccggaatgaaaaagttcaaaaagcaccaagacatgatttttagatatattggagtgtatgggtgcgcccgtgtcaaaaaatcactccgtgactcgcgctgcgaaattttgtcaattaataccaaagttggcctatattggccaacgtgggtgcgatgtttttcaccggaatgaaagagttcaaaaattaccaaaacacgactttggacagaaggagtgtattgggtgcgtccgtatcgaaaaatcactgcgtgacttgcgcggcgaacttttgtcttgccaaagttggcgtatattggcacacgttggtgcgatgtttttccccgtaatgaaaatgttcaaaaagcagcaaaacat

SEQ ID NO: 66376 - DNA, 2268 bp, Oryza sativa
tgaatgcgaaaacagttgtaataattagtcaatattaatcatccactgtccaacgctacaccacgttgtaacaggcccaaccatccacctgtactatccaatttcaatagactaaactaggatgagacaaatcacggtgaatctggttgaccgcccataaccgcgggcacggctattcgaatagttttactctgatcagaggtgtacaactgtacccacaagacacagccctacgacacgtttccatgcgccgacatgccaccacgacataccggaaagaggccgtgacaggaccattcgcataaccccctctagccaagcacaccacacctcaggtttcacccccgtccccagcgggcgacgggcagtccctgctcgtgcctaggtgaatccggaagccgcataggccgtcgcagggcccatccaaactccatcacgcccacccttgcctggatgcgtcagctagagaaaagctacactacaagcctagccgttgcccacgctggcttgtggtaagtacgaggaattcttctagggtttcccgagaaccggtccttaattaccatgggtgcgactagcaaaaccatgcacccacagtccaccatgtgattcattttaattaaccaacaccaaagcggtggtactaatccaacattaccattagaacctgcagtctatatttcaataggatttttccccaaaagtgtgctagttgaactaagcatggctaagcaattcctagtccaaagtctattcatgttataacccaagcctgcaacccatatccctagttagaacctaatccatacctcccattaaattccaactgactgtcaaataaatccaaaataagttttactaaaaccctaaccgatcttatttgaacaaatttcaattgaatgagcgatcaagatttttcccatgaactgaggaacaaatcccaattttcccaaaacaaatccaattgcaaagaacatatgcaaatgaaaagattcggaggtctcttagggtttccatttggcttgtcctacggtcacggtcggcttcaataccaacttgtcacacccagaaattcccaaatagaattccaagcagaatgtgcattaaaactcttgtccaggaccggccagggtacacaaacgacaatgttgacatacagatccatgtcttacaaacattataaaagtcttacataaatgcagcggaaattaaaaggataactggagctaagccttgacttggatagcagtggggaacaccattcgacaggcatcctcgatggcatggatgaaggctagtcctcagaaaagccaccatcggaagcatactagaagtctggggggagggggggagggaagatagagcaagactgagtactacccactgtactcaggaagtcataccggaacggagcgtatgatgcaaggaatataaccaaagaggactaaaggagttcatttgcataaagccaacatttgtaaatagtagttgaaagcggtaaaacagttgtagtaattaaccattatttaacccattcactgctcaacgctacaccacgttgagacatgcccaaaccacaacctgaactaatatgatccattaagctaagttaggatgagactaatcacggtgaatctggttgatcacccataaccgcgggcacgactattcgaatagttttactctgatcaaaggtgtacaactgtacccacaagacacagccccacgacacatgccagtaccacataccggaaagaggccgacatacctgtgtgccgacatgccagtacgacataccggaaagaggccgtgacaggacccttagcataactctctctaaccaagcacaccacacctcaggtttcacccccacttctcaaaaggcggcgggcagtcccctctcatgcctaggtgaatccggaagcgacaaaggccgtcgcagggcctatccgctccatcacgcccacccttgcttggatgtatcggctagaggaaagctacactacaagcccagccattgcccacgctggcttttggtaagtacgataagttcttccagggcatcccacgaaccagtccttaattgccatgggcgtgaccaccaaaaccatgcacccacaggccaccatttaacgtattttaattaaccaacaccaaagcggttgcactaatccaaaatcatgcattaatgtaattcccccattgtgtactagttgaactaagcatggctaagcaattcctaatccaacatctagtcatgttacaacc

SEQ ID NO: 66377 - DNA, 4048 bp, Oryza sativa
tggtttcagatttaataaatgccaatatatttgtagaagaatgtgtttgtttttattgtgagaatttctgctaatgaaaaacatttaaagttggctctgtatgcaaataatgatcatatatatttcagttgttttcacttttatctatatggtaggtcagagctggagtacagtataattttgactaaactataccgagtgttaaataatcaatatgatgttatcagctatataaaaatatcaaaataaaattgaatgtacatactgagatatataaaaaggtaaccatagatgtctgctcatggtcacgcaaggcgtgacttaaatggctagtctaaacttgattcatggacccggcacttaatattatgaattttttctctctttgtttaaattctcgttcttcagcttcgaaacaggtaaaataaccagtctctcaactcccagaacggtaaaactcgtccacttcaaaaaaaataaatagggggaacggtaaaactcttaaagccttgaatggtaggacatcgtacgggaaactacaatgaaacaaacaagctaggaagagaaaaatatacttcccgatcaaaagcatactatcacgaattcgaaaactttggagaaattcaaatttgaaatgaacaaaccataaaaaaaatcctacaaatacgattatattgatagtaaaaattttcaaaaagaaatattgaatttacccatcgtttttgaatggaacagatgggaacaatatgtgaaaatgagaaaaaaatgcctaatgggctgacgactcaataagcccaaaacacacgcgagtccaaagcatcacagcacgagccgtcgcggcgtctccggccgccgccgcagccgccgccgccgtagcacatctcccgctcgctggagtatggctgcttcgccgcctccgcggagccctagctccggcgatccggctgaggccgccgacctggccgcctccgccgccgccgctctagcatctcccgctcgcgtatggagctccctcctcgcccgccttccctcgctctcggactactcccgcctcctctccgtaggccgcggccgcggccgccgacggcgtcgcgccgctctcccgctccccattcggcctgccgccgcccactccgcccggtgaggaatcccctcggctcctatgcttcttatgcttcgcaggcttttcatggagtagtgtagtaactagtaccattaccatgtacttgtgattcgtggattggtggacatgacaggtaaaacaaattggggcgaattctcggttagcaggtggtgtatgtggaactcgtactaatgtgtttcgatgttgatcactgcttgcagtatgtgctaatgtgcatcagtttttcttctactatattcgatgcatcttgttatgtggctggttcatgtaatgcattactgatttttcacatgccattgattattggtgtgcacagagttacttggatatgtttctgactatatgttattcgcaggattgccggtcagatgcccaaagcttttgacatcctacaagatgttgcgcaacacactctgtctaatttgcatgatatccagaagagcttaatattttggcagtccaaagcagaggtataaagttgattcataaaaattgaagtgcttctacacttttaatatgtagagaagtccactacttactcatcttccgttgtcctatgctattttctccagggaacaagttcacagaaactgtattaaatgatctttgaaagaggtccaagggcctttgtcgaagcagcatggcaaacactgactagactcaagagcaatgggagtccagtcccgcaccttttgcactctgcttctgatatggtctcaacaaaacttgctgtcctgacaagtatgcaacactgcttggctgcttttcttgctgaggtttgtttagtcagatgtttatcattacaaatgcttatgtctagtagaataaaactcgtgtcagcagttctttcaaagctaactttgtagttgctcgcttccaaaaattgctgtactactctagtcagatcattcaaacccaattttctaactctttgataacattgtttgttttacatgacacagttccacatttataaatccaaatcataccttgcttgttctataggtttattgcgaagttgacaaattcaaagaaggattaactgaaaattcagataaatcgcttcacacactgtttgctgttttgaatactgtcttctccaaattggaggtatcactccaaaatgtttgtgaggtatgcattgtttgcttttcttgcatttggatgttatatgtataatatacttttgtgtttggcattatgtaatatattttcttcaggggcatactctactgttcgcactcgatggaagcccatctgaacttctctttgaaagattaccagaaattgattatgataactcagagtggacagaggcctcctcaacagatgctatatgttttatctaccaaaacctccagaagctagataaccttgtttgctctcaggtaagcaactttctctttcaacaacagcaacttgtctcgcatttgctacttctattaatgttacctgagttgtagatggggtatggttggatcaatgttatactattggaggttctatgattgggcctgttcggctgcctgttctgcagttgtggcacagccggcaccaacagtgccacatgcacacgcgcagccgcagccgccgctgccagcttgctgaacaggcccactacctgtttgtgcttgctgtataaaatgtttatatagctatatgcatatgcattgtttcagactataaatgagtggtattgtcatacctatagttctgaacaggcgccccattagcatgcatataatggagcaacatgctgattatcaaaaccatgagatttgagatgtgagaattaatcatgtggatgaactagtgaaaatgtgttcaatgccaaacttgtatctcaatacagagtaaatgtgtaaatgtatagcattctccaggtagtattttattttttgtgatttctccatttatcatatttttacttttataaactatgtaagttgcagttatgtagaaataagtgggtttgttcactgtacaacaataaatcttacatttcttatcagatgattatatgttgcttaattgcctgaagcaaatattttctgcaattatagctctcaaggcataaaaaaccaagacatatgaccatatactggttgccctacacatgtggagcgttgggtctctcggcatgttctctgtggcttttgcgacacagtagcttgatgggaagttctgacatcgacaactgggttcaaagtgccaaagagtcaatagctggattttgggatgtgcatgttgagaaacctgtaggatactttctatttatgtccttctattatttatcttatgcatttttaaatgatgctagtgtaagttaactgagggtgaatcaaggcattctagttaaagtcttttctcgttattccgacattgacatatatgagatgttctctgaggtacaggaggataagattttgttaatctattcatgcaaatatttgtctaacaaaaaggaaaaccagataaagggaaagaaaagcatgctgccttgtgcatactagccgtactgttttcttatagtataagcatatatgatagagtatagaaacaatttcatgtgtttgtttactgcagcacttgcacttattaccatgaacatccttaagtttacatgtgtatataaggcatataactaactactatctttgttgacaattataaggcacacacgtagtttcaaaattttggacattgtaattttttaccaataaataagtaatgtaagatgcaacattatatagttgtgtgatacaaaaatggtaattttgaatttttgtttgcaataacttatgatcatgatttgtagttacacacgctatattgcaaaagattcacagtcataaattcattttggcagaccacaccaagtcaaatcgcacacaatattatata

SEQ ID NO: 66378 - DNA, 4183 bp, Oryza sativa
ctaacctgtgcccggtagcatgggaaaccgttgtttttcttcttttttttttccctttccgtctgttttcataccctgctgcatggagtagtgtagtagcgttgcatgatgatgcgtatagcgattattctttaaacagcaagaataatactccttaagtcttaatatgatgttattgtttttttataatttattttaatttagtataaatatgtaaatgaattaaaattatacttttttatgataaaacaagtcacaacaaaataaataatttttttgaggaaacaataataaataactagcatggtggcccgtgcaaatttcgcggctagcatctttatattttctcatataatagcatatatgttttctcattatattattcaaatatattaaaataacaacataattttaaattttgcaataactttacaaaactactaatgtgtaatattcatattatattttatatacatgttagttattaattatttttaatatcaaattttagttatttgtaaattatatatattcctatatggactctagactcgtcttttaatatttctttttttttaattccgaatttcctgtaaattgtatttctatatagcctatatgctcttcttctaatattatttatttttatttctgaattttcatattatattttatatacgtgttagttattaattatttttaatatcaaattttagttatttgtcaattatatatattcctatatggactctagactcgtcttttaatatttttgttaatttcgaattttctgtaaattgtatttctatatagactctatgcttttcttccaatattatttatttttatttctgaatttttattacttctaattgtatttctatgtggactttaaactcatctttcaatattctttaatttttaatttcaaatttcagttacttctaaattgtattcctatatttgtaatcctatattgaccttaaactcttcttcccatgtttttcttaattttgaatttttgttatttataaattgtatttttatatggactctaaactctacttttaattttattatgtttattccaaattttagttagttttaaattcctatatgaactctatcctctacttctaatattccttatttttaattccgaatttcagttatttcctaattatatttctatatggactctagtctcctcttttagtatcccttattttttaattccgaatttcacttatttcctaattgtatttctatatggactctagtctcctcttctaatattccttattttttaatttcgaatttcaactatttctaaattgtatttctatatgactctaccttttctttttctccgattaatgtgagaatttctaggccatgagagcgaacgtggaggctcctttttctatttctttaataatataatagatatttatattttttaaagaaataaaataaatggttaaacgttatgcgaaaactcaacgacatattatattttgggatgaaaagatgacatactatcattagtcatgacattagtacctgattgttgcagtctgatagcttatttatcattaatcatggcaagtccggtttttctctactacctgatgttcatgacaagtccctgttggctgttgcaatcattgtagttgtgccagatgggataatatattagcagtttgctaatgacagagtagtgacgttgttttcatacatagagaaatccctagggaacatggcaccctgccggctcccttcgcaacttggtgacaccgaccgcacaagtttcagctgtcaccatctcttgggccgcatgttggcggagaaaggcagcccagccgtcttctagttgaaactaaaaggcccagcacaactcatcccgcacggtttcgctgatgaatcgttgcgggttgccgctttggacaccgcctaggcgcctactccacgcgccgtcggattcctgcccggaactagctcgatctcactcgttgtcgctggtgacttgtgccggcttggctaagatcaagtttagtagagccactcctagcttaaaatcatctataattaatttaatagccaatacatataatagttatatgcaaatatacaccacactattgatatataatttctcatgttatatacacattacgttttatgttttatatatgtatgtatatagttgatttatagtatactattgtataacctgctctgctcgatctcatctcggtgatcccatacttggcacgtacacgtgccctcttgatgacataaacaaagagcagacagcttgtgtgcgcttgtctaggtagaaaaaaagggatccgatcgatccgaagagcatggtgaaaagcacgctattaccagtaccaccactgttcgtttcgtttgttgggtttcggtcatcgccccacacatgtcgcgcatgcatggttgtcgccgcgacacgtgccggcgcgcgcacctccctctccgcaccttaactccttcgctctccgcccacttccccatcacgcgcgagcgctgccatcctctcctcctagctaggtcgatcgacgtcgagaatggcagatcggcagcagcagcacgcgcacggcgagggccggacggcggcgcagcgcctcgggtacgcgcccgcggcgtcggcggactcgccgtcgacgacgctgctccggcgggtgcagacgcacgcgccgaactccacccaggtggtcggcttcctcacgctggccgtctccggcgccgtcctcctgctcctgaccgggctcacgctcaccggcgccgtcgtggcgctcatcttcctggggccgatcgcgctgctcaccagccccatctgggtgcccgtcgccgtcgcgctcttcgtgctcgccgcggccgcgctctccgcctgcgccttcgtcgtcgtcgccgtcgccgccggcacgtggatgtaccgctacttcacggggaggcaccccgtcggcgccgaccgggtggactacgcgcgcagccggatcgccgacacggctagccacgtcaaggactacgcgcgcgagtacggcggctacctgcatagccgggccaaggatgccgcgccggcgcgtaagccgcccgcgcgcgccacatgtgtgtcggtgtgtggcatgcagcttagatgtgatcgttcttcttcggtgtgtttgtgttgtcgatttcctcacttcttctgtaggctactttaatttggtattttgatcttcttcttctctggatcgtacgtcactcgggttgtatttagtttggatcataagacgtcgcaccgggctgaattgatcttcgtcatttggcctgattcgatctcgcaatggtcgatcgcaattcctcccagctcgaggttacgctcaatgacgactctttgcgtgtgagatgtgacctagctagaaaagtccaaaattttatcgttttcgcaaagcaaaagatgtgaagaagcaaacggcacagcattaaacaagcaagaagttaaccaaacaatctgaattggaagcggttttgatatgttttttcagttgggactggaggcgagcggcgccacaaaccaaattctgcctcaccaaatgagctgagatcagcgtgcaacggcgcaaccagttccgtgcaacagtcgaagatgcattcagagatcagtgcgcccaccagttccagtcgagcagagggcatccgccatgccggcaacaacaccgaaccatcgcatcacgaaccgccgtgaagaccgaagaagaaacagggagacagggtagagataggagaggaggggatgacacgtggggcctattcttgtaaaacttttgtgatgactaggctgccgcgaggataccaagtactccgtaaatcaaaaccgccatctaacaatgaggtagttttgaacgattttaacaggggaacggctaatgggcgatcgatctgaacgatcgatccccatccctgtacactcctctccccgcttcctccctccccttctttttcttgctacaccataaatttttaaaaaaattaaaaaataaagttggaaaaatctatgtataaaaatattatatatataaaaaaaatttgaatttaaattcaaatttgaaacgggtatgtaaacttttgacttataaactttgggtctataaactttaagtgtgtaaactcttagatg

SEQ ID NO: 66379 - DNA, 2815 bp, Oryza sativa
acgcccttgattgacagcctgcttgtacagtagttcatcagaattgtatacaggccacttcaattcacttcctttcaggtctttttccatctttcaggtctcttccctacacagatcttaccaacaggttaacactgacatatctccatgtcttctgtcttggatcaagttttctttcagaactttaaagtgcagacccgtcagttattgtatccccaaagatgtttcaaattgatatgaacataatgtgagttcaagtagtgggatgtttatgagcttattaccaaactgcagatgtgccaggagcactgatgatgtaccagaaggggatgatactgctgaacaaggaggcgtatcggatgggctacaggggaggccgtccagcctgaaggacccaattcagactcggcgtccggctagacaggccaaggcgaatcctcgtaattatgggcctgattgggccatgtaagtgtgctgttgaaagctgtgtgaattggcgtgtgtgaggggaaagaacgagtgagtgggtgagattcagacataagcaatgtaatgaactgaattaaaactcagaacgggcaacttggtggcgatggcggcggcggctcaatcctgttggattggagcattgtaatctaaattggttgccctatttcttgtgttcttcctgaattatgttgaggtgttcgagttagaagagttgtttacaagatggcctagtcctgtcattctgcacattagtgtttgtagtctaattttctgaaccaaacaagcatcttacattggctgtgtttgagcatccaaagtctcaagatttgctatattatctcctgattttggcatgtgctatgtgaatttcataatatgatctttaacaatcatattttgcttgtcaaatttgaggatatgtattgatcagtaaaggggatatttgttgcttctgaacctgtacatgcaattgttgtcaatctttgagttatgataatttattaaatatttagtcacgtggatttcacgtgcatgcttactagtatgtaaaatgtagaaaaaataggagggggcccaataaaaaacctacctacatggtttattttcgtagtcccgctccctctccttttctcttctaccatgcgttaattccttttccatcctccctattactttacctatcctcctttcggcctctcctccctttatctcctcttctcgacggttggtaaccggatccgatagcggcgaaagggtgggatgagtggtggtggaggcgtcagatttgcctcgtgcgggaaggggcgatgccgtgatggttgctagggtgaccacgacgacggtggggaggggcgaaacatcggcttagtgggaccacgacaatgacggtagactcgaggtatgtggatccgtcggtagcaacaggagaagcggatccaccggtgacctctccctttcatcgcttttccccatacttagcgcatggatccgcatcgcccggcatatggaagcagcaatgacgactgtagaagccttaggagaatggatttgtcgccaccgggcggcatgggagcagcaatgatgactgcaacggcctcaagagaacggatctaccgccgccgacttcaatagcagatttactgccaccaggcatgggagtggcaacgacgaccgcaatggcctcgggagtgcggacctaccgccgctggccttgggagtggtggatccgccatgcatgggaggatcgactaacgactacggtagccttaggagtgcggatcgaatgctgcctgcctcaggagcggtgagtggtgactaaagattgtggtgaccttaggggcagcggtgacaacgaccctgggcatgggaacgacgaccgctaccaagctagggtttcaaaaattttctttttggctaaaaattctttttacaggcaagcatcgtgatgtgccacatgcaaaaatcctatttttcacttgcagttgtgttgatcgcctaggaaaacctcaatttttacatacacctagcgcaaggagttgctacttccacctataaagatgcatttcagccattttaaccttagccaaaaaaaatgaacttgacatattttcattcaacttgattgataagatgatttatatgtaagtgaagtagtagaatagatcgaggagtccaaggaagaaacggtacatatcatacatgtcatcgctttataggaaaacagatactttacccagttataaatatttaagcaatgtctgatccatttttttcaaatttttgaccattaattttatatatcagtataagtttataaaatccaataagttcatgatatataatattatttttcaatgcaaatgtaggtatactattttgtttgtgttttacactaagcatttgagaaactatttatcaaaatttattctgattgtcaaatatttatgatagaatagagcaggacaattaaattgcacactttatatcgagctggacatttcctttttgttttctccaaatccctgcatatatatgcagtcgcgcgcatgcatcgatgatttacccagcaaaacacacatatgatacggccgagatcagccagcttaattagttaattattggtggaccattagatttggcgcgctgtaaatttaagggcggagctagaacgaaatagagagtaacacttgcttaatttactttagatcaaatttaagcagatgtggatgtataagtttgtattgagagggtgtatatatggtgaaaataagtaagatatggctacaaaattttgtttgaccggattcgtgggcagcccctcgatcgg

SEQ ID NO: 66380 - DNA, 20708 bp, Oryza sativa
tatatggtaaaaaaactaaaatgcaacaacaaaatggaaacacatttcaaatgaatgtattacatgtgatggagtcagtagaccagcagggcttcgccgctccccttctcctccccctcacccctccctctttctctttttttggattttgagtgaatacattgaaaattctcatagggggaaggggttttatagtggggaggggaaaaatcgccctccctaagggcggcaagggggcctcctacaaaattccaggcagcctcgccgtccttttgtaggcgcccccccacacagtggtaaatcgccctccctaagggcgacaagggggccacctgcaaaaaaaccaggccgccctcgtcgccctgttgcaggcggcccccgaacagagcaaaaccgccctccgtaagggcggcaagggggccgcctgcaaaatggcacgccccccatagccggccgttaggaatgacctaacggccgtgtgccacgtcacaaaaaccaccctttgggagggccccaagggcggcgggcgactagttttgtaaaattttcaaacacaaaattagttttgtaaatattttaataaaaaaattaaaaacaaaaaaaattctcttccggaaaggttttataaatccactagaccattaggcgtgcctttcccgtgccctagccggagtaaagggtgcatcattaagagggcgatatatttttagatttgggaagggaaatttctaaatacttaaaccacataattgtgaatggtaacatgagccttgctagtacagaattggtaggttgtggtgtagagttgcatataatggaacatggtaccgtcattagtaaatagcatagtaagtactggtcgatggtttataaactgatcatagatagtttttacatggtaggccctagagcaaaatcggctacacgtattaggtagcctgattgtgccatatatggtctattgtctctaggcactgttacacaaaagcagtgcatatggagatagcatcagtaggctggtttcatggacaactcaaaaggcattgttcctaaagctggcataggtatattacagctactcttctgagacaatataaaccactgcttctaagcgcttcctaatataaaagtggaatatgcagatagctccaatgcttatgctattctcctccatgaaagatttccatcctgttgttaagttgcagcgtccatctgttttgctatgaactctgtagaaaactgcgttgtgaagtattagaaaaacatattgatgttagttgagtatgtgtaaaatatacttgcattgatgtggattatgaaaaatgtataccactctgccttttaatggctgttgcattgatggacattgttggaggcatgccacgagggccttcaaccagacctgccaaaacagtctaactcgcgaggaattaagccaagtctagaagattcggttgaggcgatgatgtggactagggttcccgatctttcgaaaggttctgataaccaataatttgggcggactcgcgacacaaatcgatccggcatcttgatcgaacacgctcttgagccccgcaatcgcaacaccatgtctcctctggttatcacccgtatcgaaacgcggatgacctcactgagaaggctaatccctgtttgccaatcgaagaacacaaacaagaacaagatagaatacaaccaaaattgcagatgaatgattaagctcactagttggggtcttacaaaccgatttagcggcgaaactgttctcgatagaataatctaagcaaaacccgactctaaatgatgacgactaaagaataaatatgattagagatgtcctagggttggcctagggcgcacacccccttgagctaatgtaacgccccgattttcgttcgggattaaaaatcaattaataatgcatttctagaaattatattaaaagttaaaacaatttattcgagtgaattaatgggagaattaaatttttcccttaaaaatcattggccgggaatattttgcaatattctttgtgccctaaaatattctctgaaattttctcgtgaattttcggagctcaataaataattttaatagcacatagatcatttaatcaattaattaaaaagaaaaacaaataaaattccctcttctccctttgggccgctttcggcccattcccctccttgctcctttcccttccggctgggcgcctccctcccctctcctctttgggctgctcggcccagttcagctcccctccccccccccccaaagtccagaaaacccccacctggcttcccctctctcttccattggctgacaggtgggacccgcagccccacctgtcatccccttcccctacctccagccaccccatcgccagggaccggcaattgccgccccaccctgccgctaaaaccgccgcctcccgcctccctcgcgcacgttcgaccgtgcggatgtggtcgccacccactcctcctcattttcccccacttttccccaaaaatcacgccggtttgacctccctcgagctccatgtcgccaccccacgtcgccggccggttgccgcccgattccgctcctttcggcaacgatttccctctcctgagcctatataaacactgtccatgcgaccctcgtccatttccccaattttcccgtactccccacactctctcccgctctccccacgcgagcccaagcgccgccgctcgccggcgactctccagctggctgctgccgccgctgccgccgtccccgcgccgcgccgtttgcgtcgccggcctcgccgcgcgttgccgaaccccgtccaccgctccgcttctgcaataaaccacccgggcgccggtttcaccgtgcacccgagccacagccgcctctcgtctcctccagtcgctcgccaccgccactcgcgtcgctgccacgctgcgccaccaccgtcgaaagcttcgtcgtgcctcgccgcaccccggcatccgattcgtttccctaaatcgccaccgcaaccacccctccaccgtcgacccgagccaccacctccgtttgtcgactgcagccgcgtcgtcccactgctttggtcgtcgccaacccacgtcgtcgcctccctcggctccgcaaggacgaggaggtcctcggccaccactccccgtcacccgaatcctgccggaactccaccttcatcgcacaccggtgagcacccgctagtcttctttcttccggccggtgattcacgccgccgggtgtctcctcgtgccctcctaatcccgccatccccttccccaggtcctgctggcgctcggtcgtccctccgctttcgccggacgtcgccggagtcccgccgtcgccgtgcctcctcgaggagcttgtcgccgccgcgttcccgtcgtctcctcgccgttgcgcgagctcggtgagcatccctcccttaccctctgtctccccttcaccggccgcctggcgacgcgccaccaccgccggtggccgtctggccggttcatcgccgccgtgctccgcgcccgcacctctgccggctgtgctgggcagccggctgccgcctcccctcgccgcgccgcgccgccactccctagcgtgcgtcgccgctgcccgcgtgcgctgccgctccccgcgccgtcgctagccgtcgccgccggtggtcgtgcgccgccgcgcgtcgtgtctcagctgggccggctctgagccgtgcccgtgctctaggcgccttgccctgtggctgcccgtggaccacccgttgtctcggtccacggtgccgccccggccgcggtggaccgtgtccaccgtgcgtctccccctttgacccgctgacgtgtggggcccgcgtgtcggcaccggccgccccttgctgacgtcagcgatcatcttttcctttgagaaattaaataataattgcgcaataaatcaataataattctagaaattcatttaaatggctcaaaacttctaaaattcatatctaattcatatgaactccgaattgggccattcaacttgcaaaattcatctaaaattgagctctacatgtttgtttactttttatgtactgtttccttggtttttactagggtttttcctcgttttgcgtgcctgcgtgtagttcgcgtcgtttcggaagttcgcggtcgcgaggatcagagttcagaaggttgtagtgaagaagcaaggcaagtcacacattccccttgagcatgttgatcccaatttataaatgttttaccgtttgcaaataaacatgcatgtcttgctaattacatgggatccgagtattacctatctgctcgcttgtgccaatgtttacttgatatctgtcctttgtcaaccttgtgtgataaatcaactagctcatggtacttatgtgacctagctagaactatatgcttagccatgcttaattaccactagctcagttgatgggataattacagtattagacctttttagtatcagaatgagctgcatgctcgagacatctgaccatgcttcgtggtcttaattatccaactaaaatacaactgaatggtgggctgtgggtgcatggttttgctagtcgcatccatggcaattaaggaccggttcgcgggatgccctggaagaacttatcgtacttaccacaagccagcgtgggcaacggctgggcttgtagtgtagctttcgtctagccgacgcatcctggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggagttatgcaaagggtcctgtcatgggctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggttgaccagattcaccgtgattagtcccaccttaataaatcgactcaatgcactgtagatcagtggtgatttaatgttactttaattactcaacagttttactgttttgctaaataaaatgttttacaaccgcctttatgcaaatagccacaaaccgtccctttgttccccttgcacgtctgcatcattggtgtggcttgctgagtacggtggttgtactcagccttgctattattcccccttttcagaagtgtagtgcttctgagctgaagatgaagttagaagaccaaggctcagaccccagttgagttttgcctgtggagtggagctgaagccccgctaggatcgcctttttccgctgctgtcgttctgtttcggtgtgaggactaagtgcctcttctataagtattttacactttatttacgtttggaaccgtatattacttgtcgttttgtgtaccctggctggtcctggacagggatttaatacacaaaatagtctggaaatttgggctaaatttctgggcgtgacagctaagcccacgacacaattacaaggcccaaaacacaaatcagattcggactggattagatatgtggcttgttttgcagattcacggcagctcggtaggaattttgatgtgggaccaaaatcatatgaaagtagactccataagaatcagcggctaggtccgtttgtagttggtgctgtgaggaggcccgaatccgaatccaaaacatgttgaactttatcttttgtcttctatggaccaaaagtgacgtggtgagatgaaagaagacttggagaaggttttggtttggttcccaatcaacttcttcaatcatccatgcattccttatgctcggtctcttttctttcgcccaagcaagtacctctgcaattgaaaacacacaaaactcattgtgtagcaacgtttgttcgaatatataacaagtaaatctaatataaaacatatgcacctttggttgattaatacataaggtagtcatggttatatccgagctagttgtgtcctcatcaggcaaagccacaaggtgaagcatgatggcaaagatcaaaagatcgggtccaagctcgacaattcgggagacatctgccaatgggtgaaagccacatgtcgaaggccatgtggcaaagcatgaaggcttcaccctagataaaacacagtcgggagaaaaggattgaagggccgcacagtccatggaggcctttcgccatagttgggccgacctagctagcccattaagagcccattaatgaaaaggacactgtgtgcctcactaatgtccttataataagggtatccatgtaaatttccctgtacaacctaaaccctagaggatgtaagcctgtactaagactataaatagtcccctggagacatgtaaaggggggatcccaaacaattttactaaataatccaacttgctgttgagtgaaccacgtctttcgacgtgacgtggttgtcaatcgagaatagttggcaccgaccatggggatctcagggcgaaatcactgagaacaagagcgaaaccactaatgccaccaaagaagatcgccaaagagagagttaccaccaagcataagtagagtgatgatgaagtggagatggctggcgaagagggtgtacagcttccagcagccggagttgttgtagcacctcttcaaggggtggcgcctccttgtcacaccttgattttcgtcttaggatttataaattatttaataaattattattagaatttatattaaatgttcattaatttacaagtgaagttaaatgtgggaaataaaatttcctaaatataaagcatggatggatttaatttttattaaattctccattgttaattatactctctggaattttctcggatttttttcggagctcaattcctaattttaatcatacaaagaacatttcagtaaatacccacatattaaattaatcattaaatggtctaattatatttttttaagtactttgagtgtccaagtattttcaggatttttcttgaaattatttgagcattggaagtatttttaacaattcaaagatcatttaagtgattattttaattggaaaagtaataaaaatcctcctcctcagcttgggccctttttggcccatttcttcctcttctctctccctcgcgcgcgtgctgtgcagtccaagccggcccaagtcaagtgctctgttctattctcagccaaccgaaaaagtctaatttgcctccctagacactgttcatcttctacctctagcagccgaactgagaccgagtgggctcggtttttcccctccaaatccgaccttttcccttgtgttttcctaaaattagttgaggggaaatattcctcttatcctcctctatcctttcccccaagaatcagactttatcccgaagaaatcaacgcggaatcgaattcgttttcgagtttatctctccaactaaccctcggtttttccggctcaaatcctctcgtttggagtccgatctctctaatccaagcctataaatagcatcccctagtcgccctctttcgtttgccccatctcccgagccttctcgtgccccgtagcgccgtcgccacgccgtccaagccgccgccgtcgccggccgacgaggagccgcctcgcgccgccgcttgcgtcgtccgccgcctcccgtcgccgccgttaggtgtgcatggcggagtagagtcccggccgccccctccccgctgtcgccggtcgccggagagccgtcgccgccgtcaatcgatccaccgccgccagacaagttcgtcgccggccaccatccgtcgtcgttcttcgttttggtgagcaccgttgagttcgcaatgttgtcctctacgcgtaggtgccctccaatcgcccagccaaggtccgcagcgccggcaaggtcgtcgtccaacccgtggctgccgtcgatgacgtcagcgatgatgtcattaatcccttttctcggttttctttttagatgcaaatcgattaaaacttcggaaattcataactaaatcgccgtagctccgattcgagtggttcaagttgctaaatttttctaaaatcgagatctacatgttaaaaatatccacatgtactgtttatgcttgtttttgtactgttttgttgaattttgttctttcggtttagtttccgacgttccggaggagagcgttttcgttgaggaaggttcggaagtgtttgcggaagctcaaggcaagtcacacagatcccaaacaactctttgagcatgttgaacccgtttaaagctattgttttatttcaacttatacattattttcgaatgtcatcgcgcgggggggggggggggggggttgagcctttcctaattaattaatgggcgaagatgactttattttcctatgggttataatttgattagcatgaaccttatatattggattggttcagctaaatgccatatgtatgtttgcttagtcatgcgtagaaacattagctaattaaaggggattaaatataaattatattattattattaattatggttatatttaatgatagctcacgatggttaatcatgttatgttgattaattgataactaaaatatgataaaggtgggttgtgagcatatggttttgatggttgtgctcatgacaattaaggaccggttcgcgagctactgttgtgagacattaaccgtgccaaccacaagccagcgtgggcaacggctttatcttttgtatagcatgattcattatggtgtgccagactgtgaagcggcgagaagtccgtgggggtcgctggggagtccatgcctctggttttgagggggtgattatgatccaggaatggtgcactgtggtgagttgtgttgtgcgaagggtattgtcacgatttcccccttagcagtgccgtggtggtacttcggggcatggcaacatgtgtggaatcgtgtcttgtgggtatagtggtacacctctggctagagtaaaactatttgaatagccgtgcccgcggttatgggcgagttgagcaatgtttttcgtgattagtcccacactactcattaatggtactaatgtgctaattaatttgactcctggtttggaatggataattccttgtttggaggtttgatctgtacgaccggggttggttgttcaggtttggttgggcctgagcagcatgggtgtgctgttcagtgttgattaaaattgatgattaattactctactgttttacttctcttaaatgtttgttaaatgctgcttttgcaaatgagtctatattatgccatcctttggtatccttgtgcacttgcatatttgctgtgtggcttgttgagtatgtcatatgctcattcttgcaataatcatcaaacctcagttgaagaaaaaggatccagaaggagaagacgtttggcttataccccagttgagctgcctgtgggagtggagctgaagccatcgctagaccgttattccgctgctgttttcttttcttttgtaagtatgtaacgttatcattatgatggatttgtatattaaattgtcagtttgtgtacctcggctgattcctggacgagggttttatgtagaaataagttcggaaattactagtgaatttctgggcgtgtcactcctccacctttggcacaagctacttcggtagtccaagcttcaaccaaggtagcggcttcgacatcttaaacggccacacgggcagtggttgcggtgaaggccccttcgaccgccgccgcctctttgtcccaggcgggaggctcaacccaagccgctgccacgacccaacaagctacggcttccaccatgctcacatccgttcaagcgaacgctgacctcgaggcacaagccgaagccgacatgggtgttgtgcgccagaacatggccaagttgcacgacatgcttcaccaaatgcaagaacaacaacaagcatttgaaacagcaagacaagcgaaggcctcttgggtagccccgcaaccgccttcgtgtcgatgcgaaaaacactcacggcctaggagatctgcgtagatctaatgcaggcccaaggcttgcctcgagtgctaagggtgtgccagctgatttgatcctacaatcaacaaggaaacaaaaaagaggaggtcggtcagccgatagccgatcggccgataggccgatagcgtatcgttggtggtccccagccgattggaccggctatggactgggtatatcaaagaatgtgtatgctgtaagaatgccctatcggctaaaagcactgcctatgaagataaaacatgtgaatcgagacaacactagcaaaagagcagccgatgaagtaaaggaagagcataaaggtaacgtgccagctagtactctggcacgtacctatacagcctggccaaaccataacaaggcgtcaaggctaagccaagagtcagatcgatggcctcagctgatacgacataacctcagtgccaagttatagcagggcctgcttgtataggtggtagatacacgtgcaataatttaagaaacaagcatattaggtaagatcagctgaaaccccgatgctaaccctaggactgaccgaaaacaggctatacctctcggttctaagcacgacttagcagatcaaacctaactgattcagcactgagtatgaaaagaaacacgaggtatagacaatcaagccaccgaccagcagtcaggctggtagataccctggctaatctaatctggtaggatgatatagtcaataccagcatcaaccctaaagcgaatatcagtcgatacaactaaatcgggctaccaagctagattagacatgatatatgataaaaccaagcaaaacgcgtaatccaaaccagtgcgatccaagagatctatcgtttctgatacagccttgaacaacatcgatgtagttgatacgattgcttgggccgacagaacgtaggacttaccccttcaccggatattgaagccgatgcagccctgcgtcaagtgccaagttctgctgaaacgtaaaaacgaaagtgaaaagtaaaagggtggcgatgcgccgaagttgtattggattgtctcccatattacaatgctagggggttaatatttatacctaaggtacaagataagtccattatggacacgactcaaacattctaaaaactctgtcggagagtgatctccactagcgggaggttggaagtcccccctttgtgagttcggccaggggagcaggtgcaatgctgaggagtatcctttctcgcaatcgcgatggatccgtggaaatcgggctcacgcggttgaaggtgacacagagagagagagagagagagagagagagagagagagagagaggttatacaggttcgggccactatcgagcgtaataccctactcttatgtgtgtgatgatcttcctatggttacaagcactccagattctcagtgcacaagctagggcttggccagccttccgcccagattctggttttttcaaagaacctctctctactcgtgggcagtgtcctccttttatagatgaaggggacatcacacgcgccgcccccatcctcaaccatcgggagagggccgacattgccgatattaaaatacatcttatgccttgggccggaagcgatccgcatggctaatctcgggtggcccccactgaatccctccggctgacacgggggacgacccctatcattccttattaaatgtttggcgacttcgtgggcacacgcacattggggggtccgatccggacatgcctcaccggttaaagccactatcaactgggcgagggacgctgggcttcctactgcaaatgatgggacaggacatacctgcccccacgccgcctgacacaagtcagggtgtgggtgcattgccgcctgtcccttctatccatcgccgggtcacagactggccacagggtggtcgcaggcacacgtcggtcagcatgcgccgcacgccgtgccacgtcacattgaatgcgacaggggcggttaccgcgccactcataaatgcgcctggcggacggcactcacgcccgctcaaggctcctgcatggccgccacgtggtggctgagcgaggatgtcacgcccagaaattcccgaatagaattccaagcagaatgtgcattaaaatccccgtccaggaccggccggggaacacaaacgacaatgttgacatacagatccacgtcttacaaacatcataaaagtcttacataaatgcagcggaaaacaaaagataacaggagctaagccttgacttgaactgcagcgggaacaccactccacaggcatcctcgacggcacggacgaagcctactcctcggataacccaccatcggacacatactcatactctggggttggggaaaatagagcaagactgagtactatccactgtactcagcaagtcacaccggaataggggtatgatgcagggatttatcaagggatagctgtacaggttcatttgcataattttggcttttataaagagaagtggaatgcgaaaacagttgtaataattagtcaatattaatcatccactatccaacgctacaccacgttgtaacaggcccaaccatccacctgtactatccaatttcattagactaaactaggatgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataactccctctagccaagcacaccacacctcaggtttcacccccgtccctagcgggcgacgggcagtcccctctcatgcctaggtgaatccggaagccgcataggccgtcgcagggcccatccaaactccatcacgcccacccttgcctggatgcgtcagctagagaaaagctacactacaagcccagccattgcccacgctggcttgtggtaagtacgaggaattcttctagggtttcccgagaaccggtccttatttaccatgggtgcgactagcaaaaccatgcacccacagtccaccatgtgattcattttaattaaccaacaccaaagcggtggtactaatccaacattaccattagaacctgcagtctatatttcaatgggatttttcccccaaagtgtgctagttgaactaagcatggctaagcaattcctagtccaaagtctattcatgttataacccaagctaacaaaggagcatggtaccaaaatagcaaggctgtaacaattggtaaacatcccatattattattgcaaaacatatgcagtatttgaaagaaaacattagaacatttgcaatataggatcaacatgatcaagtgacaggcatgacttgccttgctttgctgctggaggaacctcggcgactatctcgaagtacaccggagcgtcggaagagccggaatctaaacgacatacaaggcaaacaatgcaaacaggctataagattactgaaacagagaacaaaaccatttttaatagattctacacatttttcttgttttactgagacttgaatgggcttaaacggagctcggatgaattagttatgaattttagaagattcactgtgtttattactataacaaaaagtccttaaatcatttattgcgcaataaatcccagggctgacgtcatcaaaggggggaggcggcgccgacagacggggcccgcatgtcagcggcgcacgggtggcctgtctaccgtggaccgggaccacgtgggtggtccaccgccggtccacgggatcgacggcccggatcggcccagggccgatcggacggtgcggcggcggcctggcttggctcggctcggcacaaagccagccggccggccatggcaaaggcggcggcgcgcgcgtgttgccggcgacggcaaccggctgcggaggtggcggcgtaaaggcggcggctcgacccggcgcggctaggaaggagagggaggggaatagaggaggagggggtgcctcaccgaaagtggccggtgcggagggagacgacggcgaacagtgacggcgagccacgggaggacggtggcgatgggcggacgagctccaggatgctctaagagaggaaaagagagagattagagggagggaggtgaaccacggcgatcggaagccatggccgaaggcgatggtagaggtggtgctcaccggagtgcgaggggatgcgggttccggcgacggacctcgacggaggaggggcggacggggtggcccttgaccacgcgaacccgacggcggcgacggcgcggtgcggcggcgagcctagcggcggctagcggcggccggagtagcgggagcggcggcggcgggtggatgcacggcgcgggagcgatggagagctcgggagagttcgacaagatggggaaaaagagagggggtggcggtggagcttaaataggggagggggagctcggacgtggccggtaggggcgggattcgccggccgacgtggggagtgtgggaggagagagaggcgggatttgaaattcgaatcccggccatctcgggcgcgggcacgagcgggagagagggggaaatgggtgcgggagacgcggcgcacgaccggggcggtcgacatggcccggaggaggcgggacgtgggcgcggcggcggtttcggcggtggtggcgacgtggggcgggcggacggaggaaggggacgaccccgacaggtggggcccacctgtcggcgtcccggggagagaggggaggcggccggcctgactgggcctcggcctgcggccggcccagtgggggaagggggagagggagagaatggtccggcggcccattcgaaaaaaaagggaaaaaggaaaaagaaaaaggaagaaaaggatttcctggaattaaatattgcttgtgctatttttaattggttaaaattatttagagggctctgaaaattccactaaaaatcttgttagcgtatttcgacatgtagaacttaagaaaacttccacatgccaaatccgattatgatttgcattaatttattagggttttctcttgctttagcaccaatattttctcgggtggattataaattccattttaggcttaggaaagaacttcagggtgtgacaaacctaccccccccttaaacggaatctcggccccgagattcgaggagctggcgaagaggtgcggatgggcagccttcaactcatcttccctttcccaagttgcttcctcctctgaatggtgactccactgaacccgacaaaacctggtgaccttgtttctagtcctcctttcgctggtctcaaggatatgaactggcttctccacgtaggtcagatcctcctggatatcgatgtgctccgaatcggcctgttcttcgggtacccttaagcacttctttaattgggacatgtggaacacgtcatgaatgccgattatattggatggaagctccagctgataagcaacttctccccttcgttccaagattttgtatggtcccacgaagcgtggtgccaacttgcctttcgtctggaaacggtgtactccccggagcggagtaacacgaagttacacataatctcctgcttcgaaagtgagctcccttcggcggttatccgtgtagctcttctgtcgagactgggcaattctcaacctttccctgatggttctgactttctcttctgcttccgttaacacctctgttccaaacagttgacgctcacctgtctgatcccagaagagaggggtgcgacacttccggccgtataaagcttcaaatggtgccatttggagactaacctggtaactattgttgtacgagaattccgcatatggcaggctcttatcccatgctccaccaaagtcaagtgcacaagctcgcagcatatcctccaaaatctgattgaccctctcagtctggccatctgtccgcagatggtaggctgtactgaaatttaaacgggtccccaattctttttgcaatttctgccagaactttgaagtgaattggctccctcgatcagatattatctttctgggtaccccatgcagacacatgatccttcccaggtacaactctgccaatttctttcccgtataggtggtatgcactggtatgaagtgagctaccttagtgagtcggtccacgactacccagattgaatcgtgacccgatgatgtctgcggcagtccagctataaaatccattccaatttcctcccatttccattccgggatttgaagaggttggagtaaacctgctggcctttggtgctctgccttcactcgttggcaaacgtcgcagagtgcgatgaattcagctatttctcttctcatgctgtcccaccaaaacttttctttgaggtcttggtacattttggtgctgcctgggtgaatggaatactgtgtctgatgagcctcggtgagtatcagatccttcaattccttgtcatcaggtacacacaatctttctcccatccaaattgtgccgtgctcatcctcaaggaagtcccgggcttttccaaccctcatattctttttcaattcagctatttcagggtcatttacttgagcggctctaacctgatccacgagcgtaggccgtgcttccagagcggctacgaacccgtgttcaacaattcccactttgagacgctcaagctcctgctgcaattcttcacacatgccctcgatgcatagggcattgcagtagcttttcctgcttagcgcatctgccaccacattggctttacccgggtggtagtgaatgctcatgtcgtagtctttgattagttccaaccatcttcgttgtcggagatttaggtccggttgggtgaagatgtatttcagactcttgtggtctgtatatacttcgcagcggttgccaatcagataatgcctccagatcttcaaagcatgaaccactgctgccaattccaggtcatgagttggataattcccttcatgtggacgcaactatcgcgaggcatatgcaaccatcctgccttcctgcaatagaacacattcaagcccatggcgagatgcgtcgcaatagacttggaagtctttcatctgattgggcaggaccaaaaccggtgcggacactaatttctttttgagctcctcaaaattcttgtcgcactcggctatccatttaaacttctcatctttcttaagcaactgagtcatgggtcgggcaatcctggagaagttttcgatgaatcggcggtaataaccttgaagtccaagaaaactccgaatttgcgacacggtcttaggtggggtccatttggtaactgactccacatttgctggatcaactgccacgccttgagctgtaatcacgtgacccagaaacttgacttccgacaaccagaagtcacacttgctgaatttggcatataactggtgctcctttaacttctcgagtaccagacggagatgttgctcatgttcttcttcggactttgaatagataagtatgtcgtcgatgaataccgcaacaaacttgtcaagaaattccatgaacactttgttcatcagattcatgaagaatacgggtgcgttggtaagtccgaaagacataaccgtgcactcatacagcccgtaccgagtggtgaaggccgtctttggaatatcctcttcccgaattcttagctggtggtagcctgatcacaggtctatcttagaaaacaccttagctcccttcagttgatcaaacaaatcatcgatccgtggtaaaggatatttgttcttgattgtgacctcgttgagtgcgcgataatcgacgcacatcctcttcgtcttatcctttttctccacaaaaatgaccggagcaccccaaggtgaagtacttggtcgaatgtaccttttctgcagttgctcatcaacctgcttcttgacctctgctagttcattggctgccatcctgtatggtctcttgtagattggagcggttcccggtgccaaatcaatccggaactcaatctccctcttgggtggcttggtagtgaggtcttcaggaaacacttctgggtactcgcagactatgggaatctcttccaacttcctcgaattcctctcctcggtgaccactgggatttccacctcaatctgattcaaggagaccccttgttttggtgagactagtgatttgtacactactgtttctcccttctcgttggtcaaggtgactgtgcgattcgcacaatcaatgactcccttgaacttggtcagccaatccatccccagaatgacatctaggtctttggattcaagaagaatgaggttggctagaaatggtgatctttgaatttctattagcactgaagggctaaaactgaccgaggttgaactatttcccggggtatgaaccctcattggtgtactaagctcttctttccttaacccatgcttccccacaaatttctttgaaatgaaagaacgcgttgcaccagaatcaaaaagtacggtagcagggactgagttgacagaaaacgtacccagtacgacctctggtgctgcttgtgcctcctctacagacgcgtggttgacatgagcctagacgaaccttggcccggcacgcttaggcttcgggcatttgtcagcgaagtggccaagctcaccacagttgaagcaggaccctggctttgctccagtctccttcttggcttgcgcggatggagctgactgtgctggttgcattggtgggcgtggagctgcaccgcggttgggctgacctccatggtggttctggctgctactggcaccctgatggaagttgctggcattgaaagggcggtgctggcggacgatcatggtggtaggtccaccctgttgtccgggagtgaagcgcggtcgctggtggctcccttggttggaccagaactgcgccaccttcctcttcctgtccattttattgcgctgatcctcctgacggattgccttgtcaaccagcctctcaaagtcggtgtagcctcccgatatcagctggttggttagctcgtcatccagacctgccaggaacttttcctgcttctctgcgtcagttcggacatcctccggtgcatatcgcgcgaggcgattgaactcatggagatactccgtcactgtcctgttgccctggtggagtgcccggaattccctcttcttttgtgccacgaccccatctggcacctgcgccttcctgaagctgcgacagaactccgcccaagtgacttccatgcctggcggacgtatggccatgtgattgtcccaccaagctgacacgggaccttggagctggcgaaagcgaccttctcctgatcattacactgcaggagattcagcttcttttctatagcatggagccagtcattcgcctccatggggttggtggtgctggagaaagtgggtggcctgacgcgtagaaactccggcagtttggactgagggggagggggaccaaactgctgctgatgctgttcggcgtgctactgcatcctctggtgcatctgctggtgctggtgctgcatctgctgcatcatggctgccatcatctgagtctgatgtgccattacttgggctagcgtcggattctcggggagtagtgggggaccattgccggaatcactgttgggatgcacaccatcagtgcgctcttcgccgttgctgccctcgcctgttgtgcgggtgccattccaggtgtagaccatctggaggaagagcagacggggaaacggagaaaaacagatactcaggaactaagctttattatatagaaatttaaactgcaattgttctgatctgatttaaaacacttaaacagcaagcaacaatccttattaagacagccatatcataggaacatgatatcgaccgtcgactgacccacaagcgagcaacctaaacacgcaaactaacaagcaaaagctaaacagtcgataaactaatggaaagcgagcctaatgctcggaacggctcctgcggtcggtggagtcgaaggcgtcgtcctgctcgtcaccaggtccctctgagcgactcctggagcctggcagatatgtctcgccgctgcccggctctgagccactggagctactgctgccgcggtcgtggctgccattgggagtagcaggcaaccaacccccattgccactggcggggcccctgacggctgatgctggcgtgaaggagagagcggatgcaggagctgacacgggaacaggagctggaactggcgctggagctgcaggagctgcgggaactactggcggaggtgggttcctgggcgcaagctggatgcgcacgggtgccgttgtcgacttgcggggcgtagtgcggatccggactcctcctggcgcgggtagaccctttaattgagcattctcctccagccggggaacacaaacgacaatgttgacatacagatccacgtcttacaaacatcataaaagtcttacataaatgcagcggaaaacgaaagataacaggagctaagccttgacttgaactgcagcgggaacaccactccacaggcatcctcgacggcacagacgaagcctactcctcggagaacccaccatcggacacatactcatactctggggttggggaaaatagagcaagactgagtactatccattgtactcagcaagtca

SEQ ID NO: 66381 - DNA, 8602 bp, Oryza sativa
  unsure (1)..(8602): unsure at all n locations
cgtggcccnnnggtgggatcaactgactggacagcagcncatcataagatctggtcgtataagagttctcgccgtgcgtattaaccaagccgtgtaatcggaaattgagttttccaacttcacagctgggggctaggatcagtgcttgttcaaccaaggcaggtcaagggtccaagagccttgtcctccgagaacgattctccgacgacaaggctgggggctagggagagtgtatgactctacaaactgactgatcaaagtcggtaagagagaagacgctcatatataaaacattggtcggtaaatttaattcatttttagttttccatacaaattataacatgtcaccatttgagcgtttgctcgggggctatttctatttgatattcttttctgagtattgatttctggaaaattctattcgacattgtggaaaactccatgtctctatggttctacaccaagatcgactaaggcgagtacgacaaatgttgacaaggctccgtcgcagactctacgccttctcgatcgctcgagaacggttgctggatctcgacaaggaatacggaataaagagatggtgtacccgccgagataaaactttttgacttcaatccaaattctcgattacagcaagacgggagacttagtcgtatgttatgtactttcttggttgacgtcggagattgactcaagacaaaccctttaggtgcccgcacgaggctgataaaggaagtctaacgttatctctgaactcaccgagaacggtcacttgagctcgataacagttactccatggtcagcggtcgagaatatgaattcgttcatttgcattgaagtcgggggctactgtcatggttatggataccacatacctaatagtagtcgactaaatctcggcaggacccaccacataccatgtcttatacggaaactgacttcggatataaagggagttccggataaggaaagacaaccagtgttctacatggaaacgacaaggactgctcggattatatacatattgcttttcctagttctacttggacaagggaacacctatgggaataaatacaaggccccctaggaggagaggggacacggacaatcgacgaccacctcaatcaacacccaccacaatctacggaataatagatcaagacacaagatcaacatacaagccaacatacgccaagacaagacgccggatatcgacttcagggataagcacgactagtcccctacggtgtctctggatactgtcaggagagacggaagcgctatctctgatctcgccgggcacggattcgagaaggaagactaccctgttgtcgactacgagtcagaacttcagaccgccatgtcgacaacagttagataggctaccccaaatattgtactggtgtgattatggtgaataaagagcaacgaccggtttcggccaacaggatgttgggttattacctgataattcagggacccgaacctatataaaaatctctatctccgtctcgtttacctcagtctcgcatatatcctactaacaacgatcctcatactatgtaaataccagaaccgcgacatcaaacgtcgacagtattattgctagctttctctctgtttttttttgataagctatattatctcaaaagtttctagccttctatcttgtacatagttgatctaagaaataggttacatcgaagtctataaatttaaaatggattggtgactggattatttctgtggattacatatttcattatagggataaattagatatttttagaaaataataaaataatgaaataagtggtcttactatacaatggaataagttttttttgggaaatgtatttttgagcaactaattaattgaatgatttagtaaataagctgacaacatggcagtcaagccgtctaactacctagcaaatcaattaatcctcgctcggcgagtgtgtaacacattactccctccctccattctaaattgatctacatatttcataggtacaccaaaaccaagaaaaactaataactctctcatactatatttactctaaaaacaagctcgatgcatacaccatcccattattttctattcaatagcaaatcaagatattgcatgtgggttataaatacttgtgtgcatggatacatgtatcaatgtccatttactccaatattaatgcacaaatactccaacgaataggcttaatgaatgcacataaatataatgataatttaggaataacctaaaaaactatatatagatcaatttaaaataaagggagtatcttagaaaatttccacggcaaacactaattagctaggtttccatcaagctaattagcgagggtgtaacacattatcttcatgaccatcttccgaattttggccatgctctatgatcagctgccatcgcatgcatgcatgcctcgatctggcggtgatctcagtaaccgaatgcttatcggagtcaacatatcgcacatggccctgcttagtaattaagatgcagatcatcagtgagccttaagcccttaattagcacaattttattaaatcattgagtgtattattatggcacgcgtggtataattagcaaacagctagctaacagcccacatttcaaaaagtcaatgtatgaaccttaacaacgctgctatacgtccgaccagcgtacgactcaacggcgaaatacacggcgcaagcccaattgaattagcgatcgttgcagaagttacggacggcggacggccaatgacgtagtcgtgcgctggtcgtacgcgtcggttggacgtatagcattttcggaaccttaattactccctccgtttcacaatgtaagtcattctaacattttccatatttatattgatgttgatgaatctagacatatatatctatctagattcattagcaccaatataaatatggaaaaaactaaaatgacttacattgtgaaacggacaaatagtttttttgttccaaaatcgtgagagcaaaaggatcacggatggattcgcgacatgtgctgggaacagggcatttccggattagtcgtgcagataagctgatccgagcactttccatttgtattaaatttgctcgctcatagtactgctgatgtgatgcaaagattatcttagtctaattttgttgcaccttcttctttaggtacaacgtataataatgatcagaacgcgtgacatgcatgtacgtgctggttattactcccttcgtttcaaaatatttgacaccgttgactttttttaagtacgtgtttgaccattcgtcttattaaaaaaatttaagtaattatttattcttttcatatcatttgctttattgttaaatatactttcatgtacacatataggtttacatatttcacaaaaatttttgaataagacgaacggtcaaacatgtgctaaaaagttaacagtgtcaaatattttgaaacggagggagtacgtgacagtacgccaatgtctgcagttaatcaggactcaggagcatccatgcatgcatgtttccaggatatcaatacgagcccactacacctccaattataattaagttggcataggtaatttggacagctagctagcgcgtcttcgtgcgtaccaattagaacaggctataaatgtaagccctcagtttcattcacatttcaccactcctccggtgacagtgagtgagccgagggttttcgatatctggataggagcagactcatcgctaaatgtcttacccgactattcaaaacaccggagtacgtgggtccgtgacgctgacgctgtgaactagctagccatggccatggctgcttcttcttcttcctcctggtgcgcactgaaacagtcatgcgtggccctcctgatggctttggcttgctgcctaactacgtgcgcgcgcggcgcagtcgaggcgctgtacgtgctgggcgactcgcaggcggacgtagggaacaacaactacctgccggcgtcgctgctcaaggccaactaccctcacaatggcgtcgactacccggggggcaagcccaccggcaggttcagcaatggctacaacttcgtcgacttactcggtgagtgtatatctcaaggccattcattagctagttaattatagtacgtttattagtaatatatatattgagtcaaaaatatattttgatagctgatatttttgggataatcgatctaacattcaacgcaaaaatccctctaaaaatatatcaaatataactccgataaatatatatatatataattatggtgtaattataatataattcgcatgtacttacgtccctaaaaaattcaaaagttgtgctggcttagtgggggctgcctgcggttgtcagtttgaccctcacctcgcgcaatgtcctctgatttttacccaatacaacatgcatagatcgtatagcccattcggtggctgaaaatttgatacgatttttaccaattttttttgtcgaatgtgaaataactaggctgtaaactttttggtgtattcggatgcaccaacactctagctcacccatagacatccaggcggttgctataaaaatagcaaggcactattattccccgggtgagggcgttcacactgcatcaccgtgacgttcagccctcgagacgccaacagagatttggactgccacgttctcgccactgctgcgctcctgcgaggaacgtgctaccaaactatgacgcgcgaacctcgtgttaggtgaggccgcgtgatgggcggagcgacgggatagagtctgcattggacctgcgatgctgtccggcccccacacggcacacccccactcccacaagccaccgcgggtacctcacccaactccggtaagagaacaaaaggggcagcaacagcgagatgggggaagaggggcctacctttccagccgccgctaaccggagaaagaagagaagacaaaagatggaggagaggcacatagccttgcaggcctcgtcggcacgagccgccgccggattccgaggggcgaagctcagcagcggcgtaggcccaagccaccgtggggacctcgtagcccgtgcactacgccactaccccgatctggtcggcggtcaccccgatctactcatcgccacaggtgtcggcgatggggaggggagggagaggtgtcgtcaacagggagggaggggagaagaaccggtgatggagagggaagggagaggtgccatcttgttaatagagaaatagaaagggctaaaatagaaaatatgaggggctaaaacaaaaaaacgaagccacacatagagacccatgcattgtgggagacaattttttttaaggtgtggttttagcccatggcacgtgaggcaggccaaattcttctggcacactgtgaacgccctgagcatacggtatgatcattataaatgatctcttgtgtcagtgcctgcatgtatgtactactttcgcaagatctataattcttagagcatgatcaataataaggtaatttagctccaattatgtccaactcatctataacttactttgcagcttgtacacgcaacatctagttgtattgttgggtcctatatgcttcacatcactattaaaaaattgcagcatcgatcctatgttgcaatttttgcatagcagcatttctctcactctctcacgtccaacgtttttatctagagatgcgtgttgcagcccgatgataaaattgtcgtccgctcgcgccagctcatgcatgttctctctctttagctcttttccctatatcaccattgctatctacgtggacttagtgtcgcctgactaatgtacctgctcttaagaaaactacgaagacccttgctcttaagcaaaccatgcatggttaggcaccgtaaaacttcgccaccgctaatcgattaacttcgccaccgcgcagagcgcttgcttggctagagccaaacaaaatagggaagttctaaattaaataacatgccgaaagtaaaggggaatcagaggaaaaattaactatgtgtagtatagcttcaatagggcaggctagctagtagcttagcttcagcatacacatgcatgcacacccgctgtgaacgaaggagcgagcgagcgacgatgggttcttgcacattgtcctccggcggcgtctgcgtcgtcgtcgtcctcctgtgtttggctgcttgctgcctaacgtgcgcgcgcggcgctgtcccggcgatctacgtgctcggagactcgcaggcagacgtagggaacaacaactacctgctgcactcgctgctcaaggccaacttccctcacaatggcatcgactacccggggggaaagcccaccggcaggttcagcaatggctacaacttcgtcgatttaatcggtgagtatatatccatcatcatcgatcgatcgctgcgtaaggctagctagctagatagggagtatgaatgtatgatcgatcgattgggagattggaggcacaacgttaacgtatgttgttgtcttgcgtgtgtatgcggtgtttgactgtttggtgtgttcggagaagacagcatgtcaactggcaatagcaaaagcgatggagatatatgatagttcgacgtccaaacgaccgagcgtatatggagtgggacttgacgggattttatttggcttggcgcgtacgtatacctccgcctctctttatctcttgggatacgtgttcacatatatactgccaatcctggacggcgatatgtatacgagcttgtgtgaaacaaattaaatcgctgtagttttttccaaacaccactacgcacggacactgatgccgcatattctattgtagtatatagtaatttgctagaacgcaatatgaccattattaatttaatttaacatttctatttcaatttggcatctaaaatttttacaaatgacgtttttacccctacgacaagttgcatgcatgctccatttgagtaaatttttgtcccaaaattcaaaaataaaaaatattttggaaaatttatgaatttcaaaaaattgaacatgaaaaattgaatgatattaatctaaattttaacagatttgcaaatttcgaaacttttcttcccaaattgcgaaaaaaaggtatttttgcggaccaacagaatggaatatttccaaatttaaaaaaactcaataaaatttttatttgacgagatattgaatgaatttaaacattttcttgaaattccaaaaaaaaaatttaaaagaaaaattttgatggagtattacaaaaaacaaccccttcacaattattactaagtcaagaaaactgaatgaacggaatgttatttactttttggacttgtagtagttgaattagtttcttatatcaagatgaccttagagtagaaaaaattaatggtatttgtacatatttattaatttccatgcatgcagattacaaatcactaattttaaatatgaatcagtttgtttatgaatatataaaagtaatatttctaaacttacgtttacatatgcttcccaaggaaatttctaaaaatattagttatgaaaaatgtagatttaggtgtttctgcaactattcaccctgctctggttattatagatttaagagttttagtcctacaatttaatgtggcattatctgacctatagaattaattgtcacagaaaaatacttttggattatttttattttgtagaaaatattatttttattaagcatctgacctttgcatagattatatgcatatagtaaagaaacattgcattattattgagcctgaaaaactcttatcttgcaatttcatccatctcgatcaatatgtctctaggtccatttcatagttgtgactgaatatttttctattaatttggtataacaaataaagatattataacggtggtggaacaaaactactttaacattctactccatccatccctttcaaattataatgcgctttgattttttctagattaagcttctttaaatttaatcaaaattatagagaagtacatcagatcaattaagaatgattatgtctacgcgcgaccacgcgaaaggaatcaaagatactagcatgtgaagcaccaaactgctagctgcattccgaacaggaggaagggggaaacagctagaataatgcaccgctgtactgtgttgccgatcgagcaaaggaaaacgatatgcgcccgcgcgagacggagaacatataaaaggcgcagctaaatcaggagccacactgttatgatctctattgctaagcttgcactatgcgcaaccttttccatgtaaaaggcgcagctaaatcaaatcgccgacgcgcgatcgatcgatggagacgtgacgtgcctgtctcgcggttcggtggtcctatatgctatatactcactccgtcccaaaataaatcagcttctaaaatttaaaatcaaaataaatcaacttttactcttttacctaccattagtttgcaaatctaaaaattttatttctttcataccctttacctacctattcatcgatataacttcacaattaattagagatatcttgatcattcatatctctgatgggnggtgtnccatcagtagtctacctgcgcag

SEQ ID NO: 66382 - DNA, 16259 bp, Oryza sativa
agttcaaaaagcagcaaaaaatgattttttttgacatattggagtgtattgggtgcatccgtatcgaaaaatcactccatgactcgcgcggcaaacttttgtcagttaatgccaatattgtcctatatgggcacacgtgggtgcgatgtttttcaccggaatgaaaaacttcaaaaagcaccaaacttgattttttgacatattggagtgtattgggtgcgtccgtgtcgaaaaatcactccgtgactcgcgtggcgaacttttgttaattaacgccaatactgtcctatattggcacacgttggtgcgatgtttttcaccggaattaaaaagttcaaaaagcagcaaaacatgattttttgacatattggagtgtattggcttcgtccgtgtcaaaaaatcactacgtgactcgcgcggtgaacttttgtcaattaatgccaatattggcatatattgacacacgtggatgcgttgtttttgaccggaatgaataagttcaaaagcaccaaaacatgatttttggacatatttgagtgtattgggtgcgtccgtgtcgataaatcactccgtgattcgcgcggcgaacttttgtcaattaatgccaatattgtcctgtattggcacaggtgggtgtgatgtttttgacgggaatgaaaatgttcaaaaagcaccaaaacatgatttttggatatattggagtgtattgggtgcgttcgtggcaaaacaatcacttcgtgattcgcgcgccaatattggcaaacttgggtgcgatgtttttgaccagaatgaaaaagttcataaagcaccaaaacatgatttttggacatattggagtatatcgggtgcgttcgtggcaaaaacatcacttcgtgattcgcgcaccaatattggcacacgtgggtgcgatgtttttgaccagaataaaaagttcaaaaatcatcaaaacatgattttgggacatatttgagtgtattggttgcgtgattttgggaaatattcgaaaaatcactctgtgactcgtgcggcgaacttttgtcaattaatgccaatattgtcctagattggcccacgtgggtgcgatgtttttgaccggaatgaaaaattcaaaaagcaccaaaatatgattttaggaaatattggagcgtattgggtgcgttcgttgcataaaatcactctgtgactcgcgcgacgaacttttgtcaattaatgtcaatattcgcctatattggcacacgtgggtgcgatgttttcgaccgaaagacaaagttcgaaaatcaccgaatcaagatttttggacatattggagtgtattgggtgcgttggtggcgaaaaaaaacttcgtgattcgcgtggcgaacttttgtcaattaatgccaaaattggcacatgtgggtgtgatgtttttcactggaatgaaaaagttaaaaaagcacccaaacatgagttttggacatattggagtgtgttgggtgcgtgcgtgtcgaaaaaccactccgggactcacacggcgatcttttgtcaactaatgccaatattgtcctgcattagctgtaacaccctgaaaattcaagacaagaaaaatcactaaaattttgaactttttaaaacttttgcatcatgttggatgttgtggttgcttttacttgccgagctataaattgtcacaatggaaaatttaactaaagttatacaactgagtaataattataacaataagatatttatcatgaaccctataaatatttacgcacaagaaagcaaagtcagacaaaaggaaggttaattactaatttaacttatggatcaaatattaaataccgaaccatgtgatgcgtgccatgaaatataaacacttaggaaattataatcgttcagatcaatggaactctatctatagaatagatttactgggaaaaattaatctgatattatataatttgaattgaatcacgaatgctaaattatagaaatccatgtggtggtaaaaaccaatcaaaaagataaaccaatatgtgtgaaaacggataaataccaaaatcccaaatataggaaaacaggaaaaattagaaaaatacataataaaaataaaatgtgggcaatattaagtttgaatacaaatttacatttgaataacttagattttgtgtgaaacacattgtgacaaaataggtggcaatagtccattttctaaattagaaaaacatctaataaaatccaataaatcagttaacactgttcattgccccctaggtgcttgaccctgtcccatcgccgcgcctagccctgcccctactctgccgcgccacgcctagccctgctgcgccactgccttgtgccccgcgccgccgcacgccgtcatgtcgccgtcgccccgacgcgctgtgcgccatcggttcgcactgcgcgcgccgctgccgtgccccctcgcgtcccgtcgtgccgcgcgccgtcgccgtcgttggtcgcatcgtctcgagccccactcctccgcgcgtgccttcaccgtcgcgtcatcatcatcgtcgcgtgtcgccatcacctcgagccccgcgccgctcgtgtcgccgtcgcccgtgccgcgccgagccccgcgccgctgccgcgccgtcgtcgtcgcccgtcgcgtcgcccttgagccccgcgcccccataccaccgagtcatgcgcgtgcgccgcacgaacgtcgcgtcaccgtggttgtcgtgctgccatcgccatcgcgccgatgcatcgccgcctgtcgccctcgcgactgcgcaccaccgcatcgcccatcccgtcgccgtgcatccgttgccgcgccccctcgcgtcccgtcgcgccacgcgccgtcgctgtcgccgttgcgtcggctccactgccgcaccgcgcgccatcgccatcagcgcctcgagacccacacgcgctgcgcactgtcgctgtcatcattaggcaccgcccaacccctccgcctatataaacccccccgggcgcccattgcttcccacaccaccctcaccacctcccctccctttcccctctctttcccgtccccggcatcgccgcctctttggaagccaccgccgccgctgagccgacatgccccgccgccgcgctgtgcctcgtcgccacgccgtgctccaacgtcgacccctccgctgcgtctccgttgaccccgccgtcagtccggtgagccttcccctcccccaccgcttgacgtcgcgccgcgccgcccgccggttccagccgagccgcgagagagagaggaagcaaagaggttgcgcagagagagagaagagaaaggagaggagagaggttagagtgggccccacgtgattagtaaatagtaatccccttcttaatctttataagttaagtctattacatgtgggtccgagtggttaaaaatctagttatggagggtttataattttgagtctatgacaagcgggccctaccaggtttaatggccggtttgaccctagtcaaaggagtcgggcccacctgtcatttgcccatatggattcctttagaaagaaaaataaaataaaagaaaagaaaataggaagaccgcacctgtcaggcactatagcttgtggataaggttgtattaaaaataaatgaattaggaacagtacaatttcgcaattattagatttaattcaaatttgaatctttacactagcataacttattcattttagctccgatttgagtgaaacttgaatctaaattcatctaaattcataagctttccaatggtatataattcactatttgataaaatatatttataattattaaataattaatatcaagatgatgcataatagttaacttaaaaatgtgccaataaataaaattgatattgtactgtaaagtagatgtcaaataattgtctttaacacgctttctcactgtaaaacctatgtaaactaatgaggagcattgtttcaaattaattaaagcataggaaatactagtgccatttgttaatatatgtcaatatataattatactcatgacgtccaaattgtataaataatgtttagcctcatactttgtgactaaaattttaacacacgtagatgagtctttaacttatttatgagagataataacagagctagtgtgactaaaatcacccgcacgaaattaattaacggcatttcctatacagtagtatatgtttaggttggaaatcgacccttaagttgtatagacggtaactcactcataaatccacttaaaatcacatgtactgtgtagcttgtagtaaatagcaactattcaaataaatgattcaatattaagatattgtgcacacacctatactgtacatcccattatagctatacggtataatattaatttgcttgttgcatatattaaattagagggactatatgacaaacatgaatattagataaatactagttataaatcttgacctcatataattatagttcaattgtaaattaggattattcattgtaaaattatgtgatgggataatctgtaaccataatatgattatcctaaacaactctaacatacaaagcatggataattattaaccttttataatttattgtgacaagtaaaatattttcataattaaagaaaagcctccatcaataaaataataatacaaatggttccctgtgattaattgcttgatcccaaatccatccgacgacaacagaacctctagtatatatatgaccattttatttagatagatgcatgtgtagccataatccttccatagccattagctagactaaaccacatattagccaaatgtgtatctcatttatactatgtcggctagctccccataaaccaccatgacaacagaaagattaagaaactttagcccttagcatgattggaatcccctagcaaacaataatagtacgagcaaccctaggtacgaccaacaagtacattttgttgtgcatatttgattgttgtttgaatattggtttttctcgtgtattgtagacattgtatatcggttagtcgtgaggcaatgtatgcaacttctaggaggtgaaggttgatcaagattgtatcaagaataaggactatcctgagcaggcaagtcatcactattccttgaacatgttgatcccaattgcaaaattgttttgtttacaaataaaattgcaagcaatgataaacatcctacttgtgattacgccatgccttgattattgtttacccttaaaatccttgtaaccacgattacgtatgagtccctagtcaattatgacaattgcttagaaatgctattctagaatcatgcatactcatatttatcaaatgctatatgcttgggcaattacctttgggaaggtaattgagatgcggcatgtggagacatgagcaccacattgccatgatattgatgacatgatttgtgaaaggagaaataaaactaaacaacagttttcgactggggcggacggaggatttgggtggtatcttgaaaaggctagtaccgtcccctgtcaattaaggactgagccatgaagttaagcttgaaacgacccccgtacaaccgtacttctcgaatgggtatagacctagcggattagatagccgagtggaggcagtatcccttcatagatggttcacccctgagtgaggcaggtgcggtacggtggggcagccgttgaggtagggccgcaaggcgtgccctacatcagtgtcgccatttgtaggactaccatgagagtgtgagagagaacttaatgtgtgtgtgagacttcttccccgggagcgccagaactcctctcactgctagaaacatggatgcctgagtgcatgaggaagtaagttcgtggagcgggtactgccaatgcgaggttatcgaaaggctttgccgtgacgcgtctcatgtgttgggacgaggctcatgtgttgggcagtcgctgagtgcgggtaaagtgtacatccactgcagtgtgagtaaaccaaatctattcgaatagccgtgctcgcggttattgagcaccgggacgtgtattacacttggctagactctaaattcttaacttgtgtgggatgggatattgcataatgatttttatgctgatggagccacttcctgagaagagtgaaggtggtcgtcctcagaaaaccatgacgactcaatggcgggaagctatccttgggatcacaatggatggtagacagaaccgtcgttgtttaatgagaacattggtactaaaatttgatcagtctatgctagatcttaggcttgtgaaaagatttgcaaaacttgctttacgcaaaagaacctgaagccgttccttgaaataccctctatcatatgcattgttgctgtggtggcttgctgagtacggttggtactcacccttgctatttatatatcttttaggagagtgttaaagagaatcccttgtcggtacgcttgcgtatccaacaagatgattggagtgcggtcttgttctaggtctcgttccccagtcgactacctgtagcatgttaaccgggcccttatattattttgtcttccgttgttgttctctgatatttgttggcctacttggccctaattgttaacaaccaaatttggtaacctcagtatcggaaatgaagattggatcgaaacagaatcaaatacgagtatcatttcggaaacagagcaagaatcggatggagtccaaatcggctatgaccagatcggctgagtccgaatcagatagggttagccgatacagccgattccggcaatatgacttggtttacatcatcaggctgagttaatgtgcttcgtgtggattgccacacatggatagagtcctaagaaggcaattgtatctattaattaggatattttatgtaatttccttagagataagtgtgggcaaaagtctgccgcaaagacttatggtatcttagaatttgttagagataagagtcgtgtccgacaaggacatattttgtaatcttgggtataactagaccccgagccccatgtaataaggaagacagacgttcaaatacaatctcggcgcatcgcccatcgccacccttttgctttcgttttatttcgacgagttcttgctttcgagttgagctgcatcggtttcgatcttcaactagaggtatgacttgctatggcagcttgcgttctcgggattagtgcttccatcattatgatactctaatcttgtctatgtaagttgtcgagttatcatatatcctatataatctctgacaatatcgctttctaacctccaattggctaatatctatcgctagggagcagccgattaggttaaatatcgatgttggcttagattatataagatattcaccactctatgaagctcccaatagcttgattgtctagatattgtatttcttttcgtacttatggctgcatcagttgagtttgatctgatgagtcatgcttagaactataatctcgagcctgcttcttggttgtcgattagagtagtatcggggtttcagccgatcttaactgatttagctctatatttatttcatgtgctcaagtgaaacgatagatctgccctttatattaagatcttattgcttttagatatgttaagcttcttgtttgatatattttactcgctttaatatcttagtttagagtggtatcggagtattagctgatacatgctagatctatcttatcggctatgctgtgaacatatataatctcattattaatataagtttagatctaagtgatttatactatctcggcatggcgaccgatctatcccaatcacttgatttaagtatatattgacataaggattatatattgttaatgactacagccgatcgaatagatttagaccttccttatttattcatgactgtcgatcgatgcaaagatgacatgggcccaaagataaatgatacgtcatcggcgattggccgatcggctatcatttatggattaactacggtttctttgtctttatttcttgttgattacaggatcaaatcaactggcacactcacgaacctaaaaaggtgagattttggaccttcactggagttaagcagatctcccaggccggtgtgttcgattttttcgtcaacacgctcttggcacgcccggtgggacccgagttttcaacgacttcatcacgatggctgaaaaaccaccaccgtcaccggggacaggagtcaaacctcctgtaaataaaacaggagccaaaaatccatcagctgaagtggacccaaccaacattgttccaatcatattggataggctgacggctgagtagagggatgaacttgaacagatgatgagcaacgtgaagagcaagttcatggattcttttcaggatcgcagaggaaccattgtacagaagtacaagctgaaggtggttgcagccgatgaggtcggcttgagttcatctcagggtgacaaaggtactacaactggctcaggtgataaaagtggcgttcctcaagatggtgcagttgaagaccttggtatagatggcaaccaagagccgttgcagttcaataattttcaagataggatcgactatgccgtgcaacatgccttgatgaatcaatctggagtattagttaataccttaaccaacatggtgaaaactgttgttgatggttcgatagccgagcaccaagcctcaggtccagtctatctaccaggaggtgtttttgccaaattatagatctgtggttacggcaaatcagcagaatacctctaatacactgccggctcggccgacggctccagctactgcacaagctacatcgtcagcaccaagacagatggttaacaccagattgttgaccagggaacaaccacaacatcttgggaaaaatgccaatcggctgactcaggagcaagttgctgcaacgtttttgccaaatccatcgatagccgatccaacacagccgttgccgacccagcaagcacaaccgagacagcagacggttcagccgactcagcatcagaatttgcagcatgcatcggcaaggttaagaacacctgacaatcggccagtacagcatacagtaaaccaagtgattcctgaacacttggtccatcacgtataggccgatcaatcagttgtgcctcaaattatacctgaacatttggtgcataatatttagccgaatcttcagaactatcaaggaggaaatctaggttatcaatatcagcctccgtcacctcatgttcagtatcagcagacagggtcgccccagcctcagtacgctcctcaattcaatcagtttgagccgatgcaacaacaaatgcaaggagtacctcagcatgcgtcattggctgatatgatcgcagatgtaatgagtgaacagtttgggctcaaaccaaaagacaatggaaatttgtatcggcatccttatcctgagtggtttgagagggttcaattgcctagccaatacaaagtacctgacttctccaaattctcagggcaggataatgtttcaacttatgaacatgtcagccgattcatagctcaatgtggtgtggcatcggctacaaatgccttgagagttagattgtttcctttatctctgtcaggatcagcatttacatggttttcttccttgacatataattctgttaatagttgggccgatttggaaaagcagtttcatagttatttttacagtggagttcacgagatgaaactgtccgatttgacagcaattaaacaaaggcacgatgagtctgtgcaagattacattcaaagatttagggagatgagaaacatgtgttacagtttatctttgacagattctcagctagccgatttggcttttcaggggttgatagcaccaatcaaagaaaagttttcggctcaagattttgagagtttgtcacatcttgcacaaaaggtgactctacatgagcaaaggtttattgaggccaagaagaacttcaagaaaatcaatcatgtatatccttacatgtatgattctgatgatgaggatgatgattccgaagtagcagcaaccgaatgggtcaagagcaagaaagtcataccatgccaatgggtgaggagctctggaaaagaggaaagatttgacttcgacatcactaaggctgacaagatttttgatttattacttcgggaaaaacagattcaacttcctgctggtcatcagccgaagagttaggcaaaagaaggtattgcaagtggcataattctggttctcattctaccaacgattgcaaagtgtttcggcagcagatccaggcggccatcaaggggggaaagatcaaatttgatgattcaaagaagctgatgaaggttgatggtaatcccttccctgttaatatggtgcatacgtctggaaggacagccgatggtgggaagaacagaaattttcagatgaattcggctaggattatcaacaagtaccaaagaaagtatgataaacagtaggagaaatatcatgaaagagatggtggttttgatcctcattggaattgtgaatttttaagattctgttggaatgaaggtatgaggctaccatcgattgaggattgccctggatgcaatgaagatgcagggaattcaagccgatccaataatagaggtaatcggctgagccagaagagagtatctgttcatcagaggttgggcccggtcaatcaagatggtgattatgatgaagatgaagataggaagacacaatggtgtcctacaggcattttcaccaagaatcagaagagaagggtgcaaaggttgaggaacagggagcgttttcaggaggtgcagcaagaaattaatcatcggctagggaaaacaaaaaccaggcaagaatggcgtgttaagcgcataattacaacagccgatgaagttgaggccgacaaagcaaaaagggtgctcaagggtaaggctgttgcatctgcatcggtgaacatggttttcatgctgccagccgaatttgaagccaagcaagtcgaagttattgacgttgaagaggcttcggctaagttagttttgtcaccagagcaagcaatctttgagaaaccggaagggacacaaaatcggcatctcaagccattgtatatcaatgggtttgtcaatgggaagctgatgtctaagatgattgttgatggaggagctgctgtgaatttgatgccatatgctacattcaggaagttgggcagaaatccacatgatctaatcaagaccaacatggttctcaaggattttggtggcaatccatcagagaccaaaggagttttgaatgtagagctaacagtcggcagtaaaactgttcctacaacgttttttgtcatcgatgggaagggttcctatagcctgttgctcggaagggattggattcatgctacttgttgtattccttcaaccatgcatcggtgcttgattcaatggcagggtgacaagattgagatcgtgccagctgacaggtcagttaacgttgctagtgctgatttagctatttgggagatggatggtattgattgcttgtctggaaaagtttgggaacagtcgattgaagatcgagagcccaaattattattttgagggcgttgtggagggttcaaacgtctacaacaaggacacggtagatgatctcgatgacaaacaaggacaaggtttcatgtcggccgatgatttggaagaaattgacataggtccaggagatcgaccatggccgacatttatcagtaaaaacttatcttcagaatttagaaccaagttgatagagcttttaaaagagtacagggattgctttgcttgggaatattatgagatgccaggactcagtcgatcgattgttgaacatcagcttcctattaagcctgggattcggccatactagcagccaccaaggaggtgtaaagccgatatgcttgaagctattaaggctgaggtaaagcatttgtatgatgctggttttattcgtccatgccgatatgctgaatgggtttcaaatatagttccagtcatcaagaagaatagcaaagttagggtgtgcattgattttcgaaatctaaacaaggctacgccaaaggacgagtacccaatgccaatagtcgatcagttggttgatgctgcttcaggatataagattttgagttttatggatggcaatgcaggttacaatcaaatttttatggccgaagaagacattcataagacagcttttagatgtcctggtgcaatcggcttgtttgagtgggttgtgatgactttccgcttgaaaagtgctagggccacatatcaaagagccatgaatcggctggttggttgaagtttatattgatgatgtggttgtcaagtcaaaggaaatagaagaccacatagccgatttgagaaaagttttaagagaactcgaaagtatggcttgaagatgaacccgacaaaatgtgcttttggcgtatcggctggccagtttttgggatttcttgttcatgagagggggattgaagtgactcaaaggggcattaatgcaattcagaagattcaacctctagaggacaagacaaagttgcaggagctgatcggcaaggtaaattttgttaggagatttatatctaatttgtttggaagattagagccttttacacctttgttgagattgaaagctgatcaggagttcacttggggggcagaacaacagaaagctttggataatattaagaaatattttagttccccaccagttttaatttctccacaaaaaggaatacctttcagattgtacctatcggctggtgataagtcgatcggctcagtgttgattcaggagcttgaaggaaaagaaagggctatattttacttaagtcacagactattggatgcagagacaaggtattctccagtggaaaagttgtgcttatgtttgtatttttcttgcaccaagttaaggcattatctattgtccaatgaatgcactgtgatatgtaaagccgatatagtcaaatacatgttgtcggctccaattttgaaaggaagggttggaaagtggattttttctatagctgattaagggacaagctatagctgattttattgtggatcatcgtgatgactcaatcggttcagttgatattgtgccgtggactttattttttgatggatcagtgtgcactcatgattgtggtatccgcttggttatcatttcacctcgggggccaagtttcgagtttgcctatactattaagccctatgcaactaataatcaagctgaatatgaggcagttctcaaggggttgcaattgttgagagaagttgaagccgatgctatcgaaattatgggtgattccttactggttattagtcaattggcaggagaatatgaatgcaagaacgctacgttgatggtctataatgagaagtgccgaaggttaatggaaggatttcggctaataactttgaagcatgttcctcacgagaagaatatagaagctaatgatttggctcaaggggcatcaggatataagccgatgtggaaggatgttgagatcggagttgctacgatcacagccgatgattggagatatgatttgtttcaatatttgcacaatccatctcagtcggcttcgcggaaagtacgttataaggccttacaatacacctggttggataatgaactatattattggacgatcgatggggtgttgcttaagtgtttgagcgttgatcaagcaaaagttgcgataggtgaagtacatgaagggatttatggtactcatcaatcggctcacaagatgaagtggttgcttcggcgtgcaggatatttttggccgacaatgttggaagattgcttcaaatactataaaggatgccaagattgtcaaaagtttggggcaattcagagagcaccagcatcggctatgaatcctattatcaagccatggctgtttagaggatggggtatggacatgatcggccagattaatccatcttcaagtaagggacatacgtttatattggttgcgactgattatttcaccaagtgggtagaggctattcctttgaaaaaggttgattcaggagatgctatccaatttgttaaggaacacataatcaatcgatttggtattccgcagaccattacaaccgatcaaggctctatatttgtatctgatgaatttgttcaatttgccgatagcatcggtatcaggttgttgaattcctctccttactatgcacaagccaatggacaagccgaggcttctaacaagagtttgatcaagttgattaagagatagatttctgattatcctcggcaatggcacattaggttagccgaagcattgtggtcttatcggatggcttgtcatgggtcgattcaagttcctccctacaagcttgtttatgggcatgaggcagttttaccatgggaagttagaatcggctcgagaagaacaaatttgcagaatgaattgacagccgatgaatattacaatctcatggccgatgaaagagaagatctggttcagtcaaggctgcgagctcttgcacaagttactaaggataaggaaagggttgctcggcattataacaacaaggtggtgcctaaatctttttatgaaggagagcttgtttggaagttgatcttgccgattgggactcgttataataaattcggcaaatggtcaccaactagggaaggaccatttcaaatacataacgttgtgtccaaaggagcttatatgttccaaggacttgatggagaagtttatggacgaccgcttaatggaatatacttgaagaaatattaccgcttaatggaatatacttgaagaaatattatccaagtgtttggcacaggtggatgcgatgttttagaccggaatgaaaaagttcaaaaagcaacaaaacatgattttcggacatattggagtgtattggctgtgttcgtggcaaaaaatcactacgtgattcgcgcggcgaacttctgtcaattaatgctaatatttgcatatattggcacacgtgggtgcgatgttttacaccggaatgaaaaagttcaaaaagcaccaaaacatgatttttggacatatttgagtgttttgggtgcattcgtgggaaaagatcacttcgcgattcgcgcgacgaactttcatcaattactgccaatattggcacacgtgggtgcgatgttttagaccggaatgaaaaagttcaaaaagcaccaaaacaagatttttggacatattggagtgtattgggtgcgttcatggcaaaaaatcacttcgtgattcgcacggcgaaattttgtcaattactgccaatattggcatatattggaacaggtgggtgcgatgtttttcaccggaattaaaaagttcaaaaagcactaaaacatgatttttggacatattcgagtgtgttgggtgcattcgtggcaaaaaatcacatcgtgattcgcgcggcgatcttttatcaattactgccaatattggcatataattgcacaggtgggtgcgatgttttagaccagaatgaaaaagttcaaaatgcaccaaaacatgatttttggacatatttcagtgttttggttgctttcgtggcaaaaaatcacttcgtgattcgtgcggcgaacttttgtcaactaatgccactattggcatataattgcacagatgggtgcgaagtttttgacaagaatgaaaaagttcaaaaatcaccaaaacatgatttttgaacatattggagtgcgttgggtgctttcgcggctaaaaatcacttcgtgattcgcgcggcgaacttttgtcaattgatgccaacattggcatatattggcacacgtgggtgcgatgttttagaccggaatgaaaaagtttaaaaagcaccaaaacaagatttttggacatattggagtgtattgggtgcgttcatggcaaaaaatcacttcgtgattcgcacggcgaaattttgtcaattactgccaatattggcacaggtgggtgcgatgtttttcaccgaaattaaaaagttcaaaaggcactaaaacatgatttttggacatattggagtgtgttgggtgcattcgtggcaaaaaatcacatcgtgattcgcgcggcgaacttttatcatttactgccaattggcacacgtgggtgcgatgttttagaccagaatgaaaaagttcaaaatgcaccaaaacatgatttttggacatattggagtgtattgggtgcgttcgtggcaaaaaataacttcgtgattcgcgcagcgaacttttgtcaactaatgctaatattggcatatatt

SEQ ID NO: 66383 - DNA, 1440 bp, Oryza sativa
tggcaaccccagttccagtatgtttggcgcgaaatttaagccccccccccccaacgtcaccaaacggcggtcaccgaagaaacgggccgtccggtactcagccccaatccggtcggcgctagggtgttcaagttaagcgccatcgaccctggcgttaaggtcggggtccagatctggtgatagtttttgccagggaccaaatttacaaatagttttcaaaaagggtcaaattgtcaaattttcgggactaatttgtagctgcacgctacacaggttcccacgcgctataatcggcatgcaactagtactagcgatagaaaacactttcagcgggccggtgtcacgcccagaaatttccgaatagaatttcaagcagaatgtgcattaaattccccgtccaggaccagccggggtacacaagcgacaatgttgacattcagatccacgtcttacaaacatcataaaagtttacacaaatgcagcagaagagaagaaaggcaacaggagctaagccttgactaaaactgcagcgggaacaccactccacaggcatccttgacggcacggacgaagcctactcctcggagaaaccttcatctgacacaacctcgaactctggggttgggaaaagtagagcaagactgagtactacccactgtactcagcaagtcataccggaatagggatatgatgcaaggaattatcaaagaagagctagagtggttcatttgcataaagcgagcatttataaacagaagttgaaagattaaacagttgtaataattaattaatattaactatccactgtccaacgctgacccacgttgcgacaggcccaaccatccacctaaactatccaatttcaaaagattacactagggtgagactaatcacggtgaatctggttgaccgcccataaccgcgggcacggctattcgaataattttactctgatcagaggtgtacaactgtacccacaagacacagccccacgacacgtttccgtgcgccgacatgccaccacgacatatcggaaagaggccgtgacaggacccttcacataaccccctctagccaagcacaccacacctcaggtttcacccccgtccccagagggcaacgggcagtcccctctcgtgcctaggtgaatccggaagcgacagaggccgtcgcagggcccgccccgctccatcacgcccacccttgcctggatgcgtcgactagaggagagctacactacaggcccagccgttgcccacgctggcttgtggtaagtacgataagttcttccagggcatcccgcgaaccggtccttaactgtcatgggtgcgtccagcaaaccatgcacccacagcccaccatgtgatttattttaattaaccaacaccaaagcggtgtcactaatccaacaaaaccattagaaccaatagtctaaacatt

SEQ ID NO: 66384 - DNA, 12743 bp, Oryza sativa
agctcatcaggacttacatagcgataaaataatgagaaattagatacatactaataataataataagagcattaataccttgcaacccatattcctgagttaggacctaatgcattcctcccatcaaaccctagactgacctaatttgacaaatctcacttaaacgagcgaccaagatttttcccttgaaccacaagaacagatcccaattttcccggaacaaatccaattgcaaagaacatatgcaatgaaaaggattcagagggctcttaggttttttcccatttggcttgtcctacggtcaaggttggctctgataccaagttgtcacgcccagaaattcccgaatagaattccaagcagaatgtgcattaaaatccccatccaggaccggccggggggtacacaaacgacaaagttgacatacagatccacgtcttacaaaaattataaaagtcttacataaatgtagcggaaaaataaaagataactggagctaagccttgacttggactgcagcgggaacaccagtccacaggcatcctcgacggcacgaacgaagcctattcctcggagaaaccaccatctaacgcatactcaaactctggggtttggggaaaatagagcaagactgagtataaccaccacactcagcaagtcataccggaacagggggtatgatgcaggatattaccaaaggatagctagagaggttcttttgcgtaaaacgagcatttataaacagtagttgaaagcaggaaatcaggtgtaataattaatcaatattagccatccactgtccaacgctacaccacgttgcaacaggcccaaccaaccacctgaactaatcagttccatcatattaaactagggtgagactaatcacggtgaatctggttgaccgcccataaccgcgggcaaggctattcaaatagttttactctgatcagaggtgtacaactgtacccacaaaacacagccccacgacacgtttccgtgcgccgacatgccaccacgacataccggaaagaggccgtgacaggactcttcgcataaccccctctagccaagcacactacacctcaggtttcacccccgtccccagtgggcaacgggcagtcccctctcgtgcctaggtgaatctggaagcgacaaaggccgtcgcagggcccgccctgctccatcacacccacccttgcctggatgcgtcaactagaggaaagctacactacaagcccagccgttgcccacgctggcttgtggtaagtacgataagttcttccagggcatcccgcgaaccggtccttaaatgccatgggcgcgaccaacaaaaccatgcacccacagcccaccatttggtatattttaattaaccaacaccggggcggtggcattaaccaacgtcattactagaatctgatatctatgcattaatgtgatttcccccattgtgtgctagttgaactaagcatggctaagcaatccctagtccaatctctagtcatgtttatatcccaagctaacaaaggagcatggtacagaaatagcatggctgtaacagtaggtaaacatcccatagtatcattatgaaacaatgcaatatttgaaggaaaacaatagaacatttgcaatataggatcaacatcttcaagtgacaagcatgacttgccttgctctgctgctggaggaacctcggcgactatttcaaagtacaccggagcgtcgggagagccggaatctaagcgacatacaaagcaaacaatacaaacaggctataagactactgaaacagagaacaaaaccattttgaatggattctacacatttttcttgatttactgagacttgaatgggcttaaacggagctcggatgaattagatatgaattttagaagattcacagaaaaatccttaattgatttattgcacaataaataaaccctaggagagagggggcagcgccgacatgcgggccccacatggcagtgactccggtggcggtccgcggtggaccgagtccacggaccggggaagggggcggcgcaccacgtggcactgacgtggcgccgacgtggcgcacacgtggcggccacatggcacgccacgcgggtggccgaaccgacgtccccgatctacccgagagtagatcggacggcggcggggagcacgcggtcggcacacacgagcggcccaagccggcccgatggccacggtgcacagcggcgctaccgcagggcggcggcggcagacagcggtgaccgacggcaagcggcggcggcgcgacggcgcgggtgatgctagcggcggctaagcagctaggcggcagcgcggcgactaagcggcgtgggagagagagggaggaaggggaggaggtgtctcaccgacggcgattgatgacggcgagcgacggagggcgatgacggcaacgggacgagctctggaaccacctagcgaacacgatgaaaggggttagagagagaggaagatggaagagggcgaggacgccggccgaaggcggtggccatggcggtgctcaccggcgcaaggcgcggagtgggttccggaggcggaatccgacgggagaggggcggacggggtgacctgcacgacggcgaacgtgacggcgtcgacgacgcggctcggcgcagcggctagcggcggctagcagcgaccggagcggtggcggcggcggcggaaaggagggcgacagcgctagggcgatagagggcacgggagagctcgcgaaatggagaaaaagagagaggggagagtggggatgcttaaataggggagagggagctcgaacgtggctaggagaggcgggaatcgccagccgacgtggggtagtgggagaggagagagaggcgggatttgaaaatcgaatcctggccgtctcgagcgcgggcgcgggcgggagagagagggagtgggcgcgggagacgtgggcgcacgcgcgggcaaggccgacgtggcccggaagacgcgggagtgagggtgcggcggcggctggaggttgggggaggactcgacaggtgggccccacctatcggcgaccccgggagagaggaggggctcgggcggccagcccagcgggaaggggagggaggagagaatgggccggcggaccattccgaaaagaaaagagggaaaaagaaagaaaaataaggaaaagaatttctagggaattaaatattgcttgtggtcatttttaattgattaaaattatttctagagctcttaaaattccactaaaatcttgttagcgtatttcgacatgtagaactcaggaaaaaatcccacatgccagttccgattattatttgcatcaattattttagggtttctctcttgcttttgcagcggtattttgttgagaccatttataaattcaatttaggcttgggagaaaaatctcagggtgtgacactcacccaagatactccaatatgtccaaaaatcttgttttggtgctttttgaactttttcattccggtgaaaaacatcgcacccacgtgtgccaacataggccaatattggcattaatttacaaaagttcgccgcgcgattcacggagtgatttttcgacacggacacacccaattctctacaagtatgtccaaaaacatgttttggtgctttctgaacgttttcattccggtaaaatacatcgcacccacgtatgctaatataggccaatattggcattaagtgacaaaagttcgttgcgcgaatcacggagtgaattttcgacactgatgcacctagtaaactccaataagtcctaaaatcatgttttggtgctttttgaactttttcattccgggaaaaaacagcgcacccacgtgtgcgaatataggccaatattggcattaattgacaaaacttcaccgcgcgagtcacagagtgatttttcgagacggacgcaccctgtacactccaatatgtccaaaaatcatgtttttggtgctttttgaactttttcattccggtgaaaaacaactcacccacgtctggcaatataggccaatactggcattaattgacaaaagttcgccgcgcgagttacggagttatttttcgacacggactcacccaacatactccaatatgtccaaaaatcacgttttggtgctttttcaagtttttcattccggtgaaaaacatcacacccacgtgtgccaacataggccaattttggtattaattgacaaaacttcgccgcgtgagtcacggagtaatttttcgtcacggactaacccaacatactccaatttgcccaaaaatcatattttggtgctttttgaagtctttcatttcggtgaaaaacatcgcacccacgtgtgccaatatgggccagtattggcattaattgacaaaagttcaccgcgcgagtcacggagtgatttttcgatacagactcacccaacagactccaatatgtccaagaatcattttttggtgctttttcaagtttttcattccggtgaaaaacattgcacccacgtgtgccagtatatatctatattggcattaattgacaaaagttcgccgcgcgagtcacggagtgatttttcgacgcggacgcacccaatacactccaatatgtcgaaaaatcatgttttggtgctttttgatctttttcattacggtgaaacccacgtgtggcaatattggcatcaattgataaaagttcgccgcgcgagtgacaaattgatttttctactcggacgcacccaatatactccaatatgtccaaaaatcatgttttggtgctttttgaaatttttcattccggtgaaaaacattgcacccacgtgtgccaatagatgtctatattggcaataattgacaaaagttcgccgcgcgagttacggagtgatttttcgacacggactcacccaacatactccaatatgtccaaaaatcatgttttggtgcttttggaagtttttctttccggtgaaaaacattgcacccacgtgtgccaatataggccaatatcggtattaattgacaaaagttcgccgcgcgagtcacagagtgatttttcgacacggacgcaccctgtacactccaatatgtccaaaaatcatgttttggttttttttttaactttttcattccggtgaaaaagaactcacccacgtgtgccaatataggccaatagtggcactaattgacaaaagttcgccacgcgagtcacggagtgatttttcgacacggactaacccaacatactccaatatgtccaaaaaatcacgttttcgtgctttttcaagtttttcattccggtgaaaaacatcgcacccacgtgtccaacataggccaatattggtattagttgacaaaacttcgccgcgtgagtcatggagtaatttttcgacacggacacacccaattatctacagtatgtccaaaaacatgtttgtgtgctttctgaactttttcattccggtgaaaaacatcgcacccacgtgtgccaatataggccaatattggcgttatttgacaaaagttcgtcgcgcgagtcacggagcgatttttcaacaccaactcacccaacatactcaaatatgtccaaagatattggcattagttgataaaagttcgccgcgcgagtcacaaattaatttttctacacggacgcacccaatatactccaataagtccaaaaatcatgttttggtgctttttgaagtttttcattccggtgaaaaacattgcacctacgtgtgccaatatatatctatattggcattaattgacaaaagttcgccgcgcgagtcacggagtgatttttcgacacggactcacccagcatattccaatatgtccaaaaatcatgttttggtgctttttgaagttattctttccggtgtaaaactccgcacccacgtgtgccaacataggccaatattggcattaattgacaaaactttgccgcgcgagtcacggagtgatttttcgacacggacgcacccaattctctacagtatgtccaaaaacatgttttggtgctttctgaacttttttattccgctaaaattcatcgcacccatgtatgctaatataggccaatattggcattaagtgacaaaagttcgctgcgcgaatcacagagtgaattttcgacacggacgcacccagtacactccatgtggagaatatggatatcccatatctacatgacagttataatttagtcggatatacggtaccaaatatagatagaatatctttatgaagactcgggtttgttttttacttgtatgtcaaggaaatacccgagatcttagtcggttaggattgtattttatctataatcccatattccgttaggatatggactgtattttgtaaagcggactccttcccctatataaggagggtccgtgtgcctctcggggcgcaattcttttttccaatatatacaatcaataacatactcggcggaatcatccccggacaggagtagggtattacttcttgaataagaaggcctgaacctgtataaaattccttgtctccaaacccatccactttcctagcttgatagccacccccttttattattgccgaaatcttgtttcgacagttggcgcgccaggtaggggcagcgtcaagtttttgccgactaagtgcgatgggttccatttctggcatcgacgacttcgccttccctcccgggcaggcgttccggttcggcagcctcaacttcatcaccaacgacttcagcaagatctctctccttgactcggattcgaaccagtcagggagagaccaggtccccgtgccgttcggtattccgaactcggccgaggcctactccaagatcatatcttccgagtcggcttcaaaccactcggacgagatccaatctactcctccgcgaccagatcaagacgacgggtcctatccttcaatcttgatgaaacttcctgatgacttggacgccgtcttcacagtcaaaacatctcccactcagagatctaggcgagctccggcatcggccctgatccagtctagatccagggaggttggcgttatactccaacttcttgggacagtctcgacggaagatttggatggctacctcagctcccccggcgtcagttctcgaccaaccgagatcctcgactacgacgaccacgacgacctcgacaacttcgacgacagctatgaggataactacacgcccctcttcttcggtgtattcatggctgacaacgaaacggaggaacagcgccgagcccgagaagcggaccaagatcgcgcacggcaagaagctgaacgtcgccgactggaggaagagcgacagcgacaggagcgagaacgactatagcgtgagcaacaagatcgcgaacggattgcaaaggaggctgaagatcgacggcaacgcaccttggaatccgggaggcgagcgagagagctcattgggcaacaagacgtcgacggaacagcggtctttcgcaccccccagcagaacgcggttgcagcaatcactctcctcgacaccctcctcaaggaagacgcactcaaccaagctgatcatgttgtcaacatcttgaaccagacgaagaccatgatcgcttcctcgggtccagccaactccgcaagcacccgcaccttgactggtagccgagtccctcatcttcgatctcaagactatcaccagccatgcctcagcattgccagtgccggatctagtcacaggagcagaggacatgatgaacggtctgttcgttcacctcccgaacggtatagggagcgtcgagttgaacgaccacactccccacatcgaaggcgccccatcgatcttcgcgacaccatcaactagcgccgtccagcaagaggccaccattcaccagatcgttacgacaacgatgtggacggagttgctgccttcacaagcgatctgcgtcgagtggattggccagccggctttaagccgactggaattgagaaatatgatggcaccaccaaccctgagtcttggctcaccgtctatggtctcgcaatccgcgcagcaggaggagacagcaaggccatggcaaactatctgcctgtggctctagcggattccgcccgatcctggctccacggactaccccgtggcacaatcggatcatgggcagaacttcgtgatcacttcatcgccaacttccagggcacctttgaacgccccggcacacagtttgatctctacaacgtcgttcagaagtctagaggatcccttcaagattacatccggcgcttctccgagcaacgcaacaagatctccgacatcaccgacgacgtcatcattgctgcctttactaaaggcattcgccacgaggacctagtcggcaagttcggatgcaaacctcccaagacggtcaagcaaatgtttgaaaaagccaacgagtatgccaaagccgaagatgctattacagcgtccaagcagtcgggcaccacttggaagccaaagaaggacacgccgaccgcaggagggagtggaagtaacaaccgcaaggatcgcaagcgtaagcccgaagaacttgtggcaacaacctctccatcttcccgacaacgtccccgcgtcaacacattcgacaagataatgaactcccaatgtccgcatcatcctaactccaaccacgtggccaaagactgcttcgtctacaaacaatttgcggagcaatacgtcaagaatgcacgtaagccttcagacggagagcaaggcacatcaaagaagaaagacgatgaagacgatgcctcgactggttttcaagatcatcgcaaagaactcaatcacatcttcggcggacctctggcttatgaatctaagagaaagcagaagctaacagaacgggagatcaatgcggttcagcccaacacgccccaataccttcggtggtcagaaatagcaatcaagtttgaccgctcggatcatcccgaccgagtggtccacccggggcggtaccccctagtactatacctagtggttcgcaatgtcaagctccgaagaactctcattgatggtggcagtgcactcaacatccttttcgctaagaccctggacgatatgcagattcctcgcacggaattaaagccgagcaatgcacccttccacggtgttatccctggattatcagctacaccactcggctagatcactcttccggtcactttcggcactcgggagaattttcgcacagaaaatgtttgtttcgaagtcgctgatttcgagacagcataccatgctatacttggacgaccggccctagccaaattcatggccgtcccacactacacctacatgatgatgaagatgcttggtcctcgaggagtcatatcactacgaagcaacatcaagaaagccgtcacatgtgacaaagaaagttgcgagatggcccagacccgcgagattacactcgaccgagaagagatccgactggctgcgaccatggcaagcgaaggagaagtgcccgcaaccaagatgctcaaaagcggagaaagcaatggtaagacgaaaaagattcccttagatccctctgatcctgataagattgctgtaataggcgctgagttagattgtaaataggaaagcgcgctcatcacctttcttcaaaataataaagatatctttgcatggaaaccatccgatatgcctggtattcctagagaggtgattgagcactctttacatgttaaggaagacgccaaacccatcaagcaacgactccaccgttttgcacaggacaggaaggatgcaatcaaggaggaattaaccaagctgttagcagcgggcttcatcaaggaagtccttcatccagactggctggctaacccagtcctagttcggaaaaagacggggcaatggcacatgtgtgttgattacaccgacctcaacaagtcttgccccaaagacccttttgggttacctcgcattgaccaggtggttgactcaacggccggctgcgagttactcagtttcttggactgctactcgggatatcatcagatccgactgaaagaatccgactgcttgaagatctcgtttattacacccttcggggcctactgctacatcaccatgccctttggatggaagaacgcaggagtaacctatcaacgcatgattcagagatgtttctcgactcagatcggccgcaatgttgaagcttacgttgatgatgtagttgtcaagaccaagcagaaggatgacctgatcacagatttagaggaaacttttacaagcattcgtgctttcaggatgaaactaaaccctgaaaagtgcatcttcggagtaccgtcagggaagttgctcggatttatggtatctcaaagaggcatacaggccaacccggagaaaatcaacgccatcctcaacatgaaaccgccaagctcccaaaaagacgtccaaaagctgactggttgtatggcggcgctcagccggttcgtctcatgactcggcgagcgggggatgccctttttcaagctgctgaagaagactgacaattttcagtggggacccgaagcacaaaaagcctttgaagacttcaagagacttctcaccactccaccagttttggcctcgccgcatctacaagagccgctactgttatatatgacggcgacctcccaggttgtgagcacggtcctggttgttgagcgtgaagaggaaggccatattcaaaaagtccaacgaccaatttattttgtcagtgaggttttagccgactccaagacaaggtatcctcaggttcaaaagttattatatggtgtcttaattaccgtcatgaaattatctcactactttcaaagtcactcggtcacggtggtcacatcgtttccactcggggatatacatcataatcgcgaagcaaacggacggattgcgaagtgggccttagaattgatgtctttggacatatcgttcaaaccacgaacttcgatcaagtcacaagctttagctgatttccttgccgagtggaccgagtgccaagaagacatgccagaggaaaagagggaatattggactatgcattttgatgggtcgaagaggcttacaggcactggagctggggttgttttaatctcccgacttgagaaagattgagctacgtattgtggatacatttttctgcgtcccataacgtggcggaatacgaggcgctactccatggattaaggattgccatctctctaggcattcgccgattaattgtccgaggggactctcagttggttgttaatcaagtcatgaaagagtggtcctatctagatgatactatgactgcttatcgacaagaggtacgcatgttggaagacaaattcgatggactcgagctcacccatgttctccgacataacaatgaggcagccgacaggctggccaattttggttcaaaacaggaagctgctccttcagatgtgttcgttgaacatctttacgaaccaaccgtgcccagaaaagagacaattgaagccatggatactcaaggcgtaagcatgatcgaagccgactggagagaaccgttcataaaatttttgagcaaacaagaacttcctcaagacaaaaatgaagccgagcagatttcccggcgcagcagactttacattattcatgaaactgatatgtacaagaaaaatccatcaggaatactgcaacgctgtgtgtctttggaagaaggaagacaattgttgaaggatatacattctggtatttgtggtaaccatgccgctgcatggactattgtcggcaaagcttaccggcaaggttttttctggcctacagctgtatctgatgctgacaagattgtgcggacgtgcgagggttgtcaattttttgccagacaaattcacctaccagcccaagagttgcaaaccatcccgttgtcctggccgtttgcggtctgggggcttgacatggtcggcctgtttaaaagggcagtcgggggttacacgcatctctttatggctattgacaaattctccaaatggattgaggctaaaccggtcatcacgattacggcagataaagctagagattttttcattaacattgtgcatcggtttggggtacctaatcggatcatcactgataatggcactcaattcactggcggagcatttaaagacttttgtgaagacttcggtataaaaatttgctatgcctccgtggcacaccccatgagtaacggacaagtcgagcgtgctaatggcatgatacttcaagggataaaagcacgagttttcgaccgactacatccctatgctggcaagtgggtcaatcagctgccgtccgtactttagtctttacacactactcccagtcgggctaccggccagtcgccgttctttttggtttatggtgcagaagcaatgttgccagtgaagtggaatttgaatcactacgatttcggaacttcaacgaggagcgttatgaagagggccaagtagacgacatcaatcgattagaagaagcccgtgaagcagctttaattcagtcgactcggtatttgcaagggttgcgccgttatcataatcggaatgttcgatcgtgagcctttttagtcggcgacctggttctgaggaaaattcaaaccacacaggatcggcataaattatctcccttatgggcaggaccgttcataattgctgaagtcacttggccaggttcttatcgactcaagcgcgaagatggtactctcatcaacaattcttggaatattgaacaccttcgtcgattttatgcttag

SEQ ID NO: 66385 - DNA, 2599 bp, Oryza sativa
acacctcctctccgtcctccctctctctcccgcgccgcttagtcgccgcaccgccgcctagccccttatccgccgctagcgacacccgcgccatcgcgctgccaccgcttgccgtcggtcgccgccgtctgccgccgctgccccgcggtagcgccaccgtgcgccatggccgtcgggccgtcttgagccgctcgtgcgtgccgaccgcgtggtccccgccgccgtccgatctactctcgggtagatcggggacgtcggttcggccgcccgcgtggcgtgccatgtggccgccacgtgtgcgccacgtcggcgccacgtcagtgccacgtggtgcgccgcccccttccccggtccgtggactcggtccaccgcggaccgccaccggagtcactgccatgtggggcccgcatgtcggcgctgccccctctctcctagggtttatttattgtgcaataaatcaattaaggatttttctgtgaatcttctaaaattcatatctaattcatccgagctccgtttaagcccattcatgtcttagtaaatcaagaaaaatgtgtagaatccattcaaaatggttttgttctctgtttcggtagtcttatagcctgtttgtattgtttgctttgtatgtcgcttagattccggctctcccgatgctccggtgtactttgaaatagtcgccgaggttcctccagcagcagagcaaggcaagtcatgcttgtcacttgaacatgttgatcctatattgcaaatgttctattgttttccttcaaatattgcattattttacaatgatactatgggatgtttacctactattacagccatgctatttctgtaccatgctcctttgttagcttgggatataaacatgactagagattggactagggattgcttagccatgcttagttcaactagcacacaatggggaaaatcacattaatgcatagatatcagattctagtaatgacgttggttaatgccaccgccccggtgttggttaattaaaatatatcaaatggtgggctgtgggtgcatggttttgttggtcgcgcccatggcatttaaggaccggttcgcgggatgccctggaagaacttatcatacttaccacaagccagcgtgtgcaacggctgggcttgtagtgtagttttcctctagttgacgcatccaggaaagggtgggcgtgatggagcagggcgggccctgtgacggcctctgtcgcttccggattcacctaggcacgagaggggactgcccgttgcccgctggggacggggtgaaacctgaggtgtggtgtgcttggctagagggggttatgcgaagagtcctgtcacggcctctttccggtatgtcgtggtggcatgtcggcgcacggaaacgtgtcgtggggctgtgttttgtgggtacagttgtacacctctgatcagagtaaaactatttgaatagccttgcccgcggttatgggcggtcaaccagattcaccgtgattagtctcaccctagtttaatatgatggaactgattagttcaggtggttggttgggcctgttgcaacgtggtgtagcgttggacagtggatggctaatattgattaattattacacctgatttcctgctttcaactactgtttataaatgctcgttttacgcaaaagaacctctctagctatcctttggtaatatcctgcatcataccccctgttccggtatgacttgctgagtacggtggttgtactcagtcttgctctattttccccaaaccccagagtttgagtatgcgtcagatggtggtttctccgaggaataggcttcgttcgtgccgtcgaggatgcctgtggagtggtgttcccgctgcagtccaagtcaaggtttagctctagttatcttttatttttccgttgcatttatgtaaaacttttataatgtttgtaagacgtagatttgtatgtcaactttgtcgtttgtgtaccccggccggtcctggacggggattttaatgcacattctgcttggaattctattcgggaatttctgggcgtgacaatgagtccgtgtcgaaaaatcactccgtgactcgcgcggtgaacttttgtcaattaatgccaatattagcctatattggcacacgtgggtgcgatatatttcaccgaaatgaaaaagtttagaaagcaccaaaacatgtttttggacatactgtagagaattgggtgcgtccgtgtcgaaaaattactccgtgactcaagcggcgaagttttgttaattaatgccaatattggcctatgttggcacacgtgggtgcgatgtttttcaccggaatgaagaacttcaaaaagcagcaaaacatgatttttggacatattggagtatggtgggtgagtccgtgtcgaaaaatcactccgtgactcgcgcgacgaacttttgtcaattaatgccaacattggcttatattggcacacgtgggtgagttgtttttcatcggaatgaaaaagttcaaaaagtactgatttttggacatattggagtgtcttgggtgcgtccgtgtcgaaaaatcactctgtgactcgcgcagtgaacttttatcactgaatgccaat

SEQ ID NO: 66386 - DNA, 5132 bp, Oryza sativa
aatgttgccagtgaagtggaatttgaatcactacgatttcggaacttcaacgaggagcgttatgaagagggccaagtagacgacatcaatcgattagaagaagcccgtgaagcagctttaattcagtcgactcggtatttgcaagggttgcgccgttatcataatcggaatgttcgatcgtgagcctttttagtcggcgacctggttctgaggaaaattcaaaccacacaggatcggcataaattatctcccttatgggcaggaccgttcataattgctgaagtcacttggccaggttcttatcgactcaagcgcgaagatggtactctcatcaacaattcttggaatattgaacaccttcgtcgattttatgcttaggcgtttcgtttgtatctttcctctttgactgctaatctcaagtttttccttgaagttttcagtcgggggctactatgataataatggagtgtgatttttatcaattcaatttgcttacttgatttatcattgccctatttggtctttcgacttagtcgatgaggactgaaggtttttaatagcttttgcgggttttaggctcaataaggctagataaaggcttttaagaaatcaaaagctaagtatggaacaccaagcatagcataaattcatcagtattgtacaaattgagccttcatcatcattaattatcaaaatcattgttatatcaatcagtatcagttttttcatcatcagacttatcagacccagtcggccgaaggtcgacttcttggaatctttcaaccacatcagcagcaatcttgtcagcggctttctgcgcatcgttaatgaggtcaagagcagcttcttcgctcgtcccatctgcaaagccatcaatggcatccatatcaacccttggataaagggatttggtcatcgccaacgccagacttgctcccatacttccagcttctttgatgttcttgaaataagtatctggagcgactctcagcttgtcgaagattttggcagcatcaagtgtactcgaaccggcgttattgaagaacatggcccggatgagtggagtagcatcattagcgactttatccctggctccttcaagcttgttgatcttgtcaactaagacatcaaactgtgcttgagacttgatcttgcggtctgcatcaacagattcacattaatgaatcagcatatagaagataatggcttttgaggtattgattattggtaccttcaacctcctttaaagctgaatccctctatcttgccagctctgccttgtcattttccatagtttggatcttcttctctagttcagatatcttggcagcttgcagtacattaacttcggttaatcaagattacagagataacagcccaaatcagttgggcagagtttgcgcgaacctttggatgagccactcagtttataattggattcctggagctcagcaatccaatccctcaaatcgtgttcattctttctggcaagttctctggcctcgtgcagttgactcctggtggtttcgagggttccaagatgaggaactagtttctcaagggttgcggttttcgcctcgttcctaagatgaatcctctgcagagcagtttaatcagcgctcgagccagacggcaaacaagatggctgaggtcaggcatcaaggaacttacatttacaatgcgagtcgcttggttgagtgccttcttcattaggcagacctcttcgtcttctttttgccggtttattataattccttgaggttgcaagttgtcatcccaccacttgaccagaatgggagggcacgaatcttcggctgcttgtatacggggaatttcttcttcatcaccaatcattggtcctaatgtatctactgacaaaggttagacgattgatcagagttatttgggtcgacatggtttcagacaaagtgtttacccgtaatgatttctggacgaggacgagtggattcagatgcctttaaagtagatccagatctccggtcattgctggcgtcttgtccgcgagggttgtctgcttgggtttcaacttctggaatctcttggcttggccctgcgtccgacaggtttccagtcgggggctcctgattaactccagcttcggcttcggccgactggtttccagtcaggggttcgtcgctgggttctacattgtcgctggcctgcagattatcactcgggagatcttttgcagtcggcccggtttcttttgaggaacccgcctccatgttggtcgggtcagagtcttttctagatagatctatatcagatggtttcctgcaagtttgattgtcagtactattatcgcaatgggtgcgcatcaatgcaacggagatcgtaatatgagttgcacctagagttcttcctgatttttggcacaggacgactggatgttttcttccttggagtagcctgcttcggcagtttattggttgcctctcggtctccaagctttctagcagtgtcgcctttgtcgtcacttagaaccagcttcacataaagctagagattatcttccgtcacatcggagggcgcctactggctctcgaagctttctctctcttccgccatgaatgtggactggatggtttgatttggtctgagatacggctggaaaggaatggggaattggagtggtggatgccggcagaaattttgtggagtgtttgaggatggattggagcggattgctgaaccctagcttggccggcgcagtttgtactgtagcaggaaatggggaaaatggcgagagtctcggcggggatgacgaagagacgtttttcacttcggtgatattagggtatcgggagtgctagcaggcctgggccggcacagtacttcagcccaattttatttccagcgtggcccattgtgatccttagggacttaggcactttttgctttggcaatttgtgctcacaatgatgtggtccaatgctgttaaaaccctttttaatgcggtttgataattctttggaattaaaacgatgcaaacaaaaggtgcccgacagaaaggtgttataccgtttttgtaagccttattaggctgcaaaagctgtttgggttgatttgagatgactggtttactaatagtcattcttttagcatgttatatgcttattttggttatggtaagggtcacagcctaggctattagactcattaattaccgtgattttttatcatgtttggtgaatcattttaagagtttcttactcggattcctatcaaatatgtctatttttggatcttttgagtgtttatcacttggccctttcatgttttttatccttgatatgttcaaggagtgttgataaaaccactcggttcttgactacgtgtttagtttttcaactaatcacatagtcgggcgctacacctaattaggtgcatctactcgatgcaccatgttttattttcgcccttcgcagtctttgattttagcactcggcaaactggagcaagttgaattgaagcactcggattgctgttttttgtttcgagaaggctattttgtcaactgcgaaggtctcgggactactgtggagaatatggatatcccatatctacatgacagttataatttagtcggatatatggtaccaaatatagatagaatatctttatgaagactcgagttagttttttacttgtatgtcaaggaaatacccgagatcttagtcggttaggattgtattttatctataatcccatattccgttaggatatggactgtattttgtaaagcggactccttcccctatataaggagggtccgtgtgcctctcggggcgcaattcttttctccaatatatataatcaataacatactcggtggaatcatccccggacaggagtagggtattacttcttgaataagaagacctgaacctgtataaaattccttgtctccaaacccatccactttgctagcttgatagccacccccttttattattgccgaaatcttgtttcgacactccaatatgtctaaaaatcatgttttggtgctttttgaactttttcattccggtgaaaaacaacacacccacgtgtgccaatataggccaatattggcattaattgacaaaacttcaccgcgcgagtcacgagtgatttttcgacacggacgaacccaattctctatagtatgtccaaaaacatgtttgtgtgctttctgaactttttcattccggtgaaaaacatcgcacccacgtgtgccaatataggccaatattggcattatttgacaaaagttcgttgcgcgagtcacggagtgatttttcgacatgaacacacccaacatagttcaataagtccaaaaatcatgttttcgagctttttgaaatttttcattccggtgaaaaacatcgcacccacgtgtcgcaatatatgccaatattggcatcaatagacaaaagttcgtcgtgcgagtcatggagttatttttcgacacggatgcacacaatacactccaatatgtccaaaaatcatgttttagtgctttttgaactttttcattcctatgaaaaacatcgcacagtttgcttcttccttcatccgggctaggcacgtactccgagcacgcacgtgggccaatataagccaactttggcattaattgaaaaaagctggctgcgcgagtcacggagtgatttttcgacacggacgcacacaatacactccaatatgtccaaaaatcatgtttcgatgctttttgaactttttccttccggtgaaaaacatcgcacccacatgtgccaatataggccaatattggcattaattgacaaaagttcgccgcgcgagtcacggagtgattttccgacacggactcacccaacatactccaataagtccaaaaatcatgttttggtgctttttgaagttttttattccggtgaaaaatatcgcacccacgtgtgccaacacgggccaatattgacattacttgacaaaagttcgccgcgcgagtcacggagtgatttttcgacacggaatcacccaacaaactccaatatgtccaaaaatcatgttttggtgctttttgaagtttttcattccggtgaaaaacattgcacccacgtgtgccaatatatatgcaatattggcat

SEQ ID NO: 66387 - DNA, 26268 bp, Oryza sativa
tttgtcacagttcctttccaaggtaccgtggtggtactgaggcgcatggtgacatgttgtgggattgtgtcttgtgggtacagtggtacacctctgattagagtaaaactattcgaatagctgtgcccgcggttatgggtgagttgagcaatgttttttgtgattagtcccacattattcattaatggtaattgtgctaatcaatttgactcctggtttggaatggtatattcctggtatggaggttggattagtacaaccggggttggttgttcagatgaggttgggcctatgcaacacgggtgtgttgtatggtgtttatctaatactgattaattattcaactgttgaactattctcttaaatatttattaaatgctgtttacacaaatgagctttattatgccatcctttgttattctgtgcacttgcatatttgctgtgtggcttgttaaatatgtcatatgctcattcttgcaatattcattcatcagaagaggagttcttcagtgaaggtgatgatctggaggactaggcttggtccgggttaagttgcctgtggagtggaatcgccatagctgttccgtagtttgctttagtttatttttccgctgcgtagaatgttattgtttgagaggaactatctacctctgtaatgatttattaattgcgaatattaaatagttgtttatttgtactctattatcaatttgttattgtgtgcctcggctgattcctggacgagggtttaacacacatgtaagcgtttggaattttggatagaaattccgggcgtgacaattctgttgatgtagaccgcaagatcaaatcacaagctctgttcgacgtcctggtcggcaaaatcaaaatgcttgaaggggccagggacgaagttgccaacgccgctactccactcgtccaagcaatgttctttaataacaacggtccgagtagattcgacgcttccgagatcttcgacaagctaagagtcgctccggatacatacttcaagaacatcaaggaagccgggagtatgtgagcaagtctggcgctggcgatgaccaaatccctgtacccaaagatcgatattgacgccattgatggctttgcagacgggacgagcaaagaagccactctcgatctcatcaacgatgcgcagaaagccgctgacaaaatagcagttgatgtagtagagagattccaggacaccgatcttcgaccgactggtcctgacagttctgatgatgaaaagactgacactgattgatgtatcaatgattttgatgatgagtgatggaggcacaatttgtacaatactgataaatttatgccgtgctcagtgtttcatacttagcttctgatttcttaaaagcctttgtcaagccttattgagcctaaaacccacaaaagctattaaaaactttcagtcctcatggactaagtcaaaaaatcaagcaaggcaataataaaccaaataagcaaattgaattgataaaaatcacactccattattattatagtagcccccgactgataacttcaaggggaagcttgatgttgtcagtaaacaaacttaagcataaaaacaacgaagatgttcgatattccaagagttgtcgataggtgtaccgtcttcgcgcttgagccgataggaacctggccgagtgacttcagatattataaatggcccttcccataaaggggataatttgtgccgatcccgtgtagttcgaattttcctcaaaaccaggtcgccgactaagaaagctcgcgatcggacgttacgattatgacaacgacgcaacccttgcaagtatcgggccgactgaattaaggctgcttcgcgggtctcttccagtcggtgtaggtcatccactcggtcttctccgtagcgctcttcacgaaaattgcgaaaacgcaaagattcaaactctacctcactaggcaacattgcttctgctccataaactaggaagaatggcgattggcccgtagcccgactgggggtggtgcgcaaggaccaaagtacggatggaagctgttccacccatttgccggcatagggatttagtcggtcaaaaactcgtgcctttattccttggagtaccatgccgttggcttgttcaacttgcccattgctcgtgggatgcgctacggaggcatagcagattttgataccgaagtcttcacaaaaatctttaaatactccgtcggtgagttgagtgccattatcagtgatgatctgattaggtaccccaaaccgatgcacaatattgatgaaaaagtctctggctttatctgccgtgattgtgatgaccggtttagcttcaatccacttggagaatttgtcgatagccacaaagaggtgtgtgtaaccgccgactgcctttttgaacgggccgaccatgtcaagcccccaaaccgcgaacggccaggacaacgggatggtttgtaactcttgggctggtagatgagtttgtctggcgaaaaattgacaaccttcgcatgtccgcacgatcttgtcggcatcggacacagcagtgggccagaaaaaaccttgccggtaagccttgccaccaatggtgcgtgtggcagcgtggttgccacagataccagaatgtatgtctttcagtaattgtctcccttcctctagggatactgttgacagaaaacacgaggcctgggagatctgcttaactccagtgcaggtccaaaactcaccttcggatgtgtgagcgtgccagttgatttgatcctgtaatcatcaagaaataaagacaaaggaaccgtggttaaatctataaatgatagccgatcggccagatgccgatgacatatcatttatattcgagccgatgtcatctgtgtatcgatcggcaatcgtagataagtaaggaaaaactaaatttacttgatcggctgtaaatattaacggtatataatccttatattgatgtttacttaaatcaagtgattgggatagatcggttatcacaccgagacagtataaatcacttagatcgaaatatacatccataacaggactatatatgtttatagcatagccgatcagatagatctagcatgtatcggctaatactccgatactactttgtattaagacgttgcaacaataatgatatgttgaacaatagtttaacacatttgaatatagcaataaagggcatatttaacatatcagcgaagcaaatagaataagtatggttaaatcagatacgatcggctgaaactccgatgctattctaattgacaactagatggcaggctagagatcaatattctaagcacgacttaatagatcaaactcaattgatgcagcattaagtatgaaaagaagaacaatatctagacaatcaagccgctagaagattcatagaatggtacatatcttatataatctaaatcaacgtcgagatctaacctaatcagctgtcttttgcatacaaatattagccgataatagattagataaagatattgttgaagattatgtaagatatatgataactcagcgaattatataaacgagattagagtgtcatgaagatgtaagcactaatccctaagaacataattcgtcataacgaattttacctcttgttgaagattgaaaccgatgcagctcaacccgaaagcaagaactcgtcgaaataaaacaaaagcaaaaggtggcgatgcgccggaattgtattgaatgtgtgtcttaaaattacatagggctcggggtctatttatactcgaggattacaagatatgcccataccggacataaccattatctctaacaaactctaaaatatcacaagtctctgcggcagacttttgcccatacttatctataaggaatttacataaatcatcctaattaatagatacaattgccttcccaggactctatccatgcgtggcaatcatcttgaagcacatcaacctgagcccgacgtcgcgcacaagttgtattgtcagaatcagctatatcagcttatttagcttaactcaaccttagccgatcctagccgtagccgatcctagccgtagccgatcctaactatagccgatctagactccagccgattcttgctctgttccagaactcgatctccgcctccaactcttctttgaccaaatcccctttcctgatacgaatacttaccaaattcggttgttaacagatacgcagcgttgcagaattcttgatggacttttcttgtacaaattggcctcatgaatgatgtaaagcctgctgcgcctggaaatccgctcagcttcgtctttatcttgagggagttcttgggaggtctgaaaccgtatgaggggctctctccagtcagcttcgaccatagctatgtcttgagtgtccgcggcttcagctgtttctctcttgggtacggttggctcataaagatgttcgacgaatacatcagaaggggccgcttcgtgtttggatccaaaattcgctagtctgtcggttgcttcgttattgtgccgaaaaacatgggtgagttcgagtccatcgaatttgtcctccaatttgcgtacctcttgtcgataagccatcatgttgtcatcgaggcaggaccactctttcataacttggttaacaaactaactgtgaatctccgcgaactatcagacgtctgatgcccaaagagattgcgatccgtagcccgtggaggagcgcctcgtactccgcgacattgtgagatgcagaaaaatgtatccatagcacatagctcaatctttctccagttggggaaattaaaacaactccggccccagtgcccgaaagtctctttgacccgtcaaaatgcatagtccagtactccatcttttcctcgggggtgtcctcttggcactcggtccacttggcaacaaagtcggctaaagcttgggacttcatcgaagttcgtggcttgaacgatatgtccaaggacatcagttctaaggcccattttgcaatccgtccgtttgcttcgcggttgataaaattcttattgattattatatatatattgtacgcactatatttgagataatacatcaatttataatttaacaaattatatttaggacacgagcgaaaatccgtgtaaacaaatgccccttcgagctgcggttgccaaaattttgcttttgcatccggagctcgaagcataattttggatctgcagggacgtggtgtgagctttatgctcacaactatgtgcccgctatttgaaagattgttgagaaaattaaggagcatctccccgattatttggtcacgttccctatcaccaggagcagtgaggcagttcgtttgctcttttaatcactaacccatccactactccagtctccagaggctagactccttcctcttcctcttcttctgtgtgaaggctttgaggaaagacatcaccggtggcagaatcaagggtaagaccctgctttgatcttgtgaactgaactggcgacccctttttcttactattttttttatttttcttattggctttcgtccctctgttctatttaggtttgtgctatgcacacacacctgaagatcctcgagttgatttcattgggtgcttggtgattcaggtgtggcaagtgaaaggtacgcatgaatcttcttaccatccttcaatccattcatttttttaatagatatgtcgatctctctgcacaacgttcatatttgatacgcctctgccaatataacttcctttaaccacattgtattgaattagttgttcgtatgatcggggttcccggacattttgtaatgttacacagccaatccacgttgttagatttgcatgtactccttcccatcacgattatttgatccaaagtactgaagtatcccgcgccaaataatatgactcggggggcaacaaatgaaacatgcacaacagttcaggaccttgagcatagaagaaataaatgatacaacctatgtcacttattatctacaacacattgacctctgtaataacagaatgacattatcaccatagatggtgaaacttccttgaaaacaagaattaatcgttatatctattcaggcaattttaagcattacgaattctcatcagatctacaacggtgcataacaaaaataaatgctacattattccactgtatgtaaacaaattagtgaaatgagtgaaataacagggggcagatccaacttgggacatgggggttcagttgaacccccccaaacttttgggggaacaacaaacaaactcaaactgttacttttattaaggttaaaggctctggaactaagagaagagcttcctccagatctacaagagaagctagggtttaggcaagcaaattccaagacagaagcatccccggtgagagagagagagagagagatgaatcatcagaaagaggatgcggatgctcaccaggatccccttgctcgccggatggagatcggcgaccctccccctcccctcccctgttcagccgcgaatggcgcaagaagcggatgagacgacgagacgggagatttttttttctcttttacgcgaagggaagggggaagagatactcgagtactccacctttagctcagatttactatgttacccattatgagtagcaggccaaatgggcggcccggcccagcatagctcggacccgctgatggcacggcaactgtaatgggccgggccgtgccgtgccaggtcttgggcagaacggcccaaggaagtgttgggccgtgtcgggccggcacggctactgttgcatggaccggtggcccacccacctgcaagagaacgttattcgtgtgaaactacagtcgcaagttttctatagtaggtaacacaattaggcaaaattgtgtttatatgggtatttttcattgtcaatattgtgctattatagccgtgttaaaaatttccataatttcctttggcacaactaagagaggtttaaccttacgtcccgacccaagcattcgttgtagatatcctgaaacacgaggttcggacttcggacctgttttaaacttttcgaccgttagacacattttaaacttatcggccattagttataaatatatggtcttatatcacgttactccctcaaatattgaaaatatgttgatttggatacattttaaacttctcaacctttggacacattttgaacttctcgaccgttagttataaatatctggtatgtacgagagcaatggttttaatttttaaaacacaccgttttgcacaagttccaaactcccaaacggcctatcaaagtgctccatccggtcttaaaaacaaaggtcatgtttcctgcacaaaaatgttacaccctatcacatcgaacgtttgaagtattaaatataagctaaaaaaataactaattacacagattgcgactaatttgcgagacgaatcttttaagcctaattgctccatgattttgacaatgtggtgctataataaacatctgttaatgacggattaattaggtttaataaattagtctcgcggtttactgacggatactacaattagtttttttattagtgcccgaacaccccatgcgacaccctatataatacccgatgtgaaacgcaaaaactttacactcctggatctaaacacccccaaagttattttggatactacattccaagttcaaatataaaaatctaatagcatgtacaataatagactataagtcggctacaagcttatgtggtgaacataaagagaggagatagaaaagaagcaggctgcagatttgtagctagctgtagcacggactcctaaatgctacgtgtgtatgacaagtgggagcagtaattaatgatgtactatatatttgtagttaactattgtataatttggctattagattatctataaataatttggagctagtagttggctatatactattaaaattcctctaagcggcaaaggccgtgttcgattattagtgttagaaactaaccctttgagcacgtaaaacgaaacggttcattaatgcataattaattaagtattagttatttcttaaaaatgagttaacatgattattcaaataactttcatacatacatacgttttaaaaaaaaacgcaccgtttaaccgtttgaaaagcacacatgtgaaaaatgagatagataagtaggaaaatacgataaagaatacttcctccatatcaaaatataagccttttttttttgtttttgacttcgacacggttttaaagatgctacattgataaacgatattcataaaagtaaaatattttaaataaaaagagttacatactgtgatagtttgtttaatgctaaatctagtaatatcattttttttagattgatcttttttaatttattttttcttattaataatcaaaggacttgacactatacttaaaaaatacttatattttttatattttagtacggagggaatacaaagttaaaatccgtcatcttctatgacagaagtagtaacacgaaattaatttagctctacatccgttctgtttatgaataacggtcgaaaacgtaataacccaaccacgacgacatgaaaaaaagaaagacagataaaacggtcgaataactaaaacaacttgctactactatttgaaatttgaacaactgtaacggcccaaaaactggggagtggattctaatccctcgagggatatcccctcgtatacctttttcttccaaattcgatacaaatagttatgaaaaattctgaaaaaaattaacaatgtagagtataatgatacctactagtccaccaaaattcatgttcaaattcgatctacacatcgagaaacaaaagaagacaaatttagatataaacagtacgctactattcatacgctgaatttgtctttttatatctcgacgtgtgagttgagtttggaattaagattttgtagagttgtatatatgtgttgtatgaatgttgtcaaattttttcagtatttttcataaccgtttagatggtttttgagcaaacgagggaacatcctcgagggattagaatagtttccccaaaaactggaaataatcgaaagagtcgtcgccattttctctcttctcctcctccgctcctctgagtcctctcctctccggctctcccctcctctgtcgggaagggaaggatccaagccctcgccctgctccgcctctgatccccgccggccgccgccgccctcgcaaccctcgcagcagcagcaggaggaggagggttcaggtggtggttgccgtcggccgatgtcgagcagcctagcctcccgccgctcgtcgtcgtcgtcggcggcgaagcggcccgcggcgggggagggaggagggaaggcggccgcgggcgccgcggcggccaagaagcgcgtcgcgctcggtaacatcaccaacgttgccgccgccgccaacaatgcggtacgtgaaggatcgcttgctgctgcttcttcttcttcttttttcctttttttttctctccaagatttgttctttgctttgcgcggtttgggtggagatcttttggtgtgtgaggtggttggaatggtttgggggtggctttttttttttttttttttgcttcttggttcctcttggggcacaagtgagtcgctgttgatgcggaaatggccgaagcgatctgtgtatgatttttttcttttttggtttttttccatcttgtttgtggaggacatacgcctcgatctgttggtttcaagcaaatataaatagtgtttcttgaattcgtcttcttgagttctttctttcagccaacaacaagattttcatttcttcaatttctccttggttagcctacaaacgattctcctcttccaatccccaatatattcttgccttttggtttttcagtgctcttcacattcaaatttggacctctgccacattcttccttgctgattttgaggattctcctattccaatccacaagatttttcttgctgattttctggtttcttttcatggttaattgattgattgatttcttggggagcatccaggtcaacaggctaaattcacttgagggtttattggcaccttcagaagttcaaaataaaagctttcttggtattcgctaagtgttttgtatgtttgcttgctttggaatcttctattggtaatatgatacttgcgtgctgctaatgtttctaataaatatttgttccttttcatgcttgtggtctggaatcccaaatgaacagattgaaatataagttctaaattgatttcttgtcttcaatcctcctgcagaaatttaattcagctacctgggctgcacctgtgaagaagggatctttggccagtggccgcaatgtgggcacgaatcgggtctcggcggtgaaatcagcttccaccaagccagcttcggccatatcccgccatgagagcgccccacagaaggagtcagttcttcctcctaaagtgcttagaattgttccaactgctgcacctgcacctgtcactgtaccctgcagcagcttcgtctcccctatgcattcaggagattcaggtggtgtttacttccagggacttaacttaagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctcagtttcggttgatgagacgatgtcgacgtgcgactcaatgaaaagcccagactttgagtatattgataatggggattcctcctcagttctaggttccttgcagcgaagagcaaacgagaacctgcgtatctcagaggatagagatgttgaaggtgtgttttggttgctgaaatgcacagttatagctagaaaaatttgtgctatatggtgcattctattggaatggttgattgatcttttcccttgtttgtttcgcagaaactaagtggaagaaggatgctccttccccaatggaaatcgaccaaatttgtgatgttgacaataactacgaggatccgcagttgtgtgctactcttgcttctgatatctacatgcacttgcgcgaggccgaggtaatacattcttgactaaaccttatttctctgaaaacatttcccttgagcaccttattgtagtatgttttcataggaaggctttgttttgcttcctcatgatttgagacttgattgcatccatatgaaacacaagtaaaaaaagtttactttgatgagaccataaattaagaagagaataagtgcacatcactgatataaggcattattccaatgtaatttatcaggatatttttcacatttcaccacaatccgttcttttctgcttttcgctttgttggtgcaccttatcatctaccagacatgctttgtgaccatcaattttcagtagttttgttctgcatattatgtaaacaccttacataaaacattcttgaatacttttttttttctgaatagtgggttccatttaatggccatcatattgaaattccctatagaaccagtagaagcacagtataatatggagaaattgtaatggagttatcttcttaaagcattgactgaaccgatgaattgatacatttcaattgttgtaatcaatgctcttgaagtatttttcaattgctcattatttttgctgtgacatggactgcactactgcagtcagtttgatcaaatgacaattaatctgacctgagcacagtggtttcaaatctaggttgaatttcatatttacattgtgattttctatttgacttgaagcagaccaggaaacatccatcaaccgattttatggaaacactccaaaaggatgtaaacccaagcatgagagcgatcctgatagactggcttgtggaagtaagcttttataccgaacaaatttttttagttgattggagcctaaagaccacaatcgttacttaccactctatttgtgcttttcctttgtgcaggtcgctgaagaatatcgtcttgttcctgatacattatacctgacagttaactacattgaccgttatctttctggcaatgagatcaatcgtcaaagactgcaattacttggagttgcttgtatgcttattgctgcgtaagatctgattagcaatttttttaaatgtgtttctcagtttgcatctgagttttgtgtactgattttggcttgttcctatatcagaaaatacaaggagatatgtgcacctcaagtagaagaattctgctatataactgacaacacatacttcagagatgaggtttgttttgcatatctgtgaacatttctatgtttatctccatgactaacacatagattgtcaggttttggaaatggaagcttctgtcctgaattacctgaagtttgaaatgactgcacctacagcaaaatgctttttgaggttctattctctttcatctcatcgatgtctataatgctggaatgaatcgaactctaataactatcttcttgcctacaacaggagatttgtccgtgttgcacaagtatctgatgaggtgctgctctcttaatcatctcctgcttgctgcaatttcatactatttatatgctgcattgcattaacagcttttcatcgtgcaggatccagcattgcatcttgagttcctagccaattatgttgctgagctatcactgctggagtacaatctactttcttaccctccttcactagtagcggcatcagctattttcctggccaaattcatactgcagccagcaaagcacccttgggtacgtggtggcatcatcatattgaactttccatacatcttttatatcaacattcaaataaaaaaattacaagagctaacatatgcttctcattgtaaattggaagcagaattccacccttgctcactacacacaatacaagtcgtcagagttaagcgactgcgttaaggcattgcaccgccttttctgtgttggtcctgggagtaaccttcctgcaatcagggagaagtatacccaacataaggtataaactgcatatcctccccatttcttcagttatctgtactgttcctaatgctgcctcctgtacctttgtttctgcagtacaaatttgtggcgaagaagccctgcccaccctcaataccgaccgaattctttcgcgactcaacatgctgaactagaaaaataaaccaaggattagttacagttgctgactgaattcttcctccagaggcacctatgccaggttgtgccgtagaccgttcagataagcttgatgcaaggcatgctgcttgccccccctgttctttcaggtggtttggctgagtgtagatagatcgatgcttctgctgtgtgtggtaacttttatggtactgatgtgctttcttctatcttcttttccctgtacctagatgatccatggttttcagtactttgtacatcggagtcctgcagcaaagctttaaacatcttgtttgatattagctgccaacctgggcgtctcctaggttgatgtatgatagagtctctgttcgtgttgctcttgtgaaattctcaataagagcaccacattttcaacagtgctcattctgaataagtgctactagtgttcttgatgtttctagtaaaaaatactctctccgattctaaatatttgacgctgttgacttttttaaatatgtttgaccgttcgtcttattcaaaaaatttaagtaattattagtttttttcattcattgttaaatatacttatatgtatatatatagttttaaatatttcataaaagtttttgaataagacgaacggtcaaacatatgctaaaacgttaacggtgtcaaatatttagaaacggaggtagtatcaacttcagctttttttttttcaacctgttctgttcttctgttgacagatatatgcagctgatgtgatcgacttaaacatgatgattcagcgagattcttagataaaagcttctgacatcttttccacgaaagatgttttcatggacaaatgcatttaagattctgaaaatgaaaaatactacgtccatcctaaagtgtccaatgtttgaccgtccgttttatttgaaaaatttatgaattattttttaaaagtagtcacacataaagtactattcatgttttatcatctaataacaataaaaatagtaatcataattttttttaaataagacgaaaaatcaaacataatcaaacattgaagataaatagtgcaaaactgcacttattttgggacggagggagtatttgtcaatgcaacctgttgaagaagtgatgctcaagctatttccatacttgaagctaagcacagctgtttagacatgcatgcctgcgtgttgcatcatcatattgtacttagagctaattaatcacctatactaatataaaaagcattacttgtagtctttgctagctacactaaaaaaaagtgtacacaaattaacctcaggcaccctgcaatctaattgttgagattacaagttccagcttgtcttgcaatgcaacaggtgaactcacagattcaactccaccttggccctggcaaacgcggcggtgtgctagcaactacacgttccaaaatataaaaacctataatcggatgagacatttttttctggtactaagaatcggccaatccagattctcgtctcgctggagtctcatcctcgtctcactggagtctggaatctatagcaacgttgtttacagtagagttaacagaaattatcaccgtctaattaacttgctactgctttacaaaacgggagacaatcagacaacgccggggtgggttgaaaaggaagaaaatgcaagcacaggcaaatgccgacgataagatgactagatgagcaaggctactccctggggaaaaggctttgcttgccatggattgcaacacaagattaaaaaaaaattacaatacagaaagaatgattcgaagcatgagtctagcaaggttaaatcatcactgagctaggcctacaacatgtcgagttagaagtcctcttcgtcgtccagatctggatcatttgatggccgtattctcttgccgtctctccctccagggcgacctcccttctttggttttcctctgtccaaacacacgaggggtcagaactaggcaattctactaagggtgtgtttagttcacgctaaaattggaagtttggttgaaattggaacaatgtgacggaaaagttggaagtttgtgcgtgtaggaaagttttgatgtgatggaaaagttggaagtttgaagaaaaagtttggaactaaacaagggctaaaagggttgttcctagaaacactgttttttttaatataaagaagtgttagacaaacactgccccttgcaaggatgtatgtaaagctgataaggatagcacattttttgccacaaaggtaatctgagcacttactgcccgtttgcaggagtggttgcacctttcgaacgacctgatccatattctcttccatctgccaggatgcagctagtattgagcccagagtctcaattgttcctggtttcagcttaatgaaaacaagaaagagaacttaccatctcgtccagccatatgttcatcgacctggaatgaatagaaaataatggtatgtattagcaaactcacaaatatcagtatagcacagggggaataacaatcatcaatcaaagcaaaccaaaagattaaaaaaggggcacgggcttttcagtgcattaggatttaggatcattagtcataccgctggagatgtaaccgatgacagggagaacagcctctcatcagcctggaacttcctggagcgcttgagactgaaaataataagatagaaactgtcataactaattctgtgtgatctattagcagaacagaaatgataaaacatttgcttgtgcagaataatgaacacgcaacattatgccaatggtaatcataaatccaaccctcccttggtgatgctagatagtgcatatagagcacccctgcaattggccaataaactgacataacactatcatagcatattttgggttatgaatctgttgtataatacctgccactgccactatagtgatcagaggatcttttgttcatctgatcattagtaaattatatgtgatcagaggatcttttgttcaacatcattcatctgatcattagtaaattatatgtgatcagaggatcttttgttcaatatctataactataaattattcatccgaatattagctaaattatatgtgatcagaggctggtagaaagttcaagggaaggacagtaggtcattcaatcaacagttgaaagtaagcaaagaatgtggcatgaattctgaaggtttcgaactggtaagtatacagtgggatgtcaaaagaaaatgaatgaagacctccaaatagtaaagggcgtagcagtctaagaaaataaagatttcttacttggaagtgttctttgacgatgataagaatgattcaaaaccctttagcacacttccgaattgattagactcttgtaggtaggttgtctccatttcataaacctgcaacatatggacataaacatcatttgcaggttgtataagaacaattctgttaaaagcatgaatagatattttgttaaattatgagtgtttaatatcatatacaaaacttccccttaaagtcaagcaaagatggttgacattatagatcatgtgttgttcctggtattaaagagcgactgttttgttctttctaaaaaaaacacacatatcagtgccattaaaatacttgatatgagagcaatagcactttcctccctttttaggattatggtttctactaaaccaaacgctcctcttatttaatgattttggatgacacaccaagattcaccatcacaaacatatattggaatttggaccacatagtgtaactttgaaatactatgaatagaagtagctcatttgatacttgctgcgaataatttctgactaagacacagtagaaactccacattttaactcgaggatagaagaacagatggaattttcaggttgtagctaactgattttcttttttaccttagaataacaaagtgttctcaggcacaaagaacaacatacaagaaatagaatggtcatattcgacaagaatatcaaattgatactttcttcccttcctcctaattctatccaaattgttcgtcacaactgatcctctctgtgaaatgacaatcagtggtcactggtccagcatattggttccaaataggttcatatttctatcattcccaaggcattaagaaagattgaacaataaattcaggctactacaggtatccacaactccaattttacaaccatccgcagcaatgtaaattcgcaccactcattcgcatgttgagcaatggcaagcccttgccatctgaacatatatgcaacaaatccatggtctcctatacaaaaccctaattccaagagagagagagagagaggcgcaaaagagacagggaacagtgtgtaagacctaacctggcgctctatggagcggagctcctcctggagcttggcgcgcttgctcatcagggcggagagcatcgccgtggggttcgcggccgccgcccccgagggtgcggagcccgacgctgccttgtgcgatgcccctcctccgcctcccgagtccatggtcagggtttctagggttcgagttcgtggtttgcctgtttgggcgttcgttctgttttggctcggagacagttcactgttgtggagacgacttagcccctcctctccaatagtccgatcggtcctcttagccaaggtaaccagtatcaagatactatgtaggatcctttctcttcttggtttgatccttctcgatcggtttgattccttctaatggagaaagcttcctgtttgctgccacctgagctgtcaaatgcacatgtgaaaatgtttagcaatcaatgcatacatacccatgagtatcacacagaaaaggttaatagagtatttagcagaaatttgtgtttcacaatttttttctgttgagggatgaatttcactccaaataacattattggaatacatttctgcctataatctaagatgcacatgttttatgagcgatttgatcatgaccacaaacatgagataatgtccataccctagttaggtgcccgtgcattacaatgggaaaagagcatttggctatgtactccttcccatcacgattatttgatccaaagtactgaagtatcccgcgccaaataatatgactcggggggcaacaaatgaaacatgcacaacagttcaggaccttgagcatagaagaaataaatgatacaacctatgtcacttattatctacaacacattgacctctgtaataacataatgacattatcaccatagatggtgaaacttccttgaaaacaagaattaatcgttatatctattcaggcaattttaagcattacgaattctcatcagatctacaacggtgcataacaaaaataaatgctacattattccactgtatgtaaacaaattagtgaaatgagtgaaataacagggggcagatccaacttgggacatgggggttcagttgaaccccccaaacttttgggggaacaacaaacaaactcaaactgttacttgtattaaggttaaaggctctggaactaagagaagagcttcttccagatctacaagagaagctagggtttaggcaagcaaattccaagacagaagcatccccggtgagagagagagagatgaatcatcagaaagaggatgcggatgctcaccaggatccccttgctcgccggatggagatcggcgaccctccccctcccctcccctgttcagccgcgaatggcgcaagaagcggatgagacgacgagacgggagatttttttttctcttttacgcgaagggaagggggaagagatactcgagtactccacctttagctcagatttactatgttacccattatgagtagcaggccaaatgggcggcccggcccagcatagctcgggcccgctgatggcacggcaactgtaatgggccgggccgtgccgtgccaggtcttgggcagaacggcccaaggaagtgttgggccgtgtcgggccggcacggctactgttgcatggaccggtggcccacccacctgcacgagaacgttattcgtgtgaaactacagtcgcaagttttctatagtaggtaacacaattaggcaaaattgtgtttatatgggtatttttcattgtcaatattgtgccattatagccgtgttaaaaatttccataatttcctttggcacaactaagagaggtttaggggctgtttggttgatgccctgagaagaacttgcctgagtgaagacaagcctgaggttagtttgaaccttgttttggttgctatcctgagatcaactaccccttgcctggcctgattccttctgacttgcggttagcctgagccaggtgacccattttggtcgccagaactccaggccgcaacagccaccgataattagcgctgctaatccatcctgctggcctgcgcagccgagtagccgacaccccagatgccgcaccaaccccttgcccaatcctccgttcaattgttgctgctcgaagcttcaatgtcaactagatgcaagcgatacttgtgatcatcgtgcaattagatggactgctagtgtatatagatgagagattacttttgtaaaatgaatacgtattatatttttacgctttgttcacataataaacgtcattcaatggttgtgttttcagctcaggcacgcttgacctcagacctgcaaccaaacagagtaatctcaggcttgcctgatcaggccgaacacatcaagatctcagggagatttcaagcagcactttttcttcaggcatgcagctgagggcaccaaccaaacaagcccttaaccttacgtcccgacccaagcattcgttgtagatatcctgaaacacgaggttcggacttcggacctgttttaaacttttcgaccgttggacacattttaaacttatcggccattagttataaatatatggtcttatatcacgttactccctcaaatattgaaaatatgttgatttggatacattttaaacttctcaacctttggacacattttgaacttctcgaccgttagttataaatatctggtatgtacgagagcaatggttttaatttttaaaacacaccgttttgcacaagttccaaactcccaaaccgcctaacaaagtgctccatccggtcttaaaaacaaaggtcatgtttcctgcacaaaaatgttacaccctatcacatctgtcggagatataggcccgggggtatgtggagtaaaggagagctacttccctttccagccacacggctccgcgagctggtcccacccacatacctcgtgagtcactaaggcgaaggggagagcctcgggggtcgacgacatcccctcgggggtgacgtcaccccctcgggctctcccgtcgttttaccccgaggccctctctcggggggaagtgtgagaggggagtccaggctgggcggccataaatgtgcagcgccccaaccgtccctcgctgcattcaatgcggcgggggcagacgtgcggtgcgcccgaccgacccctgtcagtcggatgcgaccggtctgtgaccagtctattgccggtcacggccgattggacgggcggtcgtgcccccacgtcgcctctgtctccgcggagtggcggtaggtacgccccatcacatccggacggcgtttgatgcagggcttgccgcaagtcttccctcgtttatgagggaatgacagggctgccccccgtgtcaggcgggagacggcgctgggccccactcaaggaccgaccgatgcttagcttccaacaaaaggcacgggttgaaacccggtcgcagtagggagaaaggccccctcccctccctccgatggagggggagggtagagacggcgcatatggtatccccttaagctataaaaggaggaccttgcccaccaaaaagagggggagcgagggaaaccttttaaaattcactgataatcccaaacgtaggagtagggtattacgctccagagcggcctgaacctaggtaatccatttgtgtgctagctaatcggggatcggagggacgaacacgcgacttcggagagacgagtctctgcccccggccgaactcacgaaaggggggtcacgcgactccccgcgatcgggggtcttccctcgacagctggcacgccaagtagggggcagttgcgcgtttgagaagaagtcgcttccttccgtcccaggtcggaccaggccctagaccgccatggtcgaggtcctggaagcagaggaagcggtggcgcctacccccaccccgtctgggagtggggattcgggcgaaaaccgtgaccctcgtcaccatcgccatggctctcaaagtcctccccgccgcgagccttcgcggagggaggatccaacccgttcaagcggtacggccctctccccgcccccaggaggagggaggtcgcgacgcgtcggagcacgtcgccgtctcgactacggagacggtggttcgccccaaggcgcgcttcaggtggtgggcgcccttctgcggcatccccaggtgaacccggagccggagacccccgtgcggcgctggctggacgacgtggccaacttggtcaccgctgcccagcggcagttggccacgggtggccaatccaccgccacaggtacatcgagtaccccggctaccctttcctcgtcggcgaggagaagggcccgtcgatcggccacaaccttgaggcgatccacggctccaacgacatcggaggtctcgggaaggcggaggcgtcatgatgacctctacggggcgcaggatgctcgggtcaacatcgagcgacgcctggacgagcgccgggctacccgcatgggggaaggtgcctcctcatctggagtgccgcgctcttcttcgcgaggcggccctccccccacgctcacccctgggaggggcaggttgtagggctttcgttgcgagtctccagaatgtctggtggcccccgaagtttcgccccaatctcacggagaagtatgatggcagcatcaacccctccgagttcctccaaatctacaccacgatcatcgtggcggcagggggtgacgaccgggttatggcgaactactttcccatggcccttaagggtcaggcgcgtggctggttgatggcccagctccccgactccattcactcctgggaggatctatgccagcagttcgtcacaaacctctaggggacatatccctgcccgggggaagaagcggacctgcatgctgtgcggcggaaggacgacgagtccctccgttcgtatatacagcgcttctgccaggtccgccacaccataccgtgcattccagcccacgcagtagtgtatgcattccggaacggcgtgcggcataaccgcatgctggagaagatcgcctccaaggagcccaagaccaccgccgagctcttcgagctggcggacaaggtggcccggaaggaggaggcgtgggcctggaactctcctggcaccggtgcggcggctgcggctgcccccgagtctgcccctcgctctaagcggcgagataggagaggcaagaggaaaccggcccgttccgatgacgagggccatgtccttgcggcagagggcccacgtgggccccgcgcaaaggaaagattaccggcgataagccgagctccaccaccccctccggcggaggccggtcggcggacaagtggtgttcggggcacaacacttaccgccacagtctcaccgactgccgctcgtcaagaacttggccgagtggttccgaaaggccgatgaggaaaagcggcagggtcgacgggagggcaaggctcccatgacctcaaccagtgaccagcgagaggaggccaagaacaaggcccccgctgacgatggcggaggtggtgaggatctggatttctagataccccaagggaccgtcgccacattcgatgggggggcttgcgctcgcacttctcgtcgagggttcaaggctatgaggcgggaacttctggccgctgttcccacccatgaggcgatccggaaggcgtgctggtcggaggtaaagctcacctttgaccagagcgaccatccgacggtactcgctcggggagggaagttggccctggtggtctccccgactatccacaacgtcaagatgaagcgtgtgctggtggacggcggggccagtctgaacatcatctccccggctgcctttgacgcgctcaaggccccggggatgaagctccaaccgtcgctgccaatcattggcgttactccgggacacacgtggccgcttggtcacgtcgagctcctagtaaccttcggcgactccaccaatttccgcaccgagcggatcgacttcgatgtggcggatctcaatctgccctacaacgcggtcctgggcagacccgcgttggtaaagttcatggccgccacccattacgcctacctccagatgaagatgccgggtcctgccggtcccatcaccatctttagtgatgtcaaagtcgccctcgcctgtgcagaacagcgcgcggacaacctggcggcggccacggggccgcaggccccggaggcccccgcgtcccgcgcccccaagaagcgcctcaccttggccgacgaggtgcccgtcaaggagattccccttggcgacgatccgtccaaaaccgctaagattggcgaaaccttggacgccaaataggaaggcgcgctcatctccttcctgcgggcgaattctgacgttttcgcatggaagccgtcggatatgcccggggtccctagggaggtgattgagcaccgccttgccgtgcgaccggatgcgcgacctgtccggcaaaaagtgcggcgtcaagccccggagcgacaaaccttcatcagggaggaggtggcgcggctcctggaggctgatttcatccgcgaggtgattcatccggagtggctggcgaacccggtggtcgtcccgaaggccaacagcaagctgcggatgtgcatcgactacacagacctcaataaggtatgccctaaagatcccttccctctaccacgtatagatcagatagtcgactccactgcggggtgcgaccttttgtgtttcctagatgcatactctgggtaccatcagattcgcatggctagggaagatgaagaaaaaactgccttcattactcctgtaggcaccttttgttatacaactatgccttttgggttaaaaaatgccggccctacctttcagcgcatgactcgaattactttaagtaatcagatagggcgcaatgtagaggcgtatgtcgatgacctagtggtaaaaacgcgccgccaggacacgttgctgcaacacctggccgagactttcgatagtcttaggtccacacgtgtaaagctgaaccccgataagtgtgtgttcggcgtgccggcgggcaagcttctcggttttctagtctcttcccgaggcatagaagcaaatcccgagaaaatacgcgtgatagagaggatgcgccccccagcaagctcagggatgtgcaatgtgtcgctggatgcatggccgccctgagtcgatttatatcaagattgggcgagagagcgctgcccctattcaagctcctcaagcgccccaggccgtttgtatggacggaggaagctgagcaagccctcaatcagctgaaagcttacctcacttctccccctatcctggtggccccggggccggaggagccattgctactctacttggctgcgaccccccacgtggtgagtgccaccctagtagttgaacgcgaggagaccgagcaggaggtccctccggctcgtgatggcccctcgtcccccaaagcccccagcccccgggaggaccccgaggcccccggaggagaaggcgaggctttggcaggaggccccgagccctgtgatcccaagataatccggaatcccccgggggcccccgagcaggcgcgctccggatcatccgcccctgacaacacgaaccggcccgcccgaacggtgcagcggcccatctactttgtcagcgaggcgcttcgggatgtgaaaacccggtacccgcaggcccagaaaatgctttacgccgtattgatggcctcgaggaagttgcgccattacttccaagcacatcgggtttccgtggtaacatcgtaccctctcggccaaatcttgcacaaccgagagggcaccggacgggtggtaaaatgggccatcgagctggctgagttcgacctgcacttcgaaccgcggcacgcgatcaaaagtcaagtcctggctgacttcatcgcggaatgggccccagtggacgaccctgttccgtccgaaccccctccctcccccgaagagaaagaggacccaaacgccgacattcgtggcggacactggattatgcatctcgacggctccctcacccttcaaggcgcgggtgctggagtcacactaacctcgccaagcggagacgtcctcaaatacgtcgttcggctcgacttccgagccacgaacaacatggcagaatacgaagggctcctcgcaggattgagggcggcagccggaatgggcatccgccgtctcctggtcctaggtgactcccagctggtcgtaaatcaagtatccaaagagtaccaatgcaccgaccctcaaatggatgcatatgtccgcgaagtacggcgcatggaacgccacttcgacggaatcgagctccggcacgtgccccggcgcgacaacacactcgctgatgagctgccgcgtgttgcgtcggcgcgagccccacttcccccggggacctttgaagaaaggcttgtccaaccatcagcacgaccgaacccctcgaggggctccaacgacatgccctccgccccgattccttccaactcgcgccccttggagccggagggggtcgaccccgacccccctccgcgcccccggggcccgagggggtcgaccccgacccccctcgccaagtcgcatgatgaataatgtccgggcgtatctcgacgacaa

SEQ ID NO: 66388 - DNA, 23906 bp, Oryza sativa
aaaaagagagaggggagagtggggatccttaaataggggagagggagctcggacgtagccgggagaggcgggaatcgaatccctgccgtctcgagtgcgggcgtgggcgggagagagagggagtgagcgcgggagacgcgggcgcacgcgcgggcgtggccgacgtggcccggaagacgcgggagcgagggcgcggcggcggttccggggcacggaggtggcggctggaggttgggggaggacccgacaggtgggccccacctgtcggcgaccccaggagagaggaggggctcgggcggccggctcagctgggcctcggccttcggccggcccagcgggaaggggagggaggagagaatgggccggcggcccatttcgaaaagaaaagagggaaaaagaaagaaaaagaaggaaaagaatttccagggaattaaatattgcttgtgctcatttttaattgattaaaattatttctagagctctgaaaattccactaaaaatcttgttagcgtatttcgacatgtagaactcaagaaaaatcgcacatgccagttccgattattatttgcattaattattttagggtttctctcttgcttttgcaccggtattttcttgagaccatttataaattcaatttaggcttgggagaagaacttcagggtgtgacaaacctaccccccttaaacggaatctcgaccccgagattcggaagagccggtgaagaggtgcggatgggcggccttcaactcatcttccctttcccaggttgcttcttcttctgagtggtggctccattgaacccggcagaacctagtgaccttgtttctggttcttctttcactggtctcaagaatacaaactggcttttccacataggttagatcttcttgaatgtcgatgtgctcctccgaatcggcttgttcttcgggtaccctcaaacacttctttaactgggacacatggaacacgtcatggatactgatcattttgggtggaagttctagctgataagcaacttctcctcttcgttccaagattttgtatggtcccacgaagcgtggtgccaacttgcctttcgtttggaaacggtgtactccccggagcggagtaacacgaaagtacacgtaatcccctgcttcaaaagtgagctcccttcggcggttgtccgcatagctcttctgtcgagactgggcaattctcagcctctctctgacggttctgactttctcttctgcttccgttaacacttctgttccgaacagttgactttcgcctatttgatcccagaagagaggtgtgcggcacttccggccatacaacgcttcgaacggtgccatttgtagactggcctgatagctgttgttgtaggagaactccgcatacggcaagcttttgtcccatgctccactaaaatcaagcgcacaagcccttaacatatcctccaatatttgattgacccgctcggtctgaccatcggtctgcggatggtaggctgtgctgaagttcagccgggttcccaattcctcttgcaatttctgccagaactttgaagtgaattggctccctcgatcagatactatctttttgggtactccatgcagacacatgattctcgagagatagagctctgccaaccttttgcctgtatatgtagtatgcacaggaatgaaatgagcaactttggtaagtcgatccacgaccacccagattgaatcgtggcccgatgatgtcctgggcagacctgttatgaaatctatcccaatttcttcccatttccattccgggatctgaagaggttgtaacaatcctgcgggcctctgatgttctgctttaactcgctgacaaacatcgcagagcgcgacgaattcagctatttccctcctcatgctggcccaccaaaaattttctttgagatcttggtacatcttggtactaccccgatgaatggagtattgagtttgatgagcctcagtgagtatcagatcttttagctctttgtcatcaggcacacacaatctttctcccatgcagattgtgccatgttcatcttcaaggaaatcccgggcttttccaacccacatattctttttcagttcagctatctcaggatcatttacttgagctgctctgacttgatccacgagcgtaggacgtgcctctagagcagctacgaacccgtgttctacgattcccatgttgagacgttcaagctcttgctgcaattccttacacatgccttcggtgcataaagcattgtagtagctcttcctgcttaatgcatctgccaccacattggctttgcctggatggtagtgaatgctcatgtcataatctttgattaactccaaccatcttcgctgtcggagatttagatcaggttgggtgaagatatatttcagactcttgtgatctatatatacttcgcagtggttgccaatcagatattgcctccagattttcaaagcatgaaccaccgctgccaattccaggtcatgtgttggatagttcccttcatgtggacgcaactgccgcgaggcataagcgaccactctgccgtcttgcattagaacacatccaagcccgtggcgggacgcgtcgcaatagacttggaagtcctttgtttggtcgggcagaatcagaactggagcagacactaatctcttcttgagctcctcaaaactcttgtcacactcggccgtccatttaaatttctcatctttcttaagcaactgagtcatgggtctagcgatcctggagaaattttcaatgaaccgacggtaataacctgcaagtcgaagaaaactccgaatctatgacacggtcttaggtggggtccatttggtaactgactccacattcggtggatcgactgccacgccctgagctgtaatgacgtgacccagaaatttgacttccgacaaccagaagtcacacttactgaacttggcatataactggtgctccttcaacttctcgagtactagaaggagatgttgctcatgttcttcttcagactttgaatagataagtatgtcgtcaatgaataccacaacaaacttatcgagaaattccatgaacactttgttcatcaggttcatgaagaatgcaggtgcattggtaagtccaaaagatataaccgtgcactcatacaacccataccaagtggtaaaggctgacttgggaatatcctcttcccaaatcctcaactggttgtagcctgatcgcaggtctattatggaaaacaccttggctcctttcagctgattgaacagatcatcaatccgcggcaacgggtatttgttcttgaaagtgacctcattgagtgtgcgataatcgacacacattctcttcgtcttgtccttcttctccacaaaaatgactggagcaccccaaagtgaagtactcggtcgaatgtaccctttctgcagctgctcatcaacctgcttcttgacctctgctagctcgttggctgccattctgtacggtcttatgtaaattggagcagttcccggtgccaaatcaatccggaattcaatctctctcttgggtggcatggtagtgaggtcctcggggaacacttctggatacttgcagactatggggatatcttccaacttcctcgaactcttctcctcggtgaccactggaatttccacctcaatctgattcaaggagaccccctgctttggtgagactggagatttgtacactactgtttctcccttctcattggtcaaggtgactgtgcgattcacacaatcaatgacacccttgaacttggttagccaatccatcccaagattgatatctaggtctttggattcgagaagaatgaggttggctagaaatggtgatctttggatttctattgttatagaagggctgaattgaaccgaagtggagctattccctagggtatgaacccgcattggtgtactaagttcttcccttattaacccatgtatcccaacaaacttctttccaatgaacgaatgcgttgcaccagaatcgaaaagtactgttgtagggattgagttaacaggaaacgtacccagtacgacctctggtgctacttgcgcctcttctgcggacgcgtggttgacacgagcctgggcaaaccttggcccggcacgccttggcttcgggcatttgtcagcaaagtggccatgctcgccacagttgaagcaggatcctggctttgctccagtctccttcttggcttgggctgatggagctgactgtgctggtgccaatggtgggcgtggagctgcactgcggttgggctgacctccctggtggttctggctgccactagcgccctggtggaagctgctcgagttgaaagggcgatgttggcggacgatcatggtggtaggtgtttacacccaaatttggcacctaggattaaaataggaaagattgccgaaaattggaagtctaccggtttcctccgagtgggccggtctgacagccatgtcttggccggtcagaccgccggttgagagccggtcagaccggcggtgtgtggccggtctgaccggcaggtctgagttcgactgtgtttcgtcaggtctcgaggtttgcttgctcgggaaggcatgttttgggtttcctttggtttctaacccgagttggatgtggaggagggcctgtagagggcaagtgatgtgaccatggctactatggatacaaccattgctcacatcatggatgaacaagataatatccagatcaagtcctccaagtgctggaatcagattcggccacctgctacactgctgacttcaaatggccgccgaatctgcatacgacctccttttcggcccatgagtacttgatggaaagctctcggagtcctctttccaacggatttggcatcatcgccaaattccatcgaagtcatccacagatgaagaaacaaggtgctgcgtcacctgtcatgaacctgtgggcttgtaacttcttcatttgggaccccggtccaggtggggcccatgtggggtgcgccccaagctggtggagtacgaccctaggcacccctaggtcgtcctcccacccctatatatagctagttaccccttcagggttttgatgcaagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttctatttgcttgcaggtatagggttgatctgcaccggcaagatcaacaacccacagagaggtgtatcgatcgctaaggcgcaacacaacgtctcgtacggttgtagtcggattgtcaacgtttctcccaaatcgtagttatcacaactcaccaaaagatcgggccaacaacagccttgagtgtcgagaggaactcagggttcatcagcaagaccaacccctatataagggacatggccggttcattgtaaaaaatcgatctacaatcaatcagttgaatcgtttttcatattgcttttaattttctcttagtttgtccatctttgtcggtttgcgccgtaaaccgtctgccgccgctgcgagtgtgcgacacctctttgtaggtttgtcctgaaaaccttccgttttgcccacgagacgggtagttatctagaaatcggctccgctagccggtttagttaccaaaacccatctaggtttagctctttgctagatcgaggtggttagcgactctaggatcaccgcaaggctttaggtgctgcgatcgtgcttgtcaacttgtcacaaaaagttgccaacacgatttttggcgactccactgggaaggagatccgttcatcgtcaactcaacttcgacttcaccatgacgaagccgccatccaagacggaggtggagccatctaatgtgataccggtcacattggaggattccgaaggagaggaccgcaaagctatggaggagtacatcaacgagctcacacgggaggcgttgatgagggcaagcactaggactcgtcaaggcgtgattattaagcccgggccacgtcctaagctcgcccccgacttggtaagtaatgatgaggtaacacaatctatccaacaacaagtagcatctacaatagattcatctatgattgcttttaaagataagttagatgcaacttttgagggtaaatttgatgagtttttaagggttaaattcggccctcttatggccgattacatgtcaaaggataaagcctctaccactgctaaccaacctcctatagatcaaacgggtagtaaaaccgatggagcggcgcacacggccggtctgaccgggcctgacggccggtcaaaccacgacttagccgtcggtctgaccggccaaacggccgatcagaacggcacaattataccgatacaggggatcgatccgatgactaatgctagttatttgtatcatcttagaacatttgatcctcctatatctactgctgcaaataatctccaagttcccccacatgttcctaatgcttataatgatgttgctagggggtatcctcccgatactagacaaggccaatataatcatattgcggaacaaacacaacctattaggccaccaaatccaccgccaaatcaacatgggcttaataatatggaggacataattagtgagattattaggaatagattcgggattgaaactgggtattgtgctagggtttacaaaaagccgtatcctgattattatgataatgtgccgtttccccgtaattatagagttcccgaatttaccaagtttagtggtgaggatagtaagaccacatgggagcatgtaggtcaattttttggtgcaatgtggtgaggctaatagtgatacttttaatctgcgcttgttttctttatctttgtccggtaatgcttttacatggtttacttctttaccagcaaattctattcatacttgggctcaattagaagaaaaatttcatgattatttctatactggagaaactgagcttaggttatgtgatttaacatcggttaagcaaaaatataatgaatctgtcattgattatattaagagatttagagatgttagaaaccgatgttataccttgaatataactaatagagatttggctgatcttgcttttaatggtttaattgctcctcttagagaaagactagatggccaacaatttcttgatgttagtcaactcatgcaaagggctctggctcaagaaagccgagttaaggataataaaaaacttgtcagatcttatgacaaaaagcctaatgttaatgtgattgattaccctgaggctagtgatagtgaggaggagggtgatcatgatatatatgttgctgaatggtcatggactaacaaaaacaagccttttgtttgctccaacctaatgccgactcctcgcaaagatcggcaaagtgaggttaaatatagttttgatgtggccaagtgtgataagatttttgattatcttttacaagaaaaacaaattagattacctaaaggccatgtcataccatctcaagaagagtttaaacgccgagcatattgtaaatggcatgattctcattctcattctactaatgattgcaatgtgtttcgacgacaggttcaatcggccatagatgaaggacgattgaagttcactgatggctccaagatgaagcttgatcatgatcctttttcggtgaatacaattaatttcaatgataaaaaggtgttaattcggccggagcaagcagaatctactaaaggaaaaggagtggtcattggcgagccaaggcctaagatgatagtgacaaagaaaccggaagttagtgtttggaaggagaataagagtggcgcttcaacttctaaagcccctaggaagaccaaagtgacttttggtatgcttttggagaagtatgagaagcaaggtggtgagagggttcacaacaaggggaaaagaccaagatcacctcctagggagcgatttggtcattcaccaagacggtcgcattcacctccatatcatcatccacaagacatgtcatggggttcttatcgaatgtcgccgccgggttatccttatccttacttcatgccatggggggcaacgccgcaaattttcaatcatatgcctccaatgcaatttaaccaaggatggggaggaccgaggaggccaattcatgagcgtttctcttcaccaaacaataggcggttttatggtaagaatcgggctaataatgaaaagagggaaggaaagcgcgtcaaggtggaggcaaggacttcagaagtaattaccatcaaagtggggtctcatgatgtgccaataccttctggagatggagttggagtatcctcaaacaaaaaatccgaagccaaaaccaactcctcgcagtcggccggtctgaccaggccttctggccggtctgaccgcagccatgcggccggtctgaccgggtcatcaggtcagtctgaccgccgacccgacagtggtccgaccgatgcctcgggccggtctgaccgtgcgtcaagtgtcggtctgaccggcatgtctggccggtctgaccggtggtctacgtccggtctgatcaggctccagcgccggtttgacaggggaattgcaaagggcgatatgaaggcttcatcgtcttcaaacaagattaataggggacattatttacctcctagaacagagccgaatcctaggtggatgcctaaggatttgacggctactcaaaagagaaggttgcaacgtcttcgggctcaagagataagagagaaaaaagctgaagaacaaagagataaaaggttcaatgagttgcgaccgccactggtatggaggcgtaaatccatagagaaggaaaagccagttgttgtagaggagagggaggagcaatcggttgataaaggtgaatcatctccaaaagaagacatggatatcaacatggtatgtatgttgcctatggagttttgtgctatggatgaagccgaggttgctcaattctcattaggtcctaaagacgcggtttttgagaagcccgatgagtcaaaccgtcacatgaagcctctctatctcaaaggccatgttggtgggaagccggtctctacgatgctagtggatagaggtgccgccgtgaacttgatgccgtattcattgttcaagaagttggggcgtgaggatgatgagttgaagaagaccaacatgattctcaatggcttcaatggtgaaccaacagaggcaaagggtatcttttcggcgaagttcaccgtgggaaacaagacgctaccaaccgctttcttcatcgtcgatgtgcaaggtaactacaatgttattttgggtcgttgtttgattcatgccaattgttgtgtgccttctaccttgcatcaatgtttaattcaatgggacggcgatgatgttgaaattgttcaagcggatacatcggccgaggttgcaatggccgatgctacttttgagtggcgtcatgggaatatccaatgcttatcagggagggaactttctagctatgattttattagtatctccgatggcaaatttgtacctatttctgtaaagccggctagtgtagcacggctaagccatataaatttgtataatgagtaaagaggctaatttagagtggttacaaaagagggtgcaagaatatcggtctacaaagaacgatattggcgaaaccattgaagattttgatgaagtagagaagcttggacaagggtttacatcggccgatccattggaggaagtggacataggtgatggaaccaaaccaaggctgacttttgtaaacaaaaatatgagccgattataaggttaagataatcgagctacttaaagagtatgttgattgctttgcatgggaatatcatgagatgccaggtcttagccgtgagctcgttgagcatcggcttccaattaaaccaggttttaggccttataagcaaccacctcgtcgttttaatcctttgctatatgaccgagtcaaagaggagattgatcggttgttgaaggcagggtttattaggccatgtcgttatgtggagtgggtctctagcagagtcctagtggagaagaaggggagtggtaagattggagtttgcatatattttagagatctaaataaagctactcccaaagatgagtatcctatgcctatagccgacatgatgattaatgatgcctcgggtcataaggtgattagctttctagatggtaatgccggctacaatcaaatctttatggcggaagaggatatgtacaagatggcttttaggtgcccaggatttgttggtttatttgagtgggttgtcatgacttttgggttgaagaatgccggtgcaacatatcaaaggacaatgaatttaatctttcatgatttattaggtattatcctagagatctatattgatgatattgttgtcaaatcggatggtatggaaggacacatggccgatttgaggttagcttttgagaggatgcgccggtatggtttgaagatgaacccacttaaatgtgcttttggtgtgtcggcggggaagttcttaggattcatggtgtatgagagaggagttgagattgatcctaagaagatagagaagattcgtgatttcaaagcgccgacatgcaagaaggaggcccaaaagttgctaggtaaagtgaattatttgagaaggtttatttctaacctagcgggtaaaatcgatgcttttgttcctatacttcgcttgaaaaaagaagccgatgttacttgggggcaaaacaacaagaggcgtttgaagagttgaagagatatttgtctactccacccgttgtacgagcgcctaaagctggaaagccttttcggttatatattgcctccgaagacaaagttattggtgccgttttgacacaagaggaagatggcaaggaatatatcattacatatttgagccgccgtcttttagatgccaaaacgaggtatgtttttatagagagactttgtctatgcttatactatgcttgtaccaaattgaggcattatttgttatatagtacatgcatagttacttgtcaagccgatgttattaaacacatgttgcaaaggccaattctaagtgggagaattggcaagtgggcatatgttttgatagaatatgatttggcttatgaaccattgaaatctatgaaaggccaaattgtatgtggttttatagtagaccatcatacagatattgcttatgagggagaggtttgcttagttgaagttataccttggaagatttattttgatggttcttcttgcaaagaaggtcaaggcataggggtagttttcttttcacctaatggcatgtgttatgaagcatctgttcgtttggagtattattgtacaaataagcaagtcgaatacaatgctttattgtttggcttacaagttatggtgatggttggagctaaatacatggaagcttttggtgattcggaattggtggtgcaacaagtcaccggagtctacaaatgcttggacggatcactaaataggtacctcaattcatgtttagatattattgccaattttgataatttttctattagatatattgttaggcatgataattctagagcaaatgacttggcacaacaagcatctggctataatgtgaagaagggattatttctgatattagaagagccggtgcttgattttaaatctttgtgcgaaattggcaaaactggagaccagggatggtctgaccggcattgcactgccggtctgaccggtaaccaggggcggtctgaccggccgcatgctgccggtctgaccggcgacccagagcggtctgaccggccctgcgtggtcggtctgaccggttctgggcagaatgctggggggcacgtttcaatcaatttagaggctgaattaactgtgaattcagacatttgtgcccagggaacagaagaatattggagaattcctttgattcgatatttgaaagatcctacgcaaaattcgatatttgaaggttgatcgcaaaattcggcggcaagcattcaaatatacattgcttgatggagatttgtatcgccgaaatatagatggtgtcttgttgaagtgcttagatgaagatcaatctaaagtggctatgggagaggtacatgaaggaatttgtggaactcatcaatcggcccacaagatgaattggttgcttaggagagctgggttctattggccgaagatgattgataattgcttcaaatattatagaggacgcgaggcttgtcaacggttcggcaatgttcaattggcgcccgccgccgtgttgaatcccataatcaaaccatggtcattccgaggatgggctttggatttcattggtcaaatttatccttcgtcatcaaaggggcataggtttctgctagttgctacggattacttcaccaagtgggcttcgtgcctttgaagaatatgactcatacagaggtaattgactttattttgaagcatattatccatagattcggtattccacaaacattaactacggaccaaggtgcttcttctatgtctaaggaagtgaagagttttaccgaatcttatggtattaaattgttgagttcttctccttactacgctcaggctaatggacaagccgagtcgagtaataagacattgttgaagttagtgaagaagaagattgaggaacacccaaagaggtggcatgagatgctttccgaagcattgtgggcgcataggatttctaaacatggtgccactaaagtcactccttttgagttggtttatggtcaagaagccgttttaccggtggaggtaaatcttggttctcttcgttatatcaagcaagatgatttgtcaaatgaagattacaagacgttgatgggagacaatcttgatgaagtcatcgacaaccgcttgaaagcattggaataaatagagaaagagaagaagagagtggccaaggcgtaaaacaaaagggtgaaagcaaagttgtttcaagttggagacttggtttggaagacaattttgccattgggtactcgatccaaggagttcagttagtggtctcctagttgggagggtccttatcaagtatgcggcattgttcgagggaacgcatattttttggagacacttcaaggggagcgttttcagcgagcaatcaacgggaaatacttgaagaaatacttcccgagcgtttggcaagacgcttaggaggtactatggctggtaattgatttatcgtcctaagaccaaaacatgttctatgcttttagattcacgttgttcatcaaaaaggcaggggggcatatgtttacacccaaatttggcacctaggattaaaataggaaagattgccaaaatttggaagtctaccggtttcctccgagtgggccggtctgaccgccgtgtcttggccggtcagaccgccggttgagagccggtcagaccggcggtgtgtggccggtctgaccggcaggttcgagtccgactgtgtttcgtcgggtctcaaggtttccttgctcgggaaggcatgttttgggtttcctttggtttctaccccgagttggacgtggaggagggcctgtagagggcaagaccaacacctatataagggacatggccggttcattgtaaaaaatcaatctacaatcaatcaatcgaatcgtttttcatattgcttttaattttctcttagtttgtccatctttgtcggtttgcgccgtaaaccgtccaccgccgctgcgagagtgcgacacctctttgtaggtttgtcctgaaaaccttccgttttgcccacaagatgggtagttatctagaaatcggctccgctagccggtttagttatcaaaacccatctaggtttagctctttgctagatcgaggtggttggcgactctaggatcaccgcaaggctttaggtgctgcgatcgtgcttgtcaacttgtcacaaaaagttgccaacagtaggtccaccctgctgtcctggagtgaagcgcgatcgctggtggtttccttggttggaccggaactacgctgcctttctgttcctgtccattttgttgcgctgatcctcctgacggattgccttgtcaacctagttctcaaagttggcgtagtctctagagatcaactggttggtcagctcgtcatccaggcctgctaggaacttctcctgcttctctacgtcagtgcggacatcctccggtgcatatcgcgctagatgattgaactcatggagatactcagacactgtcctgttgccctggtggagggctcggaattctctcttcttttgtgccacgatctaccatgagttcagcccaatgttcaattcacaaagactagggtgacaaggaatcatgggcaatcaataattatcaaaggtaggataataataacaattaggtcacgctacccatcgatggtttataaacaaaacaatgcatgtattcaaaacaaaacatttcacaaatgggttcaatatgttcaaagagtgcacttgccttgatcctagtactgtccttgcacagcgtcttctgaagcaaactgctcttccgctccaacgtctacacgattgcaaacgaaaaacaaataaacacaaagaaaaaataactaaataacatcaaatgaaataaccaattaaatcaggaggtaaagctcgattttagaagaatttaggaggaagaatggatcgaatcggagttcaaacggaaaagttatggcctcctgaagtttgaattcggggaaaatccgaggataaaagaaaaaggaatattccaagaatattctctggatatttaatttcggaaattgaattaattttggataggaaaaaatatatgtgggcccactgtcattggcatagtgtatgggtggactcggtgtatgtggactcgatgacgtggaacgacacgtggcgacacaaggcgatgaggtggcactgacatggatggatatagggctgacgtggcgaaagaagggattatgtagatccaactgctgggatttgatctagggatttggacggcttagatttatttgaggattttggatggcaggtcccacacgtcggtgtcacaggggagaaggcaagcagcagctgctccatcacacggcctgggcgtgctctggccatggcaggaccggcggctccagcgcggcggcatcggcggctttcgtcggcgatggcgcatggcggctgcagcaaatagtggtggaggcagaggaggtggaggccaacgcggtggcgtagcaccgagctccgggacggcgtggagatggcgcacggcgatgagaggcggacgccggagttgaggtggagagagaaacggcggctcgaaagggagagagggctcagcctcggggctttaccagcggcggcggcacgggaaggagatggtgacgacgacggcgcggctcccgacggcggcacgaagcaacggtggcggcggctgctcacggtggagatggcggcggctttggaaaaagggggaaaaaggggcggtggccgatggtatttataggggagggagtagctagggttagggcgcacggtgcaagctttggaaaagcggcggctccgaatttggtggcgcggcttgcgggatttggcgtcggccgtgtgggcttgcggcgcggccggcgcgggctcggtcggcggcggcttgggccggcgacatagagaggaggaggaggccgggccgcggcggcacgtgggctcggggcttggcctccccgggcctgcagctcaagaaggagagagagagctggaggtagaagaaggtgggggaaaaagaaaaagaaagaagaataagggcagaatagagaaacagagaggaaggaaaaagggaaaaagacagggacttctctggaaaattccaaatataaagtatttgaaatttttgggaaggatttaggatttgaaaaggaatattggatttggatggaatttgaattagggattgagctccacttccgaaatacaaattaaatccaactaactccaattaagaatcacaaagcgaacaacataattaattaattaatcactttaaaaccgtttgatttaacgaaattttcattaagctattttagacgaataaaccaaatgtgaaatttcgcaaataggcgagaagaacagaaagcgaaaaatcaggacgtgacagaatttaaactgcaattgttttgatctgaattaaaacacttaaaacagcaagcaaatccttattaagacagccatatcataggcacatgatatcgactgtcgactgacccacaagcgaacaatcctaaacacacaaactaacaggcaattactaaacagtcgataaactaagggaaaatgagcctaatgctcggaacggctcctgcagtcggtggagtcgaaggcgtcctcctgctcgtcgccaggcccctctgagcggctcctggagtctggcagatacgtctcaccgctgcccagctctgagccactggaactgctgctgctatggtcgcggctgccactaggagtagtaggcaaccaacctccgttgccactggctggacccctggcggctgacgctggagcgaaggagagagcggacgcgggagctgacactggcacaggagctggggctggagctggagctacgggtgctgcgggaggagctgcgggaagaggtgggttcttgggtgcaagctgaatgcgcacgggagcagtcgtagacttgcggggcgtggtgcggatccgaactcctcctggcgctggaagacccttcaattgagcgttctccttcttcaggcgtgctatctcatcctttagagctatgatcctcacaagcttcccatcattcaaggccttggatgccttgtgcaggtcagagtgcatcctgtccattcccctcatcacggcgcacatgtggccgaaggtggtgttgttctcgccggctgtcgggcggaaggtgctggcgtcgtcgccacttgctcggcgagggtggaagcggtacgccgtgttgtagaagatgtagttgtggcgatcacgaagtctagccatcatcagatatgctgcctcctgacaagcgtgatctgcggagcctccagatgcctcaaccaccgtattagcgaggcaggtgcccacatagccatgaacctccagacgaaaatggtggggaagctcgccactgagtggaggaacggtcgagtactccggcacgttggggtagtgttgagagaaaacacgaggcctgggagatctgcttaactccagtgcaggtccaaagctcgccttcgggtgtactagcatgccagttgattttatcctgtaattaacaagaaataaaggcaaagaaaccgcggttaaatctataaatgatagccgatcggctaggtgccgatgacatatcatttatctttgagccgatgtcatatgtgaattgatcggcagttgtaaatagacaataaagaaccaaatctattcgatcggctgtagatatttccaatatatagttcttatatcgatatatacttaaatcaagtgattgggatagatcggccgccatgccaagacattataaatcacttagatcgaagtatatattaataacagggctatatatgtttatagcatagccgatcagatagatctagcatgtatcggctaatactctgatactactctatatcaggatattaaaacaggtataatatatcaaacaaaggcctaagatacttagatacagcaatatcttgacataatgggcagatttaacatgtcaatgaagcatatagagcaaatatagttaaatcagataaggtcgactgaaactccgatgctaccctaatcggcaaccagaaggcaggctagagattgatattctaagcacgacttaatagatcaaactcaactgatgcagcattaagtatgaaaagaagaacaatatctagacaatcaagccgctagaagtttcatagagtggtagataccttatacaatctaagtcaacatcgatatctaacctaatcggctgccttctacagacagatgttagccgattgtagattagatagcagtattgccggagattatgtaagatatatgataactcgacgaattacataaacgagatcagagtatcataaagatggaagcactaatcccgagaacacaagtcgtcataacaagttttacctcttgttgaagatcgaaaccgatgcagctttatgatactctgaattacaagatatgtacataacggacacgactactatctctagcaaactctaagatagcataagtctttgtggcagacttttgcccaatcgtatctctaaggagattacataaaacaccctaattaatagatacaattgccttctcaggactctatccatgtgcggcaatcaccttgaagcacctcaatccaacccgatatcatacatcaagctgcattgtcggaatcagctgtatcggcttacctagtctgactcagacccagccgatcctaatcgtagccgatttggactccagcgattcctgccctgtttccgaactcgatctccgcctccaattttgcttcgatctaatcttctttcatgatgctgatgttaccaaattcggttgttaacaggtagcccaccaccagggtcatgcgagccaactctgccacaaaatcatccatgccttctccgtggtggttgggtgggtggtcggccatctagagaagacaaaggggtaggatcaatgcatgctcaaatccaatttaaataaagtagtaaaagactcaattaaaatgaacaattgagagcagagttttgtgcatagaccatttttgcatgagggcgaataaataagacggacttacatagcgataaaataatgagaaattagatacatactaataataataataagagcattaataccttgcaacccatattcctgagttaggacctaatgcattcctcccatcaaaccctagactgacctaatttgacaaatctcacttaaacgagcgaccaagatttttcccttgaaccacaagaacagatcccaattttcccggaacaaatccaattgcaaagaacatatgcaatgaaaaggattcagagggctcttaggttttttcccatttggcttgtcctacggtcaaggttggctctgataccaagttgtcacgcccagaaattcccgaatagaattccaagcagaatgtgcattaaaatccccatccaggaccggccggggggtacacaaacgacaaagttgacatacagatccacgtcttacaaaaattataaaagtcttacataaatgtagcggaaaaataaaagataactggagctaagccttgacttggactgcagcgggaacaccagtccacaggcatcctcgacggcacgaacgaagcctattcctcggagaaaccaccatctaacgcatactcaaactctggggtttggggaaaatagagcaagactgagtataaccaccacactcagcaagtcataccggaacagggggtatgatgcaggatattaccaaaggatagctagagaggttcttttgcgtaaaacgagcatttataacagtagttgaaagcaggaaatcaggtgtaataattaatcaatattagccatccactgtccaacgctacaccacgttgcaacaggcccaaccaaccacctgaactaatcagttccatcatattaaactagggtgagactaatcacggtgaatctggttgaccgcccataaccgcgagcacggctattcaaatagttttactctgatcagaggtgtacaactgtacccacaagacacagccccacgacacgtttccgtgcgccgacatgccaccacgacataccggaaagaggccgtgacaggactcttcgcataaccccctctagccaagcacaccacacctcaggtttcacccccgtccccagcgggcaacgggcagtcccctctcgtgcctaggtgaatccggaagcgacaaaggccgtcacagggcccgccctgctccatcacgcccaccctttcctggatgcgtcaactagaggaaaactacactacaagcccagccgttgcacacgctggcttgtggtaagtatgataagttcttccagggcatcccgcgaaccggtccttaaatgccatgggcgcgaccaacaaaaccatgcacccacagcccaccatttgatatattttaattaaccaacaccggagcggtggcattaaccaacgtcattactagaatctgatatctatgcattaatgtgatttcccccattgtgtgctagttgaactaagcatggctaagcaatccctagtccaatctctagtcatgtttatatcccaagctaacaaaggagcatggtacagaaatagcatggctgtaacagtaggtaaacatcccatagtatcattatgaaacaatgcaatatttgaaggaaaacaatagaacatttgcaatataggatcaacatcttcaagtgacaagcatgacttgccttgctctgctgctggaggaacctcggcgactatttcaaagtacaccggagcgtcgggagagccggaatctaagcgacatacaaagcaaacaatacaaacaggcaataagactactgaaacagagaacaaaaccatttttaatggattctactcatttttcttgatttactgagacttgaatgggcttaaacggagctcggatgaattagatatgaattttagaagattcactgtgcttttactataaacagaaaaatccttaattgatttattgcgcaataaatagaccctaggagagaggggcggcgccaacatgtgggccccacatggcagtgactcgggtggcggtccacagtggaccgagtccacggaccggagaagggggaggcacacgacgtggcgctgacgtggcgccgacgtggcgcacacgtggcggccacatggcacgccacgcgggtggccgaaccgacggccccgatctacccgagagtagatcggacggcggcggggagcacgcggccggcacacacgggcggcccaagccggcccgatggccacggtgcacagcggcgctaccgcagggcggcggcggcagacagcggtgaccgacggcaagcggcggcggcgcgacggcgcgggtgatgctagcggcggctaagcagctaggcggcagcgcggcgactaagcggcgtgggagagagagggaggaaggggaggaggtgtctcaccgacggcgattgatgacggcgagcgacggagggcgatgacggcaacgggacgagctctggaaccacctagcgaacacgatgaaaggggttagagagagagcaagatggaagagggcgaggacgccggccgaaggcggtggccatggcggtgctcaccggcgcaaggcgcggagtgggttccggaggcggaatccgacgggagaggggcggacggggtgacctgcacgacggcgaacgtgacggcgtcgacgacgcggctcggcgcagcggctagcggcggctagcagcgaccggagcggtggcggcggcggcggaaaggagggcgacagcgctagggcgatagagggcacgggagagctcgcgaaatggagaaaaagagagaggggagagtggggatgcttaaataggggagagggagctcgaacgtggctaggagaggcgggaatcgccagccgacgtggggtagtgggagaggagagagaggcgggatttgaaaatcgaatcctggccgtctcgagcgcgggcgcgggcgggagagagagggagtgggcgcgggagacgtgggcgcacgcgcgggcaaggccgacgtggcccggaagacgcgggagtgagggtgcggcggcggctggaggttgggggaggactcgacaggtgggccccacctatcggcgaccccgggagagaggaggggctcgggcggccagcccagcgggaaggggagggaggagagaatgggccggcggaccattccgaaaagaaaagagggaaaaagaaagaaaaataaggaaaagaatttctagggaattaaatattgcttgtggtcatttttaattgattaaaattatttctagagctcttaaaattccactaaaatcttgttagcgtatttcgacatgtagaactcaggaaaaaatcccacatgccagttccgattattatttgcatcaattattttagggtttctctcttgcttttgcagcggtattttgttgagaccatttataaattcaatttaggcttgggagaaaaatctcagggtgtgacactcacccaagatactccaatatgtccaaaaatcttgttttggtgctttttgaactttttcattccggtgaaaaacatcgcacccacgtgtgccaacataggccaatattggcattaatttacaaaagttcgccgcgcgattcacggagtgatttttcgacacggacacacccaattctctacaagtatgtccaaaaacatgttttggtgctttctgaacgttttcattccggtaaaatacatcgcacccacgtatgctaatataggccaatattggcattaagtgacaaaagttcgttgcgcgaatcacggagtgaattttcgacactgatgcacctagtaaactccaataagtcctaaaatcatgttttggtgctttttgaactttttcattccgggaaaaaacagcgcacccacgtgtgcgaatataggccaatattggcattaattgacaaaacttcaccgcgcgagtcacagagtgatttttcgagacggacgcaccctgtacactccaatatgtccaaaaatcatgtttttggtgctttttgaactttttcattccggtgaaaaacaactcacccacgtctggcaatataggccaatactggcattaattgacaaaagttcgccgcgcgagttacggagttatttttcgacacggactcacccaacatactccaatatgtccaaaaatcacgttttggtgctttttcaagtttttcattccggtgaaaaacatcacacccacgtgtgccaacataggccaattttggtattaattgacaaaacttcgccgcgtgagtcacggagtaatttttcgtcacggactaacccaacatactccaatttgcccaaaaatcatattttggtgctttttgaactttttcatttcggtgaaaaacatcgcacccacgtgtgccaatatgggccagtattggcattaattgacaaaagttcgccgcgcgagtcacgaattgatttttctacacggacgcacccaatatactccaatatgtccaaaaatcattttttggtgctttttgaagtttttcattccggtgaaaaacattgcacccacgtgtgccaatagatatctatattggcaataattgacaaaagttcgccgcgcgagttacggagtgatttttcgacacggactcacccaacatactccaatatgtccaaaaatcatgttttggtgcttttggaagtttttctttccggtgaaaaacattgcacccacgtgtgccaatataggccaatatcggtattaattgacaaaagttcgccgcgcgagtcacagagtgatttttcgacacggacgcaccctgtacactccaatatgtccaaaaatcatgttttggttttttttttaactttttcattccggtgaaaaagaactcacccacgtgtgccaatataggccaatagtggcactaattgacaaaagttcgccacgcgagtcacggagtgatttttcgacacggactaacccaacatactccaatatgtccaaaaaatcacgttttcgtgctttttcaagtttttcattccggtgaaaaacatcgcacccacgtgtccaacataggccaatattggtattagttgacaaaact

SEQ ID NO: 66389 - DNA, 19615 bp, Oryza sativa
cctttggaagggcgatttttaaaatcgccctccccaaggggacgcggatcctctgactttacttgctaaagtcacggtgtgactttcgaccaatctccaccgtccgactcatccgatggaggacgtctcctgcgggctgcttttgggccattaaatgccatttgattgatgatcctaaccagcgattagtgaacctaattacctaaccaatataatactacatgagattagtcagataactggaaattacttctaatctgtgtgctaaattgctgattccatgtgaatatattactgtgtaatcagcattattgaaaaatttagtgtaagcagtacatgtgattagttttctcgccagaacgtatcgattgatatattgcacgtacgtaaatgagatccctccaaacattttattacgaagaaattgtaagcgtgttggggattgaacacgggacctcggagtcaaaatcacaaatatcaagtgcgtctctatgttccacgtatatagcaatgtatttttatacatagttatttgcttaaatttctgttgttattaaaaaaatatacgtgcgttacaattttttctcgatctttcaaaattgatcgaggactttcgatccacttgattttcattttttttcatttcccaaaaaaacgcgggaaagcagctttattatttttagtcaccaaaataaaaaataatttcatgcagttgccggcctaatctctcattgagtagtattgtttagatttattacttgttgggtagaatcagtaataaaatgacattcatctgcaacagattagaggtaactagccggtcatcccgtgccttgcacgggttattggtattggtagtataaagatcaaaattttaaccatacgtttactacgttggttatattcgaattctagcatgttagattgaaataatagttaactactccgtttgtctcagaatataagtatttttagaattagacaacggttattaagaaagttggtacaattaaataggggagtgttgtggttgaaggagaagtgaagataggtggaaaaattgaatggtggaggattgtgatttgttgagaagagaatgttggtggtaaagttgttatattttgggacaaattctaaaggctagaagttgttctattttgggacggagtgaatactacttgttaattattaatttcgaattaaacaaatgctaaatttgtgatacatccaacttatttatttgatattgtggaattctggaattaattaagtatttagttgtgtctgtggtcgagtttaaatttaagtgcacccagtaattttataattttcaaattcaaaaaaaaatagttatactcagtatggaccctagaagatataagatatatgcaattagcttttttctctcgtaataataattagtagtgatgtatggtctcttgtctatctgtataaattaaagagtccacgatattgccaattgcatgttttatttttcacaaaccctaaataaactctaatgctatgattttgcgattttgccatgatacatgctttttaacgtgaatttggtcacgtctatcagatcaagcctagattgtttactcttgctgcaagtaattctcatatgaacctacgtacatgataaatatttgtttccgtgcatgattattcgcttaataggtttctagctagttcaaatagataaaccgtgtgtaggattaattctgaatttcgttctctttacgtcgcatgatttactatcgagaagaatatttatgacatcccaaagagtcaggattgctaaaattatgggggtaaaatttttcacttaatttcacgtcatgtatcctatatgatactctagtaagtatgtttctctctctctcatttccttttccaagtagataataattaaattatttttactcctaattcttataaactgtgtactaaaaaacaaaaggtaaatattgaaatttataatgtaattatttatgttatgaaatttagcgtgtaattaactacaatgcaagtgtatgtaatatattgtagttacccttcggttttcctaaaagaaattgtatctcgaaattaggctgctaaaatatacttgtaaatggagctctatatattaactgaaatacttgttaggaaaaattgatataaggactaacccaaacgaatgaacatgaacagtaagctgcaaactacatgtacatatatatgcattgcatacgggatataccgggcatatggaaaattaaatatagttgattgcattcagaaaattataatcaatatatttttatctgcttgtactgtcattaaacaacttatcaaaatcagaattgacaacttagaacttgcaagtttaatggaatagaaacacacattcaatatgcaaaagatgatcagcaaatagttgatcattccaatcaaaaccataaattgagtgcgtcctaattaaatagactgctaaatatatattgcgaattgaacacgcaaaccatgcaaattcaaaggaatacgtatatatgtatattgtagatgcagcaatagatctgtagcagacgcagtgacggatgtgcaagcaatttttttattttgtagcaaacttttttccccagaattcatttggttaaatttcgtttcaggttaaaattaatccaatctttatggagtaaaaatagtacctgctccagacgtcaaaccagagacttaacagggatgaacgatacctctggagcgagagcgatcactgattcactgcaacttttaacttctcctcgtgattgaggcaaattatcgctgatcgggaccacagtctgggatcaaggtcgacgatcgcgttcgccgtttcttctatcgcttctaaatttccaatctgatttctcacgatggaacttggagacaaattagatgggttctgtccttccatcgataactcggtagataggatttgcaagtagcccaccgagtttaagattgattggcccacaacgttaaagtattgcatgatctacggtgtagattaaaggaattatctaattgacgcttagatctttctggttaatatgagagctccaaaaaagtgcccgattagtataggtatagatatagatttttagttatcggactaatctcacgcagtattatattttatagataattaggttcattaatcgctggttaggataagcaatcaaggcatttaatggcccgaaagcagcccacgggagacgtcctccgttggatgagtcggacggtggagatcggccgaaagtcacaccatgactttagcatgtaaagtcagaggatccgcgtcctccccaaggggcggtgggcgactagtttgtaaaattttcaaacacaaaattagttttgtaaatattttaataaaaaaattaaaaataaaaaaaatcttcggaagagctagcttctgcagctacagcgtctaacgcagctaagctagcagcggctgagatatacattcttgattgacagctgaacaactaagttttccagtgccctgcagcccaactgccctaacagtgtagcagctacaaaaacatactaccgaacaggccctgctaaacacgtttgtttgcccatattgaactgactttctactgcacggtcatcgtttcgagaacctgaagtttaactatttgataggaaaagaaacatcaaaagcaatcaagagtagataacgctggtcgaattactagtgagttcccattgtcgataattaaacagagaaaaacacacgaatgcaacgctttggtccaggatggcagcttcaggcagcctcaccatccagtgtccaggataggatttcaaaaccagttctcccttaaggaaatgtgatattcttggcgactgagttcttctctcatgcgactgtgttcttctctcatgctactgactggcttattgcgttcatgtgctttgttcagcttcacatgcatctttggcctcctttaccaagtcctccagttgtttttgtgccataggaataagttgacgggcttcaaccatctcgctgtaggcattcatgaaagatctcttacggatcttcccttcatacttatgtgcatccttcactaacttcgacagctcatcttgtgtaaacatctgaaagaaaataggtatgcttcagcgattcagcccattacaaaaatgccatgatgaaaatgttacagtttaccgcttcctcagctgtagatctttctgtggggtaacatatgatcttaatacccgtagcaagtttcatcaaatcccagtctaaacatttaatgccagaccgtttctcaatgtattcaccagtccagcgcaagtgcttggagtttttcacatcacagtattcgcaatcaagcaagaagcatgccagcttaataatagagtcagtaacctgggtacaaaagagcattctttcatcactaataaaaaaaatgtaagtaaatattgcattctttgggaaaggacagttaaggattccaagtgcacattgaacaaactatcatataaatgtgtgatggggaggcattgacattaaggaagcaacttgtgaactcaccatctctggtttgacatccaaaccatagcggttaaggagcatgtacaatccttggctcattgggaggtagtcgtccttgctcaacttcattttttcttggggtactaaaacatgcatcagattcttcaggccccacatcacttccatcacaatttcatcaaacatgcagggcacactctgaaagaaatgacagcaaaattggtgctcaaggttgtccactaagaaaagcaaacaagggagctgaacactaaccaagcttctttcaatgatttctttatattcgggttttccaacggccattttctgcccagggtgatgccacttcatgatcatctcagcaaggtcgcaactgacaccagtatcatgattaatggcactggacttgtccttgatttctcgaaattccttcagccaaatgaactgatagataaacgaaagagaagaatgttaaggggcaaaaaataaataaatccagtaaataatcatgcaatgtctcccaatcatgacgcatgcaattcagtaggtacaccgcaatcagtggttcaaaaacagtggacgctaagcagctagttccaccaagcaaacctaggcatgattaggcacatgtaaattttactacatagagtatgtactatcatattacatagagcaaacctggcatattaaatcatagaaactggcatatcatacatccatgacatcaatgatgtaaaatcttcatctctaatttgccccacttctctgtgcagacccgaaacaacactaggcaggaaaacaactagatgcaatcctaggtgctatgaaagaggggcagctgggcccagttactagttagcccagttactaattttgaattttgaaaagcggtacttctcaagatgtgctgccaagaacagctggaatatttaatcacaatcgaaagatctagcctttttcaattccttaagttcttgcaatgtgattgagaataagttgttgtgctaaggtaatatacaacgcattttaaaaacaaacaaagtgatgttctttcggttaggctgtggtgttcattatcccggtaaccctggctttcggagcatgttagagctcaatcatccctatcccacagttagaaaataaaattggttgtatagcaaaggttttagcctgcaacaatccattctttaaactataacgaacaactttcaacagagcattatggaaaaaatgcattttcaatcagttgatcagcaaacaaaaaaatgaatactgagcttgtgcttgcatttcttctctcaatgcaaataaaaaggaaaatgtaaagtaaatgtggtggtcaatacccaattcaaactggcaaccaacaacgcaaaaaaaaaaggaataacaataagaagaaatgactaactttggataccctatagtccacgccaaagtttgcccagatttcctgtagttggtagagaaaacagaaaagttaggtcgatgacaaagagagaggcaatcaagcacataagtaaacagggaaggaataaaagcatgcacctgcagggcatttggttgaatgagtctgtccccactcataccgaacattgcgaagccagagggcgtctcaaacagaactaagactattagacaatggtacgtattgtgatctgcgaacacacaagccaagcaaacttaagcaacagcaagcacgaaggactgcaagaggcaacgagaggagatcaatcgcccattcagtcagcacgcgtgaagcaaagatgtggatcttaggctgaaaagccctcatctctgcgaaataaccgctacatctgccacgcggagtcaaactgccatgaacagggtgttcacagtatgcgagatcgacaacaaacgggttccgtgcatacaggaatcgcctccccagatctatctgctcttcccatgcgatgcatgtgctaccataagttaaggatccgctaggggtttgctttctcatcctcacacgccagttttccttccgacgtgggagggatcaagagagggttggtggctcacctacaccggcgattgaccccgccgtcgccgtacgagtagcactgcatcctcgcttactcgaggtcgaggtcgaggtcgaggtcgaggtcgatctctttcctgtcatggtgtgtgagattgggaccgaaggaagacgtctcaacgttggcttcctaataccggcaacagacgccgctgccggacgagaagcacctccgccgcacagattgcgagatgtgggggttggggggagggggggagtattttaccttttaggccttgttcttttaggctgggtttgggggggaatgggccaacatccccgtgtgccatcccggccgggtcgaattttcttccgtggcccatgtatgcgttcgcctgggccggggtgggagtaattctccacccaatccacaccaatcccacggggagagaaaaatcgcctcggagacgatttttttttccaagccagccgcagcgctcggcctcctcgactcctcgttgcgctagggtttggaggcggcgtgaggtccgggaggcggcgcgaggtccgggaggcggctctagggtggagatccaggagcagcatatctccagccgctgccgctctccatcccgccctcggacgccgacgatctccatccagcttcagccgccgccggtctccatcccgtcctcagccgccgccggtctccatcccgcttcagccgccgccggtctccatcccgcttcagccgtcgccgccgctctccttcccgctctccatcccagccagtcgccggcgctcgccatctctccttcctcgcttcggattcaccggttgcgggagagggcaaggtcgagggcaacagccccggacaccaagaagcaggtctgattcttgatctcctcttttcccactcagaaaagattttgtgacttatctagtggatgaatttgttgctagttgatgtattgagtggctgtatggattgaagtatcagtcatgttctgcttagaaggaggggtgatgtggtttgtagtagtagaacctgaaaccacagaaaattccatgcacatctctgtgtgtgtgtgtgcaaatcttgcctatcagttgctctgtaatcaaggaaatatatatttgaattggcagatcctatatttctgaacatgggctctcttctttcttttctttttttttgtgagggagaaacctggtttgttgattctccaggaattattgtagatgcagtgggagcacacctaaaaaataaaaactagtgcactctgttgttgctgtctagaatgcatcactttgcttttggccaaggtcatttgagcttcagattgaacgaccaatactatatgccaattgaatgagcaagaagatacaaaaatttgagcaagaagatacaaaaatttttaaagtcatgctatgaggtggtcaggtggacactgtagtatacattctagttttggtaattttttccatggctttttgtttagcaaaatgcccttgttaaaacttgagaaatgtagctgtccatcttttgttcgaatacctattttactcttagcaatcaatttagcatatttatctattctgaactgctactatgttcacaactagtttcaggaaactgggtgatcagatatattactagaggtcataccatacaaagctatataaattgctattgaatgacaaaaatataatctgttgtgctgaattaaatttcaggagaggcacaggcgtgtggggttggcaaaagtaaagctgaaggagttgatattactcaaggtatttgagaaaaaactaaatacagttgtacttacatttgcctgatatgaagcatttaatcttgcccctgcatatttactagagtaacagaagtaatttgaagttggagagagagagagattgtaggtacaatgttatgtgatcttgctcaggtggcagatggtctcagttttttttgctagtgaacaggaggttgttattttcaagtaaacatcctaccctagaaggatatcctcactttattaaagttgctatctctgaggtttaaacaaaactaagtacacaaagtattaaaatctgaacacattattgatccccctcctcccattgcagactgtttatttgctgaaagtattaaaagtatttatgcatgtagccaccttgaatgcctctaatttcatgtttaataatcttgtaatacatatgcatattattatgttctcacacatagtttaaagtatagtaattctatatctcttttagtgataaaatcagttcgagaatggcggatgaaattaaaaggaggagagaagaggacgatgatatgatgctttttatttttcctgcgatgtatatgctgtgcggtacgacaaatagtgagaaaatacctagacatatctcaagactatccggtaaagagcggcttcaagaaatccttgaaggacatgtaatggattgtaaagttgcattccgcatggagcctcatgttttcaagacaatagcgaattatcttagagaggaaaagttgttaaaggatagtagaggcttgaggattgaggagaaacttgggatatttatgttcatgctcgctcacaatgcaagctttcaagatctacagtatgaattcaagcatagtgggtctacacttcatcggcatattaagtctattttcaagataatcccagctctcacctatagatttctcaagcttcctcatgccaaccaaacgcattggaagattagaacaaatcctcgcttctttccttacttcaaggtgaatctggcactcaaaatagaaatgaatatctattccttctccaattaaataactcatgcatattctgtccttttcttccctttttgctgcagaattgcataggggctattgatggcactcacattcctataactatagatggagagaaggcagctccttataggaacagaaaagggactttgagccaaaatgtgatggttgcttgtgatttcgacctaaatttcacttttatctcatgtggttgggaggggtctgcaaccgatgctagggtccttagatcagcaatgaatagtggctttcaagtcccaaatggtaaattttttctagtagatggtggttatgccaacacaccacagttcattgctccttatcgtggtgttcggtaccatctaaaggagtttggacgtggtcatcgtcgacctagagactacaaggagttattcaatcatcgccatgccattctgagaaaccatgtagagagagctctaggggttctaaagaagcgatttcccatcctgaaagtaggcactttccatcggataaagaaccaagtgcggattccagcagctgctgcagtgttccacaacatgatccggttgcttaatggtgatgagggctggttggacaaccaacctgataatatagaacctactaattttgtcgatctaccagaaggtgacagtgaataccaaaatgatgtgccatctcttagcaatcaaatgatcagtgggaataatattagagatatgattgctaagaagatgtgggaagattatgttcgtaactagcaagaatagtatagataatattttggttttgcatgatttgtatttatttatgcaatcaacatttatgatatggacaaattaatagtaagcaacgtagtttgtattttctcattcaataaaatattgcaatatagttatgatgtttggaagactatctccgaaagcaagcctattgcagcagcaacaaaggcatccacaaaagaaggcatcaccaaagagctgtagcatacagaagaagaaggcttctccaaaaggtagtatctaacttgtttttttgtgaagtattttcctttcatattaatgattacaaattttacttactataatctaattttgtctaatagctcaacaatcaagagcttcatggaacccgggactagaaaaggctttagttgatttacttcatgagcacaataacccacattaccggtgccaaaacgggtggacaagtgaagcatggaacaaggtcgtcaaagaatttcgtgacagacatccctatgtcgccatgaataagcaacagatccaagataaggagaaggagttaaaacgagattataggttgcttaaggaggcaaggaaacagagtggagcttcttgggataatcaacggtgcatgattgttgccgatgatgctgtttgggcaaacataattacggtatgatattttgagcataattgttttgtcctcattcaaatcactattatttgtattcatgccataattatctgtttttgtatcttgtgcagtcaaatgagaaagtaaggaagttcagcaaaaacaaatcctttcctctctttgaatccttgggtgaactttatgatggtaaatttacttgatgccataattctttgattccttgtgcttacgttcagtgcagccaaccttgttatttgttttcttctctcgttgtttggcactgctaccttctttctttggcttcttcacatatcctgcacctgtactatgttccttttgtatgctgtagtcctcttaggaaacaacaggaacatagctgattagttatgcatagtgacatttctcatatccgcatattggaaatcaatgccaaattatttggttgctcatgatgtttactaagattgaggctttaaatggctgattctgtttgctagtgaacacattcttttttggtgcagtatgatcaatgttccattagttatgcatctcccttctcggatctagtattttccctaataggtatatactgaaacttttgtatgggtagtgaattgcaacctttttttttaggccaaactgctgagggcaacatgaatttcacttctattgagccattccaacatgctactctcacacaagtgaatgaatatcttgagagaagtgactcttttcctgatgtaaattgggttgctgatgatgatgagaccactgaagttcaagatgaagataatgcagtggagcatgaaaatcagggaagccacattactatcacctcaagagctaatggagaaaagaatgtcaagaagaccaaatctactgagagagagagagtagaaaagacaccgaagaggaataagaggaatgatgttgttgatatgatgggaagttacttggagatgagaaaaagacaatctgaggaggaggaagcaaagaagagggaggaggaagcaaagaagagggaggaggcaagcaaggttgatgattgctcaataaggaactgcatcactgttgtggaatcgatggaggagctctcaaatgaagaaaaggtcaaatcttttggagtattcaaggacgcgcagaatagggagatcttcatgagtgcagggcctatgactcgtcttatatggttaagaacgatgctggtaagtttgaattactattgttactagcataatcttaatttgtgcaattctgaaattcaattcttctacacttaaataggtacatttttttagccacgttgcactttgtttatgatgcgattgtgtaacaatgcagaccatgcaagaatgacctttggaccaaaaggatattgtctttccaggtacccgttcatacttttataattttgacatgattttcatgttatatttatgtcaggtttaggctgaagttagcataattttgacataattcttgttagtatgcctctgaacttttataattttgattcttgtcagcatgccccctctcttctgtcatgcagccatgctagtgtgtgtgcgcgcgcgccactactactagtacatatctacatcgatctacatctacctatatacattcatccacttacattccttgcctaccaccttactacttcctaaaatcaatctatctatctatttatctatcgatctatcatgcgtgcttgctgtaactgattaactggcagtgtgatcatctctctctactgctgctacatatatgcagtgctatgctgcaggtataatgtgctatgtctgcctaccacaaatctaagctaattgtgacatggtaataaagcaggtgctagagtgattctctgtgtgtatgtgtgtgtgtatgtgagtgtgtttgatgtgtaattgtatcattgcttgtgctcaacaaaaacttgagtacaagtaaccatcttctgcatatttatctaatttgattcaagttcattttacctgttgtttagtttacatattagcaatcaccattgtctagtgtctaagacttgtttctttttggttgtgtagtttacagggttccatggcccatttgctagttgtgcccattggaaggaatcttttgcaagatagttcatagagaccacttgaattgtgaaatgcgatggatgaaggacaatttttcctaactgcttcttaattcatgtagctgtgatggttgcaggaaccttttttttctacaggattaacacttgcttgatcagacatagatatattatttagtttgatcggatagagatatattacgttcaaagaacctattttgtagcttgctttgcacaatggcaattggatgtttactgcttgtagaatttaatctatccaaaattataatttttaatattctcgactatttttagaatccatctgtggtaaatccatgattttctatctttacgctttttagaattattttgcacgttgaatttctgttccattttcatgatcgttttttatcttgtcatttctgaattattttgactttcgtgaccttccagctttttaaattttatccgaattttccatgatagtttctcacgctgaatttgaatggtagtaatcccttctaatctcacctgtaatcccaccttctactccaaactgctagccaacagggaaatcccagctagcaaacaggggaatagaggccaggagattgggggaacaaggggattggggggaagggattgagtgtggggagcggggacaacccaaaccccacgtgggttggttttcctttggattatttcccacagctagcgaacaaggccttacgcgtgcggctgttgtgcttctggaaccgcctacaagccaatcgatcccactgtttgggcctgattcgagataaagggccgttttgcattgctacaggaacttattagccgtaccaatattttagtagtttagatagtacatgtgcttgtttggattgtgaccaatctatatctatatctatatctatactaactagcaaaatgctcgtgcttcgctacggttaaaatgaacgtttaaatgttataaatatttcaagaacggatataaaacactgtcgcattttgatatactcatatagtcataacgtgctctctatcaactctcacatggcaagcgcatgatatcatttacaaaattgagatggtgctcggactctaatatgtcatgtcacagaaagaaaataattacttacttaaaattattgatttttgaattatctgttgtttttcgtatattgtccgcattatgcaccacacacaatatacgtggatccacatagttgccgcgtgttgcaataggtaaacactaaattaaattaaagtgttgcaacaggtaaaaattaaattaacaaacacaaacttttctcagcatttttcatgtgatcgaatattatccgtatggttaatataataaagttaatgttaggaagagcagccagccaaccacgacacgccactcctcgcccttgcctcacgtggctcctataggaacgaagctcgggtcacggcggtatcgacgaagaatctcggggcggtggggaggtttgaggttagtcatggactgtgttttgtgggtccaaagctcggggcgatgtgtcaagtcttttggaatttttttacaattattattttttttatctcaaataaatattgaagtagaagtttcgattttttttgatgtgaagaataaaagatcttaataaaataatttattttttagctgaattaaatccatggattagcacaatctagaacacagtggcacctgtccacagctaaggttttgttcagcagcctggttaggaacccatgtctacagcacgggaaaacggaacagtacattagctcgtgattaattaagtataagctattttttttttcataaaatggatcaatataattttttaagcaactttggtatataaactttttataaaaaaaggaccgttcaggagtttgaaaagcgggcgcgcagaaatcaggagcgatgagttgggaaaactggggaagaacacagccaagtgcagccagaagctcctattttttcataaaaaataaaaataaaagaagattatttcttgtacagtactactgactactgagtagataaaattgtgtggtatggtaaattggtaatccttatcctctcactctctcactgtttcgttctctctctcccattctgtctctccctgtccctctctctttactctccaagcgttgctcctcagtgctcaactgctcacgctcttgttcaaccgggagaagatgccgttcaacgcatcggcagcggcgacggctcctccggccaagcacctggtcggcgttcggctcaacgcgatggcgtcaaggttgaggagctgatccgccgtcgacggcgacgggtgctcactctgtcgttctctctctcccatccggcgcgacgccaagggcggctactgggcggcactcaactgggagaagatgcagttcaacgcgccggcggcggcgacggctcctccgaccaagctcctggtcggcgttcggctcaacggcgatggcgtcaaggttgaggagctgatccgccgtcgacagcgacgggagcagtcgatccggcgacctcttcccctccttcacggatcccatggtctctccgctccctcttgcgcggatccgtcgtcggctgcgatgggaggggttagatccggcgacctcttcctctcccgctcggatcccgtcgtctctcagcgccccgctcacgctgatccgtggccggcgacgacgggagggtccagatccggtggtgtccactgtggtcgcggcttccctgccaccgccgcttctgcacgcgcggcccatacaccgcaccctgccgtctccttcttccccgtgttagtatgcctttcatatgtttttaatgtatttgtgctgttcttataatgtagttttgcacttatgatagcatgttacttgtgcttgcaaggttgggtgggttgtcactgtggttggagctggttgttgagctgattggagtcagagatggtggccaagatggagaggagatgtcacccgaagttgtctcggaagccgcaatgaaggttcaaatctaatatgagttttgggctatcttgggttcctttataaaaaagaaaagtgatataaaaaatattgttgagattataaaaaattgaatgattgccattatggttccattttctttttgtcaccctcttttcgatctgttaacataaacttagggtaagaattaactaaatttgttcatttttaggtatcaactgaatatagtctcatttggcagtttgaagaattttgaagcagtttcaatagcaccatccatgactgattgactgatcccatgacttataacctgcaaaatggcaggattagtagagacttgggtgcacaaattagctctttgttcccttactgcctgctagttagtgatgatgtaggaaaagaatactttggtacttgtgttatgaagtagcaacttaatcaggaaaaaataacatttgaatggtcctaatctatatacacaaattgcacttttatatacacggtccgttttgtcattactgaaaggtttataaaacaccccagtgataatgctggcagccttgatatgtcctcatggacggaaaatgaaaaaaattgcagtagtttagaacccaaacctaaaatatcaattaggtgcggtcttgtagcttagccattgccctgtgatatggacatatgttaccatgaaaggaatgaagcagttcttagataaattatattgagtgttagcttcaagcatacatggcagatgcattcctatcttaaatacattagaattggcctagattatttatcttcagaattaatctcatcctatcattatgacgatcttggtcgagtggctgactcattgctggatgatggttttcttgcaggcggagatggaggcggcaaggtggggctgctggcgttggatgttgcactcgcgttcccgcaggccacgacgtcccagttcccgcccgccggtgagacctcctctcttgctttcccggtgttctcaggttctcggtttcccattattttaaataatgagatattatgattgggtgaaactgtcttggccatctaattggagtatttgagagaggtgtgtgcactgtgcagtcggcctttgttgattcgtagttatcttcagtcttgggcagcttaatctggctccaagttggcagcaagcagtccctgttctgaaaactgctctcttacttaagtttgctgaagggatactccttacatcgaagttcattagctacacttctttggttagaaattgctctgttgctgttcaatatgtaccagcaaaataaatatgagaaatcactctagtgcttctaatagggagtcatctttcagcttctattaaacacggaacatttaagaattaccttccatcgtcgtataaatgtagtaaacgcagatgtgtcatgcccaacagggaattgagtagcgtcaagcgggagattgagtatccacaccaattattaggtgtatatatgagtcttgtttgtattttcagtttttttatataggttgagaagatgtttgcatcctacttagccatgtaattcttattcttggattctgtatgtaattcctgggttgtaattattgagccatgtaattgtatatgactctatttgggattcaatcttggtgggaaaaaaccgggcccgcgtaaaaaactaatcgcgacccaccaagaaaaaatcgaacgaaaaaaagggcaaaaaaaaccaatcggacagaaattgggaaaaaaaccgtgtgcggaaaaaaaccgggcaaaagaaaaaaccaatcggacggaaaaaatccgggccaaaaaaaccgcagccttacttattttttaagtaggtatactagcaaaaatgcctgtgcgttgcaacgggtgaaaaatttctaatgataatacacactttccatgtataatgtataatggttgtatctatcgttgttgctaagacatatcataaagaaaacctcgacgtataatgtataatggttgtatctatcgttgttgctaagacatatcataaagaaaacctcgacgatggcaatctcccaatgatctttcaatctcattcttgcaactaataataggatcaatcaaattctacactatctcatgtggtcaagtctagataaaatagagtcatcatgactcttctcttaataataattaaaaatttatttatttttttatatgatacgcaatcaagaatattagctatacttatcaaagtagtctgataattatataaagtagtctgataattatatacagaatcatgcagagtcttcaataaggggcaacataagctatgtaggagatggaaaacattaagtatcctattcgactcaagccttaagaacattcacagaacgctttagaaaaaccaaaccaatgtggtagacgatggatgatacgaacctttctcgtggaatatgaaattttttctaaaattggacaatttttttgcattgcacggtgcgaaccagattttttttataaacgcagatattttctcacgttgggtcggataaacaccggcaattttttataataaacggatgctagctcccggaagcagtatttttttataataaacggagttttttctcgggaagagtcggacaatttttttcggtttgaattttctcgcgtggattcagacagtttgttccgattcgcttttttataaacaacattttttttggacggttttatttcggagtggttttttatttcgcattgagtcgaacgtttttcaaaccgttttttttataaaaagatgttttatgtttttctcggttttttatttttttactggagtcggactttttttttacgtaggtgactttgttttccctttattacgggagtcggtcgtgagaagttttatttctctttctttattaagggagtcagatttctttatttctctttctttattaagggagtcagatttcttttacggacggaatttttttccctttttatcagagtcgggcgtgggaagtttttttttgagtcggacgttttttttttgacggacgagactttttttttttatcgatctagtacgacagtagttgtttttctcgtttttgattttgagtcggacttaaagattctggcatgcgtgcatgcgccgtggaagaaggagcaatgggattaattccgcatgctatttaattaggggtgtattagtagtatctttatggatgacttataagagcagctacaatagcaggctataagtcagctacaaacatattttaaagagataaatcagaagagagaagagcagcgggctacagatttgtagccagctgtagcacggactccaagacgcagtgtgtctatgacaggtgggactagatattaatagtgtagtatgtaactattgtatgaatgagctattagattggctatagatgaattagagctagtagttggctatactattgaacttgctctcaagtacctggtttcttttaaggaaaaaaaaatgatcgcccgtgaaagcgtggactgctgaggcgagagagcggcgcccgtctcgatccttccgcccgcccttatctcttcctttttccaagcgccatttttcctcttcctctctactctcggtcttctctcctcgctcgcttgtatctcctctccaccgctgcgccatctccacagccgacgacgccctccctctccaccgctccccctccccctccccc

SEQ ID NO: 66390 - DNA, 16773 bp, Oryza sativa
gaacttttccattgcggtgaaaaacatcgcacccacgtgtgccaatataggccaatattggtattaattgacaaaagttcgtcacgcgagtcacggagtgattttttgacacgaactcacccaacatacttcaataagtccaaaaatcatgttttggtgctttctgaagtttttcattccggtgaaaaacatcgcacctacgtgtgccaatataggccaatattggcattaattgacaaaacttcgccgcggaatcacgaagttattttttgccacgaacgcacccaatacactccaatatgcaaaaatcatgttttgatgctttttgaagttttttatttcggtaaaaaacatcgcacccacgtgtgccaatataggccaactttggcattaattaagaaaagctccccgcgcgagtcacggagtgattttttccacacggacgcacccaatacactccaatatatccaaaaatcattttttcatgcttgtgaactctttcattcgggtaaaaaacatcgcacccacgtgggccaatattggccaacattggcatcaatggataaaagctcgccgcgtgagacacggggtgaattttcgacatggatgcacccaatacactccaataagtcctagaatcatgttttggtgctttttgatgttttttattccggtgaaaaacatcgcacccacgtgtgccaatataggccaatattggcattaattgacaaaaattcaccgcgaaagtcacagagtgatttttcaacacggatgcatacaatactctatagtatgtccaaaaaccatgttttggtgccttctgaagtttttcattccggtgaaaaacatcgcacccacgtgtgccaatatgggccaatattggcattaattgacaaaagttcgctgcgtgattcacggagtgattttttgacacggactcacccaatactctacagaatgtccaaaaaacatgttttggtgctttcttaactttttcattccggtgaaagacatcgcacccacgtgtgccaatacaggacaatattggcattaattgacaaaattccccacgcaagtcacgaagtaatttttcgacatggtctctcccaagatactataatatgtccaaaaatcatgttttggtgctttttgaagtttttcattccggtgaaaaacatcgcacccacgtgtgccaatatgggccaatattagcattaattgacaaaagttcaccgtgcgagtcacggagtgatttttgaatacggacgctcccaatactctacagtatgttcaaaaaccatgttttggtgcattctgagctttttggttccggtgaaaaacatcgcacccacgtgtgacaatataggccaatattcgcattaatttacaaaagttcatcgcgcgagttacggagtgatttttcaacacagacgcaccatatccactccaatatatccaaaaatcatgttttggtgctttttgaactttttcattccggtgaaaaacatatccactccaatataggccaactttggcattgattgacaaaagctcgccgcgcgagtcacggagtgaattttccatatggacgcacccaatacactccaatatatcaaaaaatcatgttttggtgcttttgaactctttcattctggtgaaaaacattgcacccacgtgggccaatattggccaactttggcatcaatggacaaaagctcgccgcgcgagacacggggtgatttttcgacacagatgcacccaacacactccaataggtcctaaaatcatgttttggtgctttttgatgttttttattctcgtgaaaaacatcgcacccacgtatgccaatataggccaatatttgcattaattgacaaaaattcaccgcgaaagtcacggagtgattttttgacacggacggatccaatactctacagtatgtccaaaaccatgtttcggtgctttctgaagcttttcattccggtgaaaaacatcgcacccacgtgtgccaatatgggccaatattggcattaattgataaaagttcgctgcgccagtcacggagtgatttttcgacacagactcacccaacagactccaatatgtccaaaaatcatgttttggtgatttttgaggtttttcattccggtgaaaaacatcgcacctacgtgcgccaacataggccaatattggaattaattgacaaaagtttgctacgcaagtcacggagttattttttgacacggacgcacccaatacactccagtatgtccaaaaatcatgttttggtgctttttgaaatttttcattccggtgaaaaacatcgcacccacgtgggccaatataagccaactttggcattaattgacaaaagctggctgcgcgagtcacggagtgatttttcgacacggacgcacccaatacacttctatatgtccaaaaatcatgtttcggtgctttttggactctttcattctagtgaaaaacatcacacccacgtgtggcaatatatgccaactttggcattaaatgacaaaagctggctgcgcgagttacggagtgttttttcgacacggactcatccaattctctacagtatgtccaaaaacatgtttcggtgctttctaaactttttcattccggtgaaatacatcgcacccacgtgtgctaatataggccaatattggcattaattgacaaaagttcgatgcgcgagtcacggagtgatttttcgacacggatgcaccgaatacactccagtttgtccaaaaatcatttttttgggtgctttttcaactttttcattccggtgaaaaatatcgcacccacttgtgccaatataggccaatattggcattaaatgacaaaagttcaccgcgcgaggcacggagtgatttttcgacacggacgcacccaatacactccaatatgttcaaaaattatgttttggtgcattttgaactttttcattcaagtgaaaaacatcgcacccacgtgtgccaatataggccaatattggcattaattgacaaaagttcaccgcgcgagtcacggtgtgagttttcgacacggattcacccaacatactccaatatgtccaaaaatcaagttttggtgatttttgaactttttcatttcggtgaaaaacatcgcacccacgtgtgccaatatttgcattaattgagaaaaataagccgcgcgaatcacggagtgatttttcgacacagactcacccaacatactccaatatgtccaaaaatcatgttttggtgatttttgaagtttttctcgcacacacgtgtaccaatataggccaatattgtcaccgcgcgagttacgtagtaatttttcgacatggacgcacccaataatctacagtatgtccaaaaaccatgttttggtgctttccgaacttttcattccggtgaaataaatcgcacccacgtgtgctaatataggccaatattggcattaattgacaaaagttcgctgcacgagtatcagagtgatttttcgacacggacgcacccaatacactccattatgtccaaaaatcattttttggtgctttttgaactttttcattctagtgaaaaacatcgcacccacgtgtgccaatatagactaatattggaattaattgacaaaactttgccgcgtgagtcacggagtgatttttcgacacggactcatccaatacactccaatatgttcaaaaattatgttttggtgctttttgaactttttcattcctatgaaaaacaacgcacccatgtgtggcaatacatgccaatattggcattaattgataaatgttcgccacgcgagtcacgcagtgacttttcgagatggacgcacccaatactctacagtatgtcgaaaaatcatgttttgatgctttttaatctttttcattctggtgaaaaacatcgcacccacgtgtgccaatataggcctggcattaattgacaaaagttcaccgcatgagtcacagagtgatttttcgacacagacgtatccaatatactccaatgtgtccaaaaatcatgttttggtggtttttgaactttttcattccggtgagaaaaattgcacccacgtgtggtaatataagccaatattggcactaattgtcaaaagttcgccgcgcgtgtcacaaactgatttttcgacacagacgcacccaatacactccaatatatctaaaaattatgttttgttgctttttggtctttttcattccggtgaataacattaaaacattatatttgtaatattttttaaagaaaagacacttactgatctctatttcatgaaccatgcagacgactgaccacacttcacctacacttttatgcaaactccgactactcactgactcactctatccttactagactcactggaccactcgacctcacaaaaggaaagagcagatgagaaaatcatagggctcttagtgtttccacttggcttatcctacgatcaaggccggctctaataccaacttgtcacgcccagaaattcgttaacccgaattttaagtagaatgtgtattaaatctccgtccaggaccagccagagtacacaaacaacaatttgatagacagatccacgtcttacaaaaataacaaaataaaactaacatacgcagcggaaaaacaaataaactagacttaatcttcacgaccaacgtgaagcttcctccatgttggcggctgttaaacaccgattctataccaccaacatctgcataaagttcagacaataaaacatccaacatagtgataggtgcttaatgtcacatattccacaagtgttggtgtatatttgtatgcaggtgtcaaaccccgaagttggagggaaatctagactaaagtgaggggaaaatttatctatacaaggatgggttgtgaacttcatcaaaatatcaaagacttagcccaaaactccgagaaatggataaaggaggacaaggggaggagatgggccgaaggccaggccaggtgggcccagcacaggtttgcccgaaccccttggttcggccgaaccaaaatctcagccattcaggctggggtttggcgtggacagtcctgatcatctcctgatgatggttgcggggcatttccgacaattcgcattgtgtaaccatcatacctacctctatataaggagcttcactccttcactctcacacacacttccaagcttgagctgaattataagaggctctattgtactatattgtatactagaataggaagagagtagagtagaagaagtcggaagaattctggagttgtcactaatcttctctcatttcttgtattctgttcattactctgatttcaatataatattcttcttgagtaacttagatttatcttataagaattaacctaaatagcatacgggattattgttcactataatcaactgaaatatagtgattgctttggtgagttataaacactgaagtagatattaattgcttagacgtggtgtttaggtaattgttatccagtaattgctgcgtatcccattgtacgtttgaggtaggtgtagaggtggtgacagccctcgagatcacttaagtcctccctgttcgggtacgtaatagagcgacatctgggaacagtgagttaccagtgcctgaagtattgctttaggattaaacttaagctttccctagacactgtttcttaccagtgaatcctctctatcctagcctatcctttgcttggtgtccttggatgaaccggaagaagaactgaccacacatgttcccttggatttgataccctttggaatactccgtaggggaagtgctacatcggtatatccgtgtgcttgcggattttatctgtgatcgtaagaattaccaacactccataaaacacaggcaatcctcgacgcccagaacaagctcggtcctcaaagaactcaccacccgaaccaatctctgcttcgaagggggtggggaggaaataaagcaagactgagtaccaaccaccataaaaatagcattggatatttgcggtaaaagcagcatttataaatcatattttgaaatagtaaaaacaatatataattaagcagtattaaatcatcactatctaacgctaaatccacggtgcaacacgcccaaccaaaaccacctaaacaactccagttctataagtcaaattattattgtgggactaatcacaatgagctggttgaccgcccaataactgcgggcatggctattccaatagttggggggcatgtgttaacgaccaaatttggtaatgccatgagccggattcaaagctagagtcaaagccgatttggcgagattccatttgagaaggtagaatacgcattggctaagaacagcatcagctgccacatgatcggctacaggcaatattggctgcgcatattggctagcgccaaatccgcggaatcaagccgatgcaaccagtctcgaaaatgatggtcccacgttggtcatcagggttagccaaagcacttcatagccattgccacacaaggattggagtcctaaaaaggggcaattgtatctattaattaggatattttttcagtttccttagagatatgtttggtaagagcccacctaggggactcattcgtattttaaattatattagagacaagaggcgtgtccggcaaggacacattatgtacttcgggtattaatatgacctgacaccatgtaatcaagggacgacagttcaataatactttggtgcatcaccacccttttctatttttattgtttcgacgagtttttgctttcaagttgggctacatcaggttcgatcttcgacgaaaaggtaaagcttgttatgacagtttgcgttgttgggattagtgcttacatcgctatgacactctaatcctgtctacgtgaatcgctgaattatcatatataccgcataatctagattgatctcgtcatctaaccccatcggccagcctctatcatcgaaaacggccgataggtttagatgtcgatgtcagcctagattatgcggtgtatctaccatcttgaatgagttttcatctatttgcttagatcttatgtttcttttcacgcttaacacggcatcggttaggttcgacctgttaagtattgtcttgaaatgtgttatctagctctttctttgaatgctaatatagatagcatcagggtttcagccgatcttacctgatttagccgtcttgttcccctacttggttctggatcgtctaaatctgccctttatatcaagatctcatccgtttaaagtatattaagcttcctatcagtctgctagtttccctgcttggtagattgatctcggttttgtatatttcacctgtgctaatatctaggtataaggtggtatcggactactagctgatacatgttaggtttgccctatcggctatgctgcgagcatacataatccctactgtggggcacatttagatactgagtgatttatactgtctcggcataatgtccgatctatcccaatcactcgatctaagcacgttccattggatggattacgtatcatctacagccgatcgagtaggcctaataatctctaagttttatctacctttgctgatctgatgcaagttatatcagcttgcctttgctgatctatcgttgatggatttaactctttgtcttttttctatcttgttggttgcaggatcaaaccagctggcacgctcagaacccaaaggcaatctctttggacctgcactagagttaagcagatctcttaggccagtgcgtgttttttgcgtcaacagaggtgtacaactttacccacaagacacgattccacacatgttaccatgccctgaagtaccgccacgatactacaaaggtggaaatcgtgacaaaacccgccgtacaaccctccctaaccaaacatacccacctcaggtttcaccccctccttgtgccaagttgggcagtcccttctcgcgcctaggtaaatccagctacagcagagaccaatatcaaggtccgaactgcaccatcgcctctacctttgccatggtatgtcagctaggttaagttatactgtagatttagcctggagtcaacatatggtaacggtcggaaaacgtcaagtgcgattttcactcggagtcgacatatggcaaatccgaaacattaccaaatatttcagaattggggggcatatgttaacaaccaaatttggtaatatcagtgttgggaaataagattagatcaaagcggaatccaagacgaagatcgttacggaaacagagcaagaatcggctatgatccaaattggctacagacaggattggcagagttcgagtcgaacagggttagccgatacagccgattctaacaatatggctcggtatacgtcatcaggttgaattaatgtgcttcatatggattgccacacgtggattgagtcctaagaaggcaattgtatctattaattaggatattttatgtaatttccttagagataagtgtgggcaaaagtctgccgcaaagacttatggtatcttagagtttgttagagatgagagtcgtgtccgacaaggacatattttgtaatctcgggtataaatagaccccgagccctatgtaatcaattaacacacgttcaaatacaatctcggcgcatcgccaccttttactttcgttttgtttcgacgagttcttgctttcgagttgagctgcatcggtttcgatcttcaactagaggtacgacttgttatggcggcttgcgttcttgggattagtgcttgcatcattatgacactctaatcctgtgcatgtaagttgtcgagttatcatatattctatataatctccggcaacattgttacctaacctctaataggctaacatctgttactgggaggcagccgatcaggttaattaccgatgttgatctagattatatagaatatccaccactctacgaaacttccaatggcttgattgtctagatattgtgtttcttttcatacttatggctgcatcagttaggtttgacctcataagtcgtgcttagaactataatctctagcctgcttcttggttgtcgattagagtagtatcggggttttagccgatcttacctgatttagccttatatttcatgtgcttaattgatatgctaaatctgccctttatattgagatcttattgctttttttagatatgttaagctttttgtttgatatattttactcgctttaatatcttaatatagagtggtatcggtgtattagccgatacgcgctagatctatctaatcggttatgctgtgaacatctataatctcattgttaatatatatttcgatctaagtgatttatactgtctcggcatggcgaccgatctatcccaatcacttgatttaagtatatatcgacataaaaattatgcattgttaacgtctatacccgatcgagtagatttagttttaattacttatttataactgccgatcgattcacatatgacatcggctcgaagataaatgatatgtcatcggcggctggctaatcggctatcattatggatttaactactgtttctttgtctttatttcttgttcagccgaactggcccctagtattattgttccaatcacattggataaattgacgactgagcaaagggatgagctcgagcagatgatgagcaatgtaaaggatcagttcatgaattctttccaagaaacccgcagaggaaccatcgtccagaagtacaagctgaaggtagttgcagccgatgaagctggttcgggttcatctcaaggtgacaaaggtgatgttcctcaagatggcactgttgaagattttggtgcagatggcaaccaagagccgttgcagtttaacaattttcaggataggatcgactatgccgtgcaacatgccttgattaaccaatctggagtgttagttaataccttaaccaacatggtgaagactgttgtcgatggttcgatagccgagcactagcctcaggaccagtttatctaccaggaggtatttttccaaattatagacctttggtcacagctaatcagctgaacgcctccaatgcactgccagctcagcccacggctccagtctcaactactgtacaagctacatcatcaccaccaagacagatggttaaccccagattgttgaccagagaacagccacaacatcctgggcaaaatgtcaatcggctgactcaggagcaagttgctgcgatgtttttgccaaatccgacaatagccgatccaacacagccccaaccgactcagcaagtacaaccgaggcagtagacagttcagccgactcagcaacagaacgtgcagcatccgtcgacaaggttgagaacacctgacaatcggctagtgcaacatacggtgcaccaagtaattcctaaacacttggttcatcacgcacaggccgatcaatcagttatgcctcagattatccctgaacatttggtgcataatatccagccgaatatctagaattatcaaggaggaaatctaggttatcaatatcagcctccgtcacctcatgttcagtatcagcagacaggatcgcctcagcctcagcacgctcctcaatttaatcagtttgagccgatgcagcaacaaatgcaaggagtaccttagcaaacgtcatgggctgatatgctcgcagatgtaatgagggaaccatttgtatcggcatccttatcctgagtggtttgagaggtttccattgcctagccgatacaaagtacccgacttctcaaaattctcagggcaggatgatgtttcaacttatgaacatgttagccgattcttggctcagtatggtgaggcatcggctgctgacgccttgagagttaggttgtttcctttgtcttcgtcaggatcagcatttacatggttttcttccttgccatataattctgttaatagttgagctgatttggagaagcaatttcatagctatttttatagtggaattcatgagatgaaaatgtttgatttaacagcaattagacaaaggcatgatgagtccgtacaagattacattcaaagattcagggagatgtgaaactgatgctatagtttatctttgacagattctcagctagccgatttagcttttcaggggttgatagcaccgatcaaagaaaagttttcggctcaagattttgagagtttatcacatctcacacaaaaggtgactcttcatgagcagaggtttgctaaggccaagaagaacttcaaaaagattaatcatgtatatccttacatgtatggttctgatgatgaagacgatgattccgaggtggcggcagccgaatgggtcaagagcaagaaagtaataccatgccaatgggtgaaaagttctggaaaagaggaaaaatttgacttcgacatcaccaaggatgacaagattttcgacctattgcttcgagaaaaacaaattcagcttccggctggtcatgtgatcccatcagccgaagagctgggcaaaagaaggtattgcaagtggcataattctagttcctattcaactaataattgcaaggtttttaggcagcaaatccaggcagccattgaagggggaaagatcaaatttgatgattcaaagaagcagatgaaggttgatggtaatcctttccctattaataaggtgcatacatctagaaggacagccgatggggggatgaatagaaattttcacatgaattcgactaggattatcaacaaataccaaagaaagtatgataaacagcatgagaaatatcatgaaaaagatgatggttttgaccctcattgggattgtgagtttttcagattttgctggaatgaaggtatgaggttgccatcgattgagaattgccctggatgcagtgaagatacagggagttcaagccgatcctataatagaggtaatcggccaaatcagaagagagtacctgttcatcaaaggctgggcctggtaaatcaagatcattatcaagataaagatgaaaataggaatacacagtggtgtacctacaggcattttcaccaagaatcaaaagagaagggttcaaaggttgaggaacagggagcaatttcagagggtgcatcaagagattaatcatcggctgaggaaaacaaagactaagcaagaatggcgtgttaaaagtacagttgtatcagccgatgaggtcgaagccgaaaaggcaaaaagggtgctcaaaggcaaggctcttgcatcggcatcagtaaatatggtttttatgctaccggccgaatttgaagctaggcaagccgatgttgatgatgttgaggaagcttcagctaagttagttttgtcaccagagcaggcggtctttgagaagccagaggggatagaaaattggcatctcaagccattgtatatcaatgggtttgtcaatgggaagccaatttctaaaatgatggtcgatggaggagctgctgtgaatttgatgccatatgccacactcaggaagttgggcagaaatccagatgatctcatcaagactaatatgattctcaaggattttggtggcaatccatcggaaaccaaaggagttttaaatgtggagctgacagtcggcagtaaaactgttcctacaacattttttgtcatcgatgggaagggtttctataacctgttgctcggaaaggattagattcatgctaattgttgtattccttcaaccatgcattagtgtttgattgaatggcaaggtgacaaaattaaaattgtaccagctgacaggtcagttaatgttgctaatgccgatttagctctttgggatatggacggtattgattgcttgtctggataagtttgggatggagattttctaaaagtgtccgattctgatatacagccgattgaagatgcagagcccaaattgttattttgagggcgtcgtggagggttcaaatgtctacaccaaggatgcagtagatgatctcgatgacaaacaagggcaaggttttatgtcggctgatgatttggaggaaattgacataggtccaggagatcgaccaaggccaacatttatcagtaagaatttatcttccggatttagaaccaagttaatagaacttttgaaagaatacagagatttctttgcttgggaatatcatgagatgccaagactcagccgatcgattgttgaacatcggctacctataaagctcggggttaggccatatcagcagccaccaaggagatgtaaagccgatatgcttgtggctgttaaggctgaagttgcacgcttgtatgatgctgggtttattcgtccatgtcgatatgctgagtggatttctaatatagttccagtcatcaagaaaaacgacaaagttagggtgtgcattgatttccgggatttaaataaagctaccccaaaggatgagtacccgatgccagtagccgatcagttggttgatgccgcttcaggacacaagattttgagttttatggatggcaatgcaggttacaatcggatcttcattaccgaagaagacattcataagacagccttccgatgtcctggtgcaatcggcttgtttgagtgggttgtgatgactttcggcttgaagagtgctggagctacgtatcagcgagctatgaattacatattccatgatctgatcggctggttagttgaggtttatattgatgacgtggttgtcaagtcacgggaagtagagaaccacatagccgatttgaggaaggtttttgagaggactagaaagtatggcttaaaaatgaacccgacaaagtgtgcctttggcatatcggctggtcagtttttgggatttcttgttcatgagagggggattgtggtgactcaaatgagtattaatgcgatcaagaatattcagcctctggaagataagacaaagttgcaggagctgatcggcaaaaataaattttgttagaaggtttatttctaacctatcagggagattagagccttttacgcctttgttgagattaaaagtcgatcagaagttcacttggggtgtagaacaacagaaagctttggatagtatcaaggaatatcttagttctccaccagttcttattcctccacaaaagggggtgcctttcagattatatctattggctggtgataagtagattggttcagttttgattcaggagtttgaagggaaagagagagttgttttttatttaagtcgacggctcttggatgcagaaacgaggtattctcctgtggaaaagttgtgcttgtgtttatatttctcttgtaccaagttaaggcactatctattgtcaaatgaatgcattgtgatatgtaaggccgatgtggtgaaatacatgctatcggctctgattttcaaaggaagggttggcaagtggatatttgctttgacagaatttgatcttcgatatgagtcaccaaaggcgattaagggacaagctatagccgattttattgtggatcatcgagatgactcaatcgactcggtagaaattgtgccatggactttattctttgatggattggtatgcactcatggttgtggtattggcttggtcataatttctcctcgaggggcaagttttgagtttgcctgcactattaaaccttatgcgactaacaatcaggctgagtatgaagctgttctcaaaggattgcaattgcttaaggaagttgaagccgacgctatcgaaatcatgggtgattccttattggtaatcagtcaattggcaggagaatatgaatccaagaatgatacattgatggtttacaatgagaagtgccgagaattaatgagtggatttcggctggtaactttgaaacatgtgtcaagagagcaaaacattgaagctaatgatttggctcaaggggcatcgggatataagccgatgttgagagatgttgagatagaggttgctacgattacagccgatgattggagatatgatgtatttcagtatttgcgaaatccgtctcaattggcttcaagaaaattacgaaataaagctttgaaatacaccctgttggatgatgagttgtattaccggatgattgatggggtgttactcaagtgtttgagtgccgatcaagccaaggctgcaatcggcgaagtacatgaaggaatctgtggaactcatcaatcagctcacaagatgaagtggttacttcggcgtgtggggtatttttggccaacaatgttggaagattatttcagatattataaaaggtgtcaagattgtcaaaagtttagggcaattcagagggcaccagcatcagctatgaatcctattattaagccatggccatttagaggatggggtatggatatgatcggccaaatcaatccaccttcaagcaaggggcataagttcatactcgttgcgaccgattatttcaccaagtgggtagaggctattccattgaagaaagttgattcaggggatgctattcagtttgttaaggaacatatcatctaccgatttggcattcctcagacgattacaactgatcaaggttcgatatttgtgtctgatgagtttgttcggtttgccgatagcatgggtatcaagttttcttctccatattatgcacaagccaatgggcaagccgaagcatctaacaaaagtttgatcaagttgattaaaagaaagatttctgattatcctcggcaatggcatactcgattggctgaagcattatggtcttatcggatggcttgtcatggatcgattcaagtttctccctataagcttgtttatgggcatgaagctgttttaccatgggaagtgagaatcggctcaagaagaacagatttacaggatggattgacagtcgatgagtattacaatctcatggtcgatgaacgggaggacctggttcaatcaagattgcgggctcttgaaaaagttacttaggataaagagagggttgctcgacattataacaagaaggtggtgcctaaatatttttcagaaggagagcttgtttggaagttgatcttgccgataggaacttgtgataataaattcggcaagtggtcgccaaattgggaaggactgtttcaaatccacaatgttgtgtccaagggagcttatatgttgcaaagacttgatggggaagtttatggacgggcccttaatggcaaatacttgaagaaatattacccaagtgtatgggttaattcatgatcggctgaatttgccgatgcatgtagagccgatgtgtttgcatcgccttgagatggccgatatagtaatatcgcccttagctgttttatcttcataatcggctgtgttttgccggtgtatgatggccgatatggttatatcgcccacagactaatttataattttatcaatgtcttcgtcattacaaaattagggggggcatatatatatacaaagttggatatttttgaaatttttgaggcaaattcagaagttatgttaatcggcataaaggattatcaaagcagttacttagttggtgaagtaccaaaatatcttagccaattacaagaattttctaagccctattacatggatagtcattgagacaaatattactgaatagccgatatagccctttgcctaatttgctttacttcttctatggcttgggcgtcttgagcatcggttccagggatgactttgagggacttagtcatatcggcaatattcctgatagccgatttcagcctcaacttctgctcttcaatagcctttggtaggtta

SEQ ID NO: 66391 - DNA, 37206 bp, Oryza sativa
  unsure (1)..(37206): unsure at all n locations
caattaatgccaatattggcatatattggcacacgtgggtgcgattttttacaccgcaatgaaaaagttcaaaaagcaccaaaacatgatttttggacatattggagtttactgggtgcgtttgtggtaaaaaatcacttcgtgattcgcgcggcgaacttttgtcaattaatgccaatattggcacaggtgggtgcgatgtttttcaccggaatgaaaaagttcaaaaaccaccaaaacatgatttttggacatatttgagtgttttgggtgcattcgtgggaaaaaattacttcgtgattcgcgcgacgaactttcatcaatttctgccaatattggcacacgtgggtgcgatgttttagaccggaatgaaaaagttcaaaaagaaccaaaacatgatttttggacatattggagtgtattaggtgcgttcgtgacaaaaaatcagttcgttattcgcacggcgaaattttgtcaattactgccaatattggcacaggtgggtgcgatatttttcaccggaattaaaaagttctaaaagtactaaaacatgatttttggacatattggagtgtgttgggtgcattcgtggcaaaaaatcacatcgtgattcgcgcggcgaacttttatcaattactgccaatattggcacatgtgggtgcgatgttttagacaagaatgaaaaagctcaaaatgcaccaaaacatgatttttggacatattggagtgtattgggtgcgttcgtggccaaaaataacttcgtgattcacgcggcgaacttttgtcaattaatgctaatattggcttatattggcacaggtttgtgcgatgttttagaccggaatgaaaatgttcaaaaagcaccaaaacatgaattttggacatatttgagtgttttgggtgcattcgtgggaaaaaataacttcgtgattcgcgcgacgaacttttatcaattactgccaatattggcacacgtgggtgcaatgttttagaccggaattaaaaagttcaaaaagcaccaaaacatgatttttggacatattggagtgtattgggtgcgttcgtggcaaaaaatcacttcgtgattcacgcggcgaacttttgtcaattactgccagtattgggatatattggcacacatgggtgcgatgtttttcaccggaatgaaaaacttcaaaaagcagcaaaacatgtttttggacatattggagtatgttgggtgagtccgtgtcgaaaaatcactccgtgactcgcacggcgaacttttgtcaattaatgccaacattggcctatattggcatacgtgggtgagttgtttttcaccggaatgaaaaatttcataaagcattgatttttggacatattggagtgtactgggtgcgtccgtgtcgaaaaatcactccgtgactcacgcggcgaagttttgtcacttaatgccaatattggcctatattagcagacgtgggtgcgatgtatttcatcggaatgaaaatgtttagaaagcaccaaaacatgtttttggacatactgaagagaattgggtgcgtctatgtcgaaaaattcctcagtgactcacgcggcgaagttttgtcaattaatgccaatattggcatatattagcacacgtgggtgcgatgtttttcaccggaatgaaaaacttcaaaaagcaccaaaacgtgatttttggacatattggagtatgttgggtcagtccgtgtcaaaaaatcactccgtgactcgcgcgacgaactgtcaaaaatgaatgccaatattggcatatattgccacacgtgggtgcgatgtatttcaccggaacgaaaaagcaccaaaacatggtttttgtacgtactgtagagcattgggagcgtccgtatccaaaaatcactctgtgactcgcacggcgaacttttgtcaattaatccaaatattggcctatattggcacacgtgggtgttttcaccgaaatgaaaatcttcacaaagcagcaaaacatgatttttggacatattggcgtatgttgggtgagttcgtgtcgaaaaatcacttcgtgactcgagaggcgaaaacttttgtcaattaatgccaaattggcctatattggcacacgtgggtgcgatgtttttcaccggaatgaaaaagttcaaaaagcaccaagacatgatttttagatatattggagtgtatgggtgcgcccgtgtcaaaaaatcactccgtgactcgcgctgcgaaattttgtcaattaataccaaagttggcctatattggccaacgtgggtgcgatgtttttcaccggaatgaaagagttcaaaaattaccaaaacacgactttggacagaaggagtgtattgggtgcgtccgtatcgaaaaatcactgcgtgacttgcgcggcgaacttttgtcttgccaaagttggcgtatattggcacacgttggtgcgatgtttttcaccgtaatgaaaatgttcaaaaagcagcaaaacatgatttttggatatattggattgtattgggtgagtccgtgtacaaaaatcgctccgtgactcgcgcgacgaactttagtcaataaacgccaatattgtcctatattggcacacatgcgtgcgatgttttcaccggaatgaaaacgttcaaaaatcaccaaaacaagatttttcgacatattggagtgtattggatgcgttcgtggcaaaaaaaaaaaacttcctgattcgcgcggcgaacttttgccaattaatgccataatttgtacacgtgggtgtgatgtttttcaccggaattaaaaagttcaaaaagcagcaaaaaatgattttttttgacatattggagtgtattgggtgcatccgtatcgaaaaatcactccatgactcgcgcggcaaacttttgtcagttaatgccaatattgtcctatatgggcacaggttggtgcgatgtttttcaccggaatgaaaatgttcaaaaagcaccaaaacatgaattttggacatatttgagtgttttgggtgcattcgtgggaaaaaatcacttcgtgattcacgcgacgaacttttatcaattactaccaatattggcacacgtgggtgcaatgttttagaccggaattaaaaagttcaaaaagcaccaaaacatgatttttggatatattggagtgtgttgggtgcattcgtggcaaaacatcacttcgtgattcacgcggcgaacttttatcaattactgccaatattggctcacgtgggtccgatgttttagaccgcaatgaaaaagttcaaaaagcaccaaaacatgatttttgaacatattggagtgtgttgggtgcattcgtggctaaaaatcatttcgtgattcgcgcggcgaacttttgtcaattaatgccaatattggcatatattggcacacgtgggtgctatgttttacaccggaatgataaagttcaaaaagcaccaaaacaagatttttggatatattggagtgtgttgggtgcattcgtggcaaaaaatcacttcgtgattcgcgcggcgatactttgtaaattaatgccaatattggcactggtgggtgcgatgtttttcaccgtaatcaaaaagttctaaaagcaccacaacatgattgttggacatatttgagtgtttttggtgttttcgtggcaaaaaatcacttcgtgattcgtgcggcgaacttttgtcaactaatgccactattggcatataattgcacagatgggtgcgatgtttttgacaagaatgaaaaagttcaaaaatcaccaaaacatgatttttgaacatattggagtgtgttgggtgcattcgcagctaaaaatcacttcgtgattcgcgcggcgaacttttgtcaattgatgccaacattggcatatattggcacacgtgggtgcgatgttttacaccgcaatgaatgccaatattggcacacgtgggtgcaatgttttagaccggaattaaaaagttcaaaaagcagcaaaacatgatttttggacatattggagtgtgttgggtgcattcgtggcaaaacttcacttcgtgattcacgcggcgaacttttatcaattactgccaatattggcacacgtgggtgcaatgttttagaccggaattaaaaagttcaaaaagcaccaaaacatgatttttggacatattggagtgtgttgggtgcattcgtggctaaacatcacttcgtgattcacgcggcgaacttttatcaattactgccaatattggctcacgtgggtccgatgttttagaccagaatgaaaaagttcaaaaagcaccaaaacatgatttttgaacatattggagtgtgttgggtgcattcgcggctaaaaatcatttcgtgattcgcgtggcgaacttttgtcaattaatgccaatattggcacaggtgggtgcgatatttttcaccgtaatcaaaaagttcaaaaagcaccaaaacatgatttttggacatatttgagtgttttgggtgttttcgtggcaaaaaataacttcgtgattcacgctacgaacttttatcaattactgctaatattggcacacgtgggtgcaatgttttagaccggaattaaaaagttcaaaaagcaccaaaacatgatttttggacatattggagtgtgttgggtgcattcgtggcaaaacttcacttcgtgattcacgcggcgaacttttatcaattactgccaatattggcacacgtgggtgcaatgttttagaccggaattaaaaagttcaaaaagcaccaaaacatgatttttggacatattggagtgtgttgggtgcattcgtggcaaaacatcacttcgtgattcacgcggcaaacttttatcaattactgccaatattggctcacgtgggtccgatgttttagaccggaatgaaaaagttcaaaaagcaccaaaacatgatttttgaacatattggagtgtgttgggtgcattcgctgctaaaaatcatttcgtgattcgtgcggcgaacttttgtcaattaatgccactattggcatataattgcacagatgtgtgcgatgtttttgacaagaatgaaaaagttcaaaaatcaccaaaacatgatttttggacgtattggagtgtgttggtagtgttcgtgggaaaaaatgacttcgtgattcacgcggcgaacttttgtcaatttctgccaatattggcacaggtgggtgcgatgttttagaccagaatgaaaaagttcaaaaagcacgaaaaaaatgatttttggacatattggactgtgttgggtttattcgtggctaaaaatcacttcgtgatttccgcggcgaacttttgtcatttaatgccaatatttgcatatattggcacacgtgggtgtgatgtattacaccggaatgaaaaagttcaaaaagcaccaaaacatgatttttggacatagtggagtgtgttgggtgcattcgtggcaaataatcacttcgtgatttgcgcggcgaacttttgtcaattaatgtcaatattggcacaggtgggtgcgatgtttttcaccgaaattaaaaagttgaaaaagcaccaaaacatgatttttggacatatttgagtgttttgggtgctttcgtggcaaaaagtcacttcgtgattcgtttggcacttttgtcaattaatgccagtattggcgtatatttgcacaggtgggtgcgatgtttttgacaaaaatgaaaaagttcaaaaatcaccaaaacatgatttttgaacatattggagtgtgttgggtgcattcgcggctaaaaatcacttcgtgattcgcgcggcgaacttttgtcaattgatgccaatattggcatatattggcacacgtggatgcgatgttttacaccgcaatgaaaaagttcaaaaagcaccaaaacatgatttttggacatattggagtgtgttgggtgcattcgtggcaaaaaatcacttcgtgtttcgcgcggcgaactattgtaaattaatgccaatattggcacaggtgggtgcgatgtttttcaccggaatgaaaaagctcaaaaagcaccaaaacatgatttttggacatatttgagtgttttgggtgctttcgtggcaaaaaatcttttcgtgattcgtgcggcgaacttttgtcaactaatgccactattggcatataattgcacagatgtgtgcgatgtttttcaccggaatgaaaaagttcaaaaatcaccaaaacatgatatttggacgtattggagtgtgttgggagtgttcgtgggaaaaaatcacttcgtgattcgcgcagcgaacttttgtcaatttctgccaatattggcacaggtgggtgcgatgttttagaccagattgaaaaagtttaaaaagcaccaaaacatgatttttggacatattggagtgtgttgggtgcattcgtggctaaaaatcacttcatgatttgcgcggcgaacttttgtcatttaatgccaatatttgcatatattggcacacgtgggtgcgatgttttagaccggaacgaaaaagttcaaaaagcaccaaaacatgatttttggacatagtgtagtgtgttgggtgcattcgtggcaaaaaatcacttcgtgattcgcgcggcgaagttttgtcaattaatgtcaatattggcacaggtgggtgcgatgtttttcaccggaatgaaaaagttcaaaaagcaccaaaacatgatttttggacatatctgagtgttttgggtgctttcgtggcaaaaaatcacttcgtgattcgcgcggcgaacttttgtcaattaatgctagtattggcatatattggcacatgtcggtgcgatgtttcagactggaatgaaaatgttcaaaaagcaccaaaacatgatttttggacatatttgagtgttttgggtgcattcgtggcaaaaaatcacttcgtgattcgtgcggcgaacttttgtcaattaatggattcttttgtcaattcgaaaaatctctcaattcatcttcctctactcatgttaatggattcttttgctgtgtccttcggttcggccaatgagtacgaaccatggaatcatgttcttgccatgttcctaggcttggccatcatgagtacaagccaaaggaatttttcctctttgttgtgtcctttgtctcagccagcgcgtatgagacaaggaagttcgtttcatttgatggcttttaacatgatttcacacttttttctatggtccggccagatgagtacgggcctaggagtggtttccatgcaaactcttttcatgtcatcctaccataccctctgatttggtcccgttagcggatacaagcccaggcgagattctcgctctcaggttcagtcctctacgagcggatacaaatcacggatacaaacacaaattttgcataattcaccataaattaaacaagcacttgctttggtcacgcttcatggcttcaagccgtgctagtagtgataaaggcatagtgataaataaaattaattgagcatactaattagcacacttatttgctagttttgacatatgttcagccatatttctctaacaagaattaaaataaaatggcgttcattttctttccgtggtcagagctaggaaatagatgtacgcatgcatatattttctccttccatctgttcatctacaaaatgatggataaatcatgaactgcgccgagttatgatggtcggccataaaattaaccaacactcacttcggttacgcttcacggcttcgagccatgctagtagtaatacaagtggagtgaaaattataatctcaaaatcatccgcatacatatatttgcttaaaacaatgtatactcgctacaccatatataaagtgcagtataaaaaaatctgatatacgcacatgcatgcatccatatactctggctgtgcattcgctatcacgtatagtttcttcccaatagcaaattaatccatatatgcatagcaagcgacaacatcatgataatcgaccataaatcaaacaaatgcccacttcgattacacttgatggtatagtgccgcgctagtagtaatacaggtggggtggaaattaaaataggcaatgcaaattcgccgtaccaaaatcccatgccgcgtcgataatattggcgctaaagcaaatactcgcctggctatgcctcgcgaatgctcaagaaaattctgcaatttctatatgtgcgctacgtataaaaaaataaagtcacaatgccaaaaaaagaagctatgtataaatttgctaccatacacgcagtgatattaaaaccaacaaattagtgggcatctataatacgcccaaaatgaaataaacatataaatggaaatctacagaagattctacggctgcgacatctggagctttaggatagatttttctttttagccttttagcagtcatgtaattttattttctttcatgttggaatccctaatcaggggttttctctacggagatgtaattaacagaatttctatataaatgtatgaattctggaagtaatggactcgcaatttctgatttttatttatttattgcatttaaattaaattgtctctaacgatttgcggataacgaacctactattacaaccatcccggttttcccggcgtcagattctggcacgcccagtgggacctacttctcccctcctctctgagttccaacatgtagaccgcgaatatgaaaaaaaaaggagataaatgcacatatccttagtggaaaaattcacgtattcaagtgcttcatccaaagcgctctatgaaattaatatatgcatgctatggtcttacaggaccagatgaaacgtctgtttatatatatggtcgagaaaactaacatatggttttctttattttgcaaggatgtctaaacaagttcaaccattcgtcacgctgcgctttggctcactgtgggtggacgttcccataggtccattccaggtcgccaacagtggcagctcccttcagaccactgctgcatcgccagctccggcggactatgaacaggaagtgagctcggcgccacagggcgggtacattcctgttctatccaaagctgccaagaggaggagggcagcagttaaggcaagacaggctgcctcacaagagcacttcatcaaggtgcgtgaggccgcttccaacgactcgatgcctcctgggtttaccagggctgcaccagccatgaccagggtggcacccgtcaagaccaggagctacgaagcatatccaaggttccgtcgcacaacactcgggcgagtggactgttcgtgagatacggacgggtccgtccaaggcagcgccgcgtcgccgagcgtcccctgagccaaaagggattgcttcttctatgccaaagaagagtgcactgggggctaatgcatccccggcctgcgtggcggggtcttcatcgactcccgtggcagtgccactcaacattgcccctgagatgctaggggtagtgtctcccaagaattccctaagcatattaggggctgcaccttcaatgtccacagcagcggcaccatcatctgcatcaacaggtgtcgcgctgaaccgccctcaccgcctgcacccacttgataaagggacggctgtgatggaggatgaaacgcaccatgagctgccctcaagcaagaagaagggtgtagtagttctgcaaagtgtccctacacaacagcaaagctcgtcgccgtcatcaagcaagctccgagctgatgccccagagttcatcccatcatcaatcaaaaaatcaagggcatcccggcgcagggcgaagaagaagcgtacgctccaatgggaaggagtgtacgtttcacttggtgacgtcaggatgggtcatgtcgacccaaccgtggtgccttctgacacggtatcgactgttactcccactcaacgcccttccatgcaaggatctttttcaccatccaagaaccgacgtcggcgacgcaatgcttgtcgcacttgggttgacttcccagttgcaactgaagccaaggagacaaggcatcagcgtgagaaagtgtacaatgacatgatgaacaaaaggatcagagaaagccgcagaggtcaagctgaaaggtttgaagattgggctacatttatggaagcaaccatctgccataccatgaaagaaatgttgccgggcgtttcaacgtccgacaatggcatgggcggcgccattatgaggcgcgccgaggcactggccagatggccagagtatcaaaggcttgttgatcaagagctgtggcgacaaacctatgtcaaccatgctaagcgcgtgtgtgctaagcgagcagcgcataagcagggagaattggcagcatgtcacgcccggaaattcactagtaatttccgaacttatttatgcataaaaccctcatccaggaatcagccgaggtacacaaactgacaatttaatatataaatccatcataaacatacttacagaagaaaagaaaacagcagcggaattaacggtctagcgatggcttcagctccactcccataggcagctcaactggggtataagccaaacgtcttctccttctggatcttttttcttcaactgaggttgattgattattgtaaggtgagcatatgacatactccgcaagccacacagcaaatgtgcaattgcacaaggataccaaaggatggcataatataggctcatttgcaaaagcagcatttagcaaacatttaagagaagtaaaacagtagagtaattaatcagaaattttaatcaacactgaatagcacacccatgctgctcaggcccaaccatcctgaacaaccatacccggctgtacagatctaactccaaactacgagctaaacaaattattaccagttatagcatcaataattattgtgagaggtgtgagactaatcacgaaaaacattgctcaacccgcccataaccgcgggcacggctattcgaatagttttactctggccagaggtgtaccattgtacccacaagacacgattccacacatattgccatgccccgaagtaccaccacggcactgctaaggggaaaatcgtgacaatacccttcgcacaacacaactcaccacagtgcaccattcctggatcataatctcccccctcaaaaccagaggcaatggactccccagcgacccccacggacttctcaccgcttctcagtctggcaccccgtaatgaaccatgctatacaaaaggtaaagccgttgcccacgctggctagtggttggcatggttaatgtctcacaacagtagctcgcaaatcggtccttaattgtcatgagcacaaccatcaaaaccatatgctcacaacccacctttaatcaggttttaattatcaattaattatcttaacacgattaaccatcgtgagctaccattgaatataatcataaataataatgtagtgtgattcatccccttaatgagctaatgtttctaagcatggctaagcaattatacatatagcatctagctgaaccaatccaataataaggtccacgctaatcaaattataacccataggaaaataaagtcatcttcggccattaattaattgggaaaggctcaccacccgatgacattcgaaaataatgcataagttgaaataaaacattagctttaaaagggttcaacatgctcaaagggttgtttgggatctgtgtgacttgccttgagcttccgcaaaggcttccgaacgtttctcaacgaaaacgctctcctccggaacgtcgaaaactaaagtaaaagaacaaaatcaacaaaacagtacaaaaacaagcataaacagtacatgtggatatttttaacatgtatatcttgattttagaaaaatttagcaacttgaaccactcgaatccgagttacgatgatttagttatgaatttccgaagtttaatcgattttcaactaatagagaaaactaagaaaaaaggattaatgacgtcatcgctgacatcatcgccggccatggcacggcttccacgcgaccaccggcaaaagagggctcgattgggctaaccgaggacaccaacgcgaagaggacgacaacgcgaactcaccggtgcaaagaacaacgacggacgacgacgaacgacggccggcgacgaggttcgacggcggctcggctctgctcaacgacggcgacggtgctccagtggtcttcggcggctgcgaaggggcggccgaggtactcctcctccgcgcgcacccgacggcggcgacggacggcaacggcgacggctaccgcggcggcgcgacgcggctggaacgtcgacgcgacagcggcggctagggcgacgcggcggcggcgcgacgggccacgagggagctcgggacttggggcaaacggaagaggacgtcaaggggatgctttatataggcttggactagagagatccgactccatacgagaggatttgagccggaaaatccgagggttagtttggagagataaactcgaaaacgaatttgattcggtttatccgggcaaaattaatctccgagaatttaagggaaagggagaggataaggtggagatgatttcccctcaactaattttgcaaacggagcacgggatgcggtggatttggtggaggaagcggcgtcggctaaagggcacaggacggcagctcgggctctgtccaagtttgaagacgacactgtagcagggacgcgaattagactttgactgcgcttcttttctctagcccgattgaaagagggtcatgaaatggactttgggaaagagagggagatgggctgacgatgacagatagacttttccagtttcagcccgaaaagcaaaaggggaattttaattacttttccaattaaattaatcactgaaatgatctttgatttgttaaaaatacttccaatgctcaaataatttcaagaaaaatcctgaaaatacttggacactataagtatttaacaagattataataagaccatttaatgattaatttaatatgtggataattactgaaatattctttgtatgattaaaattaagaattgagctcctaattcccgagagtataattaaccacggagaatttaataaaaattaaatccttccatgctttatattaaggaaattttatttcccacatttaacttctcttgtaaattaatgaacatttaatataaattctaataataatttattaaataatttataaatcctgaaacgaaaatcaggatgtgacacatcacgagcaagctccacgtgcagcaagatacagtgggtacctatgtcctcatcaagccatggtcaatgagtgtatgaggtgggatcgacatcacgcacaccgaagaaaggttgtagccgacttatagtctattattgtacatgctattagctttttatatttgaacttggaatgtagtatccaaaataactttgggggtgtgtagatccaggagtgtaaagtttttgcgttccacatcgggtattatatagggtgtcgcatggggtgttcgggcactaataaaaaaactaattgtagtatccgtcagtaaaccgcgagactaatttattaaacctaattaatccgtcattaacagatgtttattgtagcaccacattatcaaaatcatggagcaattaggcttaaaagattcgtctcgcaaattagtcgcaatctgtgcaattagttatttttttagcttatatttaatacttcaaacgttcgatgttgtcgagggaagaccctcgatcgcgcggagtcgcgtgacccccctttcgtgagttcggccgggggcagagactcgtctctccgaagtcgcgtgtccgtccctccgatccccggttagctagcacacaaatggattacccaggttcaggctgctctggagcgtaataccctatatcagtgaattttaaaaggtttccctcgctccccctctttttggtgggcaaggtcctccttttatagcttaaggggataccacatacgccgtctctaccctccccctccatcggagggaggggagggggcccttctccctactgcgaccgggtttcaacccgtgccttttgctggaagctaagcatcggtcggtccttgagtggggcccagcgccgtctcccgcctgacacggggggcagccctgtcattccctcataaacgagggaggacttgcggcagccctgcatcgaacgccgtccggatgtgatggggcgtacctaccgccactccgcggagacagaggcgacgtgggggcacgaccgcccgtccaatcggccgtgaccggcaatagactggtcacagaccggtcgcatccgactgataggggtcggtcgggcgcgccgcacgtctgcccccgccgcattgaatgcagcgagggacggttggggcgctgcacatttatggccggccagcctggactcccctctcacacttccccccgaagggagggcctcggggtaaaacgacgggagagcccgagggggtgacggttcaccccccgagggggatgttcggtcgcacccgccgagngctcttcccccttcgccctagtgactcacgaggtatgtgggtgggaccagctcgcggagccgcgtggctggaaagggaagtagctctcctttactccacatacccccaggcccatatctccgacagtagcccccggcgccatgtcagacgcgggcttcctgggaccggtctgacatggtgcctcacgacctccccagctgggattgtggacccggcggggagtttaaaggagtattgccgagcggccagattggcgggctagccatagcggcggttcggtcgcctttgatcgcgctaaagacgaggatgcttgggacgcgataatcggggaattggttagaccacgcctcgattacttcgcccgctattcctacggcggttgtggtgacggttcactcagcttgtgctcataaccgttgcgcattccacctcgagtgcgctgctgataggcgcactaaaggtgggacgcggacacgacgggcgacatggtgaacgggcgcgggaaacggagagacaactgcggacgtgggggcaattttgagggcacgaaacgaggaggcgagcgcggatgaggcgaggattaaaagggagtggaggcagggacctctcctccttcctttcgccaaccgccgactcgtcctctcgcttctcgaaccctaacactctcgccactccacgcagctttgcgcgccacgccttccgccactgccccgccggccaccatggctcaagacaaaagcgacacagtgctgccttcttcccgcatctcggcagacagacaccttagcctcccccgcaaaatcatgccggacggcgccgtcgtgagggcgggggagtcatggccgcggccgcgatatccggagcggtccgtgcacctcttgtccttcgccatggcgggattgattccgcctttctcccgatttttccacgaggttctggatttctacgaaatccatgccttgcatctcgcgcccaacgccgtgatgacactgagcatctttgcgcacctgtgcgagatgttcatcggggtgcgatcgacaatgcggttgttccaggccttcttcgtcccgcagctgctacagggtgcggtggtggggggatgttacttccagccccgaccaggcacggcggggcagtacatcgagagccacctccgcaagaaatgggaggactggaagaaagactggttctacaccgcgctgccggatcacccacgacttcgagttcccgccggtcctcccgagagatccgccgcatggctggcggcttcggagctgggcgaggaatatgacgcggtgtgggatcgtctcaggggcctgcgaagctggggcctcacaggggcaatggtcttcggcgactactttcgccgccgtatcgcccctctccaggaacgatcccgtggcgcgtgggagtacaccggccccaacgaccccatgcgcacgcatgcgggcgagcgctgggactggggcgaggaggacgccaagatggtgattcggcgggtgctgggcctggactccgccgagcaaacactgatcccggatgggatcctccccctctgctgcgaccgcgaccgggagagcatcttggccgtaatgtcggtcgtcggcgccggcaggggccggcctggccgagggggcgctagcggtggtggcgactcacgggcgcccggctcgggccgcaaacccggagacgacccggcaagtgacccgaaggggaagcggaaggcggccgaatcttggccgccctctcccccgcgtggaggaggcgccgagcgcgcgacagaccttccaccggcgggtcacaagcgacctgccgggcccgaggccggtcggaagaagaaacggctccggaagatagggcaaacggagccgtgccgagggagctacatcgagcccccgaagtggaccttcaaccgtcctccccgcaggtacaaacgctggcgcccacttcggtgctcttacctagctcggcctcttgttccctccctttctttttcttttgttaacgcgatctgggttcccttgtagcgatattccttctcaggggacctcggggtcggacccctcgcggaggacgaaatccgcacaaccggagcagtccgggcctggccaatccaaggccgcggggtcttcgcaacctcgcggtggggtccacaggacacgtaccgggcctgatcccgagcgacccttagccgggactcgacctaccgtgggtggcggtggcgtcgacgcccctcccgggggcagctccgagactggggtccgtgcggagcgccgcccaggatcggttggtgcggacggtcgcgagcccgaggttgaggtcgaggctgggggcggtcctgagctcgaggccgaggccgaatccacccgaggactggaagcgggggacgaaaagaacagccgctcccccttgcgtttggggcgccctcggggctggcctcgcagaaggggggccgagagcagccccccgtctcgcggggggtccagcagcactccgtcgtcccgggggcgaaccgcgggcttttcttccccatccctggtgagcatggagccacttctgcaggtgctcgccgccaccgactccactgtccgggaggggctcaatacccaagttcaagccctggcggaagaacggacggccctggatgccgaatgggctcagcttgtggcggaccgcgcgcgagtcgatgaggggtgccgtgccgtggaggacatggtgagggtggggcgcaaaaagcaccaagcccacctagccaaaatccaggcgcgcgaggaggtgctggactctgtcatgcgggagacggaggaggagcggcatgcggcgctgatcgcctcgagcgccctggacgaagcgctgggcgatatccgccttcagtacgaggcccatgtcgaggacctggcggagagggtcaggaatgcacgtggcaccctcgacgcagccgctgcccacgagcggcgagcagcggaggccgacgcctcgttgccggcccggactgcggcactcgaggctgaacgcaaggccttggacgaagaaagcgggagcgggggtgacgatagcgatgaagactgggacaacatcgtcagcggcgccggcctcggagggccgggcaccccgtgactatccgcgccttcaattccctcttgttgtgcgcccgtagcgggcacttcttgtatttaagccgtcgcgccatcctgccttgttttgcaattgaaacttccttagctccttttcccctttcgcttcttctattcattgctccttccactgaatgtctttgaaacagagagaacaaaaaaccaggggaaaacgggataatcagtccgtgatcgagatgccgctttgaccccatccccccctcgggcttgttctagcgagatggtgaatccgcgtttggtccagggcacctaagtggtgatgggcaaacccactgctccgagggagccgcctagcgggactggccagaccgaggccgcgtcgaccgggggtcggggacggccgtgtgtaggcccttccgatcctccggggttcgacgcaacccggggcatggcccgcgttcgtgctccctttcggggtttccaggccgcctcacagcacttaggattcagagcaaacgcagattaccccttaaaccaggacaagccagaggaagggaaaaaaacggtctttgggtaaaagtacacaagaattcattgcttgtaagaggaaaaaaggatacacagtggtagcccccggccaggcgcgcacaaaccgaggggttgtgcgggggctggcccgagctccaagaaagcaaaaaagtctcgatattatggatagaagcgacggaggtgttcgatattccaggggttaggcaattctgtgccgtcctccatggttaaccgaacggagcctggccggggcacgcagatcactttgtatggtccttcccacgttggcgagagcttgctcagccctaggcgcgactgaacgcggcgtaggacgaggtcgccaacttgcagtgatcgggcccggacgtggcgctgatggtagcgtcgcaggctctgctggtagcgggcggcacgcaaggccgctcgccttctccgttcttcgagataatcgagatcatcgcggcgaaggtcatcctggttggtctcgctgtacagtgtgacgcgaggcgaccccagggagagctcggagggtaggaccgcttcggcgccgtacaccagaaaaaacggcgtttccccggtggcgcggcttggggtggtccgatttgcccacaacacggcgggcaactcctcgagccatgagtccccgtgcctcttcaagacgttgtatgtcttggtttttaggcctttgaggatttcggcattggctcgctcgacttggccgttgctcttggggtgggcgggcgaggcaaagcataacttgatgcccatgtcgtcacagtaatcgccgaacagctcactggtgaactgggtgccgttgtctgtgataatgcggttgggcactccgaaccgagaggtgatgcccctgatgaatttgagggcagaatgcttgtcgatcttgacgacagggtaagcctcgggccacttggtgaacttgtcgatggcgacgtacaggtgctgatacccgcctcgagccgctttgaaaggtccaaggatgtctagcccccagaccgcaaaaggccaagagagggggatgacctgcaaggcttgggccggctggtggttctgcttggcgtggaactggcacgctttacaccgccggacccattcttgggcatcttgtaatgcagtcggccaataaaagccttgccgaaaggctttcccgactaaagttcgcgaggccgaatgggccccgcactcgccctgatgggtgtcggctatgagctcgatgccctgctctcgagaaacacacttcaagagtatcccgttggcggcacgccggtagagggtcccttctacaaggacgtaccgcttagagatgcgcgcaagcttttcagcttctgcgcggtcctcaggaagagtattgtcgtcgagatacgcccggacattagtcatccatgcgacttggcgaggggggtcggggtcgaccccctcgggccccgggggcgcggaggggggtcggggtcgaccccctcgggctccaaggggcgcgagttggaaggaatcggggcggagggcatgtcgttggagcccctcgaggggttcggtcgtgctgatggttggacaagcctttcttcaaaggtccccgggggaagtggggctcgcgccgacgcaacacgcggcagctcatcagcgagtgtgttgtcgcgccggggcacgtgccggagctcgattccgtcgaagtggcgttccatgcgccgtacttcgcggacatatgcatccatttgagggtcggtgcattggtactctttggatacttgatttacgaccagctgggagtcacctaggaccaggagacggcggatgcccattccggctgccgccctcaatcctgcgaggagcccttcgtattctgccatgttgttcgtggctcggaagtcgagccgaacgacgtatttgaggacgtctccgcttggcgaggttagtgtgactccagcacccgcgccttgaagggtgagggagccgtcgagatgcataatccagtgtccgccacgaatgtcggcgtttgggtcctctttctcttcgggggagggagggggttcggacggaacagggtcgtccactggggcccattccgcgatgaagtcagccaggacttgacttttgatcgcgtgccgcggttcgaagtgcaggtcgaactcagccagctcgatggcccattttaccacccgtccggtgccctctcggttgtgcaagatttggccgagagggtacgatgttaccacggaaacccgatgtgcttggaagtaatggcgcaacttcctcgaggccatcaatacggcgtaaagcattttctgggcctgcgggtaccgggttttcacatcccgaagcgcctcgctgacaaagtagatgggccgctgcaccgttcgggcgggccggttcgtgttgtcaggggcggatgatccggagcgcgcctgctcgggggcccccgggggattccggattatcttgggatcacagggctcggggcctcctgccaaagcctcgccttctcctccgggggcctcagggtcctcccgggggctgggggctttgggggacgaggggccatcacgagccggagggacctcctgctcggtctcctcgcgttcaactactagggtggcactcaccacgtggggggtcgcagccaagtagagtagcaatggctcctccggccccggggccaccaggatagggggagaagtgaggtaagctttcagctgattgagggcttgctcagcttcctccgtccatacaaacggcctggggcgcttgaggagcttgaataggggcagcgctctctcgcccaatcttgatataaatcgactcagggcggccatgcatccagcgacacattgcacatccctgagcttgctggggggcgcatcctctctatcacgcgtattttctcgggatttgcttctatgcctcgggaagagactagaaaaccgagaagcttgcccgccggcacgccgaacacacacttatcggggttcagctttacacgtgtggacctaagactatcgaaagtctcggccaggtgttgcagcaacgtgtcctggcggcgcgtttttaccactaggtcatcgacatacgcctctacattgcgccctatctgattacttaaagtaattcgagtcatgcgctgaaaggtagggccggcattttttaacccaaaaggcatagttgtataacaaaaggtgcctacaggagtaatgaaggcagttttttcttcatcttccctagccatgcgaatctgatggtacccagagtatgcatctaggaaacacaaaaggtcgcaccccgcagtggagtcgactatctgatctatacgtggtagagggaagggatctttagggcataccttattgaggtctgtgtagtcgatgcacatccgcagcttgctgttggccttcgggacgaccaccgggttcgccagccactccggatgaatcacctcgcggatgaaatcagcctccaggagccgcgccacctcctccctgatgaaggtttgtcgctccggggcttgacgccgcactttttgccggacaggtcgcgcatccggtcgcacggcaaggcggtgctcaatcacctccctagggaccccgggcatatccgacggcttccatgcgaaaacgtcagaattcgcccgcaggaaggagatgagcgcgccttcctatttggcgtccaaggtttcgccaatcttagcggttttggacggatcgtcgccaaggggaatctccttgacgggcacctcgtcggccaaggtgaggcgcttcttgggggcgcgggacgcgggggcctccggggcctgcggccccgtggccgccgccaggttgtccgcgcgctgttctgcacaggcgagggcgactttgacatcactaaagatggtgatgggaccggcaggacccggcatcttcatctggaggtaggcgtaatgggtggcggccatgaactttaccaacgcgggtctgcccaggaccgcgttgtagggcagattgagatccgccacatcgaagtcgatccgctcggtgcggaaattggtggagtcgccgaaggttactaggagctcgacgtgaccaagcggccacgtgtgtcccggagtaacgccaatgattggcagcgacggttggagcttcatccccggggccttgagcgcgtcaaaggcagccggggagatgatgttcagactggccccgccgtccaccagcacacgcttcatcttgacgttgtggatagtcggggagaccaccagggccaacttccctccccgagcgagtaccgtcggatggtcgctctggtcaaaggtgagctttacctccgaccagcacgccttccggatcgcctcatgggtgggaacagcggccagaagttcccgcctcatagccttgaaccctcgacgagaagtgcgagcgcaagcccccccatcgaatgtggcgacggtcccttggggtatctagaaatccagatcctcaccacctccgccatcgtcagcgggggccttgttcttggcctcctctcgctggtcactggttgaggtcatgggagccttgccctcccgtcgaccctgccgcttttcctcatcggcctttcggaaccactcggccaagttcttgaccgagcggcagtcggtgagactgtggcggtaagtgttgtgccccgaacaccacttgtccgccgaccggcctccgccggagggggtggtggagctcggcttatcgccggtaatctttcctttgcgcggggcccacgtgggccctctgccgcaaggacatggccctcgtcatcggaacgggccggtttcctcttgcctctcctatctcgccgcttagagcgaggggcagactcgggggcagccgcagccgccgcaccggtgccaggagagttccaggcccacgcctcctccttccgggccaccttgtccgccagctcgaagagctcggcggtggtcttgggctccttggaggcgatcttctccagcatgcggttatgccgcacgccgttccggaatgcatacactactgcgtgggctggaatgcacggtatggtgtggcggacctggcagaagcgctgtatatacgaacggagggactcgtcgtccttccgccgcacagcatgcaggtccgcttcttcccccgggcagggatatgtcccctagaggtttgtgacgaactgctggcatagatcctcccaggagtgaatggagtcggggagctgggccatcaaccagccacgcgcctgacccttaagggccatgggaaagtagttcgccataacccggtcgtcaccccctgccgccacgatgatcgtggtgtagatttggaggaactcggaggggttgatgctgccatcatacttctccgtgagattggggcgaaacttcgggggccaccagacattctggagactcgcaacgaaagccctacaacctgcccctcccaggggtgagcgtggggggagggccgcctcgcgaagaagagcgcggcactccagatgaggaggcaccttcccccatgcgggtagcccggcgctcgtccaggcgtcgctcgatgttgacccgagcatcctgcgccccgtagaggtcatcatgacgcctccgccttcccgagacctccgatgtcgttggagccgtggatcgcctcaaggttgtggccgatcgacgggcccttctcctcgccgacgaggaaagggtagccggggtactcgatgtacctgtggcggtggattggccacccgtggccaactgccgctgggcagcggtgaccaagttggccacgtcgtccagccagcgccgcacgggggtctccggctccgggttcacctggggatgccgcagaagggcgcccaccacctgaagcgcgccttggggcgaaccaccgtctccgtagtcgagacggcgacgtgctccgacgcgtcgcgacctccctcctcctgggggcggggagagggccgtaccgcttgaacgggttggatcctccctccgcgaaggctcgcggcggggaggactttgagagccatggcgatggtgacgagggtcacggttttcgcccgaatccccactcccagacggggtgggggtaggcgccaccgcttcctctgcttccaggacctcgaccatggcggtctagggcctggtccgacctgggacggaaggaagcgacttcttctcaaacgcgcaactgccccctacttggcgtgccagctgtcgagggaagacccccgatcgcggggagtcgcgtgacccccctttcgtgagttcggccgggggcagagactcgtctctccgaagtcgcgtgttcgtccctccgatccccgattagctagcacacaaatggattacctaggttcaggccgctctggagcgtaataccctactcctacgtttgggattatcagtgaattttaaaaggtttccctcgctccccctctttttggtgggcaaggtcctccttttatagcttaaggggataccatatgcgccgtctctaccctccccctccatcggagggaggggagggggcccttctccctactgcgaccgggtttcaacccgtgccttttgttggaagctaagcatcggtcggtccttgagtggggcccagcgccgtctcccgcctgacacggggggcagccctgtcattccctcataaacgagggaagacttgcggcagccctgcatcaaacgccgtccggatgtgatggggcgtacctaccgccactccgcggagacagaggcgacgtgggggcacgaccgcccgtccaatcggccgtgaccggcaatagactggtcacagaccggtcgcatccgactgacaggggtcggtcgggcgcgccgcacgtctgcccccgccgcattgaatgcagcgagggacggttggggcgctgcacatttatggccgcccagcctggactcccctctcacacttccccccgagggagggcctcggggtaaaacgacgggagagcccgagggggtgacgtcacccccgaggggatgtcgtcgacccccgaggctctccccttcgccctagtgactcacgaggtatgtgggtgggaccagctcgcggagccgtgtggctggaaagggaagtagctctcctttactccacatacccccgggcctatatctccgacagatgtgatagggtgtaacatttttgtgcaggaaacatgacctttgtttttaagaccggatggagcactttgttaggcggtttgggagtttggaacttgtgcaaaacggtgtgttttaaaaattaaaaccattgctctcgtacataccagatatttataactaacggtcgagaagttcaaaatgtgtccaaaggttgagaagtttaaaatgtatccaaatcaacatattttcaatatttgagggagtaacgtgatataagaccatatatttataactaatggccgataagtttaaaatgtgtccaacggtcgaaaagtttaaaacaggtccgaagtccgaacctcgtgtttcaggatatctacaacgaatgcttgggtcgggacgtaaggttaagggcttgtttggttggtgccctcagctgcatgcctgaagaaaaagtgctgcttgaaatctccctgagatcttgatgtgttcggcctgatcaggcaagcctgagattactctgtttggttgcaggtctgaggtcaagcgtgcctgagctgaaaacacaaccattgaatgacgtttattatgtgaacaaagcgtaaaaatataatacgtattcattttacaaaagtaatctctcatctatatacactagcagtccatctaattgcacgatgatcacaagtatcgcttgcatctagttgacattgaagcttcgagcagcaacaattgaacggaggattgggcaaggggttggtgcggcatctggggtgtcggctactcggctgcgcaggccagcaggatggattacagcgctaattatcggtggctgttgcggcctggagttctggcgaccaaaatgggtcacctggctcaggctaaccgcaagtcagaaggaatcaggccaggcaaggggtagttgatctcaggatagcaaccaaaacaaggttcaaactaacctcaggcttgtcttcactcaggcaagttcttctcagggcatcaaccaaacagcccctaaacctctcttagttgtgccaaaggaaattatggaaatttttaacacggctataatggcacaatattgacaatgaaaaatacccatataaacacaattttgcctaattgtgttacctactatagaaaacttgcgactgtagtttcacacgaataacgttctcgtgcaggtgggtgggccaccggtccatgcaacagtagccgtgccggcccgacacggcccaacacttccttgggccgttctgcccaagacctggcacggcacggcccggcccattacagttgccgtgccatcagcgggcccgagctatgctgggccgggccgcccatttggcctgctacacataatgggtaacatagtaaatctgagctaaaggtggagtactcgagtatctcttcccccttcccttcgcgtaaaagagaaaaaaaaatctcccgtctcgtcgtctcatccgcttctttcgccattcgcggctgaacaggggaggggagggggagggtcgccgatctccatccggcgagcaaggggatcctggtgagcatccgcatcctctttctgatgattcatctctctctctctcaccggggatgcttctgtcttggaatttgcttgcgtaaaccctagcttctcttgtagatctggaagaagctcttctcttagttccagagcctttaaccttaatacaagtaacagtttgagtttgtttgttgttcccccaaaagtttggggggttcaactgaacccccatgtcccaagttggatccgccccctgttatttcactcatttcactaatttgtttacatacagtggaataatgtagcatttatttttgttatgcaccgttgtagatctgatgagaattcctaatgcttaaaattgcctgaatagatataacgattaattcttgttttcaaggaagtttcaccatctatggtgataatgtcattctgttattacagaggtcaatgtgttgtagataataagtgacataggttgtatcatttatttcttctatgctcaaggtcctgaactgttgtgcatgtttcatttgttgccccccgagtcatattatttggcgcgggatacttcagtactttggatcaaataatcgtgatgggaaggagtacatagccaaatgctcttttcccattgtaatgcacgggcaactaactagggtatggacattatctcatgtttgtggtcatgatcaaatcgctcataaaacatgtgcatcttagattataggcagaaatgtattccaataatgttatttggagtgaaattcatccctcaacagaaaaaaattctgctaaatactctattaaccttttctgtgtgatactcatgggtatgtatgcattgattgctaaacattttcacatgtgcatttgacagctcaggtggcagcaaacaggaagctttctccattagaaggaatcaaaccgatcgagaaggatcaaaccaagaagagaaaggatcctacatagtatcttgatactggttaccttggctaagaggaccgatcggactattggagaggaggggctaagtcgtctccacaacagtgaactgtctccgagccaaaacagaacgaacgcccaaacaggcaaaccacgaactcgaaccctagaaaccctgaccatggactcgggaggcggaggaggggcattgcacaaggcagcgtcgggctccgcaccctcgggggcggcggccgcgaaccccacggcgatgctctccgccctgatgagcaagcgcgccaagctccaggaggagctccgctccatagagcgccaggttaggtcttacacactgttccctgtctcttttgcgcctctctctctctctctctcttggaattagggttttgtataggagaccatggatttgttgcatatatgtacagatggcaagggcttgccattgctcaacatgcgaatgagtggtgcgaatttacatcgctgcggatggttgtaaaattggagttgtggatacctgtagtagcctgaatttattgttcaatatttcttaatgccttgggaatgatagaaatatgaacctatttggaaccaatatgctggaccagtgaccactgattgtcatttcacagagaggatcagttgtgacgaacaatttggatagaattaggaggaagggaagaaagtatcaatttgatattcttgtcgaatatgaccattctatttcttgtatgttgttctttgtgcctgagaacactttgttattctaaggtaaaaaagaaaatcagttagctacaacctgaaaattccatctgttcttctatcctcgagttaaaatgtggagtttctactgtgtcttagtcagaaattattcgcagcaagtatcaaatgagctacttctattcatagtatttcaaagttacactatgtggtccaaattccaatatatgtttgtgatggtgaatcttggtgtgtcatccaaaatcattaaataagaggagcgtttggtttagtagaaaccataatcctaaaaagggaggaaagtgctattgctctcatatcaagtattttaatggcactaatatgtgtgttttttttagaaagaacaaaacagtcgctctttaataccaggaacaacacatgatctataatgtcaaccatctttgcttgactttaaggggaagttttgtatatgatattaaacactcataatttaacaaaatatctattcatgcttttaacagaattgttcttatacaacctgcaaatgatgtttatgtccatatgttgcaggtttatgaaatggagacaacctacctacaagagtctaatcaattcggaagtgtgctaaagggttttgaatcattcttatcatcgtcaaagaacacttccaagtaagaaatctttattttcttagactgctacgccctttactatttggaggtcttcattcattttcttttgacatcccactgtatacttaccagttcgaaaccttcagaattcatgccacattctttgcttactttcaactgttgattgaatgacctactgtccttcccttgaactttctaccagcctctgatcacatataatttagctaatattcggatgaataatttatagttatagatattgaacaaaagatcctctgatcacatataatttactaatgatcagatgaatgatgttgaacaaaagatcctctgatcacatataatttactaatgatcagatgaacaaaagatcctctgatcactatagtggcagtggcaggtattatacaacagattcataacccaaaatatgctatgatagtgttatgtcagtttattggccaattgcaggggtgctctatatgcactatctagcatcaccaagggagggttggatttatgattaccattggcataatgttgcgtgttcattattctgcacaagcaaatgttttatcatttctgttctgctaatagatcacacagaattagttatgacagtttctatcttattattttcagtctcaagcgctccaggaagttccaggctgatgagaggctgttctccctgtcatcggttacatctccagcggtatgactaatgatcctaaatcctaatgcactgaaaagcccgtgccccttttttaatcttttggtttgctttgattgatgattgttattccccctgtgctatactgatatttgtgagtttgctaatacataccattattttctattcattccaggtcgatgaacatatggctggacgagatggtaagttctctttcttgttttcattaagctgaaaccaggaacaattgagactctgggctcaatactagctgcatcctggcagatggaagagaatatggatcaggtcgttcgaaaggtgcaaccactcctgcaaacgggcagtaagtgctcagattacctttgtggcaaaaaatgtgctatccttatcagctttacatacatccttgcaaggggcagtgtttgtctaacacttctttatattaaaaaaaacagtgtttctaggaacaacccttttagcccttgtttagttccaaactttttcttcaaacttccaacttttccatcacatcaaaactttcctacacgcacaaacttccaacttttccgtcacattgttccaatttcaaccaaacttccaattttagcgtgaactaaacacacccttagtagaattgcctagttctgacccctcgtgtgtttggacagaggaaaaccaaagaagggaggtcgccctggagggagagacggcaagagaatacggccatcaaatgatccagatctggacgacgaagaggacttctaactcgacatgttgtaggcctagctcagtgatgatttaaccttgctagactcatgcttcgaatcattctttctgtattgtaatttttttttaatcttgtgttgcaatccatggcaagcaaagccttttccccagggagtagccttgctcatctagtcatcttatcgtcggcatttgcctgtgcttgcattttcttccttttcaacccaccccggcgttgtctgattgtctcccgttttgtaaagcagtagcaagttaattagacggtgataatttctgttaactctactgtaaacaacgttgctatagattccagactccagtgagacgaggatgagactccagcgagacgagaatctggattggccgattcttagtaccagaaaaaaatgtctcatccgattataggtttttatattttggaacgtgtagttgctagcacaccgccgcgtttgccagggccaaggtggagttgaatctgtgagttcacctgttgcattgcaagacaagctggaacttgtaatctcaacaattagattgcagggtgcctgaggttaatttgtgtacacttttttttagtgtagctagcaaagactacaagtaatgctttttatattagtataggtgattaattagctctaagtacaatatgatgatgcaacacgcaggcatgcatgtctaaacagctgtgcttagcttcaagtatggaaatagcttgagcatcacttcttcaacaggttgcattgacaaatactccctccgtcccaaaataagtgcagttttgcactatttatcttcaatgtttgattatgtttgatttttcgtcttatttaaaaaaaattatgattactatttttattgttattagatgataaaacatgaatagtactttatgtgtgactacttttaaaaaataattcataaatttttcaaataaaacggacggtcaaacattggacactttaggatggacgtagtatttttcattttcagaatcttaaatgcatttgtccatgaaaacatctttcgtggaaaagatgtcagaagcttttatctaagaatctcgctgaatcatcatgtttaagtcgatcacatcagctgcatatatctgtcaacagaagaacagaacaggttgaaaaaaaaaaagctgaagttgatactacctccgtttctaaatatttgacaccgttaacgttttagcatatgtttgaccgttcgtcttattcaaaaacttttatgaaatatttaaaactatatatatacatataagtatatttaacaatgaatgaaaaaaactaataattacttaaattttttgaataagacgaacggtcaaacatatttaaaaaagtcaacagcgtcaaatatttagaatcggagagagtattttttactagaaacatcaagaacactagtagcacttattcagaatgagcactgttgaaaatgtggtgctcttattgagaatttcacaagagcaacacgaacagagactctatcatacatcaacctaggagacgcccaggttggcagctaatatcaaacaagatgtttaaagctttgctgcaggactccgatgtacaaagtactgaaaaccatggatcatctaggtacagggaaaagaagatagaagaaagcacatcagtaccataaaagttaccacacacagcagaagcatcgatctatctacactcagccaaaccacctgaaagaacagggggggcaagcagcatgccttgcatcaagcttatctgaacggtctacggcacaacctggcataggtgcctctggaggaagaattcagtcagcaactgtaactaatccttggtttatttttctagttcagcatgttgagtcgcgaaagaattcggtcggtattgagggtgggcagggcttcttcgccacaaatttgtactgcagaaacaaaggtacaggaggcagcattaggaacagtacagataactgaagaaatggggaggatatgcagtttataccttatgttgggtatacttctccctgattgcaggaaggttactcccaggaccaacacagaaaaggcggtgcaatgccttaacgcagtcgcttaactctgacgacttgtattgtgtgtagtgagcaagggtggaattctgcttccaatttacaatgagaagcatatgttagctcttgtatttttttatttgaatgttgatataaaagatgtatggaaagttcaatatgatgatgccaccacgtacccaagggtgctttgctggctgcagtatgaatttggccaggaaaatagctgatgccgctactagtgaaggagggtaagaaagtagattgtactccagcagtgatagctcagcaacataattggctaggaactcaagatgcaatgctggatcctgcacgatgaaaagctgttaatgcaatgcagcatataaatagtatgaaattgcagcaagcaggagatgattaagagagcagcacctcatcagatacttgtgcaacacggacaaatctcctgttgtaggcaagaagatagttattagagttcgattcattccagcattatagacatcgatgagatgaaagagaatagaacctcaaaaagcattttgctgtaggtgcagtcatttcaaacttcaggtaattcaggacagaagcttccatttccaaaacctgacaatctatgtgttagtcatggagataaacatagaaatgttcacagatatgcaaaacaaacctcatctctgaagtatgtgttgtcagttatatagcagaattcttctacttgaggtgcacatatctccttgtattttctgatataggaacaagccaaaatcagtacacaaaactcagatgcaaactgagaaacacatttaaaaaaattgctaatcagatcttacgcagcaataagcatacaagcaactccaagtaattgcagtctttgacgattgatctcattgccagaaagataacggtcaatgtagttaactgtcaggtataatgtatcaggaacaagacgatattcttcagcgacctgcacaaaggaaaagcacaaatagagtggtaagtaacgattgtggtctttaggctccaatcaactaaaaaaatttgttcggtataaaagcttacttccacaagccagtctatcaggatcgctctcatgcttgggtttacatccttttggagtgtttccataaaatcggttgatggatgtttcctggtctgcttcaagtcaaatagaaaatcacaatgtaaatatgaaattcaacctagatttgaaaccactgtgctcaggtcagattaattgtcatttgatcaaactgactgcagtagtgcagtccatgtcacagcaaaaataatgagcaattgaaaaatacttcaagagcattgattacaacaattgaaatgtatcaattcatcggttcagtcaatgctttaagaagataactccattacaatttctccatattatactgtgcttctactggttctatagggaatttcaatatgatggccattaaatggaacccactattcagaaaaaaaaaagtattcaagaatgttttatgtaaggtgtttacataatatgcagaacaaaactactgaaaattgatggtcacaaagcatgtctggtagatgataaggtgcaccaacaaagcgaaaagcagaaaagaacggattgtggtgaaatgtgaaaaatatcctgataaattacattggaataatgccttatatcagtgatgtgcacttattctcttcttaatttatggtctcatcaaagtaaactttttttacttgtgtttcatatggatgcaatcaagtctcaaatcatgaggaagcaaaacaaagccttcctatgaaaacatactacaataaggtgctcaagggaaatgttttcagagaaataaggtttagtcaagaatgtattacctcggcctcgcgcaagtgcatgtagatatcagaagcaagagtagcacacaactgcggatcctcgtagttattgtcaacatcacaaatttggtcgatttccattggggaaggagcatccttcttccacttagtttctgcgaaacaaacaagggaaaagatcaatcaaccattccaatagaatgcaccatatagcacaaatttttctagctataactgtgcatttcagcaaccaaaacacaccttcaacatctctatcctctgagatacgcaggttctcgtttgctcttcgctgcaaggaacctagaactgaggaggaatccccattatcaatatactcaaagtctgggcttttcattgagtcgcacgtcgacatcgtctcatcaaccgaaactgaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggacttaagttaagtccctggaagtaaacaccacctgaatctcctgaatgcataggggagacgaagctgctgcagggtacagtgacaggtgcaggtgcagcagttggaacaattctaagcactttaggaggaagaactgactccttctgtggggcgctctcatggcgggatatggccgaagctggcttggtggaagctgatttcaccgccgagacccgattcgtgcccacattgcggccactggccaaagatcccttcttcacaggtgcagcccaggtagctgaattaaatttctgcaggaggattgaagacaagaaatcaatttagaacttatatttcaatctgttcatttgggattccagaccacaagcatgaaaaggaacaaatatttattagaaacattagcagcacgcaagtatcatattaccaatagaagattccaaagcaagcaaacatacaaaacacttagcgaataccaagaaagcttttattttgaacttctgaaggtgccaataaaccctcaagtgaatttagcctgttgacctggatgctccccaagaaatcaatcaatcaattaaccatgaaaagaaaccagaaaatcagcaagaaaaatcttgtggattggaataggagaatcctcaaaatcagcaaggaagaatgtggcagaggtccaaatttgaatgtgaagagcactgaaaaaccaaaaggcaagaatatattggggatggaagaggagaatcgtttgtaggctaaccaaggagaaattgaagaaatgaaaatcttgttgttggctgaaagaaagaactcaagaagacgaattcaagaaacactatttatatttgcttgaaaccaacagatcgaggagtatgtcctccacaaacaagatggaaaaaaaccaaaaaagaaaaaaatcatcacagatcgcttcggccatttccgcatcaacagcgactcacttgtgccccaagaggaaccaagaagcaaaaaaaaaaaaaaaaaaagccacccccaaaccattccaaccacctcacacaccaaaagatctccacccaaaccgcgcaaagcaaagaacaaatcttggagagaaaaaaaaaggaaaaaagaagaagaagaagcagcagcaagcgatccttcacgtaccgcattgttggcggcggcggcaacgttggtgatgttaccgagcgcgacgcgcttcttggccgccgcggcgcccgcggccgccttccctcctccctcccccgccgcgggccgcttcgccgccgacgacgacgacgagcggcgggaggctaggctgctcgacatcggccgacggcaaccaccacctgaaccctcctcctcctgctgctgctgcgagggttgcgagggcggcggcggccggcggggatcagaggcggagcagggcgagggcttggatccttcccttcccgacagaggaggggagagccggagaggagaggactcagaggagcggaggaggagaagagagaaaatggcgacgactctttcgattatttccagtttttggggaaaatattctaatccctcgaggatgttccctcgtttgctcaaaaaccatctaaacggttatgaaaaatactgaaaaaatttgacaacattcatacaacacatatatacaactctacaaaatcttaattccaaactcaactcacacgtcgagatataaaaagacaaattcagcgtatgaatagtagcgtactgtttatatctaaatttgtcttcttttgtttctcgatgtgtagatcgaatttgaacatgaattttggtggactagtaggtatcattatactctacattgttaatttttttcagaatttttcataactatttgtatcgaatttggaagaaaaaggtatacgaggggatatccctcgagggattagaatccactccccagtttttgggccgttacagttgttcaaatttcaaatagtagtaacaagttgttttagttattcgaccgttttatctgtctttctttttttcatgtcgtcgtggttgggttattacgttttc

SEQ ID NO: 66392 - DNA, 50327 bp, Oryza sativa
ggcacccctccctttccgcccccttcctcctcaaccacggcccacggcggcgagcagcaccctcgctcggcggcggcgccctccctctgcaggcgacgccctcccctcagccggcggcgccctctcctcggcagcatcattgtcttctccggcacagtggaggcaaccccttcccgttagtgcctcggcgataacatcctccttgcggcgcacggtggggcgctcgccaagccgccacgacctcggggcagcggcgtgcttgcctctgatgtgagcagtggcgccggtttttttgtgattttgtgattctcttgtttctttgcgtaattcttggatcggatcggatttgatctcttgttcaataatctgtattgcccgtacgggacgggtgcgagctggtcggagtgagatgcaatcttgcagactaatacggatgaaaaaattcctaggaaaataaaaaaaatggatggaagcggactttcctccttttgttttaattttttcgtcctttttggttattattacggacgaatttttttggaatccgacagatcttttttttttccacccgattgaatcggatcgatttttttcccttttgttaccgcgtcgactttttttttcgcccccgattttttttcacacggacgacggaaacatctcatactttttaagtagtagtatagtaagtatatatttttaattttcgaattaaaaactaattcattataagataagatttcataataaataaaaatctgttgaaaaaagagaaaaaaaatcgaaggcaaatataatttgacatgagggaagcaaactgtgcaagtaataaaaggtgtacaaatgagagaaaagtgggagtcgaacccgggtggccgaaatgaaaactttcatacctcaccaagtgggaagactactacatgtgggaagtgattacatggaaagtacatataccgtatcaaacgtgattttggagtagataaaaaaatatccgatcgggctgttaaccggattaaatccggatttagcgaagcgcgtggtaatgacggacgaaaaaaacatccggaaaatatatatatatatatatatatatatatatatatatatatatatatagagagagagagagagagttggacccatccaatcctactggtgaaatcaggtcagatgtaatccgaaccgtccacccatctccaccgcacgatttcaccctctccacgcgtgaagaccgagcgaagattacgggtctgtttggttgttgcctaacattgccataactcagtttgccataggtgtggcatggcaaacaaagtgtggccaacaatttgttggccacaagtgtggcaatgtttggctagaaaatgagtatatgacatgtagacccatgaaataagaaagtgtggcttgccacaactgaaacaagcaaccaaacgctaagctaacaatctgtagcatgcctaacatgtggtgtggcaatgtgtggcaccaaaccaaacagcccctacgcctcatcagtcatcaccctctcaacgcgcgactcactcctggcgttgtcgtccccttccgccgccggcgcgcactgaacgagaggcgaggtcttcccaccgctggagcttccccatccaccgcggccggccgcaggtccccatccgtcgcccggagccgacgtcgtccccaaccgccgccgccggagacaaggtcttcccgatgcgccgccgccgccgcagtccaccgctgcccatgaggtcgttcccttccgccgccgctgccgccgtcaccgcgcactgaaccggaggcgaggtcttccccagcccctgtcttcatcgtgcgcatccttgccgtgcgccatgtttagttgtcttcaccctcgacgcctcggagccggacgcccgctgcccaccaccacaccaccggacaacctctatccctgccgccctcctctccatcgtgtgcttgccttctttagcccgaggagagaggattcctaccacgtctttctgttgtgccagtatcctcatcgatgaatgattttaccacagcagcaaagcggttgccatctgctggtattatcccaggtttgcttttccgtctcctctccttctcaattcctttatgtgcccttgttcagattgcatttactttctctttctcctttctgctatcaaataggatcaatgaattgttccgtgaatgctaattatattatgagaatttttccccggcaaaaaaaaaaaacaaatgaaatctgtagcaatatgctatatattaatcttgaatttgtgagaatgtcaacattcaacctttcgactatgaccctatgtcacactgattcattgtcatatctgttgatttccaaatttgcttaatcgatacatgttaaaatgcaattccaatatatatgaaaaataacaaaattgataaaatgtttgattatgctctggaaattatacaaaatgaaaagctcaatctatatgtaaatcattgattctgggtacttattcaactacaaaaggcattgccccagatcccaactttcataactttattagtttgtcatttttgtttttgatccttgcacatgatgacagtacctctgaggtattgtttcactttcaccctaaatttacatgaaaaatcctaaatgcaatttgttttacctatgtaaatgatgcaagatgcaagtgtaggagctgaaaatttctctttcagggaccaagaagaatacaaacttaacagttaggtataatcataagattatatattgtgtttcattttgttatcattaaactgatccacatgatgttcaagtgattacacaagtgcatagattgttttaaaagttgggttcgatagatatgtagaattccatgccgccatcagtgatacctcgcaagcaagccacaatgtctgcacctaggccttcagcggctccagctactgcgtgctgcagatggtacccttccattacggtgagggggtcttctagattagctatcacggttttttttttcatgtttgtgcatgattggagtatctcttttttttcggctgtactgaaatttggtttgtgattaacctgtgaaagtatctgtttgcactgctcgatatcctttattttgaaagcgacatcccgaggaggaaggctcttgtgctaaagaaaatctttagttcctctccttccaattttttcggttcttctttttgttttgattaatgaaaccagaaattcttgaactgaaggaaaaacaggtagctctactgtgtttatggtctttcctgttgaagtaggaattcataggtgtgtggcaatgctcagcgattgcacaaggttgattctccacttctctgcatcagatcggatatatttcaattggttcgattttgatctatactgactcccttttagctaaaaccctgattactgataatatatatgttctactcagtgaaggggatgcaattagacttggaaatggagttagaaggcttaaaggttgctaatgtgatctgcatgatattatctcatgaaaaccaaacattgttttgccccttttatatattttgcccttaggattgaatcaatatttcagaatggacgaaggcatatatcctcttcaaagaatgaggtctcaagggatttggttgtcaatgtaaaatcacagatgaaacaatctttgttggtaagtaaatgcactttttgctgcattgactgggataatctcgatgaacaatgatgttgtttgctactttgattttaatgtagatcactgaattgccattctactatatatgaagcaatatttttaatgtgtaaaataccctaggtcatgtgcatgtttttttcctaagttcatgaataaaatctcacttctatgttagggtggctactagatccaatcctttggttttgtgtttcttatacacccaatgatattttttattttttttaggcttgggtacatgtacatgtttaatttttcttaatgtcaattagatatcatttgccaattaaaattcatgtagaaatacacctacctgaaccaacatattcaatcttccaatgcatgttacttcacaattttcggagctaggaatcttttagagctggacaaatccatttacattgagtgtttattataaaagaaatatattttcaatcactaagataatgataaaattctattatgtgtttgccgataagcccaggtggctgcccggggttgccaagcggtgtctccacctctgactccattcatgtaatcatgttcatggtctgctccattgagtttatttttactggatgcacatccttccattagtagttcttgcaagaaactgaaataagtaacagtcgtatagcattatgctgctagtatcttcagtaaagaatgtattgtcatttgcttacctcttttgtgttttcttcttctgatgcttagagacacaaaaacaagcgtgtacaaacgatggaaagagaataaactgtaattagtgatcaagattgcaccactcatcttttgccacaaacactgcaagagagattgatttacatatagtgaatgaatcaattctacagtcttgaagatttagctctaggttttctttagatggaatgtgcctcagatttagatttatgtacattttaagttgccaaaataaacaactaaatgaatctttacgcaaccacgccaaaggattcacctagatgcttcagtcaacatactatgacaagcagaacaacgtttattcttatcttttttatatagtaatatgcccttgctatataaaaataaaagcagaactacaatgtcttaaaagaaaaaaaaaaccatgttttttagccttggtctattgtcaatcatttgaatatgctttgcttataaatagatgattcatattcatacaatatttgctaatacgtgcattgcacgtgcacgattactagaacttattagccgtaccaatattttggtagtttagatagtacatgtgcttgtttggattgtgaccaatttattggtactgtccatgttagatttagcatcaatctagagcaacttcactataattcatatgttgactttatattggtagcaaaccaaatacaatcttgtcctacaaagaaattggtagtactaaaatttatctaagttttagcactaccaaaaaattggcatgtagcaatccaaataggcccctagttacttaaaaaattcattttagagtaaaatacactagcgttgcttaaacttgtaacgaggtctcacttaggtccacgaacttacaaaacgcgcattgaaatatctaaacttggtttaatatatcatcccagtccaaaaccttgtttgatcgtggtcttgcttacgtggcatgccgcgtggatgatgacatgatttttttttctcccttcttcctttttttttgtgggtagataaggagaacctacaaaacgacggaacacgtccatattcacatagtgaaacacgatcagactatcttaggcggaaggatgagtatgaacgctgaattgatgcagaagctttagaatgcaaggtaaatcctctgggactcgtgtcgtgaacatccagagtgtcattgtggtgaccgttgtcaggtaataaggtatgtaaggcaacgaacttgaggacaaagatgcttcgtgtgtcctaacattgtcgatgatgatttcatcataagtatcaattctttcggtaccactaatcactactatcatgcacttacccgtccctataaaattgtaccaataggaggatgtaaggaattgtcaattcatacaatggatcgatacggtcagagttacttccaatggtcaaaccataacgcaacatgagacgaccactgttggtaattcttacggttacagataaaatccgcaagcgcacggatataccgatgtagcacttcccctacggagtattccaaagggtatcgaatccaagagaacgtgtgtggtcagatcttcctccggttcatccaaggacaccaagctaaagataggccaggatagagaggatatactggtgagaaacagtgtctagggaaagcttaagtttattcctaatgcaatacttcaggcactggcaacccgctcttcccaaatgtcgctctactacatacccggatagggaggacttaagtgatctcgagggctgtcaccacctctacacctacctcaaacgtattgtgggatacgcaacaattattggataataattacctaaacaccacgtctaagaaattaatatctacttcagtgtttataactcactaaagcaatcactatattttagttgattatagtgaacaataatcccgtatgctatttaggaactaaccaagaaataattctcacaagataaatctaaattactcaggaagaatattatattaaaatcagagtaataaatagaataaaagaaatgagagaagattaccaacaactccggaattcttccgacttcttctactctactctcttcctattctagtatacaatatagtacaatggagcctcttataattcagctcaagcttggaagtgtgtgtgaaagtgaaggagtgaagctccttttatagggcagttatgacggttgtgagaaggggaaatgtccgaactgccccgcaaccgtcatgaggagagcatctggagcgtccacgccaaaccctaggatcaacggtgatcagaggagtttggccgaaccagggagtttagccgaaccagatcaacggtgatcagaggagcgaacctgggctgggccatccggggctggccttcggcttgtggactcccctgactctccatttctcggagttttggggtgagtctttgatattttgatgaagttcacaacccatcctcgtatggatacatgtttcttttcacttctagatttcctcccaacttcggggtttaacacctgcatacaaatatacactaacacttgtgaaatatgtgagattaaacacctatctctatgttggatgttttattatctggtagatgttggtggtatagaatcgacatttaatagccgccaacaaccacacatttcatttaggcttggatagagtacgaacatcgggtacaaattgcaagcttagactgtaggaacaatccattagatttacctaaatggtatgagtatccaaagtgtggttgtagagatcgctgctaggtggctaccgcctttgatattgtggatccacaaagtgaatccgcacctccttgtattgccctgagcaataaatatagttgtcatggcgaaaagataattgattttgaaatagaagtagagtaccaacgattgaaggagaatgaaaatgcaatatggactgacgaacgatggtgaggaccttcttttgcggaggcgattgtgaggcggcctaatggcgatctggcctccatgggggatctctccttcgcggacaagtgggatttctcactgggattggattttgcctcccagatttggtctcgtctccgatcaccggttaatttttcccgctctccctcatccgctttccatttggtggtttgtttttcacatttctccttccggctttctatggattctatggctattgccctcaattgctgtcttcggggaaatccaatgattttcgggttcgacatctccaaaattcctgttatagtttttggtgtcagataggaaggtaggtctctggatgtactccttgaaatctttccaaaataagttcttcaagcttcattttcacttatggaggaatggaggtcctgattggtaccgtgagtacacactatgggttcttgaagaggaaaattcttggactaaagttggtagaaaatcaaaacccatctcaaatggtgtcattcgacctggggtctcgtttgctaatgtgttttcctctgaacctactcggtctagagcagctgtactgattaaaaaagtttttgacaccatcaaggattccattcttgatcctaatcggccttccgttcttcctgtgaggaaattagtttttgactgtctggattttcctagacgaaatgttgttcaagtttctggcagtaatttgcttcacgatggatcttcgtccaaggcgggatctttgggctctttcaaatgttcaaagtgtcttgctaccggtcattctaggtctgattgtcacttccgtgtttgtttcaaagcctgctttgcttatgggcataaggcccgttactgtttggcccagagtaagaagaaggccttgacgaagtgggtagttaaggggagcaccgggaataaaacaagtcacttccgtcgtttcatctcttgctccatctctaccacaagcaaagcgacctctccttatccaatctgcaaaacccacttcgccgaagggccgcattgatcagagttccgctcccatggcagatgtgcagttcaacctggcacgctttactcctctaggtctgcatctccaggaaggtagccctttccgtctgcctagagcggacttgtcggtcaaaccccctactaggcgacatgaatgctataagctagcagaggttgagccagcgattcatgaggatattttcgatgtccataggattcagattagaaatcatctttagaatgagttgggcattgttgttggtcattgttctccccatctgttggcagtgggcttgtttgcagttcgttctcctctggttagggataccttggtcgaggcttttggtttccaatacagtaagttccacactgttcacttccgccatcatggtaggggttctaactggcgggcggctcatacaaaccgaagaggttgggtgatgtttttgggttatccgcttgatttccgtaatcagcattacatcaataaagaggtgagcctttttggtcgattggtggattggcaggagagggatcccattccaggtagtgttatgctcagagctgtgtttgatgacattgacgcagtaccgagagtatttttgctcaaggagttgcccctgagaggtggcctaggacagtcatggacctttggggtctttgttctcaacactgaatttgctgacattcatcttggtgatgaagacctccctcctttgatggttcaccttcaagaacctacgcaacagcataacgatcacatggatatgcagccagatgctccaccacaacatgatcagccctgggggaattgggatcagcaaggggagaataaccctgaaaatactggaaactcaggaataagtgctggccccaaccaaaatttggccatgtctattttggagaatgaagcttcccctgtgttctttgtgctagattctgttcagggcaaaatccaagaagtagtccttaggaatcaggttctaaggcaactgtcaaattgaattcaggggcctccaactgttctgttggttcatgcccctttcattagcttggtgctcccaagaagaaatgttgcttttgattctttgccgctagtttatcactcttcacagttgcccctggtggtcgttcaacctttgggccatgatgaggatatggaccatgacatgggctctcccctgggccatgatgagatctttgatgttcaacccttggcaatttcagagccactagaccaggcccagcccaagagcccaccaagaatcggaccagtgcctctcctgttagaacccccaagagcatcagttaagaagagagatggcaagactgtcatgtttgatcctgacaggaggcagagttctcggttgagatcttcaagtcaagagctcactcaacctgaccctagaatgggcatagggaagccgaggggaaagtctgccaaaaaactgaaagagctggtaggtatctcaaacattttaactggcaatagttctttatcggcttctgattttcattctgatttagatgaagaatgtttctctacatctgattcctctccttctgactgttcaatatctttactcgtgtcattagtaccatttccctggatcaagtagtctggtactcacgattacattgctgaaatatcaagtgcgcatacaaagattgtctagcacgaattattacatcataggcccgcaggcatagtctagaacataggaccgaacggtccggaatacattcaaaagcagaaatagataaggcagcggaatttaggcagcggccacaccattgccacaagcaatgaccgtaactaagacctacggagcgttgtcatcctccgcatcctcctgaagataagcatagggatcctcctcgacttcattgccatccactgattaaattttgtaacagcaagagtgagtaccaaccgtacccagcaagccaccacaacaacaatgcatatgatagaggtattcaaagtatggctattggtttatttgcgtaaagctaatttctcaatccttttcacaagtctaagacctagcattgactagtcaagttttaattccagtatttattacacagcaacggttctgttcaccatccattgtcttccgaaagatggcttcccgctactggccgtcatggttttctgggttttatcccttctcgcctctcgagaagttgctccaccagtataaaatcatcatgcatcatctcacccaatcagtttaagaatttagagtctagccaagtgtagtacatgtcccggtgctcaataaccgcgagcacggctattctaatagatttggtttactcacactaagtggatgtacactttatccatacttcgtgacttgcccaacacatgagccgaagtcccaacgaatgagacgcgtcacggcaaagcatttcaataacctcactttggcagtacccactccatgaactttagtccttattcactctaggcgtccaaagtttcaagcagtgagaggagttctggcgctcccgagggggaaggactcacacattcattaagttatagttaagtttagatttgcacatggcagtcctaccgatggcgacaccactgtaggcccccgcccctcgtggtcctaccaatggctgcctcaccgtaggcccctgcctcctatacacatcaagaactccactacagcttgggtaccgcctccgctcggttatttactccgctaggtctatacccaaacgagaagtacagttgtacttgggtcgtttcatgcttaacttcatggcactagcctttatcggactccacccaagtcatccagccgccctagtcgaaaacatttattcattataatttttctttcacaaatcatttcatccatgtcatggtaatgtggcgcgcatgtctccacataccgaatctcaactaccttccctaaggtagttgcccaagcatataacatttgataaatatgagaatgcatgattctgatttagcatgactaagcatttgtcaaatattgactaaagacacacgatagcatggtttacaatggtcatacaattattcaatatcaaggcatggcatatagcaaataggacattcttattcatacatagcatgcaaattttattatttaaatcaacataattttcgcaataggttcaacatgctcaaagattagtgatgacttgcctggatcacagtcttgttgtccctgctcctcaatcgactcaacacaattccctcggaatctaaatttacgtgcgaaagatcggatttgaattcaattagaattcaaataaaatcaacaaaaattcaaacagtacaaagtaaattgagaaagtggtcccatcagatagatcttgattttagatgaatttaggttcaagtttcattcaaatccgagttaaaatgagtgagttatgagggtttaaagattcaaatttgaattaattcaagaaattatgaaaagttactgttcctaattcatttatttttattctaactcaaatcaataagccacagaggctgacacgtaggccattcaccaatttctttgctcggttttattttcctaaagaaaatgcggtgtcactgataggagggtccgaccccttgtaaacaaaggtgtagccctgccctttaatcaccggtgtgacccgcatgtcattgagacaatcactaaaaactccatttaattagatttctaagcatccgggcccacatgtcattgattcataataataccattagttagggattactgtgcactaatgaagtgggttccacatgtcataatctctctgtctcgttctttctccctcccccatcgtcttcttcctctcgctcgcgacggagcagaggagcggcgcccgtgctgcgcgacggcccgagccgggacgactcggcacgcggtgggcgagcggcgacgcaccaccggatacccgcttgcggcggcgcaccaccggatacccgcttgcggcggcggcgaagcgcggcgatcgcccgacacgcgacacgatggcgcgcggcggcgccaagatcccaaaaatggcggcggcacaatggggaccgattcgagcgctggcgacctcgatttaaccatctaggggtcacatggagtatataaaagcaaaattctagcctatgctacattggaacgaggtccctccatggcgagctcgatcatggcgcgatggcggccggagtcggcacggctatgacggcgagggcttaccacggagtggcgggatggcgaagttcgatggcgcgcggcgcggtgtggccgaaacaggggcagccggcggttggtgactgtcgcaggtgttcaactcccggtcttccttgttcagcggctcccggctcccaccaacagcagcaacggcaatgcgagcacctcctctgcacaccccgccacccacaccggccgagaggccccgcggcggcggcgcagccccgcccaccaggtgtttgacacccggcagcgacgcgatttcgtttctctgagatggagcaagagttttaggggagagggaagcaaatgggagattggttttggatgaggatgagctaggggtgagcttataacagcgggagggagggcgattccttaatggataaggataatcgatcacgtagctttgtttcgatctcttccaggtttcggttcaatgcactggcgcggcctgattacctattcggtagggtcgcaggagaggggggaagctaactgtgggatatggcgccacattacccagtagtctcatccgggggtgacagaatggcaacgcaacagtgatacgatggcgacaagagcgacggcgacggccagtggtaacggccgcggtagggaggcgcagggctacgccttatggtgacgcgggggtgtcgtggcggccgttaaccctcaattcccgatggcgactcgcgaggagacgttatgacgcgggcgttcgtggcggcgcagccttggcgcgagttttcagcggctcggtcggcggcgggcccacgcggcgtggcgcgacgcggtgcggcacacgggcacgaccagtgcagtgcacgagtcggaaaggcaggtgcgcggcatggcagtggttggagagggcgacgtcgggtgttcggtcgggttaggcccagatcgagcacctggcgcgcaatgaacagtgtcgacccaagaaaaatcaaaattagggctttccttagactttttgtgtgattaatttttagatgattcaatctgtatacttcttttgggtatttaccttatttcaacacttccaattttgtgatttattgcatcctatgttaataattaatattctaatttcaacatatgtttcttttgtcccgcattttctaggttttagtatttgtctttccatatcaacatattttttcttctcatattcatcaatggaaacaatatgttttgcaacagagaaacgaataacaccagcatgatgcaaaagttttaaaatgttcgaaattttagtgatttttattatcagagattttcaggatgttacactggtctcttttgttcaatccaggtttaaatggagaatagttatattttatagtaaaaagtacgaattaccccgctgatctattgtgtgagtatgaattacccccctaaacccgaaaaccagttattttgcaccctcaactatcgataccgtatgaaaaaccccccccgaacagctttgcaagcggttttggtgtacgtggcagtccagtcagcaagtttttattaaaaaaatatagggcccacctgtcagatatcgaagtagccgataaatgatatgttcttcaatcttgtggaaagttgaatccttgtatggttgtatgaaatgatcgatttttgatgcccagtgcacaatcaatttgatgtaattattttccgttaaagaaaagttagtagtttgctgtaacagagtgtcaccgtcaccgcctctgccgacttcgccgccgccaccgctaccgccattgccgactttgccgccgctactgccgccatcgccgactccgctagcgccgccactgctgcgaccatagccacacgatataagcaattatgtggacatcgatgtcgaaacaagatttcggcaattctaaaaaggggtggctatcaagctggaaaagtggatgggtttggagacaagaaatttttatacaggttcaggccttcttattcaagaagtaataccctactcctgtccggggatgattccgccgagtgtattattgatcgtatgatctgggagaaaatcgtgtcccaagaaagacccggacccctccttatataggggaaggggtccgtattacaaaatacagtccatatccctaacagaatacgggattacagataaaatacaatcgtaaccgactaagaccccgggtactttcttgacgtacaagttaagaaacaaacccgagttcccataaagatattctatctatattcgataccttgtatcctacctaactataactgtcatgtagatatggggtatccataatctccacagtagcccccgagacctttgcagtcgacgaaattgtcttcttaaagcaaaaaacaataatccgagtgttttaattcttcctgctccagcctgccgagttttaaaatcaaagactgtaaagggcgaaaataaaacatggtgcatcgaatagatgcacctaattaggtgtagcccccgactatgtggttagttaaaaaactaaacatgtagtcaagaaccaagtggtttcacaaccaaacatcatatagcaaagcatacgcggcgttcaataaaatatccagccgactgctttttagctttaatatatcaagaatgataatatgaaaaagcccgagtgataaacactcaaaaggttcatgaataaacatatttgacgagaatccgagtaaaaacgcttaagatcatccatcaaatatgataagaatcatggcagttaacaagtctaatagcctaggctatgaccctcaccataaaaatgagcatataacatgccaagagaatgaccattagaaaactagtcatctcgaatcaacccaaacagcttttgcagcttaaaaaagcttacaaaaatagtataacacttttctgtcgggtgcctttttatttgcatcgtagtaattccaaagaattaaaaggattttaacagcatcgggtcactccattgtgagcacaaattgccaaagcaataatgcccaagtccctagggatcacaacgggccacgctgataataatattgggctgaagtactatgtaggcccaggcccattagcactcccgataccctagcgaaataaacgccgaagtcaaagcgtcgtttcgtcttccccgccgagaccctcgccactttccccatttcttgctacagtgcagaacttcaccggcgaaactagggttcaccaatccgcttcaatccatcctcaaaaactccacgaaatccttctacgcaaccaccacaccgattccccacccccttccagccatatcccgaactaaattaagccatccagttcatatccatggcggaagagagagaaagcttcgagagccaatgggcgccttccgatgtaacggaggaaaatctgatggagatggtggcgcacggcgttcttccagcaaaagagatcattgggtggcgaccggcatttggcgaagcattcccgacccccaacacgcatgaagtcgtggtattttctcatttcttctatggcggattttctcttccaacctcaagattctttcggggaattctgaatttctatgggattagcctgcatcacttgaacccaaactccatagtcgacattgccaactttattcatgcatgtgaagcttttttgggcattagaccacattttgccttgttccgccgcatcttcttactcaagccccaaccgaacaagagtaaaccatgtgttgttgggggcgccggtttccaactcaggggaactttgagccaaaaatacttttccatgcccttcaagacttcaaacaaaggctggcatgcaaattggttctatgttcaaaatcctgagcctgcactccccgagtactcctgtcttccttcggtctaccaggacacatggaattcattgcctatgggagatgaagctgctcaggccgtggaactgatggaacgtatgctgaagctcaaggagcaaggtttgcagggtgaacagatcactcgacacttcatcaaaagtcggttagctccaatcaaagagagatcccgcacggcttatgagtttgatggcaaacatgatccaaatcgcgaagatccggactccctggactttaaggtcatgaaagaaaggatgtacaagatcttctcaaatgccatcgtcgtcagttattcacatctactgccagttgtgccatataatgcattcaaccctcctccaccggtatgtgttaaaattcttcaactttcctcaaaatataattttgtcttcttgttgaatcagttaacagttgaagatattacgtctaggaattcgctttgatgaagtcagacccgccaatcgtccagcgccgatcacctcaccgtcaaactgttcaggggagcgggggaccaaagatctggtccgaatcccagcccaacacttctaatctagctggccagtcagattcccgcaagaggaagctagtgctgagtgacgacgaaggcgacgacggcaaaaaatctggagataaagaaacacccagaaaactgccgaagcaggctattccgaagaagaaaacatccagtcgccctatgccaaagatcagaaaatcttccaggtacaaatcatataacaatctcccctgttttgatgcgctcccagtatggaaataatactgataacaaaaacttgtaggaaaccgtctgatatagatccatctggaaaggactctgatccggctaacatggaaatgagttcttccaaagaaaccgggccgactgccaaaggtcatccgagtgacagccagccggcaaccgacaatgtagactctggtgatcaacctccgactggaaaccagtcagctgaagctgaaaccggagccagtcaggagcccccgactggaaaccagtcggaaacagggccaagccaagagattccagaggttgatgccagccctcgcagacaagatgccagcaatgactcgaagcctggatctccggctaaagcacaaggatcgactcgccctcgcccgggaatcatcacaggtaaacaccttgcctgagatcatgttgatccaaatgtccttaattgattggctgatctttatccatggatgcatcaggaccaatgattggtgacaaagaagaaattctctggatacgagcggctgaaaactcacgccctcccattctggtcaaatggtgggacgatgacttgcaacctcagggcattgtaataaaccgacaaaaggaggacgaagaggtgtgccaactgaaaaaggcactcggtcaagcaactcgtatcgtaaacgtaagttatttgactcaggacctctgctatcttgttcgcttcttagtgtgagcgctaataaagccattatgtagaggatccatcttaggaacgaggcgaagaccgcaaccctggagaagctagttcctcatcttggaacccttgaagctgtcagggatcaactgtacgaggcgaaagaacacgccaagaaaaccgagcacgatctaagagatcggatcgcccagctccaggaatctaacttcgaactgagtggctcgtcaaaaggtaaatacaaagtctgtccaactaactggtgcagtcatctccgtaatcttcaattaaccggagtcaatatagtgcaagccgccaagatgtctcaattggagaaacaaattcaaactctggagagcgataaagcagagctggcaagacagagggactcggccttgaaggacgttgaaggtaccatcaattgactcatttgagctatttaagctatccccttaaatgtttgcgtgttccaatggagaaagcagatcctgaacgtatagagcttcaagaagtttaacctatgtcgagaagccagtcagaatcttggaagtgagcgagaggaatacaggaaatcacgttatacggttctgtaaggttcagtggagcaatcattcagaagaagaagccacttgggagcgagaagatgaattgaagtcagctcatcctcatctcttcgccagttcttctgaatctcgaggacgagattccgtttaaggggggtaggtttgtcacgccctaaaaatcgcctaaattaaaaatgcatattttaaatcatttttagaaattattttaaaagcctacaagttaaactctaataatctaggaaaattttcaacataaaatcgagctagataaaattttattaaatactttgcttgttcctctattttctagatttttctgggaattatttgagcaagggaaatatttttaataaatgaaacaacatttcacaaattattttaattgaaaaagtataaaaaaaccctcccttaggttgttgggccgaattcggcccaacatcttctctctccgcgtgggcgagccggcccaagccggcccagccgacgccgcccgccccgtcctcctccagtcgctgacaggtggggcccacctgtcgggcccttcttcaacctccggccgagccggccgagctcgtccgagccgccgccttcctccaccaattccgccccaattcggtctccccgtgtccgattgattgaggggttttgatcccctcattctcctctatctttacccccaagattcggagcaaatcgttgtgtattttaaccgaatcgaattcgttttcaagtttatccccaaaaccaaccctagtttttcccggctcgattcctcgcggtaggagtccaatctctccaattcaaggctataaatagcatcccctagtcgccctctttcgtttgccccctttcccgagctctctagtgctccatagagtcgccgccgcgccgccctagccgccgccgtcgccggccgaccaccagccgcgccgtgccgtcgccttagccgtcgccgctgcctcctcgcgccgccgtcgggtgcgcgagactgaggggaagcccagccgccccttcgccgtcgtcgccgatcgccgtagcgccatcgccgccgtcaaccgatccaccgccgccgcacaagctcgccgccggctgtcatccgtcgtcgtttgtcgcttcggtgagcaccgttgagatcgcatcgttgccctctacgcgtaggtaccctgcaaaggcctggccgagcctcctagcgccggcgaggtcgtcgcctttgccaaggccggcatagatgacgtcagcatgacgtcataaccttttctttttagttttttttaatagatgaaatagattaaaacttcggaaaatcataactaattcagtagctccgattcgagtggttcaagttgctaaatttttctaaaattgagatctatatgttaaaaatatccacatgtactgtttatgcttgttttttattgttctgttgattttgtctttttgctctagtttccgatgttccggaggagagcgtttccattgaggaaggttcggaagtttttgtggaagctcaaggcaagtcacacaaatcctaaacaaccctgagcatgttgaacctgtttaaagctattgtcttatttcaacttatgcattattttttaatgtcatcgggtggtgaacctttcctagttaattaatggccgaagatgactttataaacctatgggttataatttgattagcttgggccttatatattggattggttcagctaaatgccatatgtatgtttgcttagtcatgcctagaaacattagctaattaatggtgacggagcgtggggctcctcaccgggagaccgcgcaggcccccctttgccggttcggccgggggcgctaagtgaggttcttcaccctcgatctgtgggatgttcgcgagagagcaaatgcacaagacacgggcgatgtagacaggttcgggccgctgagaagcgtaataccctactcctgtgttctggtggatctgtgtatgaagcagttacaaagaaacggagagcaagagagtttaaactctagaacccctctcctctcgttttggatgccctaccagttcaggtatcctctattctctgagttctctcctcatttctttcggtgggcaaggtcctccttttatatctcaaggggatcctacatgcaccacttctacctaatcttcttttgggtggggacccaccctatcttgaccaaaacttggctcgcgccttcgcctggaaactaaatcacagcttgtccttgagtgaggcccagcgccgacactcgcctgacacaggggatcactctgtcattccttcattaatgggcggagatttgcaatggctgctgtccgaatgacccttcgatgggatgggtcatacctacctccactccgccggatgcagacgcaacgtgggagcacagtttgtctgccgatgacgtgaccggcgtcagaccagtcatagaccggtcattcttgtccaccacgtgtcagtttagcatgccgcacgtctgcccttcttcatacagttacttccttgtaatggttgcgatgaagcctagcatgaatctagccgggactgacgtgctaactccaggagttaccacgccggccccggctagggacgagtgccaacaggctctcatcattccgacgggacggggcgaggcgtgcgacaggccgcctgtcgccccctaacccgcgatctgaccggcctgtgaccagtcacacactgcgaccggtcacggaccggataagcctgcgctgcgctgcattaaatgcggcgcggcgcactcctccaacccgcaataaatgcggttaggtgagccccgctgtgctcacctaacccatacaagtggcaccaaatcacaaggggtcagggcaccccagccctcggggccaaaacgggagcggcccgacccctcggggagacagagggaggggtggccacgtcaccctcgggcccgacccccccgagggggtcaggccacgtgggtgaccgcggctgcccaaacctctagtcacgatacccccggtcccatgtcaccgacaaatgggattatacataaaactatattatattattattaattatggttatatttaatggtagctcacgatggttaatcgtgttatgttatgttaattaattaataattaaaacctgcataaggtgggttgtgagcatatggttttgatggttgtgctcatgacaattaaggaccggttcgcgagctactgttgtgaaacatttaccgtgccaaccacaagccagcgtgggcaacggctttatcttttgtatagcatgactcattatagtgtgctagactgtgaagcggtgagaagtccattggggtcgctggggagtccattgcctctggttttgagggggagattataatccaggaacggtgcactgtggtgagttgtgttgtgcgaggggtattgtcacagttcctttccaaggtaccgtggtggtactgaggcgcatggtgacatgttgtgggattgtgtcttgtgggtacagtggtacacctctgattagagtaaaactattcgaatagctgtgcccgcggttatgggtgagttgagcaatgttttttgtgattagtcccacattattcattaatggtaattgtgctaatcaatttgactcctggtttggaatggtatattcctggtatggaggttggattagtacaaccggggttggttgttcagatgaggttgggcctatgcaacacgggtgtgttgtatggtgtttatctaatactgattaattattcaactgttgaactattctcttaaatatttattaaatgctgtttacacaaatgagctttattatgccatcctttgttattctgtgcacttgcatatttgctgtgtggcttgttaaatatgtcatatgctcattcttgcaatattcattcatcagaagaggagttcttcagtgaaggtgatgatctggaggactaggcttggtccgggttaagttgcctgtggagtggaatcgccatagctgttccgtagtttgctttagtttatttttccgctgcgtagaatgttattgtttgagaggaactatctacctctgtaatgatttattaattgcgaatattaaatagttgtttatttgtactctattatcaatttgttattgtgtgcctcggctgattcctggacgagggtttaacacacatgtaagcgtttggaattttggatagaaattccgggcgtgacaattctgttgatgtagaccgcaagatcaaatcacaagctctgttcgacgtcctggtcggcaaaatcaaaatgcttgaaggggccagggacgaagttgccaacgccgctactccactcgtccaagcaatgttctttaataacaacggtccgagtagattcgacgcttccgagatcttcgacaagctaagagtcgctccggatacatacttcaagaacatcaaggaagccgggagtatgtgagcaagtctggcgctggcgatgaccaaatccctgtacccaaagatcgatattgacgccattgatggctttgcagacgggacgagcaaagaagccactctcgatctcatcaacgatgcgcagaaagccgctgacaaaatagcagttgatgtagtagagagattccaggacaccgatcttcgaccgactggtcctgacagttctgatgatgaaaagactgacactgattgatgtatcaatgattttgatgatgagtgatggaggcacaatttgtacaatactgataaatttatgccgtgctcagtgtttcatacttagcttctgatttcttaaaagcctttgtcaagccttattgagcctaaaacccacaaaagctattaaaaactttcagtcctcatggactaagtcaaaaaatcaagcaaggcaataataaaccaaataagcaaattgaattgataaaaatcacactccattattattatagtagcccccgactgataacttcaaggggaagcttgatgttgtcagtaaacaaacttaagcataaaaacaacgaagatgttcgatattccaagagttgtcgataggtgtaccgtcttcgcgcttgagccgataggaacctggccgagtgacttcagatattataaatggcccttcccataaaggggataatttgtgccgatcccgtgtagttcgaattttcctcaaaaccaggtcgccgactaagaaagctcgcgatcggacgttacgattatgacaacgacgcaacccttgcaagtatcgggccgactgaattaaggctgcttcgcgggtctcttccagtcggtgtaggtcatccactcggtcttctccgtagcgctcttcacgaaaattgcgaaaacgcaaagattcaaactctacctcactaggcaacattgcttctgctccataaactaggaagaatggcgattggcccgtagcccgactgggggtggtgcgcaaggaccaaagtacggatggaagctgttccacccatttgccggcatagggatttagtcggtcaaaaactcgtgcctttattccttggagtaccatgccgttggcttgttcaacttgcccattgctcgtgggatgcgctacggaggcatagcagattttgataccgaagtcttcacaaaaatctttaaatactccgtcggtgagttgagtgccattatcagtgatgatctgattaggtaccccaaaccgatgcacaatattgatgaaaaagtctctggctttatctgccgtgattgtgatgaccggtttagcttcaatccacttggagaatttgtcgatagccacaaagaggtgtgtgtaaccgccgactgcctttttgaacgggccgaccatgtcaagcccccaaaccgcgaacggccaggacaacgggatggtttgtaactcttgggctggtagatgagtttgtctggcgaaaaattgacaaccttcgcatgtccgcacgatcttgtcggcatcggacacagcagtgggccagaaaaaaccttgccggtaagccttgccaccaatggtgcgtgtggcagcgtggttgccacagataccagaatgtatgtctttcagtaattgtctcccttcctctagggatactgttgacagaaaacacgaggcctgggagatctgcttaactccagtgcaggtccaaaactcaccttcggatgtgtgagcgtgccagttgatttgatcctgtaatcatcaagaaataaagacaaaggaaccgtggttaaatctataaatgatagccgatcggccagatgccgatgacatatcatttatattcgagccgatgtcatctgtgtatcgatcggcaatcgtagataagtaaggaaaaactaaatttacttgatcggctgtaaatattaacggtatataatccttatattgatgtttacttaaatcaagtgattgggatagatcggttatcacaccgagacagtataaatcacttagatcgaaatatacatccataacaggactatatatgtttatagcatagccgatcagatagatctagcatgtatcggctaatactccgatactactttgtattaagacgttgcaacaataatgatatgttgaacaatagtttaacacatttgaatatagcaataaagggcatatttaacatatcagcgaagcaaatagaataagtatggttaaatcagatacgatcggctgaaactccgatgctattctaattgacaactagatggcaggctagagatcaatattctaagcacgacttaatagatcaaactcaattgatgcagcattaagtatgaaaagaagaacaatatctagacaatcaagccgctagaagattcatagaatggtacatatcttatataatctaaatcaacgtcgagatctaacctaatcagctgtcttttgcatacaaatattagccgataatagattagataaagatattgttgaagattatgtaagatatatgataactcagcgaattatataaacgagattagagtgtcatgaagatgtaagcactaatccctaagaacataattcgtcataacgaattttacctcttgttgaagattgaaaccgatgcagctcaacccgaaagcaagaactcgtcgaaataaaacaaaagcaaaaggtggcgatgcgccggaattgtattgaatgtgtgtcttaaaattacatagggctcggggtctatttatactcgaggattacaagatatgcccataccggacataaccattatctctaacaaactctaaaatatcacaagtctctgcggcagacttttgcccatacttatctataaggaatttacataaatcatcctaattaatagatacaattgccttcccaggactctatccatgcgtggcaatcatcttgaagcacatcaacctgagcccgacgtcgcgcacaagttgtattgtcagaatcagctatatcagcttatttagcttaactcaaccttagccgatcctagccgtagccgatcctagccgtagccgatcctaactatagccgatctagactccagccgattcttgctctgttccagaactcgatctccgcctccaactcttctttgaccaaatcccctttcctgatacgaatacttaccaaattcggttgttaacagatacgcagcgttgcagaattcttgatggacttttcttgtacaaattggcctcatgaatgatgtaaagcctgctgcgcctggaaatccgctcagcttcgtctttatcttgagggagttcttgggaggtctgaaaccgtatgaggggctctctccagtcagcttcgaccatagctatgtcttgagtgtccgcggcttcagctgtttctctcttgggtacggttggctcataaagatgttcgacgaatacatcagaaggggccgcttcgtgtttggatccaaaattcgctagtctgtcggttgcttcgttattgtgccgaaaaacatgggtgagttcgagtccatcgaatttgtcctccaatttgcgtacctcttgtcgataagccatcatgttgtcatcgaggcaggaccactctttcataacttggttaacaaactaactgtgaatctccgcgaactatcagacgtctgatgcccaaagagattgcgatccgtagcccgtggaggagcgcctcgtactccgcgacattgtgagatgcagaaaaatgtatccatagcacatagctcaatctttctccagttggggaaattaaaacaactccggccccagtgcccgaaagtctctttgacccgtcaaaatgcatagtccagtactccatcttttcctcgggggtgtcctcttggcactcggtccacttggcaacaaagtcggctaaagcttgggacttcatcgaagttcgtggcttgaacgatatgtccaaggacatcagttctaaggcccattttgcaatccgtccgtttgcttcgcggttgataaaattcttattgattattatatatatattgtacgcactatatttgagataatacatcaatttataatttaacaaattatatttaggacacgagcgaaaatccgtgtaaacaaatgccccttcgagctgcggttgccaaaattttgcttttgcatccggagctcgaagcataattttggatctgcagggacgtggtgtgagctttatgctcacaactatgtgcccgctatttgaaagattgttgagaaaattaaggagcatctccccgattatttggtcacgttccctatcaccaggagcagtgaggcagttcgtttgctcttttaatcactaacccatccactactccagtctccagaggctagactccttcctcttcctcttcttctgtgtgaaggctttgaggaaagacatcaccggtggcagaatcaagggtaagaccctgctttgatcttgtgaactgaactggcgacccctttttcttactattttttttatttttcttattggctttcgtccctctgttctatttaggtttgtgctatgcacacacacctgaagatcctcgagttgatttcattgggtgcttggtgattcaggtgtggcaagtgaaaggtacgcatgaatcttcttaccatccttcaatccattcatttttttaatagatatgtcgatctctctgcacaacgttcatatttgatacgcctctgccaatataacttcctttaaccacattgtattgaattagttgttcgtatgatcggggttcccggacattttgtaatgttacacagccaatccacgttgttagatttgcatgtactccttcccatcacgattatttgatccaaagtactgaagtatcccgcgccaaataatatgactcggggggcaacaaatgaaacatgcacaacagttcaggaccttgagcatagaagaaataaatgatacaacctatgtcacttattatctacaacacattgacctctgtaataacagaatgacattatcaccatagatggtgaaacttccttgaaaacaagaattaatcgttatatctattcaggcaattttaagcattacgaattctcatcagatctacaacggtgcataacaaaaataaatgctacattattccactgtatgtaaacaaattagtgaaatgagtgaaataacagggggcagatccaacttgggacatgggggttcagttgaacccccccaaacttttgggggaacaacaaacaaactcaaactgttacttttattaaggttaaaggctctggaactaagagaagagcttcctccagatctacaagagaagctagggtttaggcaagcaaattccaagacagaagcatccccggtgagagagagagagagagagatgaatcatcagaaagaggatgcggatgctcaccaggatccccttgctcgccggatggagatcggcgaccctccccctcccctcccctgttcagccgcgaatggcgcaagaagcggatgagacgacgagacgggagattttttttctcttttacgcgaagggaagggggaagagatactcgagtactccacctttagctcagatttactatgttacccattatgagtagcaggccaaatgggcggcccggcccagcatagctcggacccgctgatggcacggcaactgtaatgggccgggccgtgccgtgccaggtcttgggcagaacggcccaaggaagtgttgggccgtgtcgggccggcacggctactgttgcatggaccggtggcccacccacctgcaagagaacgttattcgtgtgaaactacagtcgcaagttttctatagtaggtaacacaattaggcaaaattgtgtttatatgggtatttttcattgtcaatattgtgccattatagccgtgttaaaaatttccataatttcctttggcacaactaagagaggtttaaccttacgtcccgacccaagcattcgttgtagatatcctgaaacacgaggttcggacttcggacctgttttaaacttttcgaccgttggacacattttaaacttatcggccattagttataaatatatggtcttatatcacgttactccctcaaatattgaaaatatgttgatttggatacattttaaacttctcaacctttggacacattttgaacttctcgaccgttagttataaatatctggtatgtacgagagcaatggttttaatttttaaaacacaccgttttgcacaagttccaaactcccaaacggcctatcaaagtgctccatccggtcttaaaaacaaaggtcatgtttcctgcacaaaaatgttacaccctatcacatcgaacgtttgaagtattaaatataagctaaaaaaataactaattacacagattgcgactaatttgcgagacgaatcttttaagcctaattgctccatgattttgacaatgtggtgatataataaacatctgttaatgacggattaattaggtttaataaattagtctcgcggtttactgacggatactacaattagtttttttattagtgcccgaacaccccatgcgacaccctatataatacccgatgtgaaacgcaaaaactttacactcctggatctaaacacccccaaagttattttggatactacattccaagttcaaatataaaaatctaatagcatgtacaataatagactataagtcggctacaagcttatgtggtgaacataaagagaggagatagaaaagaagcaggctgcagatttgtagctagctgtagcacggactcctaaatgctacgtgtgtatgacaagtgggagcagtaattaatgatgtagtatatatttgtagttaactattgtataatttggctattagattatctataaataatttggagctagtagttggctatatactattaaaattcctctaagcggcaaaggccgtgttcgattattagtgttagaaactaaccctttgagcacgtaaaacgaaacggttcattaatgcataattaattaagtattagttatttcttaaaaatgagttaacatgattattcaaataactttcatacatacatacgttttaaaaaaaacgcaccgtttaaccgtttgaaaagcacacatgtgaaaaatgagatagataagtaggaaaatacgataaagaatacttcctccatatcaaaatataagccttttttttttgtttttgacttcgacacggttttaaagatgctacattgataaacgatattcataaaagtaaaatattttaaataaaaagagttacatactgtgatagtttgtttaatgctaaatctagtaatatcattttttttagattgatcttttttaatttattttttcttattaataatcaaaggacttgacactatacttaaaaaatacttatattttttatattttagtacggagggaatacaaagttaaaatccgtcatcttctatgacagaagtagtaacacgaaattaatttagctctacatccgttctgtttatgaataacggtcgaaaacgtaataacccaaccacgacgacatgaaaaaaagaaagacagataaaacggtcgaataactaaaacaagttgctactactatttgaaatttgaacaactgtaacggcccaaaaactggggagtggattctaatccctcgagggatatcccctcgtatacctttttcttccaaattcgatacaaatagttatgaaaaattctgaaaaaaattaacaatgtagagtataatgatacctactagtccaccaaaattcatgttcaaattcgatctacacatcgagaaacaaaagaagacaaatttagatataaacagtacgctactattcatacgctgaatttgtctttttatatctcgacgtgtgagttgagtttggaattaagattttgtagagttgtatatatgtgttgtatgaatgttgtcaaattttttcagtatttttcataaccgtttagatggtttttgagcaaacgagggaacatcctcgagggattagaatattttccccaaaaactggaaataatcgaaagagtcgtcgccattttctctcttctcctcctccgctcctctgagtcctctcctctccggctctcccctcctctgtcgggaagggaaggatccaagccctcgccctgctccgcctctgatccccgccggccgccgccgccctcgcaaccctcgcagcagcagcaggaggaggagggttcaggtggtggttgccgtcggccgatgtcgagcagcctagcctcccgccgctcgtcgtcgtcgtcggcggcgaagcggcccgcggcgggggagggaggagggaaggcggccgcgggcgccgcggcggccaagaagcgcgtcgcgctcggtaacatcaccaacgttgccgccgccgccaacaatgcggtacgtgaaggatcgcttgctgctgcttcttcttcttcttttttcctttttttttctctccaagatttgttctttgctttgcgcggtttgggtggagatcttttggtgtgtgaggtggttggaatggtttgggggtggctttttttttttttttttttgcttcttggttcctcttggggcacaagtgagtcgctgttgatgcggaaatggccgaagcgatctgtgtatgatttttttcttttttggtttttttccatcttgtttgtggaggacatacgcctcgatctgttggtttcaagcaaatataaatagtgtttcttgaattcgtcttcttgagttctttctttcagccaacaacaagattttcatttcttcaatttctccttggttagcctacaaacgattctcctcttccaatccccaatatattcttgccttttggtttttcagtgctcttcacattcaaatttggacctctgccacattcttccttgctgattttgaggattctcctattccaatccacaagatttttcttgctgattttctggtttcttttcatggttaattgattgattgatttcttggggagcatccaggtcaacaggctaaattcacttgagggtttattggcaccttcagaagttcaaaataaaagctttcttggtattcgctaagtgttttgtatgtttgcttgctttggaatcttctattggtaatatgatacttgcgtgctgctaatgtttctaataaatatttgttccttttcatgcttgtggtctggaatcccaaatgaacagattgaaatataagttctaaattgatttcttgtcttcaatcctcctgcagaaatttaattcagctacctgggctgcacctgtgaagaagggatctttggccagtggccgcaatgtgggcacgaatcgggtctcggcggtgaaatcagcttccaccaagccagcttcggccatatcccgccatgagagcgccccacagaaggagtcagttcttcctcctaaagtgcttagaattgttccaactgctgcacctgcacctgtcactgtaccctgcagcagcttcgtctcccctatgcattcaggagattcaggtggtgtttacttccagggacttaacttaagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctcagtttcggttgatgagacgatgtcgacgtgcgactcaatgaaaagcccagactttgagtatattgataatggggattcctcctcagttctaggttccttgcagcgaagagcaaacgagaacctgcgtatctcagaggatagagatgttgaaggtgtgttttggttgctgaaatgcacagttatagctagaaaaatttgtgctatatggtgcattctattggaatggttgattgatcttttcccttgtttgtttcgcagaaactaagtggaagaaggatgctccttccccaatggaaatcgaccaaatttgtgatgttgacaataactacgaggatccgcagttgtgtgctactcttgcttctgatatctacatgcacttgcgcgaggccgaggtaatacattcttgactaaaccttatttctctgaaaacatttcccttgagcaccttattgtagtatgttttcataggaaggctttgttttgcttcctcatgatttgagacttgattgcatccatatgaaacacaagtaaaaaaagtttactttgatgagaccataaattaagaagagaataagtgcacatcactgatataaggcattattccaatgtaatttatcaggatatttttcacatttcaccacaatccgttcttttctgcttttcgctttgttggtgcaccttatcatctaccagacatgctttgtgaccatcaattttcagtagttttgttctgcatattatgtaaacaccttacataaaacattcttgaatacttttttttttctgaatagtgggttccatttaatggccatcatattgaaattccctatagaaccagtagaagcacagtataatatggagaaattgtaatggagttatcttcttaaagcattgactgaaccgatgaattgatacatttcaattgttgtaatcaatgctcttgaagtatttttcaattgctcattatttttgctgtgacatggactgcactactgcagtcagtttgatcaaatgacaattaatctgacctgagcacagtggtttcaaatctaggttgaatttcatatttacattgtgattttctatttgacttgaagcagaccaggaaacatccatcaaccgattttatggaaacactccaaaaggatgtaaacccaagcatgagagcgatcctgatagactggcttgtggaagtaagcttttataccgaacaaatttttttagttgattggagcctaaagaccacaatcgttacttaccactctatttgtgcttttcctttgtgcaggtcgctgaagaatatcgtcttgttcctgatacattatacctgacagttaactacattgaccgttatctttctggcaatgagatcaatcgtcaaagactgcaattacttggagttgcttgtatgcttattgctgcgtaagatctgattagcaatttttttaaatgtgtttctcagtttgcatctgagttttgtgtactgattttggcttgttcctatatcagaaaatacaaggagatatgtgcacctcaagtagaagaattctgctatataactgacaacacatacttcagagatgaggtttgttttgcatatctgtgaacatttctatgtttatctccatgactaacacatagattgtcaggttttggaaatggaagcttctgtcctgaattacctgaagtttgaaatgactgcacctacagcaaaatgctttttgaggttctattctctttcatctcatcgatgtctataatgctggaatgaatcgaactctaataactatcttcttgcctacaacaggagatttgtccgtgttgcacaagtatctgatgaggtgctgctctcttaatcatctcctgcttgctgcaatttcatactatttatatgctgcattgcattaacagcttttcatcgtgcaggatccagcattgcatcttgagttcctagccaattatgttgctgagctatcactgctggagtacaatctactttcttaccctccttcactagtagcggcatcagctattttcctggccaaattcatactgcagccagcaaagcacccttgggtacgtggtggcatcatcatattgaactttccatacatcttttatatcaacattcaaataaaaaaattacaagagctaacatatgcttctcattgtaaattggaagcagaattccacccttgctcactacacacaatacaagtcgtcagagttaagcgactgcgttaaggcattgcaccgccttttctgtgttggtcctgggagtaaccttcctgcaatcagggagaagtatacccaacataaggtataaactgcatatcctccccatttcttcagttatctgtactgttcctaatgctgcctcctgtacctttgtttctgcagtacaaatttgtggcgaagaagccctgcccaccctcaataccgaccgaattctttcgcgactcaacatgctgaactagaaaaataaaccaaggattagttacagttgctgactgaattcttcctccagaggcacctatgccaggttgtgccgtagaccgttcagataagcttgatgcaaggcatgctgcttgccccccctgttctttcaggtggtttggctgagtgtagatagatcgatgcttctgctgtgtgtggtaacttttatggtactgatgtgctttcttctatcttcttttccctgtacctagatgatccatggttttcagtactttgtacatcggagtcctgcagcaaagctttaaacatcttgtttgatattagctgccaacctgggcgtctcctaggttgatgtatgatagagtctctgttcgtgttgctcttgtgaaattctcaataagagcaccacattttcaacagtgctcattctgaataagtgctactagtgttcttgatgtttctagtaaaaaatactctctccgattctaaatatttgacgctgttgacttttttaaatatgtttgaccgttcgtcttattcaaaaaatttaagtaattattagtttttttcattcattgttaaatatacttatatgtatatatatagttttaaatatttcataaaagtttttgaataagacgaacggtcaaacatatgctaaaacgttaacggtgtcaaatatttagaaacggaggtagtatcaacttcagctttttttttttcaacctgttctgttcttctgttgacagatatatgcagctgatgtgatcgacttaaacatgatgattcagcgagattcttagataaaagcttctgacatcttttccacgaaagatgttttcatggacaaatgcatttaagattctgaaaatgaaaaatactacgtccatcctaaagtgtccaatgtttgaccgtccgttttatttgaaaaatttatgaattattttttaaaagtagtcacacataaagtactattcatgttttatcatctaataacaataaaaatagtaatcataattttttttaaataagacgaaaaatcaaacataatcaaacattgaagataaatagtgcaaaactgcacttattttgggacggagggagtatttgtcaatgcaacctgttgaagaagtgatgctcaagctatttccatacttgaagctaagcacagctgtttagacatgcatgcctgcgtgttgcatcatcatattgtacttagagctaattaatcacctatactaatataaaaagcattacttgtagtctttgctagctacactaaaaaaaagtgtacacaaattaacctcaggcaccctgcaatctaattgttgagattacaagttccagcttgtcttgcaatgcaacaggtgaactcacagattcaactccaccttggccctggcaaacgcggcggtgtgctagcaactacacgttccaaaatataaaaacctataatcggatgagacatttttttctggtactaagaatcggccaatccagattctcgtctcgctggagtctcatcctcgtctcactggagtctggaatctatagcaacgttgtttacagtagagttaacagaaattatcaccgtctaattaacttgctactgctttacaaaacgggagacaatcagacaacgccggggtgggttgaaaaggaagaaaatgcaagcacaggcaaatgccgacgataagatgactagatgagcaaggctactccctggggaaaaggctttgcttgccatggattgcaacacaagattaaaaaaaaattacaatacagaaagaatgattcgaagcatgagtctagcaaggttaaatcatcactgagctaggcctacaacatgtcgagttagaagtcctcttcgtcgtccagatctggatcatttgatggccgtattctcttgccgtctctccctccagggcgacctcccttctttggttttcctctgtccaaacacacgaggggtcagaactaggcaattctactaagggtgtgtttagttcacgctaaaattggaagtttggttgaaattggaacaatgtgacggaaaagttggaagtttgtgcgtgtaggaaagttttgatgtgatggaaaagttggaagtttgaagaaaaagtttggaactaaacaagggctaaaagggttgttcctagaaacactgttttttttaatataaagaagtgttagacaaacactgccccttgcaaggatgtatgtaaagctgataaggatagcacattttttgccacaaaggtaatctgagcacttactgcccgtttgcaggagtggttgcacctttcgaacgacctgatccatattctcttccatctgccaggatgcagctagtattgagcccagagtctcaattgttcctggtttcagcttaatgaaaacaagaaagagaacttaccatctcgtccagccatatgttcatcgacctggaatgaatagaaaataatggtatgtattagcaaactcacaaatatcagtatagcacagggggaataacaatcatcaatcaaagcaaaccaaaagattaaaaaaggggcacgggcttttcagtgcattaggatttaggatcattagtcataccgctggagatgtaaccgatgacagggagaacagcctctcatcagcctggaacttcctggagcgcttgagactgaaaataataagatagaaactgtcataactaattctgtgtgatctattagcagaacagaaatgataaaacatttgcttgtgcagaataatgaacacgcaacattatgccaatggtaatcataaatccaaccctcccttggtgatgctagatagtgcatatagagcacccctgcaattggccaataaactgacataacactatcatagcatattttgggttatgaatctgttgtataatacctgccactgccactatagtgatcagaggatcttttgttcatctgatcattagtaaattatatgtgatcagaggatcttttgttcaacatcattcatctgatcattagtaaattatatgtgatcagaggatcttttgttcaatatctataactataaattattcatccgaatattagctaaattatatgtgatcagaggctggtagaaagttcaagggaaggacagtaggtcattcaatcaacagttgaaagtaagcaaagaatgtggcatgaattctgaaggtttcgaactggtaagtatacagtgggatgtcaaaagaaaatgaatgaagacctccaaatagtaaagggcgtagcagtctaagaaaataaagatttcttacttggaagtgttctttgacgatgataagaatgattcaaaaccctttagcacacttccgaattgattagactcttgtaggtaggttgtctccatttcataaacctgcaacatatggacataaacatcatttgcaggttgtataagaacaattctgttaaaagcatgaatagatattttgttaaattatgagtgtttaatatcatatacaaaacttccccttaaagtcaagcaaagatggttgacattatagatcatgtgttgttcctggtattaaagagcgactgttttgttctttctaaaaaaaacacacatatcagtgccattaaaatacttgatatgagagcaatagcactttcctccctttttaggattatggtttctactaaaccaaacgctcctcttatttaatgattttggatgacacaccaagattcaccatcacaaacatatattggaatttggaccacatagtgtaactttgaaatactatgaatagaagtagctcatttgatacttgctgcgaataatttctgactaagacacagtagaaactccacattttaactcgaggatagaagaacagatggaattttcaggttgtagctaactgattttcttttttaccttagaataacaaagtgttctcaggcacaaagaacaacatacaagaaatagaatggtcatattcgacaagaatatcaaattgatactttcttcccttcctcctaattctatccaaattgttcgtcacaactgatcctctctgtgaaatgacaatcagtggtcactggtccagcatattggttccaaataggttcatatttctatcattcccaaggcattaagaaagattgaacaataaattcaggctactacaggtatccacaactccaattttacaaccatccgcagcaatgtaaattcgcaccactcattcgcatgttgagcaatggcaagcccttgccatctgaacatatatgcaacaaatccatggtctcctatacaaaaccctaattccaagagagagagagagagaggcgcaaaagagacagggaacagtgtgtaagacctaacctggcgctctatggagcggagctcctcctggagcttggcgcgcttgctcatcagggcggagagcatcgccgtggggttcgcggccgccgcccccgagggtgcagagcccgacgctgccttgtgcgatgcccctcctccgcctcccgagtccatggtcagggtttctagggttcgagttcgtggtttgcctgtttgggcgttcgttctgttttggctcggagacagttcactgttgtggagacgacttagcccctcctctccaatagtacgatcggtcctcttagccaaggtaaccagtatcaagatactatgtaggatcctttctcttcttggtttgatccttctcgatcggtttgattccttctaatggagaaagcttcctgtttgctgccacctgagctgtcaaatgcacatgtgaaaatgtttagcaatcaatgcatacatacccatgagtatcacacagaaaaggttaatagagtatttagcagaatttttttctgttgagggatgaatttcactccaaataacattattggaatacatttctgcctataatctaagatgcacatgttttatgagcgatttgatcatgaccacaaacatgagataatgtccataccctagttagttgcccgtgcattacaatgggaaaagagcatttggctatgtactccttcccatcacgattatttgatccaaagtactgaagtatcccgcgccaaataatatgactcggggggcaacaaatgaaacatgcacaacagttcaggaccttgagcatagaagaaataaatgatacaacctatgtcacttattatctacaacacattgacctctgtaataacagaatgacattatcaccatagatggtgaaacttccttgaaaacaagaattaatcgttatatctattcaggcaattttaagcattacgaattctcatcagatctacaacggtgcataacaaaaataaatgctacattattccactgtatgtaaacaaattagtgaaatgagtgaaataacagggggcagatccaacttgggacatgggggttcagttgaaccccccaaacttttgggggaacaacaaacaaactcaaactgttacttgtattaaggttaaaggctctggaactaagagaagagcttcttccagatctacaagagaagctagggtttaggcaagcaaattccaagacagaagcatccactctagtgttgtagtcattccaatcggcagagtctataggcattttaacacccttcgaagacatattttgagccatgcctgtcatccactcactcacaccaatacttttttcaatgccaacatatatcataggttgaaaatttgagatgcttcattttgactagagtttacaagcttgacatttatatgtacagaaactaactacttccacccagccatagcgaaccatgcttgtgctactagtgatacacagggacttatataataatgactagtttttacaaagcaaatgcgaaacatacagcctgttggaagggaatgtgtcatgagaacatttacatctgcagtaaactatatctaaagaacaataatacagtgagaatatggtttgctcaagtacagagagaacatacaagtagtttgctcaatttcactgaccaattttttctagaaatctaagtacagtgagaatatggttgaaatatatacactaaaaatcaagcaataatagacacacagatcgggagaaattttaaccaacatctaggcaatcaatccccaaaaaatgaaccagatttgagggagaaagtctagggtttgagggagagagtctagggtttagggttaccttcctccttgcaccagatctgctatgccgccgccgttgtctagctcctgccgtgcgcctcctcgccgtggggagccgctcccgccgccaactgccgccgtgagctctcagcggctaagctcaaccaccgtgcgccgcccaaacttctgcccagcgccgcccaaacctcagcccgacgccctagccgcgagagaggaggcagtcgccgccgccgtgcgccgtcaccggcaccgcctcctcctcctcagtcctccctccgaccctccccttctatcttcgccccctctctcttcgcggaggagagcgatgcgagacccgactcggggatgcgcgattcgcctcggtgcggatgggggaacgaaggggtagggcggtggcattctgattgtaatttcttcgaaaagtaatgggtagcgctgtaattaagatgggagtggagctgtggagtggcattttcctcgctccaccgcgctagtacattttcgtggagcgattcaccccgctccgctccaagttttggtgaatctggaccgtttggcacaactctagctctaggtaagttggagttgggagctggagctgtgccaaacgggacctatgtaggatcctttctcttcttggtttgatccttctcgatcggtttgattccttctaatggagaaagcttcctgtttgctgccacctgagctgtcaaatgcacatgtgaaaatgtttagcaatcaatgcatacatacccatgagtatcacacagaaaaggttaatagagtatttagcagaaatttgtgtttcacaatttttttatgttgagggatgaatttcactccaaataacattattggaatacatttctgcctataatctaagatgcacatgttttatgagcgatttgatcatgaccacaaacatgagataatgtccataccctagttaggtgcccgtgcattacaatgggaaaagagcatttggctatgtactccttcccatcacgattatttgatccaaagtactgaagtatcccgcgccaaataatatgactcggggggcaacaaatgaaacatgcacaacagttcaggaccttgagcatagaagaaataaatgatacaacctatgtcacttattatctacaacacattgacctctgtaataacataatgacattatcaccatagatggtgaaacttccttgaaaacaagaattaatcgttatatctattcaggcaattttaagcattacgaattctcatcagatctacaacggtgcataacaaaaataaatgctacattattccactgtatgtaaacaaattagtgaaatgagtgaaataacagggggcagatccaacttgggacatgggggttcagttgaaccccccaaacttttgggggaacaacaaacaaactcaaactgttacttgtattaaggttaaaggctctggaactaagagaagagcttcttccagatctacaagagaagctagggtttaggcaagcaaattccaagacagaagcatccccggtgagagagagagatgaatcatcagaaagaggatgcggatgctcaccaggatccccttgctcgccggatggagatcggcgaccctccccctcccctccccagttcagccgcaaatggcgcaagaagcggatgagacgacgagacgggagattttttttttctcttttacgcgaagggaagggggaagagatactcgagtactccacctttagctcagatttactatgttacccattatgtgtagcaggccaaatgggcggcccggcccagcatagctcgggcccgctgatggcacggcaactgtaatgggccgggccgtgccgtgccaggtcttgggcagaacggcccaaggaagtgttgggccgtgtcgggccggcacggctactgttgcatggaccggtggcccacccacctgcacgagaacgttattcgtgtgaaactacagtcgcaagttttctatagtaggtaacacaattaggcaaaattgtgtttatatgggtatttttcattgtcaatattgtgccattatagccgtgttaaaaatttccataatttcctttggcacaactaagagaggtttaggggctgtttggttgatgccctgagaagaacttgcctgagtgaagacaagcctgaggttagtttgaaccttgttttggttgctatcctgagatcaactaccccttgcctggcctgattccttctgacttgcggttagcctgagccaggtgacccattttggtcgccagaactccaggccgcaacagccaccgataattagcgctgctaatccatcctgctggcctgcgcagccgagtagccgacaccccagatgccgcaccaaccccttgcccaatcctccgttcaattgttgctgctcgaagcttcaatgtcaactagatgcaagcgatacttgtgatcatcgtgcaattagatggactgctagtgtatatagatgagagattacttttgtaaaatgaatacgtattatatttttacgctttgttcacataataaacgtcattcaatggttgtgttttcagctcaggcacgcttgacctcagacctgcaaccaaacagagtaatctcaggcttgcctgatcaggccgaacacatcaagatctcagggagatttcaagcagcactttttcttcaggcatgcagctgagggcaccaaccaaacaagcccttaaccttacgtcccgacccaagcattcgttgtagatatcctgaaacacgaggttcggacttcggacctgttttaaacttttcgaccgttggacacattttaaacttatcggccattagttataaatatatggtcttatatcacgttactccctcaaatattgaaaatatgttgatttggatacattttaaacttctcaacctttggacacattttgaacttctcgaccgttagttataaatatctggtatgtacgagagcaatggttttaatttttaaaacacaccgttttgcacaagttccaaactcccaaaccgcctaacaaagtgctccatccggtcttaaaaacaaaggtcatgtttcctgcacaaaaatgttacaccctatcacatctgtcggagatataggcccgggggtatgtggagtaaaggagagctacttccctttccagccacacggctccgcgagctggtcccacccacatacctcgtgagtcactaaggcgaaggggagagcctcgggggtcgacgacatcccctcgggggtgacgtcaccccctcgggctctcccgtcgttttaccccgaggccctctctcggggggaagtgtgagaggggagtccaggctgggcggccataaatgtgcagcgccccaaccgtccctcgctgcattcaatgcggcgggggcagacgtgcggtgcgcccgaccgacccctgtcagtcggatgcgaccggtctgtgaccagtctattgccggtcacggccgattggacgggcggtcgtgcccccacgtcgcctctgtctccgcggagtggcggtaggtacgccccatcacatccggacggcgtttgatgcagggctgccgcaagtcttccctcgtttatgagggaatgacagggctgccccccgtgtcaggcgggagacggcgctgggccccactcaaggaccgaccgatgcttagcttccaacaaaaggcacgggttgaaacccggtcgcagtagggagaagggccccctcccctccctccgatggagggggagggtagagacggcgcatatggtatccccttaagctataaaaggaggaccttgcccaccaaaaagagggggagcgagggaaaccttttaaaattcactgataatcccaaacgtaggagtagggtattacgctccagagcggcctgaacctaggtaatccatttgtgtgctagctaatcggggatcggagggacgaacacgcgacttcggagagacgagtctctgcccccggccgaactcacgaaaggggggtcacgcgactccccgcgatcgggggtcttccctcgacagctggcacgccaagtagggggcagttgcgcgtttgagaagaagtcgcttccttccgtcccaggtcggaccaggccctagaccgccatggtcgaggtcctggaagcagaggaagcggtggcgcctacccccaccccgtctgggagtggggattcgggcgaaaaccgtgaccctcgtcaccatcgccatggctctcaaagtcctccccgccgcgagccttcgcggagggaggatccaacccgttcaagcggtacggccctctccccgcccccaggaggagggaggtcgcgacgcgtcggagcacgtcgccgtctcgactacggagacggtggttcgccccaaggcgcgcttcaggtggtgggcgcccttctgcggcatccccaggtgaacccggagccggagacccccgtgcggcgctggctggacgacgtggccaacttggtcaccgctgcccagcggcagttggccacgggtggccaatccaccgccacaggtacatcgagtaccccggctaccctttcctcgtcggcgaggagaagggcccgtcgatcggccacaaccttgaggcgatccacggctccaacgacatcggaggtctcgggaaggcggaggcgtcatgatgacctctacggggcgcaggatgctcgggtcaacatcgagcgacgcctggacgagcgccgggctacccgcatgggggaaggtgcctcctcatctggagtgccgcgctcttcttcgcgaggcggccctccccccacgctcacccctgggaggggcaggttgtagggctttcgttgcgagtctccagaatgtctggtggcccccgaagtttcgccccaatctcacggagaagtatgatggcagcatcaacccctccgagttcctccaaatctacaccacgatcatcgtggcggcagggggtgacgaccgggttatggcgaactactttcccatggcccttaagggtcaggcgcgtggctggttgatggcccagctccccgactccattcactcctgggaggatctatgccagcagttcgtcacaaacctctaggggacatatccctgcccgggggaagaagcggacctgcatgctgtgcggcggaaggacgacgagtccctccgttcgtatatacagcgcttctgccaggtccgccacaccataccgtgcattccagcccacgcagtagtgtatgcattccggaacggcgtgcggcataaccgcatgctggagaagatcgcctccaaggagcccaagaccaccgccgagctcttcgagctggcggacaaggtggcccggaaggaggaggcgtgggcctggaactctcctggcaccggtgcggcggctgcggctgcccccgagtctgcccctcgctctaagcggcgagataggagaggcaagaggaaaccggcccgttccgatgacgagggccatgtccttgcggcagagggcccacgtgggccccgcgcaaaggaaagattaccggcgataagccgagctccaccaccccctccggcggaggccggtcggcggacaagtggtgttcggggcacaacacttaccgccacagtctcaccgactgccgctcgtcaagaacttggccgagtggttccgaaaggccgatgaggaaaagcggcagggtcgacgggagggcaaggctcccatgacctcaaccagtgaccagcgagaggaggccaagaacaaggcccccgctgacgatggcggaggtggtgaggatctggatttctagataccccaagggaccgtcgccacattcgatgggggggcttgcgctcgcacttctcgtcgagggttcaaggctatgaggcgggaacttctggccgctgttcccacccatgaggcgatccggaaggcgtgctggtcggaggtaaagctcacctttgaccagagcgaccatccgacggtactcgctcggggagggaagttggccctggtggtctccccgactatccacaacgtcaagatgaagcgtgtgctggtggacggcggggccagtctgaacatcatctccccggctgcctttgacgcgctcaaggccccggggatgaagctccaaccgtcgctgccaatcattggcgttactccgggacacacgtggccgcttggtcacgtcgagctcctagtaaccttcggcgactccaccaatttccgcaccgagcggatcgacttcgatgtggcggatctcaatctgccctacaacgcggtcctgggcagacccgcgttggtaaagttcatggccgccacccattacgcctacctccagatgaagatgccgggtcctgccggtcccatcaccatctttagtgatgtcaaagtcgccctcgcctgtgcagaacagcgcgcggacaacctggcggcggccacggggccgcaggccccggaggcccccgcgtcccgcgcccccaagaagcgcctcaccttggccgacgaggtgcccgtcaaggagattccccttggcgacgatccgtccaaaaccgctaagattggcgaaaccttggacgccaaataggaaggcgcgctcatctccttcctgcgggcgaattctgacgttttcgcatggaagccgtcggatatgcccggggtccctagggaggtgattgagcaccgccttgccgtgcgaccggatgcgcgacctgtccggcaaaaagtgcggcgtcaagccccggagcgacaaaccttcatcagggaggaggtggcgcggctcctggaggctgatttcatccgcgaggtgattcatccggagtggctggcgaacccggtggtcgtcccgaaggccaacagcaagctgcggatgtgcatcgactacacagacctcaataaggtatgccctaaagatcccttccctctaccacgtatagatcagatagtcgactccactgcggggtgcgaccttttgtgtttcctagatgcatactctgggtaccatcagattcgcatggctagggaagatgaagaaaaaactgccttcattactcctgtaggcaccttttgttatacaactatgccttttgggttaaaaaatgccggccctacctttcagcgcatgactcgaattactttaagtaatcagatagggcgcaatgtagaggcgtatgtcgatgacctagtggtaaaaacgcgccgccaggacacgttgctgcaacacctggccgagactttcgatagtcttaggtccacacgtgtaaagctgaaccccgataagtgtgtgttcggcgtgccggcgggcaagcttctcggttttctagtctcttcccgaggcatagaagcaaatcccgagaaaatacgcgtgatagagaggatgcgccccccagcaagctcagggatgtgcaatgtgtcgctggatgcatggccgccctgagtcgatttatatcaagattgggcgagagagcgctgcccctattcaagctcctcaagcgccccaggccgtttgtatggacggaggaagctgagcaagccctcaatcagctgaaagcttacctcacttctccccctatcctggtggccccggggccggaggagccattgctactctacttggctgcgaccccccacgtggtgagtgccaccctagtagttgaacgcgaggagaccgagcaggaggtccctccggctcgtgatggcccctcgtcccccaaagcccccagcccccgggaggaccccgaggcccccggaggagaaggcgaggctttggcaggaggccccgagccctgtgatcccaagataatccggaatcccccgggggcccccgagcaggcgcgctccggatcatccgcccctgacaacacgaaccggcccgcccgaacggtgcagcggcccatctactttgtcagcgaggcgcttcgggatgtgaaaacccggtacccgcaggcccagaaaatgctttacgccgtattgatggcctcgaggaagttgcgccattacttccaagcacatcgggtttccgtggtaacatcgtaccctctcggccaaatcttgcacaaccgagagggcaccggacgggtggtaaaatgggccatcgagctggctgagttcgacctgcacttcgaaccgcggcacgcgatcaaaagtcaagtcctggctgacttcatcgcggaatgggccccagtggacgaccctgttccgtccgaaccccctccctcccccgaagagaaagaggacccaaacgccgacattcgtggcggacactggattatgcatctcgacggctccctcacccttcaaggcgcgggtgctggagtcacactaacctcgccaagcggagacgtcctcaaatacgtcgttcggctcgacttccgagccacgaacaacatggcagaatacgaagggctcctcgcaggattgagggcggcagccggaatgggcatccgccgtctcctggtcctaggtgactcccagctggtcgtaaatcaagtatccaaagagtaccaatgcaccgaccctcaaatggatgcatatgtccgcgaagtacggcgcatggaacgccacttcgacggaatcgagctccggcacgtgccccggcgcgacaacacactcgctgatgagctgccgcgtgttgcgtcggcgcgagccccacttcccccggggacctttgaagaaaggcttgtccaaccatcagcacgaccgaacccctcgaggggctccaacgacatgccctccgccccgattccttccaactcgcgccccttggagcccgagggggtcgaccccgacccccctccgcgcccccggggcccgagggggtcgaccccgacccccctcgccaagtcgcatggatgactaatgtccgggcgtatctcgacgacaatactcttcctgaggaccgcgcagaagctg

SEQ ID NO: 66393 - DNA, 1682 bp, Oryza sativa
tcccctccggcggcgggaggcagctaggcagtggcggcagccgtcgcgcacggagggccgcccctggcggcggaggcaagtgcggaggactgggcgcaaggcgcccggcggcggtggcccgcgcggcgaccgggcgcaaggcggccggcggcggtggcccgcgcagcagcggggcgcaacggtggctagacgcaaggcggccggtggcagtggcctgcgcgacggccaggcttcagtggccttcgcgacggctgggcgcaaggcggccggcggcccacggccgggcgacggcaactgctacttgattttttttattttgtgaatttttgtagtgaatgatgaatgttttgtatattttgtcgatttgggaatggtctcacaaaatttgtggattgtggatgtgtatgtattattgatgattttgctggttgatttgtggataattttattgtgcatgattgatgatttgtgaataaattgagtggatttggggtggaggaatagatataagcagaaaaaaacagccgtgacgtgaccctatctatctttagtcccggttggtattaccaatcaggactaaagatggatttttaatcccagttatttcacccgggactaaagatgggtatctttagtcctggattcgtcctcccggttgcaaaaccgggagtatagggggtttccgaaccgggagtaaaaccttttctctactagtaattcggtatatattccgtctctgactcgtcgttcagagcgcactgacgatcgagcagcggctgattagggaggtcagagcttggtgctgatggactagcaacattctccccggctgattagggagggcacgtacgccgtctcaaggctccagcagcgctgaagagattgagctcgtgccaccgcgccattaccactccgatgactcaaattagtcgtctgctcgtaatgtgtttgtcagctgttcttgtgtgtgaactttgcgcttagaaagtcggatcgtaaacatctgttatcaaggagaaaaaaggtactgtgtaaagaacattggacaaatttcaggggcccaaacactttcacctgtatcttttattctccgcgatactcttgtgaaatcaaagtgttttttattattatatattttgtgatgaacaattgatatgtgagattactggtttttatatttcacggatattcgacgaagtggtgctaactatgttggactagtcagactaggtggtgtaggtcagtcagaccagcgtgtagtgtgcggttagaccgaccagtcaaatggtctgactggtatgctcatgcttggagttggtttcgggttgtttctttggatacttgtgattatctcgtgtttataacttctggatgatttctatgcttgtgtaatagtgtggtttgctaatgttgagtcaaggtagttgtggaagaactatgctcagatatggtttcttgtttactaatgtgtagatatgtcttgatatctcaagagagtattgccggtgatggattgggaattaagttgggagaagatgacgtccgaacaatgaggatatcatgccattgctgcacaagtgatctttgccgccggttgggaagctcttattgtcccggttatgcaaccgggatggcaaattcgggattaaagatggctacctttagtcccggttgaaataacc

SEQ ID NO: 66394 - DNA, 16357 bp, Oryza sativa
tcaatgttagtaatgtggtaattaattggactcctggtttggaatggttaattcctggtttggaggtttagtttgttcaactggggttggttgttcaaatatggttgggcctatgcaacatgggtgtgttgtatggtgttatttaatattgattaattattcaactgttttcactattctcttaaatatttattaaatgttgtttctgcaaatgagctatgttatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttcttggttaagatgcctgtggagtggagtcaccatagctgttccgtagtttgttatagtttttctttccgctgcgtagaatgttattctttgagaggaactatctacctctgtaataatttttatttgcgaatattaaatagtcatttatttgtactctattattaatttgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatattttgaaaaaaatagaactgctcttctctattctcttacaaattaattaagttggcagcacatgcaaggttatgcacaaaatttatttaactcaatttcttttcctttaaaagcaaaagttgctcttctcaaaacgtttcattttctttttaccaaatcttattgattagtcggcactgtacatctattatggtatcgatttaatcatgctggcactagtactactcatcccctttaatggtgacattgtaccgtgcttatagtaggtcttaagtattctggttttattttattcacttgtccaaactgatttgtctatgttcaaaagttaaaattctaaaaacatatttatataatagcttggtatgtgtcttttcttttattgtcttcctttttggtcaaaatcagttaagtctagatggtgcagctaacttaaaatatgcattaattcttctcttctatgtttctttagatgccgccccattcaccgagaaatttgttcaaggtgttaggattcgttagggagctgaggttgatggtttttgaggtaggctatgaagttgctcccgagtaccgccaaatttcccatgaccccgacgaggagaagtgtcgtgttcgtgtgacgttggctagtgatcgtgaagaccttccgtccattaagttcgaagctggaggaagatcgtacagccatgcttgtcaagaagcagctttggtggccattggagagttgcgtcaacgctttgaagaggagttggattcatcagctttccagtatcatcctcacaagcctcatggacaagactatggaacctatacctgtcctgatggtgaagagagtgccactctgatgcatgcggtgcatatgcttagtgctatggatgcagtaagtgtggagcgagacaaagcagctcatgacagggaaaactggaatcgaggcaagatttacaagttgaagagcaaggtgtaccgtctacagaaggaattagctgaacttaaaggagaaacgccgccgccaacacccaagcttcgcctcaccgcaagaaagagaacctgtccgccacctcgtctccagttagctttgaagattcgcgtgatgggtgaagctgtgcccgatcgtgctgaacctgtcattgacatcataagtgatgaggaagaggaggaagaccctgaagaaagagagccagctactccagaggaagaagatccatcgcttcgttccgacgcaaggcggaattagtcgcttagttagatcgttgccgtagttcgctgtgttagattgcttgtttaagtttgcttgtgagtgtgtgggttttagttgttgcttacatcattggtgggatgtaacagcatgagtctagttctttgcttgtcagagtgtaagatagttggtgagatagtgttaatgcaacttaaatgtaatcatacacagttaagagcaatatagaatttaaattaattaaataactccgttctaagggtgtctctctgtcgttctttcctgttgtccctgcttatcgtcagatggtcaacacgcgcaccggaactggaagtggaagtggaagtggaagtggagctactaacaatggaggagatcccacgttagctcagattctggcccaacaaacgcaactgatcaatctgttagtgcagcaggcacagaatcagcaggcaaacaatcagaaccagaatccacccccacctccccaaaacaagctggcagatttcttacgtgtgagaccccctaccttttcaagcaccaccaatccagttgaagcaggagattggctgcatgcggtggagaagaagttggacttgatccagtgcactgagcaggagaaagtttcttttgcttcgcatcaactgcatggacctgctgctgaatggtgggatcattttcgccaaggcagggctgaaggagagcctattacgtggcaggaattcacggccgctttcaagaagacacatataccagcgggtgttgtagctctaaagaagagagaatttagagaactcaaccagggatctcgttcggtcaccaaatacctccatgatttcaaccgtttagctcgttatgctccggaagatgttcgcaccgatgaagagcgtcaggagaagttcttggagggactgaatgatgagttgtcttatgctttgatgtctacggatttccgggatttccagcagttggtagacaaggcgattcgtcaagaagacaagtataaccggatggagcagaagaagcgcagggctgcccaattcaagacacaacagggcagtaaccagaggccgcgtctcgttactggacctcaagttccatcgtatcctcaaggaggatcttcatcagttgtccgcccccaacgccagttctacaacaacaatactggtaatcgtggcaatgacaaccgcaacgtggttgctcgtcctgcagcaactccagctcagaaccagcccgtcaggaaggaacagggaagcaagccaggggtgtgtttcaattgtggtgatccaggacattatgctgataagtgtcctaagcctcggcgcgtgaagaacgctccagccccgaacaactccaatgctccagcaccaaaggcacgtgttaatcatgttgcagcagcagaagctcagagtgcaccagatgtgattttgggtacgtttcctgttaactctatacccgcaactgtgctttttgattccggtgctacacattcctttttgtctaaaagttttgcgagcaatcatgggatggaagttattagtcttgggagacctttactagttaataccctaggcaatcaagtattttcgacacaatattgtccttccgctactatagaaatagaagaagttcctttcccatcctcgcttatcttgctagaatccaaagatctagatgttatcttagggatggactggttatctcgtcacagaggagttatagattgtgccagtcgtaaggtgactttaaccaatagcattggggaaaccgtttctttccttgcgtcctctcctaaatctcatggtgtgatcttaaaccaagttgctctacaagagatccccatagtacaagactacccagacgtgtttcccgaggatttgctaggtatgccacctaagagagacatagagtttcggatagacttggtacctggaaccaaccctatccataagagaccgtacagaatggcagctaatgagttagctgaggtgaagagacaggtggatgatttgcttcagaaaggatacatcagacccagtacttcgccatggggagcaccagtcatctttgtggagaagaaagatcatactcagagaatgtgtgtggattatcgagcgttgaatgaggttactatcaagaataagtatcctctacccagaattgatgacctgtttgatcaactggaaggtgctacagttttctccaagatagatctccgttctggatatcatcaacttcgaatccgtgaggaagatataccaaagaccgccttcacaactcggtatggtttgttcgaatgtaccgttatgtcatttggactcactaatgccccagcctttttcatgaatctgatgaacaaggtgtttatggaatatctggataagtttgtcgtggtgtttattgacgacattcttatttactccaagacgaaggaagaacatgaagagcatcttcgtctagctttagagaaactacgtgagcatcagctttatgccaagttcagtaaatgtgaattttggttgtccgaagtgaagtttcttggtcatgtcatctcgtctggaggagtagcagtagatccaagcaatgtggagtcagtgttaagttggaagcaacccaagacggtttcagaaattcgtagtttccttggacttgcagggtattaccgcaggtttattgagaacttttcaaagatcgccagaccaatgactcgtctgcttcagaaggaagtgaagtacaagtggacggaggattgtgaacgaagtttccaagaactgaagaaaaggctagtgactgcgcctgtattaattttgcctgattcgaggaaaggtttccaagtgtattgtgatgcatcccgactcggtttgggttgtgtgttgatgcaagaaggaaaggtggttgcttatgcatctaggcaattacgtcctcatgagaataactacccaacgcatgacctagagttggcagctgtggtgcatgcattgaagatttggcgtcattatcttttcggtaaccgtacagagatatatacggatcataaaagtttgaagtacattttcactcaacctgatttgaacatgcgtcagcgaagatggttagagttgattaaagattatgatatggagatccactatcacccggggaaagcaaatgttgtagccgatgctcttagcaggaaaagctactgtaatatgtcagaaggtcgacgtttaccttgggagttatgccaagaatttgaaaaattgaacttgggaatagtcagcaatggttttgtggccgctttagaagctaaacctactctgtttgatcaagtcagagaagctcaagtgaatgatcctgatatccaagaaataaagaagaacatgagaagaggtaaagccatcggttatgtagaagatgagcaaggaactgtgtggttaggagaaagaatttgcgtcccagaaaataaggggttgaaggatactatcatgaaagaagctcatgaaactttgtattccattcaccctggaagcactaagatgtaccaagacttaaagcaacaattctggtgggccagtatgcgacgtgagatagcagaatatgtggctctatgtgatgtatgtcagcgggtcaaggcagaacatcagaagccagccggtctgttacaaccgttgaagattccagagtggaagtgggaagaaataggaatggattttataaccggtctacccagaacgtcggcaggacatgattctatttgggtagtggttgataggttgacaaaagtcgctcatttcataccggtcaaaaccacctacacggggaataagcttgcagagttatacatggccagagtggtatgtttgcatggtgttcctaagaagatagtgtcagatagaggtagccagtttacttcgaagttttggcagaagttacagttagagatgggtacccgtttgaatttcagtaccgcttatcatcctcaaacagatggacagacggaaagaataaaccaaattttagaagatatgttgagagcttgtgttctagattttggtggaagttgggataagaatttgccgtacgcggaattctcatataacaatagttatcaagctagtttgcaaatggctccgtatgaagcattatatggtcgaaagtgccgtacgccgctcctttgggatcaaaccggtgaacgtcaagtttttgggacagacattttgcgagaggcagaagaaaaagtgaagattatccaagaaaggttgcgcgttgctcagtcacgtcagaagagctatgccgacaatcgtcgcagagatttggctttcgaagaaggagattatgtataccttcgggttacgccgttacgaggtgttcatcgtttccagaccaaagggaaattggcaccgcgtttcgtgggaccttttaagattgtgagtcgaaggggtgaagtagcttatcagttagagttgcctccgtcaatggcgggaatacatgacgtgttccacgtatctcagttgaagaagtgtttacgtgtacctacggaggaagcagatcctgatcgtatagagcttcaagaagatttaacttatgttgagaagccagtcagaatcttggaagtaaccgagaggaataccaggaattgtgttatacggttctgcaaggttcagtggagcaatcattcagaagaagaagccacttgggagcgagaagatgaattgaagtcagctcatcctcatctgttcgccagttcttctgaatctcgaggacgagattccgtttaaggggggtaggtttgtcacgccctaaaaattgcctaaattaaaaatgcatattttaaattatttttagaaattattttaaaagcctacaaactaaagtctaattttctaggaaaattttcaacataaaaatgagctacataaaattttattaaatactatacttgctcctctattttctagatttttctgggaattatttgagcaagggaagtatttttaacaattgaaacaacatttcacaaattgttttatttgaaaaagttcaaaaaaacccctccctaagccgttgggccgaattcggcccaacatcctttccctcccgcgcggcccaagccggcccagttgccgccgccgcccctctctcatgtgagacaccgacatgtggggtccacatgtcgggcctttcttcaagctccagccggccggccgaccaagccgagccgccccaccgcgtcccctttctcctctcaaatccgctccaatccgaccccgattcctccgggtttttgagggattttgatcctctcgttctcctctatctttcccctcaagaaacggagcaatccgttgagtattctctccgaatcgagttcgtttcgagtttatccctaaaaaccgagtttggatttttcccgagtcgattcctctcgtttggagtccgatctcttcaatccaaggctataaatagcatcccctcgtcgccctctttcgtttgccccctctcccgtggtctcccgtgcctcctagtcgccgcgccgccgccgtttagtacgccgccgccgccggccgtcttcggctgcgccgcgccaccgtctccgccgtcgccgccgcttgccgtcgccgccgttaggtgcgcacggaggtgaggaagcctggccgcacctcctctttcgccgccgaccgccgtagttcgccgtcgccgaccgaccgagccgccgccgtcgtccctctcgtcgccggccatcatcggtcgtcgtttgtcgttgtggtgagtaccgttgggttcgtctcgtcgtcctctacatgtacatgccctccaaaaccccggccgactgccctagctccggcgaggtcgccaatccgagccgggccggccatggatgacgtcatgctgacgtcatcatctcctctttttccaatttcttttaatagattaaaacttcggaaaatcataactaaataaccgtagatccgtttcaggtggttcaagttgctaaatttttctaaaatcaagatctacatgttaaaaatatccacatgtactgtttatgcttgtttttgtactgttttgttgattttgtttaattgctttagtttccgacgttccggaggagagcgtttcctttgaggaaggttccaaagcgtttgcggaagcccaaggcaagtcacacagatcccaaacaaccctttgagcatgttgaacccgtttaaagctattattttatttcaactatgcattgttttcgaatgtcatcgggtggtgaacctttcccaattaattaatggccgaagatgactttattttcctatgggttataatttgattagcatgaaccttatatattggattggttcagctaaacgctatatgtaagtttgcttagccatgcttagaaacattagctaactaaagggattaattataaactatgttatattattattttaattatggttacattaaatggtagctcacgatggttgatcgtgtgatgataattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtgtaacgtgattcattatagtgcgccagactgagaagtggcgagaagtccacgggggtcgctggggagtccatgccttgtttataaagggggtgattatgatccagaaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactgttcatcaatgttagtaatgtggtaattaatttgactcctggtttggaatggttaattcctggtttggaggtttagtttgttcaactggggttggttgttcaaatatggttgggcccatgcaacatgggtgtgttgtatggtgttatttaatattgattaattattcaactgttttcactattctcttaaatatttattaaatgttgtttctgcaaatgagctatgttatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttcttggttaagatgcctgtggagtggagtcgccatagctgttccgtagttatagtttttctttccgctgcgtagaatgttattctttgagaggaactatctacctctgtaataatttttatttacgaatattaaatagtcatttatttgtactctattattaatttgtcattgtgtgcctcggttgattcctggacgagggtttaacacacatataagcgtttggaattttggatagaaattccgggcgtgacactattcacctaaaatttgtcttttttattactcctaaatgaatttgagtttgaacttgagatttggtgagaatgtatttgagtttgaacttgaaatttgattttcgatgttcctaccattcactccctcttgtatgcttgactcttgtatggtggcaaactattgataggatgcatgtggtgtgcaacttgttggccttgggtgatgcacccactcactgatgctcatgtcacaaggaaactcagcatgaggtattgtgccatccggcatcatatataatcaaaatcctgaatttgaatgactctagtttgttacacatctagagatctttagcaaaatcaatacattggaacctgtatttttccaagaaataaaatggagacaacatgcagcattattaattagtacactacaattgagaatgcgatatggtatattgtgggcgcactgcatgtctgcaccaaagccaaccacagtacagaccgaactaggcatggagatcgattaaaacagccgcgaagccctgttattaatatgagaacaaggaggttccaacattgataacatcacaggaagatgccgttgataaaaatgggacatgtttcttacatgaaataaatctgaaggcaattgaaacaacacataaattatggggccttctttaggaaaaaaaaaatcaagcatgacatgttaccaaagaaaacaataccgaccatacatatacaaatccgacaaattactggaaagaactgaatgtgtgatgtacttgcacgcaggcatactttaagaaagaatactaatgtagagagaaccaatctgcaacatctatatacggacagtggcgaagccaccgtaggggccagggagggccaacacccccctaacccctatgtgacctcccctcccctctcttctcccaaggataattagcccttataatctagccattaattacatcattagttgcggatgagactaactatataggacaactgcctagctatatatataggacttatgaaatgacttagttaactgatttatcattttaaaaatgattgcaagactccaattaaaatcatggaacaaactgtttaaattggcaaattatgatctataggttctcattctctcttctagctaatcgctataacatgtatgatgtcgagttagcaatcatacatcaacgctacaatgtcactgttcaccgaaccttaagtgagttaccacgtctcgtagatggcaccccccgtctctaaatcctggcttcaccaccctacatggatctctgcaatatgcagcatcttctggtgcatcacgtcaccattccattgagtcttgaagtctttgtgcaggtccatcaaacagagcttctttagggaggcaagggattcaatgccttgagggactttatccagcttccgcaatgatacaatgtataaaccttcgatgcatggaagggcgccatccgtgatgtttatctggttgacatcaggcatgtgcattaacacaagagtcttcaggtgggggaacgcctctgcatcaagaaccaaagttttcgaactgtgcatgttgttcagtcttagataagtgaggtttgacaagtgtgatgcgagcatccccagtggatcttcaccaagatgacaccaacttagagctaaatatttcagatatgtaccatggctatgaaatatcgggtagtctagtgtgcccttagcccattgccctctgataattaacctgtggagttcattggaaatgggctggagagcctcaaaacaaagtggctcattttcatcctttgccgaaagaagcaagctggaaagaagcggcatatttgatagtgtagcaaaaatatttccacaatcagcagaacttatgttgtcaatccaaatacttcttatctgcattagttccttcagctgctcggccaagtccttgctggcttccacagtctcaagagtctgaagttcttccaacttagacagatatttgggtgcttgcactccaataaaataccggaactctgacttattttcatcctcatatctgtcagctagaaggtgcctcagcttcttgatcttagtgattccacgtggtagcttctctattttagtttgcttgatgtccagagtttgcaggtttgagagcttgtcaatagactctggtagtgagcagagtcttgtccgccttaagccaatgtaacgtaaattaaacaatttgcctatgcatgctggtacttcggtgatatctgagtcttgtagctctaggacagtgaggtatttggattcagacaaaattgaggataacaatccaggagggtgtgtagttgtttcaagtagtgtgcgaagatgtggaaatttcactgttgatgcacaaccttttccattgttcaagaataatgacagacgacggacttcccaatcaaccttttccacagctccataatcatttgcgtaaccgaacctctcctgtccagcaattgagagagccaggttgcgcacaatgtcatgcatcttacaagagatcaccttgccaagctcatcatactcgtcaacttcaagcatgttccggtggatcagttccatgagatttatttcggccacatcttctggtctattgtgttcgattctcaccgcaaaaccttctgcaacccagtaccgcacaaggctctcacgagatatgcgaaaatcttcagggaacaggctgcagtacaagaagcagttcttttggtcagctggtaatgcatggtagcttactttcagaattgccttgacatcatcatttttggccagctcactccgaagctggttgtacatttgttgccaggcatgctcagtttgtagctttgtggacatcaggccacccatggtaacaagtgctaggggcagccccttacacttacttactatggaggcagccacattctcaaggtccagcgggcacctatggtcctttgtgttgtaaaatgcccttctgcagaaaaggttgaatgcatcaatttcacccaaagcctgtatcttgagatggcattcagagggagcaagaactgccacatgttccatccgtgtcgtgatgataatgcgacttgcttggggattcttaagcatgccctgtatttcgaagtacacgttctggtcccagacatcatctagcacaatcaaacatgatgtacagttttcagtccttctgtttaattcttttgtcaattcatgaacgcccattttgttgattagatcttccttggattctgatgattcttgttccatgggtatgagcggactgactaactgtcttagaagactaaggatcgtgcaagtctgtgacacagtgatccaggcatgaactgggaacttgatcttttcacgttcaaatacgtctaaggccagggtggtttttcccagtccacccataccagacactgttatcactttgtggcctggttcttcagggtacagtaattcaagcaaccttttcctgttgtattcaatccccacaggatcgccacattcaagcaactttcttcttccttgagatcgcggtgtttcgatgtcagtgggtgttcttgaaatgagctgaactgtaggtaaccattccatttgctgtcttttaacctgttcaacatcaccctttatcttcattacctcactagcaacttcactgaaaacacctgcataatgtgctcctcttacgcatctcatcactgatccttcttgctgccgttgacaagcatagtatgagtacttgtccattatgtcttcaacacggtaagccagcttccgcagttcgtcgatccaacccttgacaacattcatgttggtatttgtggaatctaaatcttgtattacatctttcatgagacgcaattcccttctgatatactcaactttgtcaggaagttccctcaagttagatacttttccggagagtttggctatgacagccctggtggcttcatctcccaaagctgtactgatctttgagatggcaagcagcacagcttctgccattgccttagtgctgcagaatagaatcatgaatcatggagctttgtcacataacgaatttaaaagataaaaagggtacttgttactgttgtagaacaattacagctaagattgtttttacgacccttgtgggaatttgcaagccatatatgtattcaagtattcaccatgatgtaccaatagatataggtgaaggagctgtgtcaagacataccatcctcctagtgaatgagtgagaaagtaaagctaatcttaatctatactttctataaaattatagcccactaaatctaaagctcaacatataaccataccacatcatcaccactagcaataattactccctccatctctaaatacaagggattttggttggatgtgatacatcatatgtccagatttagtactacttggttattctggtttgtaaaaaggaaaaaaaataacacaatgatgatcacacatcagacatatttgatcacttttggtggatatagctgatacttgagaactgttttgtttgaagcgcctgcaacactcgtaatttcatcaggtaaatatttttggaccatttatggtgttatatgtcactgaaggtaagcatttttgtgcccgtaaagttcataattttcattttattcattagctggagagacctacttcttattgatttaaatcccactgctatgatttcttctactaatggaatgaattatgtgttaattgtcttgttggaaagcatctatgttttcttcaagaggtgatgttaccatgtttacccaatgatttctgctatttcatctttcttaacaaactgctttcttgttcgtaacaagatcgttattcttatgcattatcaggtggacctacttatcaaaaggtatatatatatatatcctttatccaaagtaggaaattaactttcttagaagtgcaaagcaaaggatgataatgttgcctaaattccaatataatatttcctttcatatctaaggttatagatgaatttcttaaccaagcggccataacctaagtgtcttttgtggtgtggaattatatagtatccaagttcatcatgaaccaatcctgaagggtccttactggaggaacggcatttgcggtcatttcctgtgctgtttaatccagaaatagtgctggagatgaggaagtctattgcaagatggtgatcctaatccattttcatttctaagcctgtggcaaactgttgctccttaaaaattgttatgttcattgaaagactctggttctattggacgaggtattgcgtggtgcagtcttattttatagcttatagctgtctcttacccttagggagttagtaaaaccaatcctttctgaatgtcatggaaattagtcattgtttcccaccaatctgaacttctcaagtggttggatcttaccctctgtcttgccaaaaagctttttaaagttcaaagcagtttcatatctaaagacatgaccattggatgtacttgtgggttcagaacttcaaatttctttataccaagatgtagaatggttattttggttgaatcctttactggtgcaatgctctatttgtagaaatgctttctttacaacagaacttcactgaagctctgaggatggtgtttgtgtgagagttcaactgaaaataaactgatgtttttcggacaatcagttaatgtggccgctgctaaatgcatgagcatcagcagtttagccaaggacctaggaaccaagttggcatgtttctgtctctttatgtcgccaaactaatttatcctgtaacttttattttattctctaagtttgtgctttcacccaagtacagggtgatgtcaaactacattgcagggaaattattgggattgttactaatgagaattctttatctaaactgaagcagatggccgtagcaactcaatataacatcagccaaagagataaatatatgagaggatgcaaacatttgagactgattaccttctggggcttgacttgagcttgtagttctagcctctaggtattattgcagcagttggcgaaataatgtgatgaaaaccctgcactaaagttaaaaaagaattattctttcaataaaacatcagaacaaaacaatgtgatgttgaaattgatatagttgtactgccagtatatacagagatctccaaaatgcagaactaaaccagaaaaaagctgttcactgctgttctatgtgattgtcgctcaaattcataactaatccccaagattttcaagcaaaaaagaactaataatctcttctcccaggaggaaaattctcgccagaaactgtataacttccaagcagacaaaaaaacaggaaaactattccagatctgagagtctgtaaggcaccaaaaatacgagaagattcagtacagatcttcgagctagagctgcaagcagcaagagatagaatctcacctcaaatcagaacaagggtcttctttcgtcagctaatccatcgaagagcagagctagtcagatgatgatttttggaggtcgagaggctactcccctctctctccctcgccttgatctttagcctgcgaggctgcgacgacttgagatcaagtcccacgcgcttagcagcatcctctgaagtctgaactagcagaagaaaccgctgcgaaagttcgtcaaaatttccaggaagaagccaagagaagagatacccactactgcagtcaatctgagccgtcggttggacggctcaatggccagattttgtcaagttcatctgggccgggtcaacgctcaacagcgaggtcaacgtcgtcaattattttcttttccttttccttttttttactagataaaatgcccgtgcgttgcaacggggagaacagat

SEQ ID NO: 66395 - DNA, 9767 bp, Oryza sativa
aaaatttgtcgacaaatatataacaaaatcgttaggtatatataggtatagatttgtcaaaatactcggttactataatgggcttagcgtgggccggaattcacttgtgggccgcactgtagcagccgaagcccaacaagcgctcgcatcgacggcatttttcacggcgagcgttttctggggtgtccggtggccgccgctggcgaatcagatccgccacctcgccctggcgctccggcggccggcgaggtgggctgcgctgcgccgccgcttctggccagattcgcctggtaactcaccgattcaatctaccggattatttgctaggatagctagcctaattcgttggttgcgtttcagatgtttgagttaggcggtatattgatgtcgtaacgagttcagttttgtctacctcaaaaaaaaaaaaattcagttctgtagatgctgttcttccttccatgttcatgtggggatttatgccctaaaatacatatggcactttcaacacaaagagagttcatacagtactagagcaatgcattagtgccttagtggtagcatgccatgtcatattgagggctgctcactgttcatactgtttcagtataaaacttcacatctgctttatcaacaagtttgtttattattgccttgagtgtttcaccgaatttttgtttgtcaaagtatatatctttgaaatgctaggaggctagatctgtttttatctctgaaatttgatgttgcaatcctgctttcctacagaggagtgtattgctgctatcgtccaacaaacaatatataaaaggatgctatgagatcattatgtaataaatccatgtcaaaatgggaataaaggatcattattcatattaaacattgcgctgcctgaaacggatttaagaactggaagtgaaacacaaggcaaagacccaaggaacttcaggtcgtgactcctgatggcaaagagactaagagagtcgatatttcatgacttgttgaagaaaaatatgaaccagatgtacagataccaagtacaccagagccaatgtctttttagagaggattgggtgaatgcagatgcacttttcaagttattcatcgaaggaagatgtagcacaccactcctaaacacgcagatctggaacatgctgcattttccggtgcatttctctatggatccaatctgctttgaagtcttgatgcagattgaggagccagagtttcttcagggagaaaagattttcaatgcccacagggactctctccagccctggcagtgaatcgttgtataaaccttcaatgactggaagtgcatcatctgcgatcttcagccggttgacatttggcatgagcttcaagacaattgtcttcaacttgggaaaggatcctgcagtaatgatcaacctgtttgcactaatcatgctgttaagtctcaggtatgtgaggtttggaacatgtagcccgagcactcgaagtggatcctctccaagttgacaccaacttagagctaggtacctgagatttttcccatgttcctgaaatatcggcaattccaatgtcccagtggcccactgccctctgacaattagcctatggaacttcttggatattggattgagattttggaatcagagtacctccttctcatcacatgcagagagaagcaggcttgaaagaagtggcatcttggacagagcagtaaaaatctttgcacaattagtagcactgatattatcaatccacaagttttgcagtttcgtcagcttctctagctgttctgctaattccttgctggcttgaacagtttcaagagtctggagttcttccaaacctgataaccctttaggagcttccactccaatgaagtatcggaactctgtccgtttctcatcagcatatctgtcagctataagatgccgcaacttcttgaccttaacaattcctcgtggtaatttcactattttggtttgcttgatatctaaagtttgcagattagagagattctcaatgcattctgggagcttacatacgttggtgcgtcttaagccaatgtaccgcagattaaacagattacctatggatgtcggcacttcactgatttcagagtcttgcagctcgagaacactaaggtagtttgatcgagaaaaaattgagttcagcatgctggtggaggatgaaacagcttgaagggacaatagagttcggaggtgcggaaatgacacccttggtgcgctatcatctttccatccacatgttgagaagcgacgaacttctgtatccagctgcgtcattgtgccattatcacttgctgagccaaacatctcctctttagcaacatcaagagccaggttgcgcacaatgtcatgcatcttacaggtactcaccctgctgagctcatcattctcaacaacttccaacatattacggtgaatgagttccatgagatttccttcagctacatcctctggtttgttaccatcttttctcactacaaagccttgtgcaacccataatcgcacaaggctctcccttgacatggagtaatcctcagggaacatgctgcaatacaagaagcagtttcttaggtctcctggcatatcgtggtagctcagatttaggatcgcccggacatgatcattttttatcatctcatttctaagttggctatatgtttgattccaggcatattctgtttgtttccttgaggacaacaggcttcccatagatacaatcgctagcggtagaccttgacacctcttaactatagaagtagccacctccataaggtctttggggcagcctgttctaccatggaaagcccttctacagaagagattgaatgagtcagtgttgcctaaaggttggagatcaaggcgatattttgaggatgcaagagctgccacttcttccttccttgtcgtgatgacaatccgactttcctggagattctggaatgcattgcgcatcatagtgtatgcttcatggtcccatacatcatccagtacaatcaagcacttgctatcttctaactttttctttattttatctgttaactcataaacatccattttattcatgtttgcagctggtgattgctctcggtatgcaaccttcataagtagagtgcatagcaattcttccacatcgtaggtctttgatacaacaatccaagcatgagcagggaagtttcccttttcccggtcgtacacattttttaccaatgtagtttttcccagtccacccatgccggacactgttatcactgtaccatgcggctcattggaatacagccatccagtcaattttctcctattttcttcaacccccacaaggtcttcatctttaataaattctggcaggcagcctccagatatttgtctctcaatatcagaaggtgtttttggactcatgagctctgccgaaagagaccatttcattagatctttaacattccttggcagatttttcaagtttgttactttttcagacagtttcgctagaacagccttggtggcttcttctcctaaagtggtaccgatctttgagatggcaaggattactgcctccgccatcagtgctgaagaacagaaacatggagtcagtcttttatgtgatatgctaacaattaagaatatcaggcaagaacatcatctgattgaatagatctgatccatgtattatgtgctttacggattatggaaataatgaacacataagccaaacaacatttaatccaatgcatgtaaaaaaaaatgaaacaaaatccaaaagcagtaacagtcaaatacagtttccagcgagatgcaagcacaatgaatatataaattcattttgaaattaaattggagctatctcttctgtatactgaaattagtatatgtgagtattaaaaaattatttaccgtaggtttgtgctatataagttccgtaggttattttacattaggtcagtattatgcaaggttacacattgtaacgaaattcaggtttagttttgaaactccaatgtattatatagaaatcaataacaaactagaaattaaatggactgctctaggcaagaccatttcattctagagtcattgtccatgctagtttcataaaaaaaagtaccgacacgattaaaaaaatacataataatctgaatttctctggaacatctaaaactccagcaaattaaacatacccatgttaattggtaccagcaagagctggccatgtggttttctatttgtacaaacgggcccatctatttccattgaaattgttagcgtagattcttgtaaaggtttgagagttgatgcatatttgttattacataactggttcataataatgagatcgggtatttcaaatcatttacttgggaggtattttttttgttttccttttttacatatgccgtacatgcatacagaaatatctaattatgagactccctgatggtagactttcagaaatattttaataaactaaattactttctggaccttgattcacttgctccctagtgtttgagctgctgcctgctggtgcttttcacatagttattgaatttgatcatattggttacaattgctcattaaaaaagtgaactgatgtgaccttgattcacatgtgatgcgatcttttatttcttcattagctgaactgcctaaacaattttatttcttaatgactataggtattttttgtctctgcttcagcaattcgatatttttgtctggattactttcttgtcattagtagtatggaccttgtcagtcaaagatatgtctggtgataatattattcaaacaggaggattatgagttaagaatcatgttgtgctagctaagattttagatagtttttctaatgacgtggattcaaaatccactgaagtatgcatcttatcatttttcttttttatgcaaaattagtgacaagccggtgtgctttcagattattttctcacatttatcttgtcttgctgaaggcacctggacactggtttctgttggagtaatgtttcaaattggctttcctcaataatatcaggacttaatccatttgtttttgacgctttaaaacagctatgttctctgtgatttactatcttcagtttgaagttttttaatgagatgtggacataaatatgaggtcaagaacaccagaagaatgcacacacactttagcaggaatagcttcattcacagtaagttgtttgtctctactctttgacgatattgaaaatggctcactttaccctctactttttgacgatatttgtctttaatgtttttctttctacaagatgtattttaagttgaaatttcggagatgaaatcaagaggtatcctctactgcatccgtctaaacggttgaaaccgtggctggattttgttgttgtgttcatccggtgaggtttaaactaggcaagtagatgccactgaggggaaaaccacgtcaaatcttcgatttttgcaagcattaaaacccacaagccccacaatgccaagaattttccatcaaacatagacataaaagcaccaaaccaaaagatacaaagcaagattcagtacaaatcaatctaacctgagctgcagatcaagagcccgtctgtaacagcagatgagctggtgatactacgccttgccctgacgatgaaggatgagaggttcagagaggcagcaaggcaggtataatgcctctcggtcttgaaatctcaatcagatcctgtcagtttggtcgcaatttctgagaatcagtcaccgacgacttgacgcgcagtctacacggctaagcggttgcagtgccattgtcgtccagtggccaagttggcgcgtataaagacatgagtccactgtggatgtttccttccatgaaatttctggtttttatgatttatatgtgcagcgtccgagcttttctaagcacatcctgtgcgttataacgggtcaaacctatataattaaagatgggcatgctttaacgtatgatactcatatagtgtactccctccgtttcacaatgtaagtcattttagcattttctactctcataatgaatatgaattcattaacatcaatataaacgtgaaaaatgctagaatgacttacattgtgaaacggaggaagtatatgctacgaaaaagaagagaggatggaagatgattgaagaaggagatggaaagaagaggattccacttttacagtagtatagttagaggcacgtaaaagttgaaagaattattgtgcagtaagagagaagatatggaaacacttaaaaagggcgtcaataattcatatcgaaatgaaaataagctaatggagaggacggtaagtaggtcatgacatatttttttctatagtccactacgcaaattaggatatcaaaatttctataattgtgtcggcacatttttgtctcagtcaattttttacccgtcggattgaagttgatgtccctgtgcaccatgcttggctgtttcatattgtaaaatcaaggagaatagcccacttgatccctaaagtttcgctttaaggttaatattgtctttgatattttattttgttcaatcagatccttgaactttatcatatggtccaatatgaaccataggtctactagaaacgccatgtagatatgccatgtcatcatcttattaaaaatggatggtgaaatgtataatttctccattatgtgtgatacgaaatattataactaattttacatgattatataatttaatctaatcctaggaattgatatatacacaaaattgattatgttgcatgtattggtagacaaatcgatatatttgagtatttgcaaatgtaagtgtgtgtgaatttttcctttttccctcttatgttgtatgtaagggtatattaagtatttcatgatagatttgtataagatgatgagatgagatgacatgcctacgtggtctttctgatgggtccaaggaccatagtagactcaaagataagactccgagaactaattcgagcaaaataaaaaatcaagaactatattgaccacgaaagtttaaggaccaaataggctatactccctaaaatcaaccaaataaggagccattagttgtcggtttctcgattacacgtcgtcagtttctttttcctttcttatttggcaaaatacgcggttgctaatttgtatcgactctagactggcctgagcagtgggccggatttcacttggggccgcaccgtagaaggcccaggcccagcaagcgctcgccggcgacgagcacggacgatcattgacgccgctctccaagggcggcgagcggcgagcgttttctaggggtctccgcctctccgccgcccgccgccggccgccggcgcatcagatccgccgccttggtaactcccgaggtcgccggcggcccgtgaggtcggccgtccaccgcttctttccagattcggcagggttatttgaggtaactcctggattcaattgcccccgcgatttagttggtgtttgcttcaatcggattgattgcttgcttggatttaatgataacatcagaatttgtttacaattttgtgaatggcattcttcttcgcatgttcatgtggttagaaactttaggatttatgccctaaaagtattgcagtacaaaagagagttcacagttcggatggtgtactgcagcactgaatttgtggtaccatgccatgtcacactgaggaagtgaggattgctcactgcttaggctgtttcagttaaattctgctacatatgatttatcaaaggatttacttattgcctttaggatttcatctaaattttatttgtcaaagcacatttttgcccgcaccgttttttattttgtgtgtttagctcatttagaccagtgtatgtttgaaatgctacgaggataaacctattttctctctctctatgatttgaaattacaatcttactttcatagagaggagtttattgtcgctactttgcaacaaacaatatataaagaaatgctactagatcactgtgtaatatacatccttatcaaaaagagaagaaaggatcattctacataattaaacaccacactacccaaagtggagaacacattgacttcactgttcacaaatgcagttcaatagcataatagttcttacaagaaagccaatatctgaaacagccaaacaacagacctaactcctgggcctcctagccaaagagagccaacatttcaggacttactgacaaacatatcaggcatgatgaaaatgtaaatatgctgttactgataacaacaaaacgaaagacttgttggaaaggactggacgaaatgcagatgcatcaaacaagtcttgactgaaggaacatgtaagttgtaacatcccactcctagacacgcaggtccggaacatgctgcatcttctggtgcatttctccatcagtccagtgagatttgaagtatttgtgcagattgagaagccagagtttcttcagagagcaaagggtctcaatgccctgaggaactctctctagctctggcagcgacacgatatataaaccttcaatgactggaagtgcaccaccagcgaccaccagctggttcacatctggcatgtgcttcaagaccattgtcttcaggttgggaaaagaccctgcagaaagggttaaagtttttgcactattcatgttattaagtctcaggtacgtgaggcttggaacatgtggcgcgagtacccccagtggatcttctctaagttggcaccagcttaggatcttcacctctcatcttggcagaaaatctttaacttgaaggaagctggagtccaactacatctcagtagtgcatatcatcctcaatcagatggtcaatctgagcgtgtgaatcagtggctgaaaacctatttgcgatgtctaacagttacaaaaccaaagaaatagcattctctaccttgatcaggttgagtgctggtataatactacttttcatacatctttgaacatatctacttatcaagctctttatggtcaaaaaccaccaatggtgggtgaagcactcataccagccaattttgttggaaggcttcagaaacagagcgcaagcaagagctgcattaattgattcagtaaaggccggtctagataaagctcaagcttttacgaagtattttgcagatgtcaaacgaagtgaaagaacattacaagttggggacatggcctatctcaaagtgcagccttatagacacaatgcattaggcctgcacagctcatttaaacttcattctcgttactatggtccatttatagtgattgacaaaattagctcgcaggctcataagttacttcttgctgaacactctcaaatccatcccgtcttccatgtgagccatctgaagtgccataccggagcaaaagctataccagaaccagggttgcccttgattgatacaaatggcaatatcctcacagtgcctattgctctgctaagagaggcgtctgatacctcgaaacaacacccctgtcattcaatggaagattcaatgggaaaatcttccaccagaggcggatacataggaggatgctttgttcatcaccaaggtttttcatgctttcaaaccatgaagacatgatacttaagggtgggtattgtcagaagtctgaaactctgaactgctgaagaagcataggaattcagacatgaataggaaagagcggaagatggacggctcagatgcaacgatccgattcactaatgatcatcggagggtgtgcgtagcttttgaggtctgaaa

SEQ ID NO: 66396 - DNA, 8496 bp, Oryza sativa
tatagtaagcaactattgcatgaattagctacttcctccgtttcccaatttaagtcattctagcatttcccacattcatatcaactatttcacctagcttgtctggcgacctcataggtcgctcgcccccgccggcggcctctccgggctccgacggccccccccagctttagcctctccacaccgccgcccctcctctcccctagttggcccaaatgccagactcctcagcccggacacccaccctcgtcaccgccattatcgcccctcccattcatcaccgtccttctccacctccccgcccctttctcctccagatctgccgccctccctagcctcccctaccctagaatgcttcccttcagctggcccttcccatcaatcccctccacagttactcctccacgccaaacccccccaagatttgcaagatccagttgaagatccggctcccgtcagcacttgcagcttgcttcccgggacggtctctggcggccacccctcctccagctcggctgctacagcattcatggcgccgcgttccccaattgatcgttctttggctggtttggtacatccaagtacaaggcgtctttactcctctgtgctgatggatctccccatatccgctgctcagtctgagctcgatcctcatcggccagctgcaccacgaccttcttccccgtcggtatcagtgctgaaggatatcaagactctcaagagtggccgacgtctcgtcctgtcttcttagaatcctcctccttcagcgcaaaatcctccggtctcgtctctggtctctgctagtcatcaattcgccgaaagcaactgggaagaagtcagaaagaagcattggtggcgaaagtctccttcattcaatcgagccaacaaccaagagtgttctcaatccagaagagaaaatttcctgaagcacatggatggaaaatgtttccgttgtctgagcacccagcatcaagtgtctgtctgcacagagcctattcgatgttggttctgtctgaaatctggacacttagcctcctcctgcctcaagcgttcgggctataagagctcgcccactccacccgttctatccacaaaaaaattcccagctcttggtcctctacgctttcccccaaaatccttctcagcttcttcgcccatccccatggacgacctcactgcccgtcctctccttgactcggtggtcgtctcagccactggcgagattgagaggcgcagagaacgtttctctgctcgctccttagttgcctggcaagttggggctctgggtgacaaagttgagcttaatgtcttcgctgacgatgttcgttctgctttccacattagaagagctgacatccaattcaccaaattccaccccgaagatttctttgttacctgctccaaccaaagtgatcgcgatgccatcctccgccaaccaaggcttgctacggcctctggccgagtcttcctctttcgtccttgggatgaaagtctccatggtgtcccagttcgctatcgctaccgtgctcgcctctgtatcgaaggtgtgccaatgcatgcccgtactgatgaaacggcggcaaaggtgatcggtcgcaagtgttctatccactatgtggaggagtactccaggcgtggcaattacaaccgcacatatgacatgtgggtttggacagatgagccgagagccatccctcggggtggttcctttgccatcacgtctgctgacaaggaaggcctccccactgacatccccctccccgagctggagccactccgcaatcctcctccttctgagccaaagaagggctggtcctacgacgtcctcattcatgtggacaccctcgaagatcttcacgctcgcaaagcctgggcgtacaagtgggactataaagtccaggacgacggcatcaacttcagagagtacccgcttccctgcagggctgagccggacccagctcgtggcccggatgatgaagacgaagatggaaacgatccttccaggggtcggtatagaagccgctccctctgggatcggctgagcgggcgctcccacagccgaagcagagatccgaaccggcgagacacccagcgacgtgaccaagaaaggaggggcagatcgcgggacagagagcgctctgatcacagataccgaggtcatcgttcccgcgagccaagcgaggtgagacctcccctgcctgcccagactgatcctcagctccctcccctaatcccctcttctgctgctgctttccccctgcaagttgttgtcccctcttcgaaacctgggttcagatgatgatgcggcttctcccttggtctgcacttctgtcgcagccgttgaaatccttcagcctgatgaaccactcttttcgcaggggcgtgtggacatcctcgacattttggagagccatctcgacccaatgcttcatgaagcagccgtgcatcattccatctattctccagatacttcctcccctcgtgtctcttcccctgtttttgtgcctacttctacaggacatgcaggagcagacacaccttctgcgtgcaaggcaatgaagattgacagcttcatcaacggccttgcaactccagtccagccgcctctcctgccagcccccgacgtcaatgcacggaagccttcccgtgcaaaggtgaaaatccctgctttagtttcggcgcaacgacacagcgagcgtctgctttgcaagcgtcgtgctggcgcgaagcttgaaaactttgcccaagaaatcctctcaaagaaatttggtatcattgatgaatctgcttcttttgatgataacattaaaaagttgtatttacagcggtacaagaagcctctctcgccagcatcactgaagataatcgccgacttggttgaaaagggagggtgcaagacgatcgggatgaagaatttgaagaaaaatgcggcagtggcgcccctgtgactgcctccgaccggcttacagttcaagcgaagcagattttgtctccaatgattccactgccaaggccgatgtcccccgagtgtagctgccatgtctttcgatgtactctgtttcgtctgcttgttagtgatcctgaaatgtgtatctgtcacctatcggagccccgtttcggctctgtctcacccggccttttaaagcatatccacctcaatgctagctgtgtttcttccagtttacctggttgtgtttctgctatgcggagtgtgtttagatgctttttagattatgtcacaagataatgtagccctgttcaattggaatgtgagaggtatgaatgccaaggccaagcaagactctgtcaatttctgcattcaacaacatgctgcttctattgtttgtcttcaagaaaccaagattgctgttgtatctgaccaaatcattctaaactctctaggtcagcgttttgttcgtcaatatgcagctttgccagctgatggcaccaagggtggcataatccttgcctgtgatgaaaacttcttctccctctctgatgttcggctgggaaattactcaatttctgctactgtaaccatgcgagaggaaagagttcaatggtccatcacagtagtctatggaccacagattgaggccgacaaaattgccttccttgcaaaattagaagatcttcatctcgaaatgaaacctgcttggtttattgtcggagacttcaatctcatttataaagccgcggataaaaataacgaccgtctaaatagaagaatgatgcaacgttttaaaggtctcattgataaattacaagtaaaagaactgcatcttccaggtcgccgttttacctgggtgggagacggatctaacccaactcaaactaaaattgatcgtgctttttcaacctcggattgggacctgcttttccccaatttgtgcctcttcccgctgtcgtcgacttgttctgatcatgcccctattttcttcgttggaaatgaaaagcttagcaaattcccaaacttcaagtttgaatcttactggttgcatgtgcccggtttcttggacgtggtgcaaaattcttggcagaaaacgattcttgccacaaataagcttgccatttttcgtttaaagctccgtcgtttagctcgtgatcttagaagatggagccgctaccaaataggagacatcaagctgcaacttgcaattgcgtccgaagtaattcttcaactcgagattgcacaggaatctagaatcctctctgttgatgaacaaaatctcttgaccaacctcaaatcgaaattcctcggactagctgtgttaaacaagctcaagattagacagagatcgagaatgacttggctcaaagaaggggatgtaaattcgaaatttttccacattaaggcaaattccaggaaaagaaaaaatttcattcacactctacacacccctacaggtatagccatctcggcaaagacaaagaggaagaattatacaggtatttcagagaaagattgggtacaagtttcaaaggacttcaagccttaactggcgtttgctaaacctcccctcccttgatctctctgagcttgaagaagatgtttcagaagaggaactaaaagccacgatttttgctcttccccctgagaaggcgccgggcccggacggtttcatcggagcccttttcaaagttgcatggaatatcatcaaggaggacctgctggcagcgatttcttcgttcttgaaccataacacctctcagctagcagaacttaactcggcttatatttgcctcattccaaagaaagacgatgcccttggcgcagaccactttcgccccattagtctcattcatagttttgctaagatcatcgccaaaatcatggcaaacaggctagctccgcggttaaatgatttggtttctcataaccaaagtgcctttgtccgcaaaagggcgatccatgacaacttcctttatgtccaaaacatggtaaagcttttccacatatcgaaaaagcaatgtcttttcttcaaaatagacatagcaaaagccttcgacacagtaaattggccatatcttttggaggttctcaagcaatatggatttggaaatcgttggctaaattggatttccaaccttttcgcctcatcttcgtcccaggtgctgctaaacggctccccaggccgacaaatcattcacactagaggactccggcagggcgacccgctaccccgatgctttttattctagctatggaaccttttcatcaaattattagagctgcggaatctgccaacgccctaaccccgcttggtataaggaatggccgcttcagatgttctctttatgcggatgacgttgctttgttcgcaattccaaccttggacgacacgacggccctttctcagattgtgaccctctttgcgaaaatctctggcctacacacaaatgtaaacaaaactgaaatcttccctatcagctgcgaaggagtcgacctccagcatgtcattgctagttggccaggacagatcaaaaacttcccatgccactatcttggtctcccacttcattttaggaaattgaggaaagtcgactttctccctttgattaataagattggctcgagattacctggctggaaagggcgttttttcacttcagcaggacgacaaactctggtctcctccgttcttagtgccatgccgactcatcatctaactgcccttcaagctccgaaatgagtttttaaaagaattgaccgtttcaggagatcctttctttggaagggagaagaccctgatcactcgaaccctggagacagtctgataaattggcaaactgtttgtagacaaaaaagtttgggtggggctggtctcttagatttggaaagattttcgagagctcttcgcatacgttggttgtggttaaaatggaaagatgataccaaaccctgggtgggtatggatttgccctgtgatgagatagattggagactgttccaagcagccacgatcatctcggtgggcaatggcgccaaaacaagtttctggcatgacaattggctgcaaaatcaatgcctaaaagatgtgtttccaaactgttttagattagcaaaaaggaaacagagatctgtccaagtcgaattaactaacaacaaatggctgttttcgttcaggcaattcacatcaatagaagagcttcatgatctcattcagcttggaggtttactccaatcagtctcgttctcccaatttccagatgacataagctggaattggacaagttcggggtcgtatacctcaaagagtgcatatctcggtcaatttcaaggttctgttgtttacaatgatttcaactccctctggtcggctccggcggaaccaaaaatgagatttttcggttggttggtgctccatcaaaaaaccctaaccgcacagaatctactccgaagacactagccatgcaattggatttgctgcctttgcacttatgcttttgaagatacaaatcatcttttcaatgaatgcccttttatcaggcgtgtgtggcagctagtgtgcaggtttcaaactatggcgctgatggctcctctcttttcccagatatttcaacctggtgggctaatcttaatttagtgggaagcaagaggcaaagaacgacgatcagaggtatacttttgactgcatggtggaatatttggctagaacgaacagaaaaatctttcaaaactcagcttgttcagaacttgcagtagctcttcagataaagcaggacttagacctgcgtagctcggtttttaagccaccttgatttaatatttttgtaaaaaggtgtaatttcctatctccccaaacctgccatgtaatcttacctctttgctgttttcatctattaaatttccggcagatctcctgccgtcgttttcctcaaaaaaaataaaatattgatgttaatgaatctaaatagatatatatgtctagattcattaacatcaatatgaatgtgagaaatgctagaatgacttacattataaaacggagggagtattggattggttataggtgaattagagctagtagtagactatactattgaacttgctctaatagtctgctattgtaccttctctaaatgattttctttttcgtgtgagggtgtgtgtttgcaagagtaagttcccaacactcccctctcgttttccgcgtgcacgtttttcaatctgttaaatggtgtgttttttgcaaaaaatttctatacaaaagttgttaaaaaaaattatattgatccattttttaaaaaaaaattagctaatatttaattaatcacgtattaatggaccgctctattttcagtgtatgggagatggttgccaacactcacctacctcatctctagtcgttgtggcggcggcaaactccttgtaagccggtcgaatccatctgtaatggggatcgagaaatataaaccctagttctagtctcgttcttgtctcgcggcgcccttaaattttctttagatcttttgctttatcttgttataaattttgcctgtaggttccaggtaggtagccactcagctcaaatctctgaatctctcaggaatccgggagaaattggcccttgcatcctgacagagccgaagcaaagcggtcgccggcggcggtcatggacgacgaccggcgatgcccttccttgggttgcgacctcccgcgcgtcggaatcggtaacgcccggattcagtcattcagttccctgcgattctgttgacggttgctcattcgatttattctggaaattctcaggtatcggttctaggttccgcgtccgttgcgcggtatatttgtgtttcagtgctttctaggtgctcatccttcttgcatgttcatctggttgcaaattcggcacatgaaaaacaaagtaatgcagcaatgcatcagttcaggttgccacggcatacagtgggtgagaatttcttcggttaaacaatagcagtaaattacgaccaagtctaaggactgcatcatctgatttagatattttctctaagatttgggaatgcaatcttgctcatataggcatatacatatgagtagcagaatgcaccctgaagacaataaattagtgctatgggaatatgggactattctgctacacattcctctcaaaattgtaaagaaaggaaaaaatttatcatatggaatactggcgtataaaggttgaaggaactgggaggtgaattacagttacatcattattagcaaatgcagttcaaaagtaaaaggacacggttccttgtccttagatgagaatcactatctgaagcacccaaaacaacagaacaaattacaggtcccgatggataagaaagccaatgtttcaggtagtgctaccaacagctccataactaagaactatgaagagataaatgcagatgcaccaaccaagatcattgcataaggaaaaaagaaacactgcactcctacatgagtagctctggaacatgctgcattttctgcagcatttctctctcaatccagtcagcttt

SEQ ID NO: 66397 - DNA, 6433 bp, Oryza sativa
tgggtagtcgagtgtctgcttggcccattgccctctgataattaacttgtggagttctttggactttggcctgagttcctcaaagcaaagtgcctcattttcattccttgcagagataagcaagctggaaagaagctgcatgtttgacaaggtagcaaaaagctttgcacaatcactataacttatgttgtcaatccatacacgtcttaatttcaacaatttactcaggtgctcagccaagtccttgctggcttgcatggtctcaagagtttgtagttcctccatattggacagatttttgggtgcttgcattcctacgaaatactggaacgtcgactgtgtttcatcagcatatctatcggctatcaggtgccgtagcttcttgaccttagcgattccttttggtagcttctctattttggtttgcttgatgtctaaagtgtggagattagacagcttttcaactgattgtgggagtgtcttgaccttggtgctccgcaagccgatgtaacgtaagttgaacaaattccctatggattctggcacttcagtgatttctgagtcttgaagctcgagaactgtaagatagtttgattctgacaaaattgaggacagcatataagtggagggtgacattgctctcaatgatactagggttcgcagacgtggaaatttaagttttagtacatcattgttttcccatccacaagatgacagacggcgaacatccctttccatttctatcattgtgccataatcatttgaaagccaaatttctcctcttttgctatagaagtgccaggtcgcgcacaagatcatgcatcttacagctactagccctgcctagctcatcattttccacaacatccagcatattcctttggattagttccctaagatatctgtcagccacctcctctggtgtgctatgttgttttcgcactgcaaagctttctgcaacccacagccagatgagggtatctcgtgaaaacagatgatcttcagggaataggctacaatacaagaaacaatttctaagatgtccaggtaagtcacggtagcttagatttagaattgctcgtatatgatcattgttcactagctcgtctccaagttgcttgtacatttcattccaaatataactctctagtttcactgaagaaaacaagccaccaatagatacgattgcaagtggcaggccttcgcacctgtccactatattgtgagccaacttctcaagatcctgtgggcacttgctgtgcatgctgttatagaaggtctttttgcagaagagatcaaatgcatcattgtgctccaatggtttgagtttgagacggtgtgttgggtatgcaagagttgccacatcgtcctgtcttgttgtgatgattatgcgacttgtttggcagcttaggaacgcatcctctatcagagtgtatgcttcccggttccaaacgtcatccaatacaaccagaaattttctatcctttagcctttcctttattatatttttcaagtcacgagggtccaaatctgataaatttgtctgttcagggtacccaattgttggcgtcgtttcgacaacaccaatcttcctaagtaatttcctcagtagatcaaccccattatatgtctgtgacacgacaatccaagaaaaagcatcaaaattgttcttctcccgctcatactcatacacattattgaccagagcggttttgcccaatccacccataccagataccgttatcactgtgttaccttgctcactggagtacaaccattcagtcagcagcttcctgttgccttcaatccccactagataatcttgtgccaggaggcagtcttggaactgtttcctttcaatataagtaagcgggttaggaataaggtcaggctgctgcagccaccgttctttccgcttcccagcattttcaatctttttctctatctggataatctcttccgcaatatcactgaaaactgtgacatatttctttttagtgaatacctttttcatggaactttcttcttccaacataagagcatggtatgaatatttgtccattacatcctgaacatggtgggccaggccccgcacctctacaatccaacccttgacaacctcatcgatgggatgtgttgtactcatcttttttataacattgttcattgtctccagttccttctttatttcatcaacctttgtcggtagttccttcagatttgcaactttttcagatagcttggctatagcagctttggtggcttcctccactaaaactgaaccaatctttgagacagcaaggattacagcctccatgtcagctgaacaaaggtgaatatactgtattacataatgtagtaacaaactaaagtaaactagcacagcccagaggatcgattcatgtaattagcaacaagtttatgaaaagaaaaacctatgttccagtcagttttcagttcatcatgttgagcctatagtttcagttcattccctacatgcttgagttttttattttgatcccctctgttcctactctgttgcgtgagggtagtttcaacaaaaaaaaaattataaattaactcctgataaaacttttctataatgaaccataagcatgaatagaatggcactgcaagatttggcgctgtgttccttattttgtgggattttagtggctgcatcgaccaggctgcttatatggagtgcgattctatgaacatacagccaaatggcatgtggcactgttcaaaagggtccatttctttaatgtttttttcctacaggtctataagtagaaaatactagctgaaaccccgcgcattgctgcgggaatttagtatgataaaaataaaaaaaataacgtgtaagatagctagataatatcagattaagtaaattaatgtggtttatgataatttaaatttaaatagtatgtagaatggtgattcaaacgtaaaaagtaaggtggtatgactttatggaagaagaaaagtagggagatagtttagaccgtagattaattatttaaaggctaaaaacaattgatgtgatatgacttaattagaggaaaaagggagaaagataatttggaccatagattaatcatttaagcactaactaagtgaggatgaaccatataagtatagaggatatcataaaatataataaagatatatattgaaacattatgtgaatcatgttggatgataatttcacatatttgtatttgaaaaactcttaaattataaaaactataaagatatagcatgtttgcatgatgtttaaatgtgatgattgttagtggatgatgatgcgacatctttgtatgttaagcttaaagagttagtgggggataactttatattaagatagaattaggaaacgggctcaattgtgaagactccactgagaactgtttagtttacagtatctgcatcacttactgtcacggatggttttgcgtttttatgtgccatttattcacagttttcattttctttgttacgctgcgaggcctagctactacgtcccagtcttccaggcttgatggtccttggcaatcacctatgctttctttggcagatgacttattctggtgtactcaatgctttcagtcttttcatctttctacaagggaattgttttgcaagctgttctttagaaactacttatgtttcatattataagatgttttagattttgaatatattcatatatggattcatgcttgtgttttatatataactaggaaggtggcccacgtatatgcgtgagcgtttatatttgaaaggtattccctccattaaataatgtaagccataaccaccattaactctaaaaaccaagaaacaattattatcatctcattgtttgaatcatcttaataaattcagtgcatgcacccaatagaattcgagattttgagaatgaaagtgttaaaaaaatataataatttagtggagaagaggtgctagttaattgcatgcatgcatgcatgccttatattttgaaacatgtaagaaaaatagttatgccttatattttgcaatagaggaagtaagattatagtttgttcaaaaattgtcttatggatagggaactaaagatcaaacaatgtccttttaaaatgatttagggattctatttttttagaaaaaatatatctcaaaaaagcattcatcgactctttgaatagaacatagattaagtttatacgacttttgcatcaaagtaaatattaaactattgtaactaattatcatgcatatcatttgtacacatactgacataccgtgcaaatatggctacaagcaaaaattgcgagatctaagagttgaatcgcctcgtgaaggcacatgacaaacaaattaagggtaaattagaagttggatttttttttctctatatataagttcaaaaatttcatattttctccatagttctgaagaactttaaagggtgttgctgcacacaaatcacctacacaatcgctttgcttggtagtgcaaaatatcaacattgtttgaagctaatttcttttgttttcacaagtttgatggttttatttgaaacaatatttgtttgaaataagaccataattatataaatttaattagtatggatagtttacttataaattttgaagtgttttatagtgaaacttatttctatcatgtagtctgcatatataaaaaatatagttttgttcaataagttcaatacaattttcatcagaaaaattaaaaatattttaaaaccatccatgactacttaaaaaattttgtttgtctattttttaaaaaaaaattcaaataagcacatattctccttcttatcgatgtcttgtctttatcataatcaaagaaaaactccttgtacaactgacatatcatgccatcactcaatcacatacagatgtaagctgtttgtcattattctcggtccacttattacttggttgtatccttcactcacccatcatcttaaacagtcgtaagaccatattttatctaatttatctacttattagtttatataaggggtaacaactaggggtgaaaacggtaacggtaattaccggccgaccggcgttcgttttcgactttctaccggccgagccatatggaaatggtaatcgaccgaaacaaaaatggaaatggtaaaaaatatggaaatgaaaacggaaatggttttgctgttataccgatcgtttccgtatttaccgtattctcgcggaaattaccgtttcttataatatggtaattaccgtattctaaatatgtcgatattataggacatgtctatacgtgacccacagcttatagattgactgactcttcaataaaatctctaacttttgtacatggctaaaataaagttaatttataatttatatagtataagcttgaatttatgtatatatatataacatacttatgtaaagttaaatatatgtttttatagtttaatgtttccgtatttgttaccggtttccgatctgtaccgacatgtttccgtccgtattgttccgtttctggttttccgatatttccgatatcgttttcgtttccgactttaccgtttccgattttgtttccgagaaaaatatggttacggaaatggttgaggctgtttttcgatcgtttccgaccgttttcatccctagtaacaacaacacgttgcttctccctcgtgcataagacacatggtctaattttttttcgccaaaacaagttcttagttaacacatgtaatgtaattagaatattatctgtgtaatatatatgtatatgacatagggtaatttttgttctagctttaccctgtttatatacatataaatataaattaattatatataactcgcggtgcttgactcttctctctacatcacatcttcgatttgtttttatgttattaaaaaaacaataattatccattgatgatttgatgtcttcacattgcagcgtcgtgatcacccaagctactttaggtacggtgccttgtcatgcgtgcataaggcaaatacgcgcacgtgtgttgtgctgagaaaaatagagaggtcttccgaggtttttgttttcttaacaaaagatatatatggttgtccaaaaataataggttcaccggtttaaaaaaaaatgatagacaaataaaaatatttataataagttaataatagatatatgtgtacaaatcatatgaatgttagtgattctaacaagggatggaggggccaaaacgttttataacgtgaaatagatggagtatttcactaagtctattatttgtaacaccacctgaatagaatggcttccattttacctgtcaactgttttctcacatcggtaaatgtatgaaacagtttggcatttatctttagagtaaagttgtctaatagtccctccgtttcatgttataagacattttgac

SEQ ID NO: 66398 - DNA, 6206 bp, Oryza sativa
  unsure (1)..(6206): unsure at all n locations
ttagagtagtttggctttgcccaaagtcaaaatgtcttataccctgaaacggagagagtaaatgccattaccgatggattcagaaccttatatatctataccaagctgtgttatgatatttggttttactacatacttctgcaatgccaaaaagttgtgttgtatctagcatgcatatggtttagcactggtgtagatctgttgtataggcagggtcatggttgatttgttatgagatgcacttgataatgtagtggtaaggggtgcgtggttttaatcccaaggtcccatgttcaatcccaacacgctcacaatttattcttataataaaaactagcatggtggcccacgcagattgcgcggttagcatcattatgttttctcccatataatagcatatatgttttctcattatattattcaaatatattaaaatgacaacataattttaaattttgcaataactttacaaaactagtaatacgtaatattcaaaatatattttaaaaacgtggtaggtattaaatatttttaatatccaattttaggtatttggtaaataaaaaaatttctaaaaggactttagactcggggttttaaaattttttttttttaatccggaatttttggtaaatggaatttcaaaacctcaaggttcttctccaatattatttaattttaatttcggaattttaataattccaaatggaattccaatcgggcctctaaactcatcttccaatattctttaatttttaatttcgaatttcagttacttctaaattgtattcctatagtgactttaaactcttcttcccatgtttttcttaatttcaaattttagttatttataaattgtatttttatactgactctaaactctacttttaattttattatgtttattccaaattttagttagttttaaattcctatatggactctatactcaacttctaatattccttatttttttatttcgaatttctatttttttttcttcattgaatttctatatggactctatactctacttctaatattccttatttttaattccgaatttcagtatatggactctatactctacttctaatattccttattttgaattccgaatttcagttatttcataattggatttctatatggactctatactctacttctaatattccttatttttaattccgaatttcagttatttcctaattgtatttctatatggactatatactctacttctaatattccttatttttaattccgaatttcagttatttatttcctaattgtatttctatatatggactctagtctcatcttctaatattccttattttttaattccgaatttcaactatttctaaattgtatttctatatggactctagtctcctcttctaagattccatattttttaattccgaatttcagctatttctaaattgtatttctatatggactctgttttttctttttccctaattaatgtgagaatttatagaccatgagagcaaacatggaggcttctttttctattcctttaataatataatagatgtttgcccttcaaatctcgtttatctggttgacttgttactgtttctttatttggtcctagttgtttttgtcttccttttgtaatccatattaattctgtacagccgctatagtagcactggatcttttgtaaagcaacatttcaactatatcgcanattgattggccattagaaaatttcgttgggctactcatctttcatgctttgttcttggtgaaatgattggtaatagtttccacgggccattcaatttagcttaagatgtccttgcagtagatggccaacaataagataataaatgataaaaatacgggaaacatgtaattaacacacagtatttaaggtgatgcactgcanacaacagtaatcgctaaatgttgcagttgaatcagcactgaacaaaacaacaacacaaaggttctttccccatctctgaactgaaaaactgaccgtggaacttttgcactgtcatattggtgattttatacgatgatctaatgctagctcacctgctggaagatttgtaggccgactacaaaagggaggttggagaacttgcgcccaactgttggtggttggtgtgccgaaccctgcagcatgaaggaagaaacgatgagaacacatgcaagacagctgatcaattgatcatggcgttgggcaaagggtccaagaccacacacttaaccagggttcacaattccaacaaaaaccggtcgaattccgtgaaaaaacgaggttttgacaaatttacagtaggaaagaaaagaataacgaattcaaaaaaagaaaacactttcctgggccggattctatataataggcaagttagtacttcgcccaaataacagaggagaggggatgtggtcctggcgtcctgcatctgatcgctcccaaaaaaaacatcgagcagaagggtgaggcgaggccgccgtcttcccagcggcgtcgcatctcctttgccccccaccggatccggccgtccgccgtcccccccccccccccaccggatcccgcgatcctcccccgaagccgtcgtcggagagccattttccggccggaaaattcaatgtgaaaaccctagattggtatgtgctccatttacttttgattttgttggccacttatgctagctagtgggaatttcaccaaagccgaccgattttcgcgagcttatcagtaaactaaggaaatttgttttcaaattttgattatgaaatttattcggaatctactgcattccacctgattttgcgaaaaccgtcgttccgcccgagcttgaaacggaaggtcattttagaatcgtaaaccctgcgctcaacaaacaccacatgcacgttctctacgcatgatttatgcatatgtagttagaaagttggaccccaccagcaagattaaatctcctccaaaatttgtggattttttcaaatatttgtgaatttattaaaattcatttaaattcagtcaaaatatgttaaatttcaaaataattcggtcagaaaatgccgaaatccacgattttttcaaaatttcggcaaccacaaaattttggtgcataccgaaattagaaacactgctcaggggcgagatcctgggtatggcaatctagcgatccgatctcatgatgctaggtccgttagccggctgcctcactccgtcggtcgcatccgcgcctcgctgccggccgcggcggctgcaaatctgcaactgcaaagtaatccctccgtttcaaaatatttgacacttttgactttttaccacatgtttgaccgttcgtcttattaaaataatttatgaaatatgtaaaactatatgtgtacatgaaattatatttaacaatgaatcaaatgatatgaaaagaataaataattacttaaattttttgaataagacaaatggtcaaacacatacttaaaaagtcaacggtgtcaaatattttgaaacggagggagtaacatttacgctgatggtcactgctcgtcggctgaagtgcttatctgctgcgtctgcatgtgaaaggagaaggcgatcagcaactacgtacaccagataccaccacgttcccatccttgctaattgcccaagttttgttggttttctctctcctgatttgagctcagaggttgcgcttggagccttggaccaagctgtgcgcctcgtgttgctgacctagagcaattccaactgactcttcaaaccaaaatttcgtaaacttaggaaaaagaacgtgctccaatagatttgccatccaaggctgtgtttagtttacaccaaaattaaaattttggttgaaattgaaacgatgtgacggaaaagttagaagtttgtgtgtgtagaaaagttttgatgtaatggaaaagttgaaagtttaaagaaaaacttttgaactaaatacggcgcaacttgccaagccaaataggtagccaaaagtttcacttggctggccatatctagcaagttgaaaccacatgcctaccatgggtcccaccaccccaccttctctacccatctccatccctctcaagccgcttcctccaccgcacgagtgcacgctgtcattggtcgtcgcgcctccacctcccccaccgtcgttggggagtggtgcacgcccacaatcaattaattggtcagatttatagttttacagctttgtaatttatgagctcaagagctagtaatatatttttctcaattattagttcgtccttgatattatgttgtctagaaagtacgtatcgggaaagaaaaaggtggatgatttaataaaatgactgaaagggcccaatggacaaattcttaaagtaatattagaaagtttttcttgcaattcaattgcttactggtaacaagcatttatatatatatatatatatatatatatatatagagagagagagagagagagagagagatattatttagatgtgatttgtgggccctatttttagtttcactaggccacccaaatctcaagaccgggtgcgccggcgcgcgtgggcgtgccccggcgttggagcattacgacaagcacctcgcgggcgacgcagtagggacagacggtgctcgtcacagagctgaggcgagcgagatgggtggatgaaattgcaaatcacatacacaattcaccgccaccaaagatccaaccccaaacgaacaggacaatttaccagcgactattcatgctcaaacgctaaaactaagaacgaaatctcctacgaaatcaggatcaaacccaagtgcgcgagacgaagaacaggacctaccgtcccagaagagcaagctgaaacatgcatgacatccgcctaactacaacaccatggatttgcaaacgagaacatggacgcaccttgtgaactcgatgatgagagaggaggagacgaccttgactcgactccgccggaggcccgagcggagagaggagacagaagtagaacgaagctttgctttctctcctttttatggcttttacgggtcaagtagaaccaagtcaaccatcgactctggcggccaagtcaatagctactagtgccaagtggccagtggagcacgtacgtgcagtaggattattcctcatgaccatgatggcactagtaaattaatcattgataaaaaaaaatggatcatgttgaacatgtaactatttaaaattttgaataatggtacgattaattaatttgttctctatggtaggaactctgcatattcatttattcaagagagggattataggcccaaaaataaagttacaacaatgaggtagtttttgggacacttggtgagaacaaattgagcgacaagaccataaaatcgacaccaggctattgcaaaatgatttacactctatggcaggcttagggcctgtttagggaagcttaaaattatgaaaagccttctcagaatctggaaaaagctggattttccaggttctggctttttgtttattttctagattctacaactacaacttcttagaatctaatctaaaagctggactgtttttgagcttatgattctgggtgaagctgctgtagctagaaacttccctaaacaagcccttgattggtttgtgtatagatatttgtaagattgaatcacttgaactaagtttaccagagagggtaaatggtatgattaccaaaaaccaaaacttttagcagaattaaagattaccctggtgtgtttgctccagtctgactgtgccggaacttccgaatctgaccagtgtagatcctccggtccaaccgtctagcttctatcgccgttgtctgatgccgccggttcaaccgccttagctccgatgatctgaccgccaggtagccaccattctgaccgttgtgctcttgccagctgtgtggccatcgagcccgagaaaaacacaaattaaagaactctctgaaaatatatcaaatttatatttttaattgtggtatcaaaatgcagcaacaacattcttctctcaacttttgactaaactcaaaatctaagctaaaccctaagttttctctcaacacatctcttacaaaatcaattccgagacaactcaactcctcttctatttatacctagaggtggctgcccaaaagccacaaatccaactcatgcaaatagtcctaatccactagggtatgtttgagaggagaggatt

SEQ ID NO: 66399 - DNA, 935 bp, Oryza sativa
ttcaccaatcacgcatattgttctttaacctaaggatcccgcacactactggagaagtgatctttgtcgggttagccaaaaaccacattagtcccggtttgaataggaaccgggactaaaaatcattttttgtcccggtttagaacttcaatgatttttagttccgggactaaagatcatatatttaatcccagttgtttatatcaaccgggagaaaagatcaaaaaaacgcgcgcgccagagcaatctagaaaaattgaggagaggatgcgcgcgggggaggatactcgcacggttatagagggaaaaaaaatctatctcctccttatcttcttctcctctcctctcctctcctcttcttatcttcttctcctctcctctcctctcccttccagccctctcctccccctcctcccctcctccctctctgcccgagcccggctcggccggcaccctcctccctctctgcctctccagatctatgtgatgagatgtgttgattaattttccgatctgtgcgatgtgtggagtggataattttgttgtaaattttgtagatgtttttgtgattttgtgaatgatttgtgattctgtgttgaatgtgtgattcaatatgtgttgagaatgaactatgtttatgttgttgtgaatgattttgagaatgaaactatatgttgttgtgaagatttaggatgaactatgctgtaaatgatttgggatgaatttttgtaatgatttgaatataatggggggggggcggggggcgagatatggaaaaaagaaaaaaaaaatctttgtccaaccgggaataaagatctatcttttgtcctggttatttcaaccgggactaaaggtagccatctttaatcccgaatttgccatcccggttgcatacccggcacaataagagcttcccaaccggcggcaaagatcac

SEQ ID NO: 66400 - DNA, 2657 bp, Oryza sativa
cctcgacgatgacctcgaatggcgaagccaggcagtaccggttgaggcagcctcgcggctgtcaaggaggatcgacgccggcagcgtgcgcaagtggatctggccgtcgtggcgatggttcctgtcctcctcgtcgccgatggcacccctgtgtgcatcctcacccggaccttctccgatgatctagccctcgagcttctgccgccgccgctaccagccgccggccccaagctccagccgcgtccctcggcctcccacacgagctcctcctcctctgagcagccaacacgcaggcctcaccggaagctttcttctctgtgtacaacaaaaggctgatgattttgggaatttttggggaatgctacaatactaaaaaacttgggctaaaattactggaagtagatgttatcatgaacttcatttggtgaatttttgagatttttctcatgtatagttttccaatgaaaattcaaaaatcttggtttgcatatacattatacatcgaagggcaaaatagtctttgcacagtatctaactgagtacaagtgacagagtagtgacggtgatggcatttctgggacaaaatgactcgtacgatggcatttcctggaagttgcgttcgtcgatggcatttcttggattagggtgcttgtgaatggcatttcatggattttctctttaaaatgttgtttttctttttgtttttgtttgtagatggccggcagcgtcacccgtcgtggcttggacatgactggcttcatcttggagctgcggggcatgtgcgtggtcctggggtatccacatggagtggactaccaggccaggccgctcccggagcaggagggtgacgatgcagagccccacgctgcttgggaggttactgcagtgatcctctctggctctcccgagcggacttcgctggcagtcaccgcgggtggagattctttccccgccgcttgccagaacgccgctctcctcgccatcggcacccttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccatcagatggtgcgccgtgggatggtcgagaacaacttgaagatcctggagctgcgtcaggagaacctgcagctcaagaaggacctagacgcggtggaggcgcagctgcatcagctcaagatcgcccagggagaggtctgctgccccaagcgtcgccgcgtctgccgcagccagaagatcaccgcccgcaagagcacctccaggcccgagcttgttcgtcagtccctggcgtggacctgcttcgtcgagacccctcgtgccgagcccgcgcccgtggttccccaggagggggaagcctccggcgttggtagcacggaggatgcgctgttgctcaccttccgtcctggcccgtcgcagcggtagacgagcagttagtaggctggcgcgtgtgttctttctcgtttgtcttcttgttgggttgtgtggggcatggttatgccggtgtgtggcataactgtgtcggagcctgtctttattttatttgcctaagcaacttgaactttaatgaacccatttaatagcagtaataaattcaagaattatggtagtcgtgggtggttagttttaattgttagctctctctgtttgctggtctgtgtggggttttcagatggtgatgaccaggagaaatgctgccaccggtgatggcaaccaacctgaaggcagcaaccacaaccaccagggcaacccacctccacctcctcctccgcctccaccaccaccacccgataccaacgccattctcacccaaatcctcgcccagcaggccaacatgatgacggctttcctccaccacctccaaaatccgccacaacagaatgctccaccaccacccccacaacactctaaactcgccgagttcctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggcccggttcaccgccgctttccggaggacccatgtgcccgccggagtcgtagcccttaagaaaagagaattccgagagttgaagcaaggcaaccgctccgtgatggagtatttgcatgagttcaacaacctggcccgttacgctccggaggatgtgcgggaagatgaggagaagcaagaaaagttcttggcgggaatggaccctgagctgtccgtccgtctagtctccggggactatccggatttccaacgtctggtggacaagagcatccgcttggaagccaagcacaaggaactggagtcgcacaagcgccgcttggcaaatttccgcaatcaacagggtgctaaccaaagggtccgctacaccaatccctatccagggggatcctcttgccagcagcaacaacagcagcagcaacctcgctccg

SEQ ID NO: 66401 - DNA, 11854 bp, Oryza sativa
ccggttaattaagataaagctccaatttattgagggattaaatgataattcttggagggtatctttttaattaaaaataataagtaaaaaaactgccgacagggaaacaaacttgggtggtgaggttcaattcccaaactccagttaaaaaatttgagagaaagtgtgagttctttcattagattgtatctatatctaacatactatgctgttgggaagtgcttgggtcagtaaaagaaacattattatacacaagcgatgtaatagcaattcaaaatctgcttgtttacatcaatttgagtatcgatttactgtttagtacttaactataatataaccctttgcttgtctgagacattaattttgtggaacgaatgaatttgttgtgggggggtcacaacaaaattaataaatgaatcagccaggtactgaatgataaaactagtattagataagcatgtaatatttcttggaacatggttgcatttataaaataaaaggaaaagtatattttacttccctaaattatttggctgaagcagttaatcctaagcaattttaagttcgctctattccctgaactactaaaactggctagcttaactctctcgttgctttgtcgtttttgtttgtccttacacaagatgtgttttaaactgaaattgtgtgagatgatatgctcgctcagggtcaaatttcagaacaaatttcccaatattttctagcaaagagactagttagtgatccctcctctcaacaaggcgaaattcacgaaagaaaaaggcagaattttccagcagacataatcagaaaagttaaagctgatgacagctacaaactagctagatgatacaaagcaagatccagtggaaatcaatctaacctgagctgcagacgatcagagcgtctagaagagcagagctggcgagacgatcagagcatgtgaggtttaagataggcaacgaagaaaatataaagcacaaagccactagcctcaaatctcaatcagatccttgtctgtttctctgaactagccgccgacgacttgacgcgaagtcgacgcggctaagcatttgcagtgccaattatcaactggccaagttgtgcgtgtaggacgggagtccgctgtggaagcttcctttttcctgatctcaaaatttatagtataccctccaaaccgcatgcagtgggggatgctggattctttttaaatggaccagaaactcgagaaattattgctcaatagattattttgcctatagtaaaaaggaaaagaaaaagtaaatcagaattgttcatatcgaaaggaatagaatatctgtagtccagtatgcaaattagaaaagatacagttttgattagtttactgtcctgcagccagctcactggtcaggctgttcgctgcatcttggacatatactcgctttgcccaaaatataagggattttggacggatgagatatttttttagtacaaggaatctggacatgtactagtaagtgttgcatctgtttaaaatcctttatatttaggtacgaatggagtaggaagaaacatattgttatatttgaggatggagggagtaggaagaaacataccgtgtcaccttaacagtccttgtacttatgactcagttgttgaggacctagttagctagtcggcaactgcaaaaatataattccagtctccttattctactcactaatgacagcttagagaaagctaacaaactgatttcttatgttttcatccaactaaaacggccggagacctccaagtcgtcttagtataaaaatctctcaagtcaagtttcctcgatttcttggtcgtcgtcttcgtccaccttttggtatgctcgattttttaaaaaaaattatgactctttttgtaaaacttatttcataaatagaccctccaaaaatctaattatggatatggactctactcggtgccggtgagcttggcatcgaggtttcatgcacccacgctggagaccttggcatcgagttagagggggagggggagagagtgtcgatgttgtagatcacgactatggtatttgcaaagtttggggatcattcgtaccagggtataagcgagactaaggtaaaatagacggagacaaggattttcatgtaggttcaggctccttatttaacaggtaatagccctactcctgctaattgaaaccagtgttgctcttattcatcagaatcacacaagtacaatatttgggataactctaatcatcgtcaacacggcggcatgaaccaccacacgttgtcgacaacagggtagtcctcctcctctaatatgaactgggcgatatcagagatagcgctagatccctcttgttagcctctgtggcaccagattggatctgtttaggtttatctcttatgttgatgtctggcggcatgtattgatgtatattctgactgttgcctgtctatttagactcggcttgtcttggtccgtctccccctcttcttttaggggtcttgtatttataaccatagatgtccccttatccaaatagaactagaaagataaatatggatacgatccgaatagtccttgtagtttccatatagaactctgcttctccttccttatctggaataccttccatatgcaagatttgatttcatataagacttggtatatggtgggtcccgttgagcttaacccaacactattgggtatgccttacccataaaactgacagggggtaggcgccatgcttcttggtgcggacaccgagttgtcccgagatggcatgggatggcatgagtgtacagcgagcaccaagagtctgagacaccatggaatggcacgtgtttggcaacttttttgacaagtagacaaacacgatcgagacacctaaacgccttgcggtgattgtagtgtcgccaaccacctcaatctagcaaaagctagaccaagatgggttttgataaactaaaccggctagcggagccgatttagatagaacaatagataactatccgtctcgtgggtaaacggaaggtttacgggacaaacctacaaaggatttcgcactctcgtagtgaagacagacgatttatggcacaaatcgacaaagatggatgaactagactagaactagattgaaatattgaaaaagcgatttaattggctaagttggattgtgtgtagattgtatgctcaattgaaccggccttgtcccttatataggggttgatcttgcctcctacaggtcctcctccacgtcgaactcgggatagaattcaaaggaaacccgaaatatagcctcctgagtaaggaatcctgagacatgacgaaaacagactcgggcttggactctgctggtctgaccggccacatgccgccggacagaccggccctcaagcagcggtctgaccgaccaacaaacgacggtcagaccggccctatggaggaaaccggcggttttcccaaatcttagcaattttccttaatttgaacagacaaacgatgatgatgagcatggcccacctcaaccctccctcttctccatttcaatccctgcctttttatcagttgattctatcttatttttcctctatgtagctcctaatgttactacttcctctatttcatactacaagactttctagcattgctcgcatataagatagaatatactacaagacttttttttcttaacggcaacatatcctatgcacacaggccctcacgtgtacacacgtgcacaccaactaaaaaatgtcaccaaaaaatttagaaaaaatcatacacatactttcaattgtattacacctagggttaaaatcttaacgtcaaattcattatattttagccgtaacaaaaaaaacaaaaaatctgacagttttaaggttgcaattttgtcagaattttatcttttttgttattctctatatagaatgaatttgaagatgcgactttgcacgttgatgtaatactattgaaagtacatgtatgaattttcctagaattttttgtgataatttttagttggtgtacacggtgtgtacacgcgaatatatatatatatatgtgtgtgtgtgtgtgttaatgaatctagacatatatatatgtgtttagatttattaacatctatataaatgtgagtaatgctaaaaagtcttataatataaaacagagtgagtaatattttttttctatggaaatcttgaatacccatcccgaaaatcatgtctctgtcactaatagggctagtggcatttggccaagcgttggtcgggttggtatgtgcaggagttactagcacgtgtggtggaggttttttttttctttttccttgataataatttcgtagggttataatcttttgtactttttcccagctttatcaatatgaaatttcacaccatcttatcttatgtgtgggccattttggaaaaaaaaaactgagctgcaattgtatcgctttcagtaacaccagaccacgcgatcatttttaccgtgactcggtggttgatgacctatagcttagctagttggcacaactgtagatccgattgctccatacaatccgtctgcttattctaatcactactggtagctaatggaacgtaaaacgaggaagtcattgccattttgattaattaaattttaattattttaaacttaaaaatggatttatttgatattttaaaacaacttgtatataacaagttttcacacgaaatataccatttaactgtttgaaaagcatgctaacgaaaaccaaggtaaaatctgtataatcaaagttagaacggggttagagaaaagccaataaaacggccgtggacctgaaaagtttcattagaatacacctctcaagtcagtctcctctgcatcctggtcgtcgccttcgtctacctctcgcctcgccgtcgccggaagaggagctaaccggctggagatcgattgatccaacatgagtgacaatcctccaggtatgtgcatgctacaagcttaaccaatcatccataggcgaactatttcacgtttgaataacatattttctgtaaattttcttactttgtgggtgttgttcatatgcaggctacttcgttggtcgcccattgaaccatgaagaacagcaagcttcacggccggctgaggaacagaacgctcaattccctggtaggtatacaggattaattagttttctgcatacatcaatttgcttagttttctgcatacatcaatttgccggatatgatgtagcagatcttgttataacttgaggttgataagtgctttgaaaagggttcttaattttcagtcttctatgcattcttctattacctcaggctgttttgtttgctatgtcctatgatagttttcaacttttcaaatttcaaatccttataaagattaagagaaatctttatcttctgattttccttttctactactaaggctactacaatggcaatccggtcagaccaaatgatgctaagggtgcacagaggaatgaaccgggcttctttaagaaactgtaagctgcaattcgtgtacagaatatcagatgcttctgtctgtagttacccattgatttgtttttctctttgcatgatgcattggctcattgaatctctgcagcttcgggtgcttcactggcggtcaaaatgtgaactagatcaacacggctgtattcgcaatgttaatcgacagttcatcaagaaatcagtggaattttgatggagaagttatcattttaggaaatacaagttttgtttcttccaaagtttttcttttcctgcagttacactgttgtgaattgtacaatcatatcccaagcaaatgagattattccgcgttatccattagtattttgcttacctgtttggatctatcaatttactatattgctactggtctcattaaaaggattgttttatccaagtcgtctttgtcaaggaaaaggtccacatgaatatgaaaactttgaactttctcttggatggttcagaaattttttttgactcaatcgcctattaattacaacgaacaatcatttgtcattttcaacgaaaaagaataataatgtttgcaaacgagagcagcgatcaatgagatgactttgacaattgaccgacttatttgcaactgcaagtcttcaagcaattgaaccaaactgtcatggattttaatttttcagcgtttgctttgagatgaaaatgactataaattaactggaaaagttctaagactcttcgctgacaaggattgataggtattctggtatttggcatgcttgtggtcttcattaattaatcctggttcagggtaaataaacttggacaataatcaattattatactcattcaaatcaaggcctggtttaattcctaactttttgttcaaacttccaacttttccatcacatcaaaacttttctacgcacacaaactttcaacttttccatcacatcgttccaatttcaatcaaacttctaattttgacgtgaacaaacacaccccaaattacacttagaatcttatattcgccaccagtccatactatactaatcaagtagacacctttactttcatctaatttccaagactaacagccaatgcatcaaccttatggactatcatattgaaacattttatatcatgttccttttgcaatacttatttacaaatacaatcctatgaaacttaattgtaggaatgaaccccaatctcagtcacagccaagcccaagcttaggagtgaactccaacatcttagcaccaacaagcaggtcacttagttactactccctccgtcctaaaatgtaagatttttagctatgaatttggacacgtatgtgtccagattcatagctaaaaattgctatattttgggacggaggtagtatattaatcttgcttctagcatggtgccattggtcaactccaaggatttttgtgctgagatgttagaagttttagggtccatttgtgcgatcagtttttaagggtttgttcttaaaataagtattgaaaaagaacacaaatgtgtaaaatcttcaggggctacttaaaagaaaaagctttttgcagacagtcaaaagtgatttacacaagtggccagccattatgtctacaatttaaggcctgcgaaaatcatgcatctttcacattgattgatattctgtcttcaaaagcatcatacatttatcattgatatgtaggtttatgattcatcagacctatatatcagtaataaagtcacatgcctttcaatgtagaagaggccgatctctttcacttgcagccaaactaacacggcccaaatatctgtaagacaatgaagttttccctgtcatgacaacttacaagatccagagtatctgtcctaactaaaacggttgccagtacggtgaaaataaaaaaaacaaacagtggatgatttgatattctcattgcatgccatgtttgcaatttcgtggaaagaaataacaaatagtggatgctttgatattctctatctcatgccatgtttgcaaattcctgatactctagttactgagctggtcttcgagtagtagtggtcgctggttggtgatgccacttgagcaacgacttgggttttaggtcgtcgcggccgaaaaaaatatcaatctctgcgcgaatcattggcgtaggccagcctgggagagaggaaggaagcatcttcctgtgcctctccttaccctcttcgtcttcttctccatctccttgtgtgctcagtagcttctcctcctacgaaaccaaccagctgccgccggtgaccgtcgatccgtcgaccgccgccgccatgagcagcgatgttcctggtacgtgtcactcactcacaagctttctcttctcttcttttttttttgtttgtatcaatcaatcatgctaaagcctaaaggaattcttgcttctttatatcagtctaagaatttttcggtgtgtgtgtacgtttgttgcagggtacttcgtggggcggccgatgaaccaagcggagcctgcgaaagaacagcagcagggcgccgacgagcagcggcctgctaccaacgcgcagatccctggtggtacgtccaacggtgcaaactcgatttgatgatcaaattttggccgcaaaagaatcggttttgcccgatgttttgctgaactttgcttcgttttcgttttatgtaatcgttttgggacacaaaaatgagtcgattttgtccggttggtttgctaaatttttgcttcgttttcattttttgggggggagaagactacttcgtcgggcgtccggcaaacccgcagcagccgccgtcgcaacctccgcgggcgcaggagagatcgagcttcttggccaaatggtactccaatttgttcttcgaaaatcgaacaacaattgtttagattgtattagatttcatatcgatttgtcactctgatgctttgctcttgctgatttctctgtttcgtttctgcagctgcccatgcctcgacagccgagctgagggatagacgaacaagtgcggcggcgggcgtgaccgtaaattcgatgggaaaattgaagcaaatttgcttggagtgataaggctcggatctgtgtttgtgttgcaagttttgctaatagatgtttgtaactgaaggttgcttctattcatttgtataccaattgttcattcgtatcatcagagtgcgaattcgatgaaattgtccattccaatccggcatgccttttctccttccttgaaatgaatattctgctccattgctggcaaatgtcaagaatgagtttgttgttttattcagtactgatgttgattgcatggttatcccgaatttgtttcccttttttttgtgaaaataaatccaaatctttaagttcatctttgataaaaaaaattctttctttgctagaaaatatatatattgttttagtcaattttgcaacttgcgtgcatatgtttttgccacagctctccacagtacatgtacgaagcaacttgatgaactaatattgtaccaattaagaaagcgaaaatcattcccagcaaaataaaagaaagagaactatgttcggattccagcggaaaatagtttaatagtgctagaattactccatggggattatttttgatgatttatttgacagctgaatgtgagtgttaacctaatgtttgattcccccaatcttgtctgcaggatgcgagaccacttttttttttgaatgaaatgatgagacgatttgtggctttaaaatatcgtatttgttttgttggacaacctagcaaccaatcattttctgctcacttggtagcgaattttttttacttgtttgatcagaatcatagttgtatcacatggaatttgtagttctacttagaaaaaatgcccgtgcgttgcaacgggaagaaaatatgagaaaattaaggagaagttgaaaaagatttacattatgtaattaacttaaatacaaatttcctgaaatagttgatattttttaagtaggtatgtgtttaaattaatttaaaagtaaattaagtgtggaaatacaatgatatggctggatttaatttttatgaagttctccatgattaattacgctctctagaattttcttgaaattttcagagcttagttgcgaattttaataatacaaacatcatttcagcatttatttaaaaaaatctaaataaaaaccctcctttctctttgggccattttcagcccgtttccttcctcagcccacagccagccgacccacttttctcccttctcctcccctccgcctcggcccgcaagtacgcatccggcccggcaaggcactacaagtctaatcatcctccccactcctttcccagtcacgtgggcacgtggtccggtgctacagggttgtctcctacctctgtctatattgtcgcatctgcccgacgacgcctgaatccacctcctccgtaaaatccggtcacatccttggagataatctgaaattaactgagaggttttgatacttatcttctcctctttccgttttcccaagaatcaaagcaaaaccacgtcgtataaatgtcggaagcgaaaccctagttttttttagtctaggcccatttctcttaaaaaaaaactgcgcaagcattcgcgagaggggggaggaattggaccatatggataaaaaaaagtgtgacgaaaggaaaaatacgaattttttaattagttaagatactaatgaattttaaggtaatacaatagttagtgcataattgtcaagaggcaaattatatgtatataaagaaaattatattatataaaagttgggtggtaaacgccctgagggaaaaaattcatgaaaccatccgtcccaaaataaatcaatatagggttgtatgtgatattatttagtataataaatctggatatatattatattggtttattataagacgaaatgagtagcgttgtaagtatcgagtactaatccctctcttgggtaaagggacacgcagagctaccaaacgaacatactctgtttttaatagacgatgatgtttgatttttaacacaaaactttatatatttttcttattaaaaaatttgtgcaaatacattatacttaaagtatttttagtgataaaataacccacaataaaataaattataattatgtaatctttttaataagatgaatgatctaatatgtattaaaagctaacggtgccgtctattaaaagatgatgaacgtagtatattaccattcgaatttatttaagttttgcatgctccgtatgctccaactattttcttttttttaaaaaataatcaatcatcaatgtaaaagtgccatccttgtcactaggaattctctatatacccgtagcttttaactatttgccatttttagatttgacaaataactatttgtcacccctatctcaatgacatgtgggtccacatgtgtctatgacatatagatctagtggcaaaaagttaattgccacatccaaaagtggcaaatggttaaatatctccggaaatggcgccaactgaacgtgctccactggccggtgtggatggttgacttagtcagcgcactggtagcgaactatagtagtagcgattagcgatggaatggcagcgttgacttgacaaataaaaaagtgagaaaaaccaagctgcagcttgcagccagctagctcattccgtctcttctctttagctcaccctcacacctcgcccatagagtcaaaggtcgtcgcctcctctcccatcagcgagccgctccattgcgagctcatcaaccaattaatccagatacgtgatgatccatgccttcgcttgcaaatcgatttgtgctttagttaagcggacttctgcccaacatttctttctgccccgatttagacggagattaattagttttggtggatttttttgttttttagcgtttgagcatgagaagctagtggttgttgggattgtgatccggttcggatctttggtgatgaaatcgtcatgctcgcccggccacctcggttgcctgtgcgaccaacgccgtgtcgcgtcaccggtcgcccacgacgtgttcggcgtaaggcgccaaagcgaccgggagaatatgtaggccagtagcggcggcgccggcggccggattgccgattcgtgcggtgtttggagtttggcctgcagtcgatgtgatgttattattatcgccggccgcgccggcgcggccggagtgcgttgtcgcggccaccgtgccaagatgtaccactcctgctttatttctagggccaaatcttaggaaattttcgaaagttgtaatgtcctgtgcctagatggctaagctgtgttggtttacgcaaagctcgttaggattca

SEQ ID NO: 66402 - DNA, 747 bp, Oryza sativa
tttggttttcactcaaattgctgatgaggtagtcaagatagagaaggaaatcaagcaagttgtagaactcaaggataagtggttgccgctatgcccatttgtttctcacccactcactgagatggagagacagaggtcccaagacatcttcccggaacttgtcaaagatgaagatcttgtgggtattgaggacaataggagactgctgacagaatggctatattatgatgagttggacaataaggtgataacggtgtcaggaatgggtggactgggaaaaaccaccctggtcacaaatgtttatgagcgtgaaaagacaaacttctccgctcatgcatggatggccgtgtcacaaacctacacagtcgatgctctgttgaagaagttgcttaggaaagttggttacaaaggtgaaattgacaaaatggatgtttatgatttgaaagaagaaataactcgagtactcaaagataggaaatgcttgattgtactggatgatgtctgggaccaagaagcatactttaaaatatgcgatgcattccagagcaaccaacagagtcgtgtaatcatcacaacacgaaagaatcatgttgcagctcttgcttcctcagcatgccgccttgatctccagccactggatggcaatcaggcctttgatctattctgcagacgggcattttatagcaccaaggaccatgagtgtcccagcgagcttgtggaagttgctgcatctatagtagatcgatg

SEQ ID NO: 66403 - DNA, 2288 bp, Oryza sativa
cccccccccccccccccccccgggagaaaacggaaagatggagagagagagagggggaaggagtagcggaggttgaggaggtaggtgcgggagatttgctcagcgcaaagagatgactgaggggagtgattttcgtggtagggcagcctaggaaaaaattttggtggtaggcccacctaaattagataccgctacagtaaacatttgctaatgataaattaattagacttaataaatttatctcgtagttattttgttattacactacgtttaatactttaaatgtgtgtgtccgtatatccgatgtgacaaccataacttaaaagttttctccaactaaacaatgccagttctaaaaaattttatccaaaaatatcacatcgaatttctagacgcatatatagagtattaaatatagaagaaacctaattgtgtagtttgcatggaaatcgcgagacgaatcttttgagtctaattagtccatgattagccataaattctacaataacccacatatgctaatgacggattaattaggctgaataaatttatctcacggttttcaagcgatgtatgaaattagttttttctttcgtgtacgaaaaccttttctaatatatagtgaaatgtccgttgtgacatcgaacaattttcacgaactaaacccacgctaaatcccagaaattattttaggagacggaaaagacagcgacgacttgacccagacagaaataagaaaataaaagagaaaagaaaagaagaagaaccaagctgcaggcagctggctcaagagctccgggcgggtcaaggtctcctcctctctcgtcggcgacctcccttgcgattgattcatcaggtgcgtgcatcccttcacttgcagaatccatggagcttgggagcgattagtagtagttcatgctgcagagccgtttcgccgctgagcattttttgttgactccctcgatttgctcgtgctcggcgactttagtatcacccgaagatcgcgaagaactcctccttctctcgatttcgatccgcattccgttgacggattggtacgcgagttgactttgcaaggattgatcatctccccctttgggatgaacatccagtgtccccccctttgcggcgcccgccaagtgttcgtcggaatgcgcgttcccgaccgcgagtctaggcacgctgcgcgccgacgcatccggcgaagggaggccgccacgcctccgtctggtgtggttccgcggcctgcgcgcggcgctttttttttttttttggccaaatcttgtccccggttgtgcacgatcacgaactgctttgctgactgcgttctcatcctctcttgtttgatcctgcagggttctgcacattgaccgtacagcacctgcgctccagccctgttctctggtcttccagcaggtgagcaagcatataaatcactactcagtatggcagtgtatttgttgtgtgttctgttctacggatcatttttttgttcttcatagttgttagtctaatgttccaggtaatgctgctaaacttgcttgtctaatgtatagtctttctgctcactgtcttgttgatgaaccagttattttctttgaatatgtatgaactatgttcagcccacaagttgcttcagctgaagctgtatagggtgtgtttagttcacaccaaacttccccccaactcccaactttccatcacatcacatcacatccaaaactttcctacacacataaactcccaactttttttccaaactaccaactttccctaaacttctccccaatttcaggaactaaacacatgtatgttggtgaaatgtaataaatgcatactcaaattaaagtaaacaactacatacagaatagctgtacttcatgatgtataacattatagcaatgtttcttttactgagccaagcaggagagctcttccgaaagcatagtttgtccagaaaatctcgtagccgatttccgaactccaaagtaaggtgtcaaaaaaaaaatgttccaagtcaattaataaaatataacttagcactggccttcatatatgatactgtttgccattctgatttggaatcctactctgtgcccacaagcaaatcaaataaagcttgtcatttatttgctgagttgtatcttatgagatgccattaacttctcataaaacgttttatgagatcatagatgcttgtggtaaaagaattactctatggacacggtgcatgagtaccattatttcttttctcacagtggaccattattatccaagtctgaacagtg

SEQ ID NO: 66404 - DNA, 8188 bp, Oryza sativa
ccatgttgaggacgtaatggacaagtactcatatcatgctattcaacttgaggaagaaggtttcttgaagaagtacttcgttaaaggttctcattaagtcgtggtatttagtgatattgctgaggaggtagtcaagttagagaagcaaatccagcaagttataaagcttaaagagcagtggttgcacccttcccagctcaatcccaaccagcttgctgagactggcagaccacggtctcacgacaacttcccatatcttgtcaaagatgaagatcttgtggggattgaagaccacaagagattgctggctggatggttgtactctgatgagccagatagagcagtgataacagtatctggtataggtgggttgggaaaaaccacattagtcacaaatgtttatgagcgtgaaaaggtcaactttgctgctcatgcatggattgttgtctcccagacctacaatgtggaggctctattaagaaagctccttagaaagattgggtctactgaactgtcacttgatagcttgaacaatatggatgcacatgacctgaaagaagaaattaagaaaaagattgaagatagcaaatgtttgattgtgctggatgatgtctgggacaaaaaagtgtactttcagatgcaagatgcattccagaatcttcaagcaactcgagtcatcatcacaactcgagagaatgatgttgcagcccttgctacctcaacacgccgtctcaacctccagcctttgaatggcgctgatgcatttgaactcttctgtagaagggctttctataacaagggccacaaatgccccaaggagctagagaaggttgctaattctatagtggataggtgtcatggcctaccactagcaattgtaacgataggaagccttctgtcttcaagaccagcagcagaatttgtttggaataaaatatacaaacagcttcggactgagctagcaaacaatgatcatgtccgagcaattctaaatttgagctaccatgacctatcaggagacctcagaaattgcttcttgtactgtagcttgttccctgaagactacacaatgacacgggagagccttctgaggttgtgggttgcagaaggctttgtgctaggcaaagaaaagaacacgctagaggatgtcgcagagggaaaccttatggaactgatccaccggaatatgctggaagttgtggacaatgatgagattggcagggtaaactcctgtaagatgcatgacattgtgcgtgtattggctctttctattgctaaagaggagaggtttggttcagccaatgatcttggcacaatgttgcttatggataaggaagttcgtcgcttgtcaacatgtggatggagtgatgatactgtatcaacagttaaattcatgcgccttcggaccctgatctcactttcgacaacctcattgccccttgagatgttatcctcaattttgtgtggatctagctaccttacagttcttgagctgcaagactcagagattactgaagtgccgacttctattgggaatatgtttaatctacgttacattggcttacgacgcaccaaagtcaaatcacttccggagtctattggaaagttatctaacctccacacgcttgacatcaagcaaaccaaaattgagaagctaccacgaagtattgttaagatcaagaagctaagacaccttatagccgatagatacgttgatgagaggcagtcagatttccggtactttgttggaatgcatgcccctaaagaactttccaacttgcaagagctgcagactctagaaactgtggagtctagcaaagacctggctgagcaactgaagaaattgatgcaactaagaagtgtgtggattgacaacataagttctgctgattgtgcaaatattttcgctatttctttccagcttgcttctttctgcaaaagatgaaaatgaggaactctgcttcgaggctcttaggccaaggtcaacagaactccacagactaatcatcagagggcgatgggctaagggtacacttgattgcccaatatttcacgggaacggcacaaatcttaaatatctagctctaagttggtgtcatcttggtgaagatccactagggatgctcgcttcgcatttgccgaacctcacttatttgagactgaacaacatgcatagtgcaaacattttggttctttctacagtcttttccccacctgaagacacttgtcttaaagcacatgcccaatgtgaaccagctaaagatcatggatggggcacttccatccattgaaggtttgtacgttgtgtcactctcaaagctggatatagtccctgagggcattgagtcccttcggaccctgaagaagctctggcttctgtacctgcacagggacttcaaaactcaatggcacaaaaacagaatgcatcagaagatgcagcatgttccagagattcgtgtttagaactttagatgcggctggctggtgccgtttgtagtttttttccccctctgtttgcagcaggtgtcgatttccgatgagttgcctatcattcctagcttttttgcgttcgcggtgcctctgtacattatgtgtagtttcatttactttgatattcattgtatgtaagagcacatccatttttttataagaccttatttgcatgtactgttgccaatatattaatctctctgtttggagatatatgcggtggaaatgaaatgtaacaagatagtaggaccaatgttgtcaatgctattatgcatcaatgcaagtatataatatggttaggatttaagcttctggtcatccatctatatattgtctagctctctggtcactgtgctattcacttgtgaactactatatcccctatacccagcatttttgttggaagacctcacaacttcaggcttactttatggtggttgtgctacactgcgctgggcttgttattttactgaccgtcgtagtttgttttacaaattaaattacagttatataattgtgttacttaactgtcatgtctcttagtggttttactgtttgcgacatatagattaaaaaaaaatcagtttgccaaacgccaaaaaatctaaaagcgcactatatagaaataatttcctgtacaggactcactttatattgcagacggactgtaagtggtcgcgtctgcaaaaatcacgctctattttcgtgtgcggttctttaaaatgaccgcaaggaaaaaacaatttttgcaggcaggcctcttaacagatccacacgcaataataggcttattttcgcgtgcgaacctgttaagtgacccgcacgcaaaaatagcccacccacccttttagctcccggcgccacttgatctcttcccatcctaccactcggccactccaactcccactccctctccctctccctctcatcctcccatctctcctctcactcctcccatctccctctccctctccaccctcccctgtacccactcctggcgacggcagcagcctcggctagggcggcggtggcagcggcatcggtgagagcggcggcggcggcattggcgagtgtagcggcagcatcggctagggtggtggcagcggagcggatccgccgctggccaccacggggagggtggatccgtcgcctgccaccgtggggagcgcggatccgtcgccggccaccgtggggagggtggatccatcaccggcgaccattgggatgatagcggcgggcctcgggcagggcagcgacgatgactgcggtggcggcaatggtctcccagcctcgggcgtttggatccgttgccggcgaccaagcggacgacggtgactggcctcaggcaggccagcggcggcggctggattagggttccagggcggcttttggttttttttttctgtttcgattttttattttctcgtgcgggtgacttaagtgcccgcacacacgtgtgggtgcatcacccgcacgaaaaaaatcggattttcacaggcacttcgttctagacgggcggaagatttgcacgcaaaaaccgctttcgaccgcacggaaaaatcgttattgtactaatggcagctatttgcaccaaattagattatcctaatccactatgatacaattaatatcacttgggggtgtttagatccaaggctgtaaagttttggcatgtcacatcggatattatatagggtgtcgcatggggtgtttcgggcactaataaaaaactaattacagaatccgtcattaaacaacgagataaatttattaagcctaattaatccatcattagcaaatgtttactgtagcaccacattgttaaatcatagagcaattaggcttaaaagattcgtctcgcaaattagtcgcaatctgcacaattaattatttttttagcctatatttaatacttcatacaggtgtttaaacattcgatgtgatagggtataaaatttttgtgtggaaactaaccagagccttggtatagtttctcctgtgcatgtaagcaagtaggccctgtagtcttgctaaacatcactcacttttttctatccctctgattgaagggcatctctaatgtgcatgtaaatgcgaccataagccatatgataatattcttagtacaactttatgtatagggaggtgtgtttggaagagaatattgctatggctaacttaaccttaaagctagctataaggaatataaaattactttatgtcttttcaacatgtacgttggtttgaatccttcatactataagaattaatagatattattttttctagtgagtcccaacttaaggtgaagagatgatcttaaacattgtagcattgactataagtaaaaacacatatatgtgggttccgtcttatagttgttgtttggtttaacattgaggatgcccgaaggaggaggttcctctgacatttacttcccagtgatgttgtcactaactgtggacataagggtagtactccctccgtcccattttaagtgtaaccatagttttccgcgcccaactttaatcgtctgtcttatttgaaaattttttgaaaaaatttaaaaacataagtcatgagtaaagtactatttatattttatcatctcataacaacaaaaatactaattataaaaatttctcaaataaaacggacgatcaaagttgggcgcataaacttaggatccacattccctcattgaaccactcactactatgcatagtgtgatcagcatacgctctgtggttgcctactcggctcttgtgaagagttgcacatagtaatgagcatggtggtgtcaaaccacaaatttattcgcaatggcaggatgtaggtagctaggtgtgcctaaaagttaaaaggttaagatttgcaagagaaaaacaatctattgaaaggtttattcccatattattaaaaacagtttttttattaattaaaaaacataagtggcatatcagatacagaccagcaatcgtgctgcaccgcaccaaggtacaacaaaaatatagtttctcacttagcacaaggtacaacaatgtgtttctgaatatgttacaacaattacaagcactaacaacaaagaacaacatggtgaacttcattttgaccagacagatgtccagtgatttgaattgaagaaagacaaaccttgcaaattgaccagacagatgtccagtgatttgaatcgaagaaagacaaaccttgcaaattgcaattgaagtacaaaggagcacagatattgcaacggaagcaaccaaatgtcgtcaatatatcttctcaacgttgaaatgagccgtatttgtttctgagattctagtcaacagaactagcagtaccatgtaccaacacagtaaatcagctcagagcaatgacaatccacaaacaactcttccaatgtactgcaaaatcaaaatggccgtcatgatactatatttggataaagagattttcagctaattaaggtacatatattaactaaagtgccctgcagcatgtataacttgcttcgatttccttttggcttcgcaattacagtacagttactatttttctagcaatgttgcacacatgactacaaatgaaacttttccctagtagttcttgtattaatctcaccatgaaacacaagtatacaacacttaccaatcaacaaatggtattccatataacatgacacaacgtgccttaggtgggttgtgtgtggttgaaaacatagtaagtctacttaggacttcaccactttggcatgatgccgctaggcagggaatggggaactgggattgagcaattactaagctacccttattaatactattttctgttccaaaattatggcaagatatgctacgtaataaatatttgggatcgcaacctttatctcaggctttttgaaaagcgggggactcatatttttgggctagccttatgaaagccaaacaagattttcttaggtttaggtcctttcgtattagggaaagctctcaaataaggttttgggaggataaatggttgggtaatgcctcgttgagagattaatatccttgtctctataacatagcaaggcataaacaatcgactatctcataaatctttcaaaacaatcctccaagcttttcatggagacgagatttaatcggagcaaaattagccgcatggcacaatttatggcctcgcatagctgatttggtgttggcacaggagcaagatgaatttcgatggaatctcacccccaatgggatcttttcggtcaattctcattacttagctcttgtccatacgggcatcccgaatataaatagatgtatttggaaggtaaaagtattgctcaaagtaaagattttcttttggtacttacgtcggggcataattctaaccaaggataatctagctaagcgaaagtggaaaggtaataagaaacgttgcttctgtcataaggacgaaaccatccaacatttgttcttccaatgtcatgttactcgtttggtttgatccgtgattcatatggcttataacttacaacatcctcaaaattttaatcatatgtttgggcgttggtttacatgtgttcctaaggatatgagaaatctgcttttgatgggtgcaacagctatttgttggtccatttggctaagctgaaacggggcaatttttgataataagatggtatcttctcctttgcaggttattgctttagtcaccaggtggctacgcaccaggtctatcctccacaaaccgggtcttcaggtattgtggtggtatcgcgttgtttggatcaggtggtacatgagttttttaccctagagcatgggtggcgatctagtcttcggcttgatagtcactaatttcttagttttgtgttgagagtctagttagatcctgttttgtagctgtgtgcatttcatgcagaggccaggagtgagcccagttagaagttatcgaaaaaaatgaattaatgatgggtatcaattggttaaggaggtaccttccaagtactgtaaaagatctcaatgaacaaagtttcacagttgatcagttagagagtaagagcactgcaaaaccactcctccaatatgttttctaaccgctttgtattcacacaaaccctgatttttatagtcactgatatagaaacagggttatttctcttgagaaagaagagccaaactgagcatgaaaacaggttttgaaaaaacaaaagatttgaactagtagctacttaaggtcaaagctgttttctagtcatcaatgctaggttggtggctgagtcgtccaactacttctaagacatgaaatgcttacaactttagatgcaaatagcgcgttggtgttcagttgggatatgggtgcgaaaaccttttcttaggagctgtaagatctgctaagtttttcctgggaggagtactaaagcaaggcccaactgtagcagtattggacaaaattggatagagaaatataaagaaaaaggtacacatacacataatccggctaagcatttgtttaaaaataaaagaaaacagaagccatacggattaatcatcagcgacagcataagcagcttgcaatttacatggcaagattaatttcagttgatcgtaaatgcaactattggtttaaagaaactgcaactaactagattattactctttctgatttttaaagtaaatacaagttgttttagcactctcaactcttt

SEQ ID NO: 66405 - DNA, 1295 bp, Oryza sativa
  unsure (1)..(1295): unsure at all n locations
gtcttcacctcctcgttgctgcttagatcaatgggttgaatgatatttctgtccatgagcttattgaaattctcaactgctggatcaggaaaagaacctgaaggtagtgcttctacaaatccttcagctgaccatcgcctgagtagtctttttctcctgattgaatgaccactggggaacatgccaaaatatagcaagcaggctttgagagcatggcaagatagtgtagagtactcatgaatcagcacctgtcgcattctctccaaggtgtcgtcatcctccagatgattgcatagctggttgcaagcatcttcacacttgggttctcttggccagcccatttttcgcaagaattgacctactgtaagaagggcgagtgcttgaccatcacattttttcaaaatccgtactgaatcaggctgaatgtaatcttgatattcccccgacaagcatttttcaagaacaatttttttgagtgtatcttatctagccttctaattttatatacatagccattggctgaactgcaggctttagctactgattgcactgttgtggtcaccactattctactgctgaaaccatccttcgggaaggcagattcaatagtactccacaaatcttttcgcatgtcatctattacaatgaaatacctaataacatgaaacaacaaaagggaatggacattagtaaaaatccactccgtatgaacaaataacaaccatgggccaagcaagcacagcctctgttttcactgtactgtaattgtccaatccgtaggcctcacactgaattattttactgcgttaatttagttgtctgcatagtctatagtttgttgtttgtttggaagataacatgagtatataactcatggaaactatacaccgctattacactgtaatcaactaaacacacagaaaagtagagagttccaaatctagaactgaaagccaagttaccatgacacaccggagtggagttatatgacacactgtagtatcacaatatcaggttatatggtgataaaaccaatgtaccatgatagcaatgtaaaacgcaataatacctctataaacgagcatgatgctatctctatgatagcaccctgaaactcgataataccatcgtgatacggctatacaaccattacctcacctcagcacagctaccataagcctagccacctgctttcttgagagggagacagagacggatataggactgaggactggacatatatatcttcatacatcatgatatnnnnnnnnnnnnnnnnnnncgaactcgaatca

SEQ ID NO: 66406 - DNA, 7231 bp, Oryza sativa
  unsure (1)..(7231): unsure at all n locations
cataaatcgaatcacgggtatgaaaaaatggagcagagcatgtggaacttaaatcagcctaattagaagaagaattgttgatacctcaagttggtcagctgatcagtgagatttacaataagctggtccaggtcgacaacggaggcatccgatggcgggttagataccagttgtccgattatctccctcaacaccttgctcggatcaccatgtgccgcagaaacccaggcctgtttactgaaactccggccgagaccgctgttgttgtacaactcccttgcaagtgcagtcttccccaagccgcagaacccaacaatcgatatcaccttaagcttcttcggctcggcttctttcagatgctccagaagttcttctcggggcaggtcgatgccgacgagatcagcctggaggtttctcccgtcagatgcaccggagcagcgttgctcatccgagctgacaggggaggactgatgaccgacgaccaccgtgtatctttctcgccgctctttcgcttcgtctgctctcttcctcagcttcttcatctctttggccaactgaagcttcgacgttcccgtgacggaattgatactgaaaagagaagcttgctgatcccgagttttctgatacatgatgcgatctacgcagtcctctatgtcgcgagccaggtcgcgaagctcttcgatggacagcagcagcacgcttccacggctcaccgtccgcaagagctgctcgtcaatggctccggcgatcatgcggagctccttcaacagaaattctgcgtcgcctttgaatcccttgtacagattgtacttctgatctaccagagagagcatcctcgacgcgagtattttcaacaaaccgctcaaaatagctgcctccatctgcgatttctggctactcgacgggcttatcctcctattcgatccccttgtgcatcggggttgactcgttttttttccttttagtataaaggaagctttcattaatgtcaaaacgattatattaaccactccctataattctatctgtaagttcattcataattttccgtgcacaactctgatcatccgttttatttaaaaaaataaaaaaaattaaaaacataagttacatgtactattcatgttttatatctcataataataaaaatactaattaaaaaaaattaaataagacagataatcaaaattagatgcgaaatcttatggttgcggaggagcatcaagttaatagaaccattcagaaaactcatggtctctgcataagccaagaggtccccgatctcattctcaatacctgctttttttttttcaatttctttgtaaatttgttcgcaaaaaccagatcaagcccaaaagtagagattaatcggatcgtgctatattacaatgcgcagggcatccacgacacactaacgatatttctagtaaaattataaaacctggtcataagtcacaactaaaatttatactatttgtttattatttattaataaaatcgtgatcgtgatgtagttatcatgtttactttgtgtgctagcttgatctgggaaacaaatataacttgagtatactaagctacacactgtaactcaaggtggatgccaagctggctcagctcggcttagtctggctcgttatgatatcaagcagttgatgtgaaaattcgtcgtgacacacaagggcctgagaaatttgcttaactccagtgcgggcgtgtcagtcagtttgattctataactgacaacatagataattgatgataaagaaccgatagccaaaaagccgatgtaacgatactagcatatgtcgataaggttttgaacaatctgctatatatccaatgtagattctgacacttagataaagataatggaaaaacttgaattaaccatcccattcaatttgatgataatatgatgaagtaaatgtccaatgagccaatcgatcgatattgatgcaaaatattaaatgtaggctcgacggttaaacatacatcggttggaagtctatgtaaagataactgtcgggggataaactcctcaagcgggggaccttgaggcccctccttcgttagttcggcgggggacagcgtgtgtaaatcaagaaactgataagatcgaaaaggaccgagggggttgggccctcaatcaaaagggggagacaaaagggattatacaagttctggccgctaaggagcgtaataccctactcttctgtgtgatgatttttctaagcttttgaagtctctgaatctctgatgtacaagccagagctaggagttcctactccaaattgtcctctctcccacttactggacatgaacctccttttatactccaaggggttctcacatgcactgggtgtgcaatctagttctggggggggggggggtaaatattctctatcttcaaagtgcgtcttgtgctgcagcttaaaaaacgcatgtgcatcagctgccgtgcagggcctatcaaatcatgccggctgacgcaggccgacacggggaggatccccgtcattcaccatttaatggatgtggattctggggtgttagtgcaccgggaatgtcatcccgggtatgttcaaggcagtcaagccaacgctgaatagttgagaggtgttgtacccctcatcatcgtgacgggacagggcatacctaccgcacgccacctgacacccggctagagcatgcgtggcttgcactgtctcgtctgtcagtcaaccggtcacggttcagtcaggtgcgcagcacaccgcattaaatgcggcgtggcacgcctgctccgtccacactaaatgtggttaggtgggcgctgaggggcgtccatcgaaccactctcgcacgacggtcacgtggtgaccatcccgaggggtcggggcggctaccgctcgttcatgggcccgacccctggggggaaatgccacgtggatgtcgagggaggctcctccccttcaagcacggtacccccgggcccatatcaccgacaataatgtatcgacttacactctgataaaacgtagcacaaatctataaacttagccagctttagattatcagcagtaatatagaagatcagacccaaccgagacagttctagattacgtctgatcaaataagctagataagtccatagatgtatgctaatatgatcctaatgagctataaccctggcttagcaaacttgtttgcaagctcgagcgagttcatttagcttgtgagccacggggcaagagatgaggagcgcaagatcgccgacacttaaagctagacaatgcaagagatgagctcgagctcgctggaacttggagcatggggaggagctcaacaatggaggtgtcagtctcaaggataagacatatctcctatacatgggtttgtggaataggcaataccatatatccaataatatatgagaaggtatcctttagttaaggaaatacgatgaataaggaaggaaattatcttcctagaatagaaggcctgtatcatgttctatttctccgagttctacttggagagaaagatgatgttcgctattaatacaagatcttctaggaggagaggggacacgcctacggaatacatgccaacacaaaatacaagcctagacaaactaaatccggaaccacaaaggccggcatgagggatctagagctatctacaatctctccgagttcatatttgacaaagaagattacactagccgtcgatgacgtgtggaagctccatgccaccaagctgatagagactagattaggtcaatcccaaatattatattcaggtgatactgatacataaaggcattatcggctctggccaacaggagtagagttattacctgttagttaagggccccgaaactatataaaaatccatgtctcctatatgttttacctcaatctctcatataccctggttctaacgatccccatattctacaaataccatctacgggtatagccggtgataggaagagaaaagctcaagcttgccaacacttgagtcttggtccacaggaaggctcgtgctcattgtggttcgctgcgctggggccgggcggtggcgcaggtgggtggcagcatcgggtgctgggggcgtgcgatggcgttgggccgagcgatgacgcaggtgggtggtggcattgggcgttgggggtgagcagtggtgcctagctctagggacgagcatcagtagctggagacgcagggcgacggcaccatacgctccttttggtgatgacgacaggttgagcgacgggcctataactgttggtgaagagcgacggacggcgtatggcgcaagcggtgagcggccttggcgggctagcgacttggcgagtggtgatggcgagtgggtgggtggcggcgaagttgtgcgcagaggggagacaaacacggcgcacgctcgtgcatgaagaaaggaggctatgactgctgtgaagagtgaagctagggtttttaatgctcttggccctgaaagtatgggcccgtgggttgtgggctgacttgctgagagcaagtttaatagtatagccaactactaactccaaatcttctatagccaatgtaatagtcaattcatacaatagttacttacgatactattaatacctggtcctacctatcatacacacagtacgtcttagagtccgtgctgctacagatctgtagcccgctgctcttctctctcttcctttatctctttaaaatatgtttatagctggcttatagcctgctattatacttgctgtgaggtgcagtgtggctatagcctgtgggctactctcgagttgactgattatctctaacgaggtaaaatgccaaatcggctcgttacgaaaatgaaacgagtctagccgagcttgtcacgagctgagcgagctaacgagtaataagcttttccgtccacccatatatgtaacaaatgataataccacaaccattttatgattatattaataattaagaaacatatataacttgagttgtgttttgacttttgagacaatgttttatagtttattggtcacacagggcctaacggggatgacaaacaaaaaaaaaaaaaaacgtagggcacccacaatacaccacatgcagtgatcatttgaggtattgaaccatttcaatgtcttcagcaataatgtgtatataaagtactcaccaagctggctggcgctgattaggagatccttatctagaattagttttttggagtatctatttgtaaataagttttacaaaaggactcgtaaaaatcctagcggtatggacgtcgtcgtgtcggagtcgggcacacgacatacgcactactaaaaaaaaacaactcggaaacgtacgggaaagctctaccatttctgttttcggttttttttttttggaatcgaaaattgaggatacgaaaacgtacggccggaaaccatttctgttttcgtattatttttggaaatcgaaaatcccatatatggagacggaatcgaatattatcaaatacgaattggagcgaatacgataacaatatttatcgaaaaatgaaaacaactcttactaaggttctcaaatcaacgaagaaatacaactcattattttttctaaaacaataaatcaacatttttaatttctatcatcaattaataaatagtaatatacctagttgtacacttcacttttcagaactataatgagctacattcatttgtaactatggaatggcataataaaacagaaacaaatatttattaagtaaaaaaaccagatcaagtaccgaactaaaaagaatatccccatttaaattcagagtagagaagagtaaagttaatcatgtgtgtatgaacagtaattcatctccgataccgagaaaataaaatctaaattcacttcgagaaattttccgacggattccagttccggacacgacggattccagttccggacaaatagtagccttattgtattcgttttaattccaaaaataaaaaaaaaaatccaaattcatttttaattccaaaactctctttaaaaaaatttcaaccaacactttccttttccgaaaaacgtctgaaaatcaaaaactatctaaaccattttcatgcgtacacacaacattttccaagtaattttttaattgcaccatcgatcccaaaaaatatagcagctcaatggtagtagttccgtagttgcggcggggtgagggcatattctaatgtagaactacctccgttcaaaataagtgtagtcgtgagtatctccgtatccaacgtttaacactctgttttatttaaaaaatttataaaaaaataaaaaatagtccgcgcaaagtttatgatatttatcatctnatnatataaaaataacataaaatattttcaaacgagacgaatggttaaatattagctataaacagtgtaaaactatatttattttggaactgagcgaataagttttcaagtcaacgagtgagatacctttttgcgccaaggttggaacttggaagggcctccaagatcaactcattcattgaggccattctcttgaggcttgagcgagacagagagagggggggcatggagatggaggtcccgacgagtgcttccatgggtgccatggggtcgcttctcaggaagctccatgtactactcactcccgaataccagcagctgatagagccagtgaaggacgggatcgagctcctcctacaagatctggaagccgtaaaggccgccatggtggatctgtcagagatggagactccaaccatgatggcgaggcactggatgaacgaggttcgtgacctatcttatgacattgaggactacatcgacaatacgatggactcctgctctaattcaggtgcagatttggaatcattcgactgcggccgaattggggaatttggagcttctattaaggaggcccggcaacggcacgagatctatgagcttggccgttgcacatcgagatttacctgtccccaaattccagcgccaaactggaaggggataaaccttgtcggcatggggaaatccaaggtcgagcttaccaacaagctcaccgacggttccttgcctcagctgaaagtagtatccattcttggatgtgcaggtgtgggcaagactggcttgccaaaccagtgttctgcgaacttcgagggcgattcgagtgtcgagcttttgtgcaggcctcaaggatgccagataccaaaaggcttcttcgaatgatgaactacttgc

SEQ ID NO: 66407 - DNA, 1172 bp, Oryza sativa
atcatggcgaacatgattgaagcactcgggtttggagtaatctagttcgagagaagattatctttccgactgtgaaggtctcaggggctactgtggagattatgggtaccccatacccacacggcatggttatccgactagttataggggataacttatatatatgaaatatgtaacacatcatgacttgggtattacgtttccctgtatattatggaacggcctaaagtcctgctttgataagattgtaaagtagatttaggaaaccgataccgtagtggttaaggtttctatcttgtaatcctgccccccgtcctatataaagtgggcaggaagccctctagggggcatgagcacatatgatcgttagatctatactacacccgacggattcaaatccccaaacaggagtagggtattacctctcattgagagggcctgaacctgtctaaatcctttgtctccacatccatccacttttaggtctcgtgcgctaccccgttttattattgccgaattcatgtttcgacagtgttgtttggtgttctttttacgcttggttaatttcttggaggtaaacttggagctcatctccgtgaacttgcagcggcggtccatggtggcgcggtcgactgggagaagggagcgtcgatgcatccgggcgagggcaattgtgtgattttactctttgggctgggataccctaggcagttgcattgtgggctgtgtagccttaactgttgctcgccctaactcaagctacacaaaggaggtcacgtgcactgtggcatgggaggccttggaccgaattgaataatgctacacatacgactacctcgtccgaccgaggcgtacaacgatgcatctccaccgtagattaatatgtacccatggccctatgccctgatggtagtacggggtgcattggatgtatgagtcagaatggagtcgtacactaaggtcgtatgtatagcacgattggaccgaattttgagtttcaaaagggccagagacactcatagagtagcttgcactgtgagtgtccttagcttggggataagccaggatagcgtggaggataagatcggcagctggtacactcgatggctgcctatacggcctaaattagggaggctgacgtggctaagtctttccttcctcattgcacttat

SEQ ID NO: 66408 - DNA, 6215 bp, Oryza sativa
gcgcaacgcggtgcgttgacggacacgccaggcacggcgcacgggcaagggaggtcgcgcgtggctcagtagcgacctggaaagagcggcgctgggtcgggaagggttcggtttgggctagacgcagatcaaacggttggtggacgatggatagagcgcccataaaaagaaaaagaaaataacgaaagggaataaaaggaaaaagagggagagggaggggctaaactgcaaaagtgaatgggagtggaattgagatgtagctctctatacgtttcggtatggggaattcaaatattttatttaaatatttgtttatttgattattcatcatttcccaaataaaactggctttacattatatcatcccaaattcatcctatatattttggatttgagaattcaaatatttaaatttgcatgtttatttatttattcatatctctacctaatgattgtagtctatattggattattccaaaattaacttaaataattgggggctttgatagtcctaaaattaattaaaatattctaatgggtccattattaatacaatagcacatcggttgaacttatttgtataacaaggtattttacatggacatgtttcatctattattccataaaatcaaattgagacttggtacaatattgatcgaaatgtttaattatacactcacataaacgtattttatatataaagcttaattcatttacatgaccaattattttatgttagtaaattttattccatgagagactcgatgaaagttctaaatattaatttaattattctagtggaacactcctatatatagagagtcattgtagtggcgactatttcatggttacttagatgtcatgacacttgtcacatggttccaatatttaatatttgacctataaattaaattagtaattaaccttctctttgtatggctttgttgtgttgtgcgtaaatatttatagggttcataatgaatatcttatttttataattattaattagttgtatagctttagcttaatattcaattgtaacaatttatagtttggcaagcaataataatcataacatccagcatgatgcaaaagttttaaaaagtttgaaattttagtgattttttattgtcagtaattttcaggatgttacacaaggcatatcaacaatattggctagaaagaattcaaagatatcagtatgaagaagatttggccaatagaattgcaaagttaatagaggagcagtttggacttaagcccaaggaacaaacttctgtgtatcggctgccatatcttgattgatttgatagagttacgttaccacaccaatacaaggttccagacttctccaaattttcaggacaaggtggtatatatacaatggaacacatcagccgattcctagcacaatgtggggaagcatcgactgaggaagctctaaaagttagattgtttccactgtctttgactagatcggccttcacatgtatttcttctttaccatcaaactctatcaaagattgggccgatctggaaaagcagtttcattcaaacttttttgctggcatcggtgagttgaagctctcagacttagtatccattcagcagcaagaaggagaatcagctatggaatatattaagagatttcgtaatgtccgtagtcgatgttatagtttgagtctaagcgatgagcagctggcagatcttgcattccaagggctatctacacctatcagagacagattcttttgccacgagtttgatagcctagctcatctaatgcagacagtatcggctcatgaaagccgattggaagaagcaaaggaagatcaattttcaagtcatcaagatcagaaagaagataattttgaagcatgagttctcatacaccaaaattggacggcatgtgttaacagtaaaatttggtaagaccctaagagaattatcacgtcgccaatagtcagattcctgctatattcggttaaggaaattaatctgttaaaggaagcttatccagtagtgaccgagttcaaggagaatgcggcatggcatgttatctattaattaggcattatttattagttttcttttatctttagaaaagtgtgtttggtgtcccatcaggactttatgttttccttttatgttttaggagagtttctttcttgtcctaaaaggactaatatctccccatgggtataaatatgtacacccggggttattgtaaaatatctccacgatcaatacaattcggcgcatcgccaccttttaccttttctacattattttatctttcggtgggatttggcacctgacgcggggctgtattggctttcgatctccggcgaaggggtaagtccaatgttccgctggcctaggcaattgtatcgtttacattggcctcgttcaaggctgcatcagtacattcgacctcttggattgctccggtttggatggtatatttgcctacatatttatcatatgtctctattaatctagtcttagcgtatcaatttagctctatcggttgcttctcgttttagggtttctgccggtatcggctaaatcgtattgctagattagattagcttagacatctaccaccctgaaaactcagtcattggcttgattgtctagatattacgtttcttttaatacttagtgctgcatcagttaagtttgatctactaagtcatgcttagaaacataatctctagcctgctttttgactataaataagggtttcatcggggtttcagccgatgagttatttggatgttgcatcggcttacaaggattgcatacaagttggatttagccgatagcaaaaaagatttcattgtttaatataatcttatggattttatgacgtcggacctccagccaatgtatgctttaaccttcggatcaatgcttattctattatatcatattgctagacgattggtttatactagattatattattgttatattatattatcatcagccgattgcctttatatcattatttactcaagtatcagaatctacattgggcatatattcgatagctcaaaactctatcgctatcggctggtatcagcatcggctggaattactccatcagcttgttagccgatcggctcattgatcttcaatttacatatcttgtcagttgcagggtcaaactgactgacatgcccgcatctcaccaacctttggtcctgcactggagctaagcaaatttcacatgccagtgtgtttttcgcgtcaacagaccctagtaaccattgttccccaccattcctgattttattattcatggtaattaataatctcttaattaactacgtagtaattagaatgaaaaaaattggaaattgggaaggatacaatgagaaaggacgtgcaaaccatggacgctattgcgtatagcatctaggcctggccacaattaagaacaacgtccacattctgaaccgcaaatcactgatcgatagtctggtttagcctgaccgcttgattgctccttatggtttagtcactttagattgattcaaaatcatgtcaactttattttttccatcagaaaatctttccaaaaaaactgttcaaataataaacttcatttgtcaaattagcacaattttcacaattgatcaacacccttatttttgcgacatctggagcaagaaaacacttcatcaaatttcacaatattttttccatgtactcaatatgacctaaggcatcttttagcttcatcttgtttagtaagcatgttgagcaattcaaaacatcatattgttcatttcactttttggcacaaatcatgtcaaacattgaactagcataaaaaacagtttgatatttttttcaataaaattttagttaaaaacaactcatccaaagtgtgtgtgcatgtcaactccaagagcgagagaagattttattctcaaatcatgtgtagcattatgtcacggccagaaattcaagaactagaatttccatgctggatgtgccttaaacccctatctaggaccaaccagggtacacaaacgacaatgttgacatacagatccacgtcttacaaatatataaaacattacaaatgcaacagaaagataaaaacgagccaaacttgaaagtttgactcctgcagcgaggcgaccccactccacaggtatccttgacggcagcgacgaaaccaacttctccgagaaagctccaactaggaaggacttcagctctggtgtggggaagagagagcaagactgagtactacccactgtactcaacaagtcataccggaagagaaggtatgatgcaggatatatcccagggaggctaaaggttcatttgcataaagcaggcatttaaaagcagaagttgaaagcagtaaaaatgttgtagtaaattaagcaatattaatcatcactgtccaatgctacaccatggtgcaacaaacccaaccaaccacttgaactacaccagttcattaagccaattattaaggatgagactaatcacgggggaatttgggttgatcgcccataaccacgggcacggctattcgaatagttttactctggccagaggtgtataactgtacccacaagacacgattccacatatgtcgccatgccccaaagtaccaccatggtactgctaatggggaaatcatgaaaatacccttcgcataaccctcccctaaccattcacaccacgctaaggtttcacccccactcctaacccggagtgggtagtcccctcgtgcgccgcggtgaatccggcagctggacaactggacaccccggctgacccaactccatcacgcccaccctcgccactggtgcttaggaaagggtcgagctatactacaagtcaagcaattagccactcccgcttgtggtaagcacggtaagtctttcagggtttcctgtgaaccggtccttaattaacatgggtgcgaccagcaaaaccatgtacccacagcccaccattcaatagcattttaattggataattatgaccaatgaaacatggctggatgtctcgagcacgtagctcgccataatgctaagtgtctaataatgtaattatcccatcatgtgaagtagtggatataagcatggctaagcatttcctaaaccaacatctagtcaaattaatacccaagttatcaatggtataagggaaacaagatatggctgagtaataggaaccatcccagatgacattgtaaaataatgcaatatttaatagaaaatgggacatttgtaaattgggcacaatatgatcaattgtatgatgtgccttgctcttgcgctgttgagacctctgcaacgtcttcaatgcaccacggagtgacgaaacggccgaaactatgtgacaaacaaagcacacaagcaaaacatgctataagtctactgaaacaggaaacaaaaccatttttaataaattctagggatttttatgaatttactaagacttaaatggacttaaacggagatcggatgaattagttatgatttttaaaagattctctgtgtttttactataaacagaaaagccttaatgatttattgcgcaataaacctaggcgaggatgacgtcagcaagggggggaggtgcggcgccggcaagcgggccccgcatatcagcggctcaagggggagggagtggcggttgactggtgggccccactgggcagcgacacaagaggggccggtccaccgtggaccaagtccacagggccgcgggtggtgcgccacatggtaccgacgtggcaccacgcgtgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggaactcctcttctggacttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcaaagctattttgtaa

SEQ ID NO: 66409 - DNA, 1147 bp, Oryza sativa
gtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttggggacttttgaatagagggagcggtgtgaatccaattccacaataaaccaacaattccagagtgtccaggtgatatgaatatttcccaaagtctatagttataaaaccacctaatgttgcctaattaacttgcgaagcatctacctaaaattatactagtggtactatgagtagagtgtccactagttggggttttgtttgttctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgtcttcccaaacgtcggcttcgacttccacgaagagcggatcttccgaagctgcagcgtctacacgaccaacggaaaagaaaaggcttaaactctaacaaattccacataacagcagaaacaaagcacaaaaatgggttcttgacttcttaaggaaaaaattagagacttgaacggtccaattccgagttcaaatggccaagttatggccatttgaagtttatatgctctttaaatggatatttacgaatttcttcatttaaattttaatttaaaatcgaattattgcgtcagccgggagagagggcgcgcggaccgggtccacgggagtggggcccacgcgtcagcctctcggtccacggtggaccgggagcacgcggctggcggcggccggcgccgtgggtcccacgcgtcagccgcacccgcgggcgcgggcggctgacggccgggcccacctggcagccgcgagagcgcgcccgaaggcggcctcgccggcacggccgacgggagaggacgcgcccgcgcccc

SEQ ID NO: 66410 - DNA, 1324 bp, Oryza sativa
ccatcgaccgccgagcgcgccgacgacaatgctatctcctgtgtcctgttttctccctgcgtgcgagtgctcgtctcggctagtcggcgacacgtcccgttgatactgtatgattttgtcccgttgccaggtggccgtgccgtgacaaaaaaaatacagtactactagtaattagttctcgtaattacactcaagtctgctgggagagtttaacatttcgagaagcagctgattagtagtcagtttttaagaatttaaaaaaaatgggttttcctgcttccggcttatagttcatttactaaaccctataacggcagcttctcagtatctagatcaaaaacttttggaggaatttataattttgagaaaagctgcagcattaaaatctccttaaaacaggcccttagtttggcatgcatctgtgcatgatgatttatttgcgagttgagaccgaatagttaatttgattgctcgatggatcatcaatccattgatagacgtcatgcgtgtctctggttcacttctcccatgacgccatgtaacgtgttcttcacacagatccctgcattcccatggtctcaaaggcgctttaatttggacctattttgtaagtgataaaaaaacagagatgttactgaaaatatgtttatggagtggctggttgatccgaggcaaactttaaggatgaacttttgctgctcatgttgagtgaaatattgtactactatactagtatggcactttcccttaaaaaagagagtgcaaaagtaataaagaacggctcgatcgtgtgcgccactgcacaacaccagtgtgctcgagaaggcttctgccgcatcctctccacgtgcactgatctttccaagcgtcgttgctccaagatttgctggtgttcatcacgaacaagacactgttcatgccgtgatgcaacttcggtgctagtagctttcatcactattacctgcagaagcgttcacttgcattagcagatgggggccagatatatcgatgcaatccaaccatttgcaaattgcaacgacctcttcgcatcctccctccgtgctcacgtctttatcagaaacatgacaccagcaaggcaggatgtgggctttacatgtgtcctaacttaaatcatttttaacttttgcaagtaaaatagttgaatatatatgctgcctgtaagttagcacgtatcaatctcctcttagaaaaaatatacaccgccgactcttcttatgtagttggtagatgagctaagctagcacaagaaaagctcgtagttaaattcctggtttggcatctgattcgacacatcacggacgga

SEQ ID NO: 66411 - DNA, 565 bp, Oryza sativa
ttctcccatcagctaacatagcgtaaacatgctctagaattttcaggtacagttgatcttgaaaggaagaacgaagcaacaaaaacacacttgcacaaatatccaagatcagaataagtattagaaagtttcgcaaaaaagaataaatattagagagctacaaaacattcaccgactaacagattattgctaagctgtaacatttatacgcatgacaaaataactaatgtaaaagaaacacaccattacaccaactctaaagtcatcacctataatacaagcctcaaacaatacgcaaagtcaaaccattccttgtagactgatggatatttgcttcttcagcaaaactcagcaagtctttcttcgatttaagatcaccaatttcccctccgtacagacaatgtaagtaaccttgttgaatcacaatggtggctggcacgaaatagttccatgaattaactttgcatgaacctgccagttttgtgtcgcataggatttttctgttttatttgcatctcccaggaacaaatctagcaggggcttgcacaaatgctcatgaaacagt

SEQ ID NO: 66412 - DNA, 25535 bp, Oryza sativa
tgcaagtagctcatgcacttttagggtttttctttttataaaccttttcaactttgtttatttcttttcaattattatttgggctctggaaattccactaaaatttatttacacattttaagcttttaggaaatatacaaaaatcctccaagcctcatttgacttttatctttgcacattttaattgttggaggctttcacatgaattttaattattctttgcacaatttcgaggatgaattttagagtcgatttgggacgcgacaaacctaccccccttaaacggaatctcgaccccgagattcggaagaactggcgaagagatcgggatgggctgccttcagctcgtcttcacgctcccaagtagcttcttcttctgcgtggttgctccactggaccttgcaaaaacggattacccggttcctggtcctgcgttccatggtgtccaggattttcactggcctctccacgtaggtcaaatcttcgcgaacttcaatctgctctgagtcggcctgctcggatggcactcgaagacatttcttgagttgcgacacatgaaacacatcatgcacgttgcccaaggaggcgggcagctccaactggtaagcgacttctccgcgccgagcattgatacggaaaggacccacataccgaggtgcaagcttccctttcgtctgaaacctgtgtacacctcgcaatggcgtgacccgaaggtatacaaaatcgcccactgcgaattccaggtcacggcgacggttatctgcataacttttctgccgggactgtgccacctttagattatcccgaatgattctgactttagcttcagcttctctcaggatatcagtcccgaacacttggctttctccaacttggtcccacaagagcggtgtccggcatttgcgcccgtacaacgcttcataaggtgccatttgtatgctggcttgatagctgttattgtaggagaactcggcataggggagactcttatcccaggtcttcccgaaatctaggacacatgcgcggagcatatcttctaggatctgatttagacgctcggtctgtccatctgtctgcgggtgataggcggtgctgaaattcaatcgagtacccagctcttcttggagcttcttccaaaagtgagaggtgaattggcttcccctatcagatacgattttcttgggaacgccatggagactcacgatcctagcgaagtagagctccgctagcttgttccctccataggtggtcttcacaggaatgaatcgagccaccttggttaatcgatccacaactacccatatagaatcatatccgccttgggtttttggaagtccggtgatgaaatccatcccaatttcatcccatttccattctggcacttggagaggttggaggagtccggccggtcgttggtgttctgccttgacacgctggcacacatcacacagagccacgaactctgcaatttcccgcttcatgctaacccaccagtatttctccttcaagtctaagtacatcttcgtactgccagggtggattgaataaggactttcgtgagcttccagtagtatcaactgtttaagttctctgctatctggaacgcatacccgatttccgttccatagggttccgtgttcatcctccgtgaaaccagcggctttaccctgtttcatattcttgaggagtccatgcatgtccggatcattcttctgagcctcgcggatttgatcgagcaagataggcttggcttctaacgcagccacgaatccacgaccaactatgcttaggttcagggcttccatctgttgattaagttcgggtggaatgccacggacgttaagagtgttgcaatggctctttcgacttagagcgtcggcaaccacgttggccttaccaggatgatagtgaattcccacatcatagtctttgatgagttctaaccatctcctttgccgaagattcagatccgactgggtgaagatgtatttcaaactcttatgatcggtatatatttcacagcgattcccaatgagatagtgccgccagatttttagagcatgaaccaccgcggctaactccaagtcatgtgtagggtagttgccttcatgaggtcgtagctgacgtgaggcataggctaccacatgaccgtcctgcatgagcacgcaccccaatccttggcgtgaagcgtcacaatacaccatgaagtcttgcgagtatccggcaagattaacactggcgaggaaaccagcttttccttgagagtttgaaacgcattctcgcattgcgggctccacacaaatttctcttctttcttcaacaactgtgtcatgggtcgagcgattttggagaagttctcgatgaatctccgatagtatccttccaaacctaagaaactgcggacttgagtgactgtcttgggtggcttccaatcagtgacggcggtcaccgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgggagtatatcagaatgtcatcaatgaaaaccacaacaaacttatccaagtattccatgaacactttgttcattaagttcatgaagaaggcaggtgcattggttaaaccgaacgacatcaccgtgaattcatacagtccgtatcgcgtggtgaatgcggtcttcggaatatcttcttcacgaatacgtaattggtgatatccggaacgaagatcgatcttggagaatacagtggcacctttaagctgatcgaacagatcatcgatccggggaagagggtacttgtttttgatggtaacttcattgagagctctgtagtcgacgcacatcctcttcgtcttgtctttcttctctacaaaaatcacaggagcaccccatggggaagtactcggacgtatataccctttttctttcaactcttccaactgtttcttgacttcggccagttcattggctgccatacggtagggtcgcttgtgcagaggagtggttcctggagcaagatctattcggaactcaatctctcgcttgggcggcataccgggtagttcttccggaaacacctctccgaactccctgacgatgggaatttctgacagtactatctgatgcagttctgaacttctgacagaggttggggtgcgaagaaaacaaccggttgttccggtcctcggtacagagtgacggtgcgtctcgcgcaatccactactccttgaaattgagccaaccaattcatcccaagaatcacatccaagttcttggtgtctagtagaatcagatccgagggaaaaggaatcccctgaatttctataggaacggcagggctataatactttgctatcataacccctccaggggtggtgatgagcagagggtttctaagcctttctacccccaactgatttttccccacgaatggcacagatataaacgagtgggaagctccagagtcgaacaaaatagtagcagggatggaatgaatgaggaacgtaccaacgatgacgtccggagttgtcagcacgtcctcggccgtcacgtggttcacacgaccccgaatgacatccttcccgccgttgttggggcggggaggcgcttgaccttgctgacgccttggcttcgggcatttatccgcaaagtgcccgggctcgaagcagttgaagcacagacgctgctgaccttgagcgtccctgcggccttgaccaggctgcacagttggcgtaggaggacggggcgcacgagtcccttgctgattctgctgctgctgcgcctgtggtcgtcgccctagtcttccgctgtttctcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaacgcggccggccatgcgggccacggatggacggccatgatctgccgaggggcagattgggcagctggggacgggcggcgccaaggccggcccggacatggcgcacggcggcggccggcgaccggccggcggcgcagcgcgatagcgcgcatgctgagaggggtggaacacacgggagaggaaaggagaggagagaaaagagggttctcaccgtgggttggccagtgcgggaagaggcgacggcgagcggcggacggcggggcgagcggttggatgacatccagagtgacctaggggagcaaaggagaggatttagagggagagaggagatccgcggtgagcggcaatgccagccgaaggcgggggaaatggaggcctcaccggcggcgcgagggaataggggctccgatggtagttggcggcaaccgagcggcggccgaggtggccccacgtggcggcgaagctaacggcggtggtggtgtctgtcacaccctgaaaatcataaatatataaattgttgtttaaatggaatttttagaaataattttaaaagtcttaaagagaagatctagttttaattaataaattccaatataaaaaggggccagataaaatttcattaaatactttgcttaattctataattcctagatttttctgggatttatttgagctaagaaagtatttttaataaatggaattgcatttaagaaataatttaaattgaaaaaggttttaaaaagtcttcttttggctttgggccgaaagtcggcccaaaagccttctctctctcctcggcccagccggcccagtccgcagccgcgcgcgcgcgcgttcggtcgctgacaggtgggtcccacctgtcaggtccttcgtcctccttcggccgccgccgcccgaaaccctagtttcgcgccgccgccgtctccttccaaatccggccgttcctttccttctccggccgaattgatagaggggaaatgatctccgggatctcctctaccttttctcctttggaatcatcggctaaatcgttttggaaagagttggattcgagttcgtctcggattcgttcttctcgatctttccttcctcgtcgccggccgccgtgggcctttgccgtcgcctccgagcccctttaaaaagacccccggtgtctcctctacccgtcgccaccctcgccttcgcctctcgtcgccggaatcgctctagcaccatgtgccctagcttcgccgtcgccgccgccgctccagccgtgcgccgccgtcgctccagccgtcgccgtcgctcgggaaggacgtcatcgtggtcgccgtcgcgtcgccgtcctcgtccgccccttcgccgtcgccggagatcaccggagcttcgtcgccgtcgacaacccgaaggtttccgctgtttcctcctcgtcgccgtcgtcgtccgttgttcttccgccgccgttttggtcaccggtgtgttcgccgcgtcgtcctctacgtgctggtgccctccgtttgcgtcctcgcgccgccgttcgccggcgagcgtgcgccgcccgagccgtctgctccgccgagccgccgccgctgtcggtgacgtcaccgctgacgtcatcggggtcgtccgccgtgagccggtcgtggaccgttcgatctcggccgtccgttttggattggttcgatctcggccgtccactcgcgtgaaccgccgcccgtgcccccggtccaccaaaaccctagccgctgacgcaataaacctccttttccttttcaaaaataattcattattgcgtcataattcaattttaaccgatttaagtgttttaatccgatttaatctttaaaaattcgtaactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgattgtcattgggtggaattaacctattctttgttatagcccttttgttcttgattactttattccttgataccttgggttataataatttgactggttgaactttatttatattggttcaactagatattagatataattgcttagccctgcttagaaacattagcacatttatgggataactaatgattcactattatttcatgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgtgaggggtattgtcacaactcctttccgaggtaccgtggtggtattgaggcacatggtgacatgatgtggggttgtgtcttgtgggtacagtggtacacctctgatcagagtaaaactatgagaaaattccctatctagcatcaaaaaaagttgctcttccctctatagcacctaaacttaaaaagttccctatctaggcacttctaaaatttcccttccctatgtagcacttctgttagtttttatacttgacggtgttaactagcgggagaaaagacggttttgcccttctttagttttcagacttgcctgtacatgatgttcgttattaattacttaagttaattaatgacaagtgaacccacaggaggataattattattatttttcaaaagagtggattgacatgttatatttgcagtgctacgttaaatcaagagaaagcacgtctaaaataccaacgatcatgtacgggcaagtctgaaaactaaagaagggcaaaaccgtcttttctcccgctagttaacaccgtcaagtataaaaactaacggaagtgctacatagggaaggaaaattttagaagtgactatattgggaacttttgaagtttgggtgctatagagggaagagcaacttttttttatgctagatagggaattttctctaaaactattcgaatagccgtgcccgcggttatgggcgggtcgaacaatgtctttcgtgattagtcccacacctctcatcatagtaataaatgctttaattggtaataatttgattagctcctggtttggaatggaatattcctggtttggagatagaactgtgcagccgggatggttgttcagaatggttgggcctatacaacagggtatgttgtatagtgttggattaatattgtttaattattactcaactgttttattaaattctcaaatgtttgctaaatgctgtttttgcaaatggaaccctattatgccatcctttgttatcctgtgcacttgcatatttgctgcgtggcttgctgagtatgtcatatactcaccttgcaatcattcatcagaggaagagttcttcaatgaggctgatggtgtggaggattaggtgtactcttggtcaagctgcctgtggagtggagccgtctgcgccgtttattttttttccgctgcttagatctttattgaataagaggaactatctacctctataatgacattttattcgcttattaattagagtaataattgtactctattatcaatttgttattgtgtgcctcggctgattcctggacgagggttcacacacatgtaagcgtttggaattttggatagaaattccgggcgtgacagtgtcaacactttcaaagatatttgagccttggaggcgaaatcacaacactttcagaagagataactaaactgaaacgtttggagacacctgatgtggagattatggataccccatatctacatggcagttatagttaggttggatatagggtaccgaatatagataaaatatctttataggaactcgggtttgtttcttaacttgtatgtcaagaaagtacccggggtcttagttggttacgattgtattttatctgtaacctcatgttccgttagggatatggactatattttgttatacggaccccttctcctatataaggaggggtccgggtccttcttgagacacgatttcctccaagatcatataatcaataacacactcggcggattcatccccggacagaagtagggtattacttcttgaataagaaggcctgaacctgtataaaattccttgtctccaaacccatccacttttctaccttgatagccacccccttttagtattgccgaaatcttgtttcgacagttggcgcgccaggtaggggttgcgtcaagtttttcgccgatcagtgcgatgggttccgtctctggcatcgacgacttcgtcttccctcccggacaggcgtttcggttcggcagcctcgacttcatcaccaacaacttcggcaagatctctttcctcgactcggattcgaaccagtcgggaaagaaccaggtctcagccccgttcggaattccaaactcggccaagatctaccccaagtacatctcgatcgagtcggcttcaaaccactcggacgagatcccatcttctccaacaccaccagatcaagacgatggggcctacccaccgatcctgatgaaactccccgacgatttggcggccgttttcaccacaacggcgtcttctccccgtaggcctaggcggaagtcggctttaacaccgatcccgcctagctccagggaagtcggcgtcatactccagccactcggcacagtttcaacggatcaattggaaggctacttcagctcccccggcgtcgactcgcgtccaactgagatcgtggagtacgacgaattcggctaccgccacgacaaccacgacctagacgacttcgacgaaagcttggaagacaactatacccctctctacttcggcgtcttcatggccgacaacgagacggaagaacaacgccaagcccgagaagccgaagcacgacgcgtacagcaagaagccgagcgacgccgactggaagaggagcgtcaagtacaagaacaagaacggctgcggtgtgagcaacaagaacgcgagcgggctgcaaaggaggccgaagaccgacaacagcgagccttggatgcatggcgacgagcacaagatctcattggccagcaaaacgttgaggggacaccggtcttccgcaccccacaacagaacgctatcgccgcgatcacccttctcgacacccttcttaaggaaaacgaactcaatcaatccgatcacgtcgtcaacatcttaaaccagaccaagaccatgatcgcagctacgatcccggttaactccgaaagcgtccgcacgccgactggcagccgggttccccatcttcgatctcaggattaccaccagccaagcctcagcatcgccggcgcaggatccaatcgcaggagcaggggccacaacgagcgatctgttcactcgcctcccgagcgacacagggagcgaagagttgaacggcctcgctcgccgccacgccgacgtcccgtcgatcttcgcaacacgatcattcagcgccgtgcagcacgaggtcaccgccattcaccggatcgctgcgacgacgacgtggatggagtcgccgccttcaccaacgacctgcgtcgagtggattggccggccagctttaagctgactagaatagagaagtatgacggtaccaccaatccggagtcttggctcaccgtctacggtctcgcaatccgcgcagcaggaggagacagcaaggccatggcaaactacttacctgtggctttagcggattctgcccggtcctggctccacggattaccccgtggcacaattggatcatgggcagaacttcgcgatcacttcattgccaacttccagggcaccttcgagcgccccggcacacagtttgatctttacaacgttattcagaagtccggagaatcccttcgagattatatccgacgcttctctgaacaacgaaacaagatctccgacatcaccgacgatgtcatcatcgccgccttcaccaaaggaattcgccatgaagaggtggtcggcaagttcgggcgcaaacctcccaagactgtcaaacttatgtttgaaaaagccaacgagtacgccaaagccaaagaccccattatcgcatcaaagcagtcgggccccagttggaagccaaagaaggatgcaccgaccacaggagggggtggaagtaacaatcacaaggaccacaagcgtaagcccgaggaacttgttgcgaccactacacactcctcccgacaccgttcgtgcgtcaacatgtacgacaagatcatgaactcccaatgcccgcatcatcccaactccaaccacacggccaaagattgcttcgtctacaagcagttcgcagagcaatacgccaagaatacacggaagaactctgacggggagcaaagcacgtcgaaaaagaaggatgatgatgatgcccgacaggttttcaagaccaccgcaaagagctcaaccacatcttcggcggccctttggcttacgaatccaaaagaaagcaaaagctgactgaacgggagatcaacgctgtccagcccgatacgccccaatatcttcgatggttagagacaacaattaagtttgaccgctcggatcaccctgaccgagtggtccacccggggcggtaccccttggtactagacccagtggttcgcaacgtcaagcttcgcagaaccctcatcgatggtggcagcgtattaaacatcctcttcgccaagatcctagacgacatgcagatccctcgcaccgagttaaagccgagtaatgcgccctttcacggagtcatcccagggctatctgcaactccactcggccagatcactctcccggttaccttcggtacccgggaaaactttcgcatggagaacatctgcttcgaagtcgctgatttcgagacggcataccatgctatactcggacgcccggcgttagccaagtttatggccgtcccgcactacacctacatgatgataaagaagcctggtcctcgaggagtcttatccctacgaagcaacattaagcaagccgtcacatgtgacaaggaaagttgcgagatggcccaaacccgcgagatcgcgaccgccatagaagacatccgactggctgcaaccacggcaagcgaaggagaggtgcctacaaccaaggtttcaaagagtggagaaagcgaagccaagactaagaaaattcccctagatccttctgatcctactaaaactgctgtaataagcgccgagttagattgtaaataggaaagcgcgctcatcacctttcttcaaaataataaagatatctttgcatggaaaccatccgatatgcctagtattcctagagaggtgattgagcactctttgcacgttaaggaagacgctaaacccatcaaacaacgactccgccgctttgcacaagacaggaaggatgcgatcaaggaggaattaaccaagctgttagcagcaggcttcatcaaagaagtccttcatcccgactggctggctaacccagttctagttcggaagaagactgggcaatggcgtatgtgtgtcgattataccgacctcaacaagtcttgccctaaatatcctttcgggttgcctcgcattgaccaggtagtcgactcgaccgccagctgcgagctactcagttttctggactgctactcggggtatcaccagatccgactgaaggaatccgactgcttgaagacttcattcattacgcccttcggggcctactgctacatcaccatgtcattcggactaaaaaacgcaggagcaacttatcaacgcatgattcagagatgtttctcgactcaaatcggccgtaatgtcgaagcctatgtggatgatgtagtcgtcaagaccaagcagaagggtgatttgatctcggacctggaagaaacctttgcaagcatccgcgctttcaggatgatactaaaacctgaaaaatgcaccttcggagtaccgtcagggaagctgcttggatttatgatgtctcatagagtcatacaggccaacccggagaaggtcaacgccatcctcaacatgaaaccgccaagctcccagaaagacgttcaaaagctgactggatgcggttcgtctcacgactcggcgagcaggggatgcccttcttcaagctgttaaagaaagcagacaatttccagtggggacccgaagcacagaaggccttcgaagacttcaagaaactcctcaccactccaccagttttggcctcgccacatccacaagagccgctactactgtacgtatcagccacctcccaggttgtgagcacggtcctggttgtcgagcgtgaggaaaatggccatgtccagaaagtccaacgaccgatctacttcgtcagtgaggtcttagccgactccaagacgagatatccccaggttcagaagctgttgtacggtgttttgatcaccgtcaggaaattatcccattacttccaaagccactcggtcacggtggttacatcgtttccacttggtgacatactccataatcgtgaagcaaatggacggatcgccaaatgggccttagaactgatgtctttggacatatcgttcaagccacgaacttcgatcaagtcccaagctttagccgacttcgttgccgagtggaccgagtgcaaggaggacacccctgaggaaaagatagagcattggaccatgcattttgacggatcgaacaggctttcgggcactggagctggagtggtcttaatttccctaactggagaaagattatgctatgtgctttggatacatttttctgcatcccacaatgtcgcggagtacgaggcgctcctccacggactacggatcgcaatttctttgggaattagacgtttgatagttcgtggagactcacagttagttgtcaaccaagttatgaaagagtggtcttgccttgacgacaacatgatggcttatcgacaagaggtacgcaagctggaagacaagttcgacagactcgaacttacccacgttcttcggcacaataatgaagcagccgacagactggccaattttggatccaagcgcgaagcggccccttcggatgtgttcgttgaacacctttatgagccaaccgtacccaagaaagaaacggttgaagctgcagacactcaagacatagccatggttgaagccaacaagagagagcccctcatacgatttttaacttcccaggaactcccacaagataaagatgaagccgagagaatttccaggcgcagcaggctttatattattcatgaggccgagctatacaagaaaagcccatcaggaattctgcaacgctacgtatccttagaagaagggagacaattactgaaggacatacattctggcatctgtggtaatcacgctgctgcacgcaccattgtcggcaaagcttaccgacaaggctttttctggcccactgctgtgtccgacgccgacaagattgtgcggacatgcgaaggttgtcaatttttcgccagacaaattcatctaccagctcaagagttgcaaactatcctgctgtcctggccgttcgcggtttgagggcttgacatggtcggccggttcaagaaggcagtcggcggttacacgcatctatttgtggctatcgataaattctccaagtggattgaagctaaaccggtcgtcacaatcacggcagatagagccagagatttttttcatcaacattgtgcatcggtttggagtacctaaccggatcatcaccgatgtcgcgtcccaaaacgactctaaaatacatcctcaaaattgtgcatagaataattaaaattcatgtgaaagtctccaacaattaaaatgtgctaagttaaaagtcaaataaggcttggaggatttttgtatatttcctaaaagcctaaaatgtgtaaataaattttagtggaattttcagagcacaaataataattaagaagaaataaacaaagttaaaatggttttataaaaagaaaaaccctaaaaagtctttcccccccccttcccctcttgggccggctcggcccagctccctccctctctctcctctcccccgcggcccatccggccttcccccgcgcgcgcgccgctgacgggcgggcccgcccgccaccctcgctgacgggtggggcccacccgtcatcccctacctcgcgccgctcccgccgcctcgcccgtgccctagcgccgccgccgccgcggattccgccgcatcccgccgtccccgcgcgcaataaagagggggaaatcactccccgtgattccctctccctttccccccacttttccctctctctctccctcggattcgtttggaatcactcccgcaaacttcgccggcgcatcaatggcggccggatcttccgcggccgattccccctcatccggccgctctctccccctcccaaccctatataaacgctccccgtgcctccctcctccgtttccgccactcgccgctctctctccccgtcggaatcgagctcgcgccgtcgccctctctctccgccgtcgccgccgagctccggtccgccgccgtcttcgccccggacctcctcccgcttcggcatcgcctccttcggcttcgccgcaacctcgccgacctcggccactcctccgtttcgcccgccgaccgccggaacgccgccgtcctcgtcgacccgagccgcgccgccgccttcctccgctccggtcgccgttcccgtcgtcgccgtcgacccggggtgagccgtggaccgccgtttcgcttcccccttccctcccctctctcggccgccgctccgccgtgcctatggccgccgccggcgaccataggggcgcgggcgcgccgtctcccgtcggccgtgccggcgaggccgccttcgggcgcgccccgtggctgccatgtggggcccggccgtcagccgcccgcgccctcgggtgcggctgacgcgtgggacccacggcaccggccggcgtcagccgcgtgcacccggtccaccgtggaccgtgaggctgccgcgtgggccccactcccgtggacccggtccgcgcgcccctccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatttggagtttattagagtaaaagccttttcttttccgttggtcgtgtagacgctgcagcttcggaagatccgctcttcgtgaaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttattattattgttattgttattattaccttgttcaccctagaataaacaaaaccccaactagtggacactctactcatggtatcactagtataaatttaggtagatgcttcgcttttaaataggtaacattaggtggtttttcaactctagactttggggaatattcatatcacctggacactttggaatggtttggtcattgtggaattggcttcacaccgctccttctattcaaaatccctaaaatggttttaggctgggctcggggtgcatggttttgatagtagcacctcggccatataaggaccggtcttcgggcctctgttgcaaagcactaccatacttccacatgtctagtgggtaaggcttagtttgtggctcagtctagttataaacaaaagtacacggatggagatggaagaagtcgggggtcgatggacatctctaggacaaatgaaagctacacgagctgcggcccggtagtcgagatgtcatggcacagggccggtgtcctgctgctaggggctcagtcctgcctccctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaaggtggaatggttggcctgggttggcttgggacgagctgggacccagggtcgggttgccagttcggtctgaatcatcgtaggccttgggttaaggcaggttcgtgtgggttcacggccttgataaataacattgtatagttctaggatcgcatttacaaaatagctttgagcaactaaatgtctttaaatgctgtttactgcaaccctaaccctttatattataattcccttgtactcccttgcatttattatgcatttgtgggtgtgtctggttgagtacggtggttgtactcagtcttgatcaatttttcccaaacccagaaaaggagccccttgaagatgaaggctttgggtttagctcgtgcctgccgtaagcgcctgtggtcgtcgccctagtcttccgctgtttcttgtttgtctctgtgtgggctgggccttcgctgcccgtgtaataaattaactatttacgcttccgcttgttaaactctgatttgtatcaatttttggtgtaccttgcctcctgggacaaggattaatgcacgcacgtaaggaacgcccgttgggttatttccggtcgtgacaaccgataacggcactcaattcacaggcggagtatttaaagacttttgtaaagacttcggaatcaaaatctgctatgcctccgtatgagcaatgggcaagtcgagcgagccaatggcatgatacttcaaggaataaaggcacgagttttcgaccgactaaatccctatgccagcaaatgggtggaacagctaccatagtactttggtccttgcgcactacccccagtcgggccacgggccagtcaccattcttcctagtctatggggcagaagcaatgttgcctagtgaagttgaattcgaatctttgcgttttcgcaattttcgtgaagagcgctacggagaagaccgagtggatgacctgcaccgattggaagaggcccgcgaagcagccttaattcagtcggcccgatatttacaagggttgcgtcgttatcataatcgtaacgtccgatcacgagctttcctagtcggcgacctggttttgaggaaaattcaaactacacgggatcggcacaaattatcccctttatgggaagggtcatttataatctctgaagttactcggccaggttcctatcgactcaagcgtgaagatggtacacctatcgacaactcttggaatatcgaacatcttcatcgtttttctgcttaagtttatctctgtatttccctgtcttgactgacaacatcaagcttctccttgaagttatcagtcgggggctactataataataatggagtgtgatctttatcaattcaatttgcttacttggtttatcattgccttgctcgatttttcaacttagtttacgaggactgaaagtttttaatagcttttgcgggttctaggatcaacaaggcttgacaaaggcttttaagaaatcaacagctaagtatgaaacaccaagcacagcataaatataccagtattgtacaaattgtgcctccatcatctatcatcaaaatcaattgatacatcaatcagtgtcagtcttttcatcatcagaactgccagggccaatctgccgaagatcggtatcttgaaaccgctctaccacatcaaccgcaattttgtcggctgctttctgtgcatcgttgatgagatcgagagcagcttcttcgctcgtcccgtctgcaaagccatcaacggcatcaatgtcaatcttcgggtacaaggacttggtcatcgccagcgccaaacttgctcccatactcccggcttctttaatgttcttgaagtacgtgtccggagcgactctcaacttgtcgaagacttcagaagcatcgaatctactcggaccattgttattaaagaacatcgcctagacaagtagagtagcggcgttggcaacctcgtccctggctccttcaagtcttttgaatttgccgactaagacgtcaaactgagcttgcgatttgatcttgcggtctacatcaacaaaaccatatcaatgatccggcataccaaagagaaactcagagtattgactgacggtaccttcaacgtccttcaggggcgagtccctttgtttggccagctcagctttctcattctccagagcctgaatctgtttctccagtcgggatatcttggcggcttgcactgtattgtttccagacaattaaagtcacaacgatgacagcgtaaactaactggataagttttgtgtttaccttttgacgagccgcttagttcgaaattagactcttgaagttgagcaatccgatcccatagatcgtgctctgtcttcctggcgagctctttgacttcgctcagctgatctctaacagcttcaagagtccctagatgaggaaccaattttttcagggttatggtctttgcctcattcctgagatggattctctgcatgatgactttgtcaatgatcttgccgagaaggaaacgaggtagttgaggtcaggagtcagaggacttacattgacaatacgagttgcttcaccaagtgccttcttcagctggcacacctcttcatcctctttctgccggtttattattatgccttcaggccgcaagtcatcattccaccacttgactaggatgggagggcgagagtcttcagctgctcttatccgaggaatttcttcttcatcgccgaccagtggtcctgatgcatccacggatgaaagtcaaataatcaattgaagttactcggatcagcatggtttaaggcaaggtgttacctgtgataattcccgaacgagggcgagtagattcctgtgctttagccggggatccaggccttgggtcgctaccagcgtctggcccttgagagctatcagcctgagcttcgacttccgggatttcttggcctggccctgtttccgactagtttccagtcgggggctcctgacaggcttcggtttcagcctcggccgactggtttccagtcgggggttggtcacccgggtctacattgtcggttgtcggctagttatcactcggatggccttcgacagtcggcccagtttctttggaggaactcgtctccgtgttagccggattagagtcctttctagatggatctatgtcggatggtttcctacaagtttttgttatcagtattactttcatactgggagcgcatcaaaacaaggaaaggcgttaaatggttcgtacctggaggattttctaatctttggcatggggcgactagacgttttcttctttggagcagcatgcttcggcggttttctgggtgattcttcatctccagatttcttgccattgtcgccttcgtcgtcgctcagcactaattttctcttgcgggaatctgattgcccggctggattggaggttttaggctgaggttcggacctaatcttcggtcccccactcccctgaacggtctgatgacgaggagatcggcgctgagcaattggggggtcggacttcaccaaagcaaactcctggacaggatacccgccactgtcagttgattcaacaggaagacaagactatattttgagcaaagttggaaaattttgatacataccggtggaggtggattgaatgcgttatatggtacgactggcagcagatgcgtatagctgacgacaatggcgttagagaagattttgtacatcctctccttcatgatcttaaaatccagggagtctgagtcttcgtgatttggatcatgtttgccatcaaattcaaaagccgtgcgggatctctctttgattggagctagccgacttttgatgaaatgccgagtgatctgctccccttgcaaaccttgctctttgagcttcagcatatgttccatcagttctacagcttgggcagcttcatctcccatgggcagcgaattccatgtgtcttggtagaccggaggaagacaggagtactcggggagtgcaggctcagggttttgaacatagaatcagttggcatgccagcctttgtttgaagttttgaagggcatagagaagtatttctggctcaaagttcccctaagttggaaaccagcccctccaacaacacatggtttgttcttatttggctggggtttgaggaagaaaatgcagcggaacagagcaaaatgaggcctaatgcccaggaaagcttcacaggcgtggacgaaattggcaatgtgaactatggaatttggattcaaatgatgcaagttgatcccataaaaattcagtatcccacgaaaaaatctcgaagttggaacagaaaatccgccataaaagaaatgggaaaagaccacgacctcatgtgtatcaggggttgggaaagcttcaccaaataccggatgccacccgatgatctccttcgccggaagaacgccgtgcgccaccatctccttcagattttcttccgttacatcggacggcgcccattgactctcgaaactttccttttcttctgccatcgattcgacctgaatgggttgatttggttcgaggaatggctggggagggatgcggaatcggagcggtgggtgcgcggagaaattttgtggatttttgggaatggattggggcggattgacgaaccctagtttcgccgacgcagctctgtactgtagcaaggagtgggggaaatggtgagagttccggcggggaagacgaagcgtcacttagacttcggtgttttgttaagggtatcgaaggtgctaatgggcctaggcctgtacagtacttcagcccaatatcattaacagcgtggcccgttgtgatccctagggacttaggcattttttgctttggcaatttgtgctcacaatggtgtgacccgatgttgtcaaaatcctttttctcgcggttagataattctttggaattactacgatgcaaataaaaaggtgcccgacaaaaaagtgttatactacttttgcaagcctttttaggctacaaagctgtttgggttgatttgagatggctcgttttttaatagtcattctcttagcatgttatatgcttgctttgattatggtgaaagtcatagcttaggctattagacttgttaattaccataattttttataatatttgatggatcattttaaagagtttttactcggattcttgtcaaatatacctatttgtggaccctttgagtatcattcactcgggctctttattcttgatataataaggctgaaaagcagtcggctggatgtttattgaaagccgtacatgcttggctatatgatgtttggttgtgaaaccatttggttcttgactacatgtttagttttttaactaatcatatagtcgggggctacacctaattatgtgcatctattcgatgcaccatgttttattttcgcccttcacagtcttcgattatatcactcggcaggctggagtagcaagaattaaagcactcggattattcttgagaaggctatttcgtcgactgcaaaggactcgggggctactgtggagattatggataccccatatctacatggcagttatagttaggttggatatagggtaccgaatatagataaaatatctttataggaactcgggtttatttcttaacttgtacgtcaagaaagtacccggggtcttagtcggttacgattgtattttatctgtaacctcatgttccgttagggatatggactgtattttgtaatacggaccccttctcctatataaggaggggtctgggtccttcttgggacacgatttcctccaatatcatataatcaataacacactcggcggattcatccccggacaggagtagggtattacttattgaataagaaggcctgaacctgtataaaattctttgtctccaaacccatccacttttctaacttgatagccacccccttttagtattgccgaaatcttgtttcgacacctgatcttaggagaacggaggtgaatatcgtgtcaaccgaagtcatcaagctactctatttaactagtctgcttggaaagtttaagcttcaaaataaagccaagagattgaacgaactgcagaaatttttcagcactgctatacatacgattgtttttatacgacatttgtacgatgaaacgtttctctcctaatgatttttagcgttgaaacggatccctctccactgctgagcccatatccaaagcccaacagctcctgacttcctagcctgctctctcgttggcatgcctgcacagccaaccaaagcaatcttctttctaattatatacttcctccgttttacaatgtaagactttctaacagtgggcaatgctagaaagtcttacattgtgaaacagagggagtattaagcaatcttcttcctaaataaatcttatatagttattgtacttagcgctcatttatcatgtggcaggttaggcaaattactcaaacatttataatcccaccttggacaaggatagcatcaaccctagttggaagtactattccatcccataaaaaagcaaatcctagctacgaacctggacacgcatatgtccaggttcatacctaggattagattttattttattttattttattggatggagagggtagattctaatggccacaatcggaattggatgcagaaaaagttcatatacgaaccaatgtcaaacaagatttacatatgtttggatagagagagaggtcctagagacaaacttaaagccaaagtatagtgctgctcaagtttctctgaatatagatcttcctgaagtcctgacttcctgctgcatatagatctttaatgctgacatgaacgtatgatcggtcatcttaatcacttcttttgtttatgagagatgcttgatgcatgctccacggcaataatctccttttattttctttgcctgatgttccatgatcagtgagctcttttctccttccattattgttggtacaatattgttcttttgtaacattcagtttttacaactttggttaatgtgtcctgccaacgcacagagacactatatccaagaatttttattttatgacttgattatatggttagataatgttatgtaagtgtagaatcatgtgacgatttaatcttggtgatgaacaattgtcaaaagtaagttgtcgacgggtggtacccgtagaccggatatagagggtattggggtacgttggtacaaggatctacgtaatacgacatcaagcagacaggagacaagagttatactggttcaggccccttgataggtaatagccctaatccagttgatgtgggattatatggtgaaaaacacaggttacaaaggaaacaatggaactcgtcggatccggcgagatcgtagtcgagttggttcgactagatctcgatggcttggctcctcgcaggctccggcttcgtaggctgtgtgggttgtgttggctctgagattcgatgtcataagcccttcccgggggggtcccttttatatcgcagatctggaggtctccaagtagaacgcggaggtatcagaccctatacgatacgtcaatgacccagtcctgtccgagtaggattcttcccatctgtagattccgtgaaaggtttccttagaatatacaggaagtatccgcatgcgcgtgggtatgccataccgatatgtaacgtatatcgaagggtaaatggtatgcctaacccgtaaccctgacataagtgtttattgaaaatacagtgaatagtatattcagatattagtgaacggttttgttggcattgtgaggccagtcagaccgggtgggtgccaccgatcagaccagtggtggtttgtcacgcccggaaattcactagtaatttccgaactaatttgtgcataaaatcctcgtccaggaaccagccgaggtacacaaactgacaatttaatatacaaatccatcataataataacgttacatacttacaaaagaaaagaaaaacagcagcggaattaacggtctagcgatggcttcagctccactcccacaggcagctcaactggggtataaaccaaacgtcttctccttctggatcctttatcttcaactgaggtttgatgattattgcaagaatgagcatatgacatactcaacaagccacacagcaaaatatgcaagtgcacaaggattccaaaggatggcataatataggcttatttgcaaaagcagcatttagcaaagatttaagataagtaaaacagtagagtaattaatcatcgattttaatcaacactaaacagcacacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcagtaccaccacggtacctcggaaaggagttgtgacaataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgttttacaacagtagctcgcgaaccggtccttaattgtcatgagcacgaccttcaaaaccatatgctcacaacccaccattgacaagttttaattaccaatt

SEQ ID NO: 66413 - DNA, 1058 bp, Oryza sativa
tgagttcttgggagcaatggcgccgccgggggtgggggtgggtgtggcgtacctgtgggggaaggggaggggtgggcggaaggggacgccggtggtggtgaccatggagagtcccaactactcggtggtggaggtcgacgggcccgacgcggaggcggagctgcgcaccgccgcggtggccatggacaagggcggcgggcgtggcaggagcaggagcaggaccgccaggcagctcacctgggtgctgctcctccgcgcgcgccgcgccgccggccgcctcgcctccttcgccgccgccgcggcgaggcgcttccggcgctcccccgctgacgccgccgacgagctcggccgcggccggggacggctgatgtacgggttcatcagggggttcctggcgctctccctgctcgccctcgccgtggagctcgccgcctactggaacgggtggcgcctccggcggccggagctgcatgtgccggaggcggtggagatcgaggggtgggcgcactcggcgtacatctcgtggatgtcattccgagccgactacatcaggaggccaatcgagttcttgtcgaaagcttgcatcctcctcttcgtcatccaatccatggaccgtctcgtcctttgcttgggttgcttctggatcaagctgaggaagatcaagccgaggattgaaggggacccgttcagggaaggatcagggtatcagcaccccatggtgctcgtccagattcctatgtgcaatgaaaaggaggtataatttagctgaattctcatcggaattttgtatactctgtagttttgtagtgtgttatgttcattcattgtgtgtgcttactatgagacaggtctatgagcagtcgatttcggcggcttgccagctagattggcccagggagaagtttctgattcaggtgctcgacgattccagcgacgagagcattcagctgctgatcaaggcagaagtttccaagtggagccatcagggtgtgaacattgtgtatcggcatcgggtgctgaggaccggttataaagctgggaacctcaagtctgcaatg

SEQ ID NO: 66414 - DNA, 1759 bp, Oryza sativa
ctagtggcatagcaatcagtctatattagccacccgtgggcagagcatagctaagaaaatttggttttgtataggcacgtgtttggtttattaccaactcctgggcatctgaggcttagtattttcagataattcatcatatggttgaaacagattatttgctttacatttttttttaaaaaaactacagtttcttaaaaagaaatttcactgtattgctcagtttattagttttaaactatttttaagtttgtttattacaaatattttatttatctttataattaaataggtagtctagagcaataattcgatcaataatctgttgtaaaatgagtcatagggtagaaccagttaccagtccaaacccatgccttgggctggtctaaaaatctacattttctttgcatctttttgtgggattttaaggtaacccctatgttgaagcctttattagaccactggtccatttgtcatataggagtatactacaacttttggtcaaaacttacttgttgtcaaggcaattctttttctgtgccccaaataagcagattctttatagatttttcaaaatataaatattctagaaaatccataatacagtttattgcggttagaccactataatgaaaaacaattatggttaacagacaatatgcgactcatacaagatttttcatttgcttaactgtatcatgatcgcacaaacaaactctttctgacactgtcataagcagtctgttttttttttgagggaataagcagttactttgtgttcttactgataatctgatactgtgatctgatccgacagactagaaaaggtggacctcaggagagtgaggagcttggcgaagatattcggcaccaccgtctgcgtcggaggagccatggccatggcgttcttcaagggccccaggctgctcaactcctcctctctgatcgtcgacctgaactttcttctccactcgtcagcgagcagcaagtgggttatgggcgccctgttcctcatctgcagcagctgctgctggtcactctggctcatcttgcaggtgccaagttcgatcgcctcactcaaccatatgcagccatgccaccaattgccaaatcttgttcagatgtaattgtacatcttggtatatatccagaactgataatcctgacaagatgtgttgtaggtgccaatctgcaagtcgtacatggatcccctgacgctgtcggcgtggatgtgcttcctgtcgacgctgcagtcggcggtgctcgtctccttcctcgtgccggacatcaacgcctggaagatccactccctattcgagctcggatgctgccttttcgccgtaagctataagctcgctcgatcgcctcttcttcaggtgatcatttctactgtgatgttgcaaacaaattaactcgataaatgttcactgccgcagggcgtgtttgggtcaggcgtgacgttctacctgcagtcgtggtgcatctcggtcaggggccctctctactccgccatgttcaacccgctctgcaccgtcatcgccaccgtcgtcgccgccgccttcctccacgaggagctgcacatcggcaggtgaaaaatcgatccatcaattggtctaatttcatgtaatggagttgttctaacgacgagatatttggttaatttgtgtcagcttgttcggggcgacggccattgttgccgggctgtacatcgtgctgtggggcaaagcagcggatggcggcggcaagagcggcgggagtg

SEQ ID NO: 66415 - DNA, 5570 bp, Oryza sativa
tttggaaccaattttgaggacaagaggtggatacttgcattgttagaggctatcttcaggtccaaaaactcaacatcaatagtgaaacgcccagcgtacatcgtatcaagttgccagaaaaagtcttcgctgcttcggaggagatgctcatgcactgtcaggaaaaattggacaatacttatgaagatcaatgaggctgcccgtaacatcagtaaaacatcactgcagtagctatagaagcaagatgactatggaatgacttggaaataaaagccattgggctgttaatgcttgaaagtgaacattaccctattttcgttctattcatattataacaatgacaaagccacccaaattccagtaaacctagtgtcctgtgaaaattagaaaacagacaccttatgtttcatgaaggagatggtggagctgttctgagcttaaaaaggttcacccaaaactaaagcagtagaatggaaggtagaaacagtcttctgcgtatagcccttccctttgagttattgctcacatgatagttggaattaaaatgaaagtgttatgcaagaaaacaccttttccccccaatatgccctacgagtatttcatagagaaatatgatgaccatatgcatagggagggtctgactctttgggagcatcttcaactagccaccatacctgaatggtgaatggtactactagagtagatagctggtaagggaagtgaagaagtgctctattagacaatttgcagatagcatgttaagtggtcaggtcaggtcaggtgttcaaagtctgaagatggcatggagagtgaagacaagacatgcactaaaacggggatggtccatagcctaaagctaaatatggtggtggtggcaagaagaaagaagaaagtagaggagtatatgtaccaggggagacgcaggagcggcgtggcgggccggaccagcaagctcggagaaggaagcgggcgagcgggggccgttccttggccacccgcccgggctccgggaacagcctcacgtatacatatcgagccttctccaccgataggtacctgcacggattcggatcgaattggcggatgatttgatttgatagggcaaatcggtgatctctgagtagtgggggattgggattgggaagggaaccagttccagatgccgatcttgaaggaatcggagcggcggtaggaggaggggccgaaggtgtcgatgcgccactgggccagccgggagatggtctccacccggttctccctctccatcccgccgccgccgccgccgccgcgccgtctcctctcactctacttgtaataactcccggtaacataactcattaacttttcctttttcctggtcaacaacatttttcttatcttagaaaaaaacaaagagataaactttaagcctgttcagattgtagctaaaataaaccttactaatttttagcaagatggcaatattactaaaattttagtacgatttcttatatatttatcaaatttagtaacaaactaaacataaattttatttggcagctttataaaaaataatatggttgaaaatggcatcaaaatgaacatgccctttccgagacatcacatttttatgggtgatgcaatgtatcaaaaaaaatacacacaattttgaaaagtaattttgaaatagaagatttctattgtagtataaatacacacaattttggaaccggacaacacaagatgctcaagggaagaatgccaagagaaaaaaaaattaaagaaaaaaaaaaggtcccaccgggattcgaacccaggtcgccagattcaaagtctggagtgctaaccactacaccatggaaccattattgttgctaattatctctgtaaacttatttatacaaataatattcgttagagcccacttgagacggcccattagtttatagaatgataatagctaggcctctttcgtcagatggttcgaccttccaagtccaactgtacgcaccgcttcaaatctgtttgctccctcttcaattattctcctacattgtttacgaggtttagggcttgttccttctaaagaaattgtaatggaaaagtactgaaatatgtcatcctttaacactaaactgcccatttgttttaaagaaactcacgaaaggcaaatttcatatccctctactttaggaggaaaaaaaatccacctcaacataatgttttcaatcctttgtactgtttaccgaacaaccatagaaaagtttactatgttttcaacccttaggtttgcacatgtattatcatatattcctacttttttttctatttttatgttgtgaaaatcctacaaagcaaatgagcccttgagggaaacaaaactttttttttaccaaaaatgtggtgacacttttgttcatttcagccctatatatgtaatctctctctctctctcattttagtatataactatctctcatatcatatcttctaggcagttgattaattacttttaattttgtttctcttaaacacatgtattatcatatattcctacttttttttctatttctatgttgtgaaaatcctacaaagcaaatgagcccttgagggaaacaaaacatttttttaccaaaaatatggtgacacttttgtctagttcatttcaaccctccctctctctctcattttagtatataactatctctcatatcatatcttctaggcagttgattaattacttttaattttgtttctcttaaacattgtgtattaaaaaaaaatacaatgtaactgcagaaatttataatataactttaaaaatttacaatgtaaatgtagttaatatatagcacaaaaatgatttgactattttctatttaaattgtggcgcaataaatatagctagtcaagaaaatagaatatctctaccatatctatacttctttaaaaagactctaaagttgtgttcttttgggcgggttgggaacctctcacctccacatgcaaaacggagcgatagattaacacatgataacgtggcaatgatgcatctgtctttccctacctatttccgttgtagcttttacatattacccacttaaacttcttaatattacataagaactaaatctaaatagatagccacatgtaaaattaaattaagataactattccatataggaaaaggtagataacatatctcacaaaaaagtacttttctttattttgagaaatattgtgatattttttgtacttttatcactagcaaagtgcgacatttagctagttagaaaagctagcatacgtcataccatcccggtacgtatataagacaatatagtcatgtagtccacacgttacagccgaaacatggccataccttatgctcaatgtccccatgcccaagcctagccatgtgaccacaccttgattctccacattcctcctctactaaattgctcatgtcgaagagcatatgcaggcctagcgcaacaaatacatgcagctgcgtgagccgatttgatcatacataactttctccctagttttttttgttcttaacttaatttttccccttcatttcatttgatttcatttgtcagtattaactaatgcaccatacccttttatttgtatatcttaaatttcttactccaagcactattggagctatgcatatcgactggtgataccatgataatcttatgtattcaagggcaaacattaataatatttagcgatgctacattgatgatactctactaatgcaccaattacacttatagcatgctaaagataatcgtaaacatattatacggtcaatacaccaacaataatgataaacaatgatgaaaccctcaatacaatgatgatattcatgacacattgatacaccaacggtatgaagtggacaatatatttgacatgccaatggtactatcacccaaaggatatctcaaatacaacaataccatgcctataatacctctcatgcatcaacaataacacgttgatgatacctccaacacacatatagtactcaaattggaatatcgatgatatttgaaatacattgaccataaaaaaactaagaactcaacattatgatatatccacaatactatagtatcatgctacttgttgagtcataatacctttgtggtaccatgaagaatcattgatgttttgtgatacgtcttgatttcatcaattcatgatacccgtaggtatcacggatatttcatgatacctataggattaatggtaccttgtagatatcaccgatgtttccatcatgacaccttgtggtatcatgatacccgtaggtatcaccaatatttcatgacacccaaatgtattaggtacctttgttgtatcatgataccagttggtatcaccgatatttcataatatccatatgtagcatggtaccttgtggtgttatgatactcgtaggtatcactgatatttcataattcctagatgtatcaggtaccttgtggtatcatgataccaatagagataccatcgacaattcatgatacctttaggtatcaccatgtttcatggtgcccatatgtagcatttacattgttgtatcatgacgtaccaccaatgtttcacgaaggaatcctctatataggtgtgtgtcagggtttaggggtaactaaatttctatagtaacattatgaagctatatcaaggttgtaagattatatcatagagatatcacctatatttatagtggctttcatatagtgttgtctgataagccaacaagtagataataaaggcctatgtaggtattactaaggttttatatatggtgctatcagtgatatgtatatcacaaaattttcatgaacgtgttgagctcatcttttcccttcgtcggtccagcccaactgctatctatcctaattagagagggaggcatgctatcctagaccaaaacacacaaattatgctgacaagaacggccactaaagccagcccaatccggccaatgcacaaagcttaatctagcatgggctatgtaacgcgtgcgggccgatagggttccatggctagcacttaagcaaaataagtgctcagctcgcgaaatagtggcacgttgaacataagtagaagcactagcaagtcaggtataccattaagatgatatatcgtacgctagttgctccctatgtaaaaacatagcggaaaaaatatggttccctatagtttttttatctgtagagaacaaagggtagagggcccaccacactcttaccatcgtctaccagcatgcagaaaacaacataggcagtgccataaaagttgtatgggacaaactctcatttgcttcctaaatttttttgctttgacccaattttgtttttttttcgccatctctcatctctaatatccccttttcttatgctccttccatcccaaaatatatatacaacttctagagttcaaattttgtcccaaataaaacaacctaatacttgtaaaagatgatttttacaactaaactacctatactaccccttaacttcattatcacctgaaagtctaggtccacaactcacccaccttgagga

SEQ ID NO: 66416 - DNA, 14917 bp, Oryza sativa
aaaattttcatcccaattaaaaccctgctctaaaggtgcaatcctcatcgaacctaagactagcatcaggttacttgtgctaggcaggtaggtaacttgtcctcatgcgtcccactattcctagaggttctcagttaagtagatcgaggaggaggtagatgtagtaaagaggtggtggccttggcgtgttatctaagagtgatgtatgatcgtgtgtcatttacatcttaaaattgtagccttaaaaatacaaatcttaaggggctgtgtgttgtttagttgcctgaaaacaagaaaaaattagtaaaactttgaatagccacaatatatcgttttaagattcgtgcaattccctaaccctaccatttcttatcttcttccttacattctcgacacaattcctctttatccctcccgatcccccaacccaacacacacctcctcttccaccatgccatatgtacagaaattgttctactcctaaccagatagagcatggctattgatttcactagagaggcgtagatgagctttagtgtgccccacccttctttgtgccatcgcccccaccatgctctttcttcattttcccaaagagatacccggctcgccccaccttgcctgtcggattatccaccaactcctagttgatcacctcacccctgccaacaactgaccctctccttgcctgtggctccaacgccatcactgtcaccttgtaccatataccttcaccatcgagctgccacctccacagccatccctctaagcactacaatggtgctagctttccttgacgaggcattttcatcaagaagtagcgcaatccacacgcacatatgctggagagagacgttgatggatctattaaaggggatgggtggatttgggggtttgcgggtgaaagggcatacatacacacgctgatttagaaaacgaatgccggacaaatgcatacggtccatgtaaacactggaaaaatgcacatgttttctcttacttacacgtggggctttcttgaaactatatattattgattagttatatgatgaaaatacttgtacacctatgctagtacagttgttacgactaattaggcctagattatatatgacgaatttttccatacaatcccatacttacaaatgggaccaactttgttgtgggctcatgaggaccctgcctaccaagttatacaacaaaattcttcgtcaccgtgtgatagcccaactattaatgacaaaatccacggcgtttgtgatgagcccgtttgtcgccgtgaacatatattatgaccaaggcctccagttattgctaggattggttgagggtgaagtttacgatgactgtttaacgaatttgtcatagatcaatgacgtacggattccctattcgtcacacggaatgcgtagaaagcctatatctattttattgaagccctgggaagcccccgccttccattccccccaacccctctctcaccccacccaaccttgggacttataattggtctgtgctgccatctttaggcattgccggagagaagagatgcttgctagaggaaataaaatagctgctcgtggagaagaagaggtgcatgaatttccatgttcatctaactattaaactatacattggaattttcgaggaatattttaggtgatagaaaattaatccccaaatactaaacccttagaatacattaattttcacataatacattacttttctgtaagataagatcggaagtgagatatcatggggtactcaatttgggcacatgaataacaaaaggatggaaacaactgatgattgcgttagggtggaccgccccagccggtgtgttatgattgcagtggtagtggaagttgctatccacgtatataatcccgcggcttcaatttcaattatattcgttctgttgattaacagtgaaggtatctgctgagtttaagcaatgtagcaatctactatctacctagctaggtgtactaacaaactgtgttttgtatctatcaactaaaaacaacacatgcagaaacaagtgatacgtacgccatgatcaatataatgttacattatatttaaacaatgataaaatatatatatatacaaattaattgatcaatactatatatactgcagagaggtggtgtacacattaagcagacaacgatatatgtatacatatatatgatgtatatagtgatagtgcatatatatgtgtatatatagcacctaattaaatgctagctaacttaatcatcatcagttacaaacctctctcagcaatgaggtcaaaagacgaacaaccgatagatacacacactgacactagtagctaattaattaagaatgaactaacaaccgtgtactgacataagctagatagtaagcatgcagatggcctgatgatggccagtggtcaaattaatgtatacatcatggagacggagtaatcaactaattaatagtacactcgatcgtttaattgtgcgtatttgtaagaattcatgcatatatatgatgaatgaattgtcaattgataataatcgatctggatcgatcgatcagtctcggtcatcgatgaagcctgacgaagaaatgttgttgctgttcttggagctagaagcggaaggcaggtggtggaagagctgatgcgccggcggcggcagcaagctggtgagcaggttccagtcgacgatgccggcttgctgatcgacgtcgacgcagctgctagcctgcgagacgtagccctcgccgtcgacgatggtggggctctccagaggcggcatcatgtcggagaagtgaagcttggactctgaactcagaatgttgctgtggtcgacgacgctgttattgttgttgttggcgaagagagctgaggcagcggcgctcatcaatggccgcccggcgaagctagggttgtcgtggtgcagcagcaagctgtagttgtcggggacggcggcgtaggctccggcgccgtagctgccggggatgcagccgtaggacagcctgtgctgctgctggttgggcatcggcttctgaaacgcgcggcaaaccacccaaccttcctcctgcatccatattccatattaatatccatgaattaacatatatagtaggacagataattaagtaaagaagtaaaaaattaagatggaatggaataggtggttgcaatgcatgcctgagtaggggcgtgttcgtttgattggaggcggtactcgtggatgatccagtcggtcttccggccgttgggggcgcgacccttgtagaacaccagcgtcttcctcatcccgatcaccctcgtcgacggcgacgagagcaccggcttgtcgcggccggtggccttccagaagcccgccgccgtggcgcggttggtcctcgtcccgctggggtacttgcggtccttgtagctgaagaagtaccactccgtctgctcatcgccgccatgcccaccgtacttgcaacgctctgccacatatatataattcatcagaatcatcgatcgttcagttcccaaattaattgctgaattgatattaattatgcatgaatagaatgcatggtttatttaatgtaatggatcagtacgtaccttgcagatcccatggctcgatcctgtagagatcgagctcctggatgatgtcgagatcgatcttctgggaggccaccttcctggcgaggtagtagcccaccagctcctcctccgtcgggtgaaacctgaaccccggcggcacacatggagactctcctgcctcctcctcatgccgatccattgctatttcctccgatcgaccgatcaattcttctagctagctagctaggagtatcgtgatctttgctgtatatatatctagctgatggatggttggaatttgattgcctggtgactctctatgcctcgatcgattggctgcagatcaaaacaagcatatgcagaaaaagctatatcatcatcagctatatatatgtcttcttcagatcgatgctcatcaattttcagcccaatctcagattctcatgagtgtatagtagctatagcctatagctagagcaatgaactgcatgcaagtgcaagtgcaagcgcatctggatgggtccaaggctggaaaagctcctagaaataggacagacacggccactcatgcaatggaacatgacctaatcagccagccagtagttgcaccatacctatacaacctagtcgtacatacatactagtaagtatacctttaaaccaatcaatattctgaagctagctaggtcgaccggggagactagcttcatgcatcagatgaatattagaactaattaagaacacggacagtcagcagctagcaagctgtacacacacgcctgtacctactaattaattagtactagcagtttgattagggacaggcaggcatgcatggactatagcatatatatgcagctgaaactaagggtaccttccttaagctagctgctcagcttgtaacacaccaaagttgggcttctgctgcatgcatgctagctaggagagatgagaactggaaagtagtagtactggcttgtggacagtatgagaggctttttggagggtagagagagatctacaataataataatgtgtgcaatatttgtcttcctagcttggagtgcacttcagggctcatatccaccatccatacaaccctctctcttaccatacagccatatagtactagtactagctcctcctttcccaatcttacctaaagcctgctgcttgttgagctcctggtcacatcttcaatatttctccacacaaaaattatatgcgaatctaacataatactgcatgcgcaggtatgtaacaacgactcgtgcatatataggtacgacataccaacaaatttaattaagatcatgcatgcaagaaatatgtactcgatccttagtttaattggcatatatatatgacgaagtgcgcgtgcactcacctaattagataaccatatgcatgaagtacagcgctacagcagcagccagaaggagatcttctcccaagtcgatcccaactataatgaacactgtatatattatatatggtggctgtgtagctagctatagatgagatgagatcaaaagatggatcgatgatggcaaggaatttagttggtatctaagctaagggagctttgtgagctatttatacatgagaaaaagcgagcttatgagtgcctgggctgtgcaaagatgaggatatgcatggtacatcatcgctcgatcgagtagcgctatagtcatgcttaattgaattaagtgcgcgtggagtggagatcttcagcgcgtgtagaatctagaccgagaaagagacaccactatactgtgtactacagcatgcattcagagagagagagagagagagaattaagcatgcagcattgcagcagctagctagctatagctaacttgtttggtcggttaacaagtcaccaagcgaccaccaccactcagtacatgaaagcgactctcaatttgttcccagcagcgcctgctcagacttgagtacaaacaaactctcatcagctaattaaactagcttaattagctagctagctagctaactacacatccatcgatatgatatgatagctagatcgatcccgatcatattcttccgcgtttataatttgtcctattgaattgaaggaaaaaaccactagagatattattaagcagacaataacatgcgcaaaaccgttgctttctatatatctcccccgacccggccatttaattaattcctacatatctcacttagtgtatcctaatagacttatatcttagttctcttagtgtgtatacatattttttcccaaagaaagattaatatatagttagttagtttaatcaacaactgtgctatatataaaactagtgcatgctctatcagattgcatcaggagaccctagctagtaagatatatatagtaaaaaacaaataagattgcctgataagaaaggaaggaagggatgatacatgcattgtatggccaaagttgtctaccatatccatttttccgccgttatattgagcttcaagggtagcttttgctacttagaacagacgctagctcgatctagctaggttgttcttcctgtacagtatacatatataattaatcattgatttgttttgacagggaagggcatgatcatatgtgtgcgtgtggagcccacaaatcatacgctagctagctaggtatggtacgatgtatcgatcgagcaataatactggcctgcagctactacatataatatgaatgatcgatatatatcatcctatatcttggccgggatcgagggaagcacactacataaaatacatatatacgcatcattgcttgtgttgcatgcttgcattgctattctcgtctctggccggccatgacaataatatttgtatttacactaacactagtgctttgttctagcttatttaagtttggtggttgtcactgtctggcttggtgaatgcacgtaatgtctggctccacactcaaatgatcagataaagacggctctagattcacgagatctctacatgatgtatcaaattcatggtaattaataatcaagtcatataacccatatttggaagctaggagttctctagaccgacctgctgcaccgtaattaaatggtaattaattaatcaataactaaaagagatcaagctaagtgtgttcatatatatataaatcaaacttatcgtgtcctctatagatcatagtagccaacctgcccccactaacaataaccaaccaatcaacagtagctatatagcttcatcagtattatattttcctatagtttcttttttgcttctgttccaaggtttagtgtggatagagttgatgtacaatagctagtaccgattgacccttcttaccatcagttcgatctgatcacattatgctagagtactatatatatattccatatccattaattgctggaggtaagttaataatttcatatatattccatacccctcgctcttggtagcatttgtttgcagacagattaaacatgtaaagtacaaggaatgcatcatccatgatatatatgcagaattgtcactactatatacaaacatttatttgatagtgtaattaaaagaagagaaagagtaatatgtactggtgattaaatgttactacatattcacatttcatgtgcctttggcagctaatgataaacacatactaggatgagatatgaagtttcccagtatgtccagcagattcattttacaaggaaatgttacatcctgtcctatgttgattttttatgggacggtaggagttgtataatatagtttgtttttcttgtaagattgttatgtatgataagcgtgtgcacattttatcaagatcaatatcgctcattcagtcacaagtccaaaaaagaacaccatagaagtagagtcaatctattatattattaaaatagccttgaaagaaggcatgacgttcgctgtggaggttacaaattcccacattaatcggagaaaaagaaaaaaagaagagttcaagtagaatataatttagaaatatctgaaattcggaattaaatataagaaaaattggaagaagagtccttatataactgaatacgagattaattaaaatttggaattaaaaataaaataaattctgaaattagaaaagaaaaaaagatttcaagtaggaataaaagttagaaatatcttaaattcagaattaaaaataattaatatctgaagaagagtcttatagaactgaataagagaataattaaaattcagaataaaaatagaaaaataattataagagttcaagtaggaatacactttataaataaaaaaaatcagaataaaaaaatatggaatttttagaaaaaaataatcaacctagaactcaacgacgacaaataacaatagcaaggggacaagtaataggcctgtaaaacaataaggtagtgaatggttgatgggacatctaaaaattataaacaaaaccataaatagaaccccaaggacgattaagaagtggaatgatagacaagacgttaagcagcatagtcatgacggttggcgggacttctataaagtaaaaaaaataaatcgaaataacaatcatgttttacttttaaaatctcaatgataataaacaggggagacaacgagcaggccatacaggagtatagtggtgtggagccggcaacggttggcggtacttctagaaatttaaaaatgaatccttaaaatttgaaataaaaaataaaataaattttgaaaatagaaaaataattctaagatttcaagtaggaatacactttacagataagaaaatatcggaatgaaaaatatggaattttcagaaaaaaaaatagtccatctcgaactcaacgatgacagataacaataaaaaggggagaaacattaggcccgtaaaggagtaagttggtggcagttgatgcgacgtctaaaaactataaataaaaccacaaatataatcccaatgatgattaagaggagggacgatagacaagccgttaagtagcacgatcacgatggttgatgggacttctagaaagtaaaatccaatgacaatcatgttcaatttttaaaatctcaatgataataaaaatacatgagtatagtatggcggagctggcggcggttgggcggatttctagaaagtaaaaaatgaaccccaacgatagttatattcaatttttaaaatcccaataacaataaatatgggagacaacaggcggatcatagagaaatacaatattgacggttgacaacactcctaaaaattataataacagaacatgacgagacaatggactctaaaaactagaagatgtttttttaaggtttaaaggaaggtaaataaaagccgtgatagatcgggtaaacaaataaaggagttataaaagagtaagagttaaatactataaaaatttaaggatgataaggttcgatcttttaaggttataagtcaacataatggccactcactccgtttcacaatataagtcattctagtatttcccacattcatattgatgttattgaatctggacatatatactccctccgtactcataaaggaaagtcgttttgtacagcgacacggtctccaaaacacaactttgacttattgtctctataaaaatatttattgtaaagtgatatatgtatacttttatgaaagtacttttcaagacaaatctattcatataatttttacattttcaaactcaacaactcgagagttattcatgatttatatttctaaggtttgacttaaatattgtcctaaacgacttcctttacaaatacggagggagtatctatctagattcattaacattaatatgaatgtgggaaatactagaatgacctacattgtgaaagggaggaagtatttaaaaaaagtaagtaatttcaaatatagaaaaatggataattttatatgtgtgctagccgcgttgcacgggtcacccagctagttctacatataaaagaggggggtggggagggggatcgtcaattccctaggagctcgggcttcaactatacatacatgtactgtatttttgtgatatttagctttaaatctgtagttttgtgataaatttattgttaaatttatagttttatgataatttgctcaaagtacatgtaagttttgtaaaatttactcattaattaattatgtgcagtttaataattagtaaaggtttcttgtaggactgtactgtgtatggtaagcgtgtgcatgctttgtcaagatcaatatcgcaaagagagatcatgttgaacacgccacagatctatcgatcgatgatctagacgaacgtacacatatcgatccatcgaatatatgagacgtctagcttggatcgagatggtgatttaatttgatcgttcgatcgcgatggatttacgcgtcatccatggactagtagctagcgatccaacatcgatttgtctcatttttacactggatctgatcaatcaatctctcctatacagtgtcatcagaagctctagctcagacacagggcgctagctagtagtagaccaattattgattaatcgatcaatacccgcgctccattccaattctcagatatcatttataataaaaacgtacgggccgcagattatatttgttgaataattaaatttttgcagatctagtggaatttaaaatagttatgttttatatgcatctcttatttggttcttgtaaaattttaattgtatccaatgtgtaattatatcaaccaatctaattattataaatattagttgaacaatcgcattacgatgtttatatttctatattttcctacttttgtaaaaaaatattttttgagataaatatttcgagcgtatgtacgtacgtacgtcgtcgctgtctcatcacatcacttggagtcttggatcgatcatgtgtatctggagaaaaagaagatcgagagagagagaagaaattcctagcctagctagatagctactacaggcagatcgaagcagactcttctccctaattggacctcacaaacgccggctgtcccctccactcggaatcaggcaactagcagtagtcaaactaaggtggtgtttggatccaatcatccctatcatatctgatgtttgaatattaatttgaagtattaaacataggctacttataaaactaattatataaatgagagctaattcgcgtgacaagttttttatgtctaattaatccataattagcacatgtttactgtagcatcacataggctaattatggaattaatgggtttattaatagtctacgtttaatacttctattagtatccaaatatccaatatgacatggactaaaaatttttagtcccatccaaacagcccctaatactacatgctgcaaaggaaggctacataaagctatcgctaacaaatactctatccgtcgcaaaatataagtatttttggatcttgacgtacacggtctccgagatgctactttgaccaacaatatttataaaagaatgatgttttaaataaaaatggttgtatattatgatagtttgtttaatgataaatatagtaaaatcaattttacatgattgatatttttttatttttttctattaatggtcaaagttaaaatgtttgacttgtcactatgttaaaattgtttatattttagaacggagggagtactagtttgtttaaaagaaaacaaatggcattagtactttgatacggcagctatacttctatcatatccattgcaagtaaagtacaataataaacgggctctaaaaattgccactcaataaatatttatatttgtatggttactacattgattgaagatgatgtgtaattcttttgtgtgttcacgaaaaatagataacgtgttaattcttgagaaatgaatttgaaatatattcggagaaatggataatatatagtggagctaactatagctaaaaattaagataaacactttacaagtagaagggagtagtaattaaatattgacctgaccgatttttattttaagttgagggtgttagttttgtctgcgttagatcgaccgactccgagaggatttgtattgtgtccttttgttgtgcatcaaattaagggaaactaatacagtatgtcattcaaagaaagcaaagaaagtactatagtgctagtccttagcaagagtagtcaagagtcaagatggattctttgcgatcctcgttgcacgatgattaagcaaagttgcttttttttttgctggaaaagttgatgttgtgattgtgtaggtagaccttggctaatgaactggctatatatgttatgttatgtatgtgtcggattttggctgggacggtcggtaatttgcgtgacggatagaagcttctggagtaatttgactgaccgtcacattcacatcactactcacttaaaattaatttgtctttcggtcggcccagtggtagtggagtttgatcgtttccagcacctttctgtttccaatcctacagtatcgatcgtcaatctgccttcctttttctttactgaaaaggccaccaccttagctagctcgtacgagagaggagaaatatgagtttgatttggctcaaccggccggcacaagagccgatcatagtgtcctcttcttttcggcttacatattatgaattatatatcataggcacacgcttctaattaagcttctaatctgtagtaagagttaatccaaaatactttcttcatcagtatttcttacgagatatcttctgattttcaaaacatagtacatacagacatgaatgctcatataaacaagcgcacaatcaccatattactgagttgtgatccaaattcatttgcacataataaaggccagcttttgccagagcgaagcggaggcccgtcgccggaggcttaggtcggagcgttatccttttaaggtttcaccttcatatatacctcttgtaagccatcgttcgccgttgtaaccttaccccgatatagtgaagatattttgctgactggcgcccatggtttttctctcttgttttgggagttttctacattaaatctcgtgtcttatgtgattgatctattgttctttgtcgtttatttgcctatcgtttcctaacactgatgagcatacatgtcttattcttgataggtacgtcgcctaccactataagaaaatagccataaatacgagcgcatatattaaatctagaacttgaatctgagtggacagattcttctaaagaaaaataaccggttgaactatgcttactctatcttcttagaggactttttatgtcaatatttctactttttagttttaattcatcagtttatgtccttgaataattatcataaacttatttccatccttcatccacattaccatatcaaacacattaccataactctcacgcaagtaaggtgaaacaaggacatttttgcaattttttagtggcagtcttgtaataacgattcagagtagtagtaaatttgtaattgcccaaaaaaaactacatacctaagctaagaatgcgaatgctctccatctttgtttggtattcacctccggtcgctccaccttaggaggggaagaaggaggggagggttggcgccggtggagaagggggagggccggtgccggagtggggcacaagtggtcgtagctggcaccgatatgcatcaagcgttgggaggagatcagaactcaggagaataggaagaggaatagttcagtgctaggtagggtggaatttttatggagaaccctcgtaatttttatggaatttttacaatgatatccttataagaggaatttctcttattctcattgtatttcgtgaaaatacgagggctttttaggaaaaataaaacgagttgtcagctagtgcgagggcttgtttgagattatgtatacagatgaggagtttttgcaaaatagactgaacacgtgtcaaattctctgagaaaccaaaaatgagaaaattgggaaggaagaagtgttatgaccggaggattctcttccatttcaaatgtgaaccctcttttgtccttaattctctgttttcttcttcttcttcttctcaaatactccttaggactaggctgttgaatttatttctcctacatgggaatacaagtttatagcccaaattaaactccatgagcaaaagggcataggagcagcaaattattgtgtgattgtttcagcatgttaggtttagaatatgcagagttgcagaccgtatgatgtggcaaatcctctcttagccaatgttattgttttttaggatcttgttatgctttacggtccacacaaataactttgcatttattttcagtttccacctttcattgaaaagggcataaacacggccgtcgtatcaaatcacttttactaccgccccaaccactatcacggcctcctaatgataataaaaccaggaatcgtaacttattccaaccatctacatatttgaaaaacgaaagccttttggatgctaatgaggaaataaagtgagaggaaatgtgctggaaaattgcttcaggaactcaaaagtgacccgtattcataatcacactcagagaagacacaggtgttaaatcaaaatgagttattgaataagtattacaattgcaaaataccctgtcattcatggagccagattctcaatggaaaaaggatttgccctattacacatatttcagcaaatacagtaactcgactcctgccttcgcatgaaaaacaagaatgcgtgggaatacacaagctacaggcaaaagagtcaagctctgggcctctggccatgatttcttcaaatgtgaaatgatccctaaataaacactgtttttgtgaacgactgctacatgtctacacatggtaagttcacacaaaaaaattccttcggttagatcaacagtccaagggaagcaacttgtctgctggccaccaaacagcgtagtttcagcttttcaggtagcttaagatcaatcctgcttgttacgaacctcacgagcacggtgcctaagctccgcccttttccatcttaccatcagcaggcagagtgtgacaagagtgttcacctacagaaacaagacaagaaacagttgcccacaatgcacgggatggaagacagaaatgatcaactggatgagacatgcacttaccaaaataaggatcgttatcaaaaggaggggcccagaccagacaactgaaatgaacagaccttggggatcaaaataattctggcttgagaagctcttccagtgttgccctaaaaatgtatttattctctcagcgagaaatacaccagaaactgcaccaaaccaacaagagcaggt

SEQ ID NO: 66417 - DNA, 1723 bp, Oryza sativa
actaagtcggttgattattttttaaaaaaatcaaagttatagaaagaattgttacttgatgtagtgatttatttttttattaaataaaataattttaatgcctggaacacacgtacatatcgtcgttatgagccgtagctctttacgtcgaccatgatcctcaaatacttatctgagtagaagaaaacaagacagttgtaacaaaattaataaaagaagaaccaataacttttaaaaatggtactataggactttaattacttcggaatttatgattgaaatataaaagcgtgagatccctaatttttagagcaattacaatagcaaagtataagtcagctataaacacatataaagggaacgatagaagaaaaacggattacagatttatagcacatactttaaaacgttgtatgtataagaggtgagcctagatattattagtgggcagcatatacctatagggttactgtaaatgatttagatgacttttgggctcacctcacagtacactctcgttaattgtcgagcgagtagcatggagtagcgagcgcaaaagtagaaaagacgttggaaaatggagctgccgtaattaagaaggatgtcctattcccgtacgatgaggttgcgagtctcttgcgaaatccgaaattttgtctcagagatttgaagtgtgtcggtcgtgtcggaacagggtttaaggagaaatgggcttgggtggcttaagctgctggtgtgtgctccctccaagatgtggaggcatccactgttccatacttccttccatatacttccatacggtttacaacgagacggtgagtttgttccatcttctctatcgcatccgtgccattcgcccatgccccgtgagtccttggccaattctatcacctgactacctgatgacgcttttcctcgtcagcagctcagcaccttaccttttactacatgctgcacctgccggattcgcccgtcttttagatggggctgatgcgcatggtgcacacgctactggtttgccggtttctgtttggtccaatatgtggcgatggcttggaccagaccagcccagcccaacctagaagtgactgagtgagcgaggcacaagccggaataagttcactttgtgaccctcaaatgtgatcgaaatctaatctgtgaccctaaaccataaaaccggatatgtcgacccctcaactcttaaaaccggtgcaatttaactccatcagcggttttggagggtggttttgctgacatggcgtctacgtggcgatgttgactcagtcttcggtccacgtggagttaacgtggcgcttatgtgtactagaattaaaaaaatatgttcagtaccatttgtcattaaaaaaaaataaatgtggaaccactgacatgtggggccatgggccctctttccttcttcctcttcctcctcccttctctctctttttctctctctcccatttctctttgtcttcatctacaggctgcggcgggcccgagcggccgcggcgagcggaaggggaggcggcgacccggcggcggcggtatgaattgacatgccaccattagcagcaagacccaaggaagggagcaggagacgacgacgaggagaaggagcgcttgagccaccaagaactccatcccaatccctctccctctctcagctcctcacactctcctttcaccaccttcctgcgaaccaggtagtggcaaagcagagtag

SEQ ID NO: 66418 - DNA, 704 bp, Oryza sativa
  unsure (1)..(704): unsure at all n locations
cctcagtctcaaaacggacacactttttcagctgttcgtagcatccaattccagtgttagaaaaagtacaccgaaggaccctcaacttgtgagccagataaaaatacgtacttgaaccgtaaaaccagatatataagatcccttaactatacaaaaccggtcacccgaggtcctagggcagtattgacgccggttttgtctcacgtgacggctgagtcagcatgggacccacgtgggtcccacatgttaggatgacacgtcatcatctctctttttccttcttctctcccttcctctctcctctcttctcgcttggatcggagcttcttgtggacgcagaggaagttgatcactgccatgcggacgacgtcgtcgcgtgcgcggatgctcgcggggacaccgaagatgaaggcgacccgcttcttggactccctggcgcggacgccgatgtgccaggcgcggaagaaggaagggggggtggagcgcccagcggaggaaggcgatcatcttcttattgtttctgcagacgttgttcctgcagcttgcagcgctcgcnnnnnnnnnnnnnnnnnnnnnnnnnnngagctcgccgtcgatatctcatcctgcaagcacacgcaacgcaacacacagggtggctcaatcttgatcgccatgcagaagcagccattgatgcatgcaagctatctagctggctagtacca

SEQ ID NO: 66419 - DNA, 4336 bp, Oryza sativa
cttagtggcagtcttgtaataacgattcagagtagtagtaaatttgtaattgcccaaaaaaaactacatacctaagctaagaatgcgaatgctctccatctttgtttggtattcacctccggtcgctccaccttaggaggggaagaaggaggggagggttggcgccggtggagaagggggagggccggtgccggagtggggcacaagtggtcgtagctggcaccgatatgcatcaagcgttgggaggagatcagaactcaagagaataggaagaggaatagttcagtgctaggtagggtggaatttttatggagaaccctcgtaatttttatggaatttttacaatgatatccttataagaggaatttctcttattctcattgtatttcgtgaaaatacgagggctttttaggaaaaataaaacgagttgtcagctagtgcgagggcttgtttgagattatgtatacagatgaggagtttttgcaaaatagactgaacacgtgtcaaattctctgagaaaccaaaaatgagaaaattgggaaggaagaagtgttatgaccggaggattctcttccatttcaaatgtgaaccctcttttgtccttaattctctgtttcttcttcttcttcttctcaaatactccttaggactaggctgttgaatttatttctcctacatgggaatacaagtttatagcccaaattaaactccatgagcaaaagggcataggagcagcaaattattgtgtgattgtttcagcatgttaggtttagaatatgcagagttgcagaccgtatgatgtggcaaatcctctcttagccaatgttattgttttttaggatcttgttatgctttacggtccacacaaataactttgcatttattttcagtttccacctttcattgaaaagggcataaacacggccgtcgtatcaaatcacttttactaccgccccaaccactatcacggcctcctaatgataataaaaccaggaatcgtaacttattccaaccatctacatatttgaaaaacgaaagccttttggatgctaatgaggaaataaagtgagaggaaatgtgctggaaaattgcttcaggaactcaaaagtgacccgtattcataatcacactcagagaagacacaggtgttaaatcaaaatgagttattgaataagtattacaattgcaaaataccctgtcattcatggagccagattctcaatggaaaaaggatttgccctattacacatatttcagcaaatacagtaactcgactcctgccttcgcatgaaaaacaagaatgcgtgggaatacacaagctacaggcaaaagagtcaagctctgggcctctggccatgatttcttcaaatgtgaaatgatccctaaataaacactgtttttgtgaacgactgctacatgtctacacatggtaagttcacacaaaaaaattccttcggttagatcaacagtccaagggaagcaacttgtctgctggccaccaaacagcgtagtttcagcttttcaggtagcttaagatcaatcctgcttgttacgaacctcacgagcacggtgcctaagctccgcccttttccatcttaccatcagcaggcagagtgtgacaagagtgttcacctacagaaacaagacaagaaacagttgcccacaatgcacgggatggaagacagaaatgatcaactggatgagacatgcacttaccaaaataaggatcgttatcaaaaggaggggcccagaccagacaactgaaatgaacagaccttggggatcaaaataattctggcttgagaagctcttccagtgttgccctaagaatgtatttattctctcagcgagaaatacaccagaaactgcaccaaaccaacaagagcaggtaaataaaatagtaagctagcataccagaaataaattcattctttaaaattgatgaaacgtacaaaataacatgtgtcagaatatgaaagagaattttcactaatgctccgctatcgtcttgcaaactagggttgagatattcatcctaacatatagttaattcatgctgaagatagctgaaacaagagcaatgcatgcccttcacatctactgcatggaacaagaatctggaaaggtttacagtgcattaattgacataattcgccagtaacttgttcaatattcctaccaatgtataactcagaaggttctaccactaaagaaacttacattaaatttaagcaagtaggtagaactccacacaaatatgttgttttttttatggttttagggaacctctatccacatttgagggaaaacgttaagttagaaagcacataaaaacaagacaattatggttggtagagtataacatttaatatgataccagcagaatataggaaaaaaggataatagtatttatgtgaatataagcattcaataaacattataaaattgcaggagaaccatgcaggacaatatcagcaaccaagacaaatcaaaacttacatgttaaagctgacaagataagttggaagttgacatttctccttgagatgattgttaccagcagcagaatggcatgaaaaattaacatgctgatcaaccaaggttcctgatgaagggaataataaagattatagcacagacataaaaattgatacgatgagatattgcatttactaaatgtttgctaggttgacgaaacagacaattaaacgtgaaggcaaattagatgtagcaaaatatggatatccactacccaaagtattcgggtcaccactgaattttgtttgtctttaataccacggatagtgtgcagttggttattcattttacaattccaactacctatattagctttcatttagtattccttgttttgagaaaaggaaggaactagaaattcaaggtgtatggttgactgggtcaaggaggctttccccagcaacatggtacacggatggcctgtcggcatagatggagcaacatagcatgacagtgcaaagcatgcgaaaactcaggtatggtatcacgtcccgatagaagattagacatgttcctttattttataatttccctgagatgttagagctgttgcgttgtgtttatgataatggaaagggagagggctacctctttgcttgtgaagaaaacaaaatagattagatatgtcattccgtaagcatggtatgactacacagtacagtacacttgtaaaaaacccaaagctcattagttttctccatctatcgatggtttcatgtacataggaaagacaggcactcaatattgttgattggggcaaagaattatcgccatagaaattatatagttagatccgtcacaagaagcatgcatcatctttttttgtgggattttggatgaatagcaagcatcacaaggtgggtgtcgtcattcatttgctaaactagcactactccctttgataagccctcaactatatactgtatcaggtagccctattgcttttcacttgtcttgtctaatctatcatactgatattgatgcgcgcgaggcaggggaacgaattttcttacattatttaattacttgatgattgaggagcaaaaggttgaagtgggaagttagatcccaggtagatccagggcagatggggggcaagaaggctataagaaagaaaccgaccttccagtcgacggcgtggaagaagccgaggaaggagtcgagggcggggcggaatccggagcggaggtcggaggagacgcgcccaaagagctccgccaccacgtcggcgtgctcgttcagcgcctcccgcacctcacccaccgggcgccccaccatctccgccgccgacgccgacgacgccgcgtcgcccatctctccggcgagtccaaggaagactcgagagagaggcgagtgagatcgatccaaggttgcggagaagacgagatgagagaaaataattaattaaataaataaaagccccctcttctgctgatcggggcccacacgtcagccacctatatacagtatatgttctcgaaaattctctctctacaactctcgagtagtgattatatcacagtttctcaccatcttccgcgtgtcttccacttccagatgttgctatgttaacgtgagcaaacaatctattcttagcttaataagagcgactagactagcaggctacaaatcggctataagcacacgtaaaaagaagaagagagaaggaaaacgggctacaaatttatagccagttacagcacagactctaatatattatatgtgtatgagaggtgggaccatatattaatggtatagtatatgcttgtagctaactattgtatgaatgaatgagcta

SEQ ID NO: 66420 - DNA, 37971 bp, Oryza sativa
catcatcaacctgaaattaacgatggcattctagtaaattcaaaggttgtgacagaaaaacagacacatgaaaacagcagacatatgaaaagctgtacctccacaaatcctctccctcttgaactagggagaggacaacagaagttcagatattcaatatcatcatgctcaacgtcatcaactatattatcggtgtcttcctggaatatacaactcccttcaaatgagcaaattagcctgaaaacatgagatgatcaatctttagatgacaagtaagcttaagcaaacatcaacctatgtctccatcaagaacaaacatatgtaaactgtagatgcaaactggcaaagtaccttgaggaatcactgactaggttcaagccttctaccctgaaattcacttttgttgaaaaaggagcagcaattggtctcacacataaaatcttgcagtaatgatgagcactgtttgcaagtggtctgtccaacataagttgacctgcagtgatataaaggagtggtgagaataacaaaattccgatgtaaaatatgtataatagaacttgaagagcactgcgctaactaatcattcgggcttaccattatgcatgaaagctatctgatgccttaccattacaaataccaaaccatatgcccaaaagttgccggtggaactattcataagcttatccaggtatgacctcatattatcagagagctgtattaaataatatgaaaacatcaagctatcaagcattaaacaaaaagatcattgtcatgacatgaaataattatttgaaaaatcatacctctttccatacaaactcaactaagcgaagatatactgttaaaataatacaaccaggtctaatatagctctctatatcactagggctactggacaaccaaccaaaaatctgaaattcaagattgaagtgttaaattaactatatttactcttccaccttgctgagggaatgcataatttacctgtgatcgcaaaactggaggtaaatcactaggaactttctcgaaaagcttgaagacaattttatcagtccgacactgcaagcattcataatgacaatcaatgtgtgtgtgtgtgtgagagagagagagagagagagagagagagagagagagagagcacacgcatttcaacatatttgaggtgcaaatccactatgcaatattacaaaatagaaaatactggcatttggcatctcaatacgtatgtactagaccgactgttgttatcagtagaaattctctttcttcatgcacttctttatactgatcaaaaggtagttcagttcaccttgtttatgtggcatttatgtgagaaacagatgcgatgaattagttagagacatttcactggtgcagatgagtcagttaaatttggatctgggaaaatgtgcattctgttcaaatttctctgcagacttaatgtttttggttcttgatgatatctgcaacaatttttctagtaaaggtactgaaaagtcatgcacgtgtaagtgtgtaacttttaagttcaaaatgtacagttaagttcatacttatataccccttaaaacagaatctgaagcatatctagtactgcataaattaaggcatgtttgacagcactccaacccttgtagaagtgcactaaaatccccttccagttcaaaatcccacttgaactaatgcccacttaagatagttatttccttatttggtatgtacctcttgttaacttgttatcaaaagataaggatgttattatagaccaataagtcgtgagcatttgaaaattgaagcgatccctttagttttgggaaactagttttctttacattaagttgcaaggaacaaatttgcaaacctgagcatctccatttgagcttgacagtgactgagctgatgttgaatctgaattgccactagtctgtggtgggctttgagtagaatcttggtgcatccatgatggacaattgggagaatcagttgtcttgaaagctggtgtaggtgaaccttcatacccatcctcgaaaccttccatgccaccataagtgtcattcaaatcaaaatctttaaatttgcatgctggagggtctgtgaaaaaaagccactagtgtaacttaaaatcttcatttggaaacattcactgaagggctagaaatgttgtgcatctcaccaggagttgcaacagtgggagactttgattgtactggtacaacagatgatgatgccaggccacattgatcaccgttcacaaaaggcatcttagagttagatggccctgcagcctctgctacagcagtatttaccaaagcattagctgtttcagaggtcccagcatttgatccatcttgcatgctttggcatgcctccaagagtttacagagttcttttggatccaatgatttggcaactgcccccaggtttctcaaaagaccagatatcaactcctgacctcttaaatgctcagcattgtcagctgcaagtacaattgtggagtcctgtgagtattatcataaaactagcttgcatggaccaagtatgttcataatagtccagtctaggcactagaagtattcctacgttattttgggaggctctacatttaagcaaatggctaaaagattgcagaattgtgctgttgtgaagtcttgacataggataggcaatcttgacacaaaggtggaaatttcctgtaagcaaatctgggagttgaatataagacttaactatgaactcatctagtaccacactacagtctttgtagtcctagaaactatgccactaacaacctttccaataaacaagaaccatatacaacataaaagctaccttacttgaaaacatcagaagtcttatttcaatcaataccaagtaaattcactcagaaacatattcagataaagtcaaactcaagtacgcaattgaaaacaaactatactagtaccagctcaccaatacatacgtgcagatggaggatctatgttattgtaccataaaaacattacctacagttcaaataagaatatgtttacttaccattcaaattggcgcatactccaaggagacccaacaataaataactgctaattttgtcctcagtaaatgcagaaccaccaacagcaacttcagggcgggtcttcctccttcgtctgttgtggcctgctaaacgtcggcggcaacttcgcttcccttcatcaaattcttgaagagggtggaatctgtaaaaggaacatgtaagcatgtacagtaattacagagttcacccatatctttttgaaaaaaaaaatgcatactatggcaccatagcacagtacattgtaaatagtattagcactatgtaatcacacggtactccttgaacagagtgccagttcctttgaaacatttatgaaaaaatatgcatgaaaaacaaatactgtaaaaactattataattgacagtgcccaagaagaattcacaatattttctaaaagttgacagtggtgttaagcataggaacaacccacacacataaaagggtgagcaaaagaaagcattactgttggacgtgggatgcacaaatgaggacattaaggaaccaaatgttctcttacatcagacgaaaaagaatatatgaaaatactggtccatgaaaaacgtgcgtactagttctagcaattacgaaatgtaaaaatggtctcagaaattctacgattcaaaaaatatcttagcaaaaatgtttctggctttgtcaacttcaactaatttttccccaaaaaaaattaatttcagactttcagtacagatgttggaaataaaaaagtattttctttgaagagaaaataatccaaagaaattacgagagaaagcagtctgattgttatgacacgtacaactgtaattttgagctgagccatcggcagtaccacatagatcttagatatacaggcacagctagaagggcataggccattttataatatatttactttcgaacattttcttttatatcgtatattcaaatgggttgtgcaatacgactccttttcggttgtattcactgctttcataagagttaatccctaacgatttctcttagcatggcactacgttgatcacttcttccagcatcatcactaaatcttgcctatgactgatagtccgtgtttttcacaattacaacataagcatcgtcattttaatcttcgctccacaaattatggtgtccttttcattttactaccactgcgcccatatgctgtgacagatgtcaaattaataaaccacgtcctgagttaaagaatcattacactctaagctcaaaaggtgcagacaaatatcatatcatcatgaatttgagaatttgactttaggatgagaaggaaaaaaaatatacctaaaattattcttcaaaatcaaaaggtacgatccaaaatcattacttccataatagtccctccgtttcacaatgtaagactttctagcattgcccacattcatttagatggtaatgaatctagacatatgtatgtgtttagattcattaacatctatatgtatgtgggcaatgctagaaagtcttacattgtgaaacggaggaagtatataatacagacaagtctacgtataaatttatctcagccaatctagattgaacatgcacagatgatagatcacaccaactcctctctttaactatcattttatcaatttaatttaccatattcatcaggattactttcaaaatccaatgcttacaaaattgttagggttggaagtttgtgagggtctagaatctgtttagccgcattgcatcaaacttgcatagcatattctacctaatcattccaatatgaacaaattatagaatgagaatgaaaggcagtagtagtttgaattaaactaacctactacattgttggcagaaccgctggacagtgttcccaaccacagcagtggtagccttggcatgcatctcgcagaccttgtgtcgtcgatggtaatccctcacaccagtaaggtccgcagtgcagccctccacctggcacgcggggccactaggactgcctccctgcaccctgatctttttgccattcctgtcttcctcatcagcaccaccacccacccctgctccatgggcaacagcatcacccccaattctcaagctcagtgacccgccgccgttctccaccagctcgtcatcctccacatcatcatcatcaatgaccaccacccgcttcctcttatcggagtcacctctagcattaacatttctcaccgacgcggccccggcttcctcggaggaagacggcgagctgttcagcgccaagccgctcgcctccgcggcgggcaccggcgtagcgacgaagcggtcactgtcccaccgccagtcgttgaggtcccagccgaacagcctcttgtcgcgcctgtccatgtcaggctcgcctagccctccgccgtacaggtggcggctctgcgccccgacccgggcagcctccatggccccccgcccccgaaaccctagaacccctcgtcaacctcaacctcaaccaccacctccctccccggcacaccgcgtaaaaggatctactcggcttccctcccgcccaagtagtcgacgaacgtgacgcccacgcacccacggatccagaccagcgaaacccacatgcccccctcttccccgcgccgccgccctccgacgcggcggagcaaatcaaccaacccgccgcgaaaccgagctcatacaccccgaatcgccgcgtaagaaggtaaaaaaaaaacaaaaaaacgagagagtggatcagcgaaccgccggaccgagcgaattggcggcggagacggcggattcgagcgccgaatcgagcggcggagggggggaattcgccgggaggggtggggggaatttgggagtagagaggaattttggtgggaatggagtggactaaactgcaagagtcgaagaggaagacgagagaagtgggggagaggggaaagagcagaagaaggggagggaggggggatgggatggggacgcgtagcgcggtggtatggtacaaatagggggcgcctattttgcaaggagcaccccgggttggctacacgacaattttctccgcgcaggttaggggaaaataaatcatatgcaggttactgtaatttactctctctgattcatattactttttattttattaaattttatagaataattagcaacagttataataccaaattagttttattaaatataacattgaatacattttgatagtatatttgttttgtgttgaaaatgttgctatattttttttttgcaaattcagtcaaatttaaatgaatttgaataagagaaaagtcaaagcaactttaatttatatggtctaacttgatatggatgatgtgattaattgtttctttttgcatttttttatgattttacagtgtatgcatacaattactgagttgcagaatatttatgaagttgggtattggacttttattttatgtccaatcctcactccccaattcccattgcatttttatagagttcaaatgtagtgacaacaataaggttatattatattaaactataattactcacataaatgtttggagacatttgttactttgtggggcatatgcaaagttattgtgcggtactgctacgtgttaagaagcattgaaatgtatgacactcacattggctggcgacgaagtacgcagtctacagaagatagatcgttgtgagaaagtcaaatgtgagttgttggaccaaagtctgcccgttccaatttacgtaggagggggagaagcattcaactgcgtgcatcatgcaaattgtcattaaatcatgtgtaagtacatactggtatctaacaagaagtacccatcaaataaggaagttcttttaaaactatggagatcgatcggaatattcaaatcgtcaaatgtaaaacaggaggatttttagccataatgagtactggattaaaactttctgatcctaactgcataaaattgtgtgataacaatagatggtccatagatatatatgacaacaataactggcaaattaaataatggatcacatcatgatggtagtaaaagatttaatcgttccaatcaagatgagatgattcattaccatctcgatcaatggcacttttccggcaacatgtaagaacttggagcaagacaatgtttgtgttcccatggaataaattaccaggtgccattcactatcttgatatggacacattatttgttctacaattcttaacatagtaaaggcatataaaaatatattgctgtaaatatatactattattgtatgccattctcataaatttattgtataatgcgctcccagagcggaacgttgataaccaaatattgaatcatactcatgcatttatatttttataaatccacccatataaccattgatcacatttatcaatggacgtgtctctcgtcaactctagttggaagtactcattatagtcatagtttcggcatcataaaaaacgacaccatcgtagccacagtgccatcatggccgtgtcacttttgttggaagtaccctttatggtcatatagtctcgatatcatagcaaatgacaacgccgtagccatagtgttgtcacgagttgtgtcaataagattgatataacctacaacgtggctatcttgttaactacacgcggcactactcatgttatcgtggcaagcatatgtaccacgtgttgccatcacgagtttctaaaatccgccgagagtccaccgcaaaattataaaatccacgctatctctagcagcacttactattatgataatgcagtgacagggttaattaattaatcattttatcatttgtgtggatgtgatgtagcattagtttcattccattcatctaaggggaaaaagttcacctccatgggtcagatcaacgtggttatttgtcaatgtgctagctagtgtatcaccacctaccaagcccataaacctatagcaagtgaaaatttcagtttaattgatttagttccctctttctgatgacaattaatcgtggccttatcatgttagcaatcatcatcagggatccaccatatatatagttgatgcttccattatggctagaaagtatgtttaattaaggccatgacttggagaatgacatcatgtttgaggcacccgcgctcgcttattgtcgtagctaattaacatattagattatcacttcgtcatccagcgatttgccctaaatcaagtcaatgagaaagatgtactggcatagatcagaactgttaagtagtagtttttcgaacggtcaggctgttgccgacgttttatataaagaagaaggtgtcttattttaaggagaaaacgagactaaaccttacaatgcacagttaattagggaaaaactggacgaaaaccacaacactctaacctaagctaccaataccatggaaaaaggaaaaatggcggagcccaaaacagctatcgataaagagcttgttgtaagcgatacaaaggcttcgacttcgtgaggcaaatgttatcgttgccgggcttgtcgcctggcgacacagcagcttcgactccacagctatcacaacatcgttgccaaatgcatcacagaaaacaagcaagacaaaccgatcgaatcgaaacatctgtatgttctctttaaggaaacactgacaggcgagcctcgcccggcaggccggcagtgacatatttatattaaaatacagaaaaaaaagttattacagatagttttataaagattctttcttgttacaatctttattctgcaaaatacgcagaagatcaatgtccttcctaaatgcatgaaatcgatgttgtgtggaggagaatttcgatgtttctgatgagtcttcatgtccattttacctcttctgaaaacattatgctactcaagaattcagtatgagaaattgagaatccatgtgttgcatttgcaaacacggtttctaggttcttgctgacgcttccagttttcaagcaaaaccatttgaattagcttcagaatttgagtctccaggtttgcatttgcattagttttcggacgttcagactttcagtagttttcactttagaagtcaggatcggtagaacttgcagtcagtgagatgcctctcgtgcgtccatcgccacatcggtctgttccattgctgactggtgggccaccccgtgcaggggcctgactgcttgtgggccatgctggactgttgtacacacaggatcagaaactgttgtcagattgttgtttccgctggctttttatatggagatgctagtggagtatagtagtattaatttttttcttctcctgtccttatttccacctactgtcaaaaaatgcagtttgtatatggaccactgcatgtacatgtagtagcaataatgcagtactgtctgtgtagtgcttgcataaatcaagaacaataaattatcactaaatataatcaagagaatcttaaagcaattgagatggtgccactacacataatataattaaaaaaattatcactgggaggctcacattatatactccataatatatcatgaatatagtactacccatcctattttaagtgcagttgtggatttatgtgtctaacgtttgaccattcatctaataataataaaaatattaattataatttttttaattagacggatagttaaacattgatagtagatagtgtaaaattgtgattatgggatggaggtagtagtaataaagtgctaggtgcattggcagtttattggttatagtcactgattgggttgtaccaaataaataattgttaggtggagcaagaaagcagcaagcatgcacgggagagttgatgttggagatccctaatctagactttctgtcgcgctaacgacggcgacctggtttggactaaactgttgtttagaaaactcgcacagtatcatcgtactctcatgatagggagaccactatatattatatgtatgtttattgcttttttttccttgatcatgtatatatatttacaccgtccatagtatttaattagataattgttaatgccttctcgactagtttcagaaatgcaattaagcgaccaagaccggcggaatcaaggagcggcggatcacaagtaactgaggcatgggaaactacggaaagttgagtaacacagcctaagagtttacttggttgagaagacgtgaggaaagaaaaagagtaggatgccaacatatgaaaagcactgtcagattggagaatgtaacggagaattattgtagtgaaagaaaaatccggctctaattcttttggtaaattgatcaaatagatatttggatagtaaaaatagtaactctgttgaagatgttctaaggtcgtctcttggtcggtttatgctgcatgcagcgtacgtgcacgactgcacggtgtatgtccacctagggaaaaggatgccgggttgccgaccgatcgctcggcttttcttatgggagaagctagcagtagcatatgcatatgcacggttggtctggatcggaccacacgtcacacatatgcatgatttgaggtccaggaacgcccaaggtgatcgttccatcgagttggcatctgcacctacgcatgtgagggaaacatgaatgaacagtaacatgcatgctctttgggcagagaaacatgaatgaacagtacacgcatgatcttaaaattgagatcctctgcagtaaaatgcacgatgtttttgtcagggtccacatgtcagtgacaaagtcacgtgtctttgaccgcaagcgggatgtatctggtgtatttgtgattttatagaagtgggtctaaaatagttaattattgttaaagcaatttctataatggatagaaaaacgtccgcattagctcttgtccatcaaatatatgagagagaattgctttatttttggttgtggtatagcacggtaagctaaagctaattttcacgatatgtatgactcactttacaggatgggcacgaatcattgtcttgatgttttatatatatatatatatatatatgtgtgtgtgtgtgtgtgtgtgtgtgtgtgtgtattgtgattgcccagcaacctagtatctccttgggtcataaatatttaatatttagaatcaaattcggctaaaattttgatagttttatatttaaattcaacgtaaacagcaatatgcacaattacgcgcattcgtatacgtacacagcgatgaagtcaacgtcgacgcagacaccaaaggacgataagtcgataaccacgccactgttaattcgattattcctcaaactcgaggatgcatatatgcttaattatgatgctatcgccaacaatgtgagtggcaaaggggattgatctgctagctacgtagcacaactcatcgtctgtttattttatttcatttttgcggggcatcgtctgtttatttgctactcgatattactatagtactaattattttgcattcatttctttatgtgttccaataaatcaataattacttttatttccagtacctagatagactattattgttcttattacatgatagtagcaagactttttttttaaaaaaaaaagaacagatgtaacaatcagatagtgtaattaaattggttgcccctgtctgcttgtacgagaccagcagataagtttcctatatactcaagggcccatttaattactctggccccgtgaccatctgtaggcccaacgatgggccagatattatttcgtacggcccagcatttttcttgggtcctttctttaaggggaaaacacttttttattgggccatatgggcccatggcttgctttgttcagtttgttttcctaaggaaaaaaaaacgaggcatctcgaacaaagaaaagacagagagagaagggaaaaaggaggtccaggggttcggaattttactcaccgaacccctctggttcaaaaaaataacacattatgatcaaactaagcatatatttaacctccaaaacgatttactgttttgttaatcatcctaattaagagttgatgtcagctaaagcagctcataagcatgccgctatggtggcgttttaccagctggttctgacgaaggttttatatattcagtgtactgttagctgcatcctgcagggaatggatatatcgagttaatctctccataattaattttccttgtcatttcctcgctgcgatatgtgtctcttgcagatgctcttgatgaatcgaaataaacgaatcgatcgatctcgaatgaatagatggatgatgagggtggtcaaatggatatattggcacgttccctttgcctaaaaagtcaacttactaaaatttgataatgttaaatttttgacacattttagctttagcatatttttggcagtgttatgtgttttcgtttatagactaagtatagtgtttcttgataagatactttcgaaaataccaattttaataggataataatgttaaggttatctttagtttattagttaccagaactatcctataagcccaaaactgtcgaaaaaaaatacattataacacattgtactgtcgaaaattattttaccatgggtgaaccgataaaaattaccgacgaaatttttttagatcatttacgggaaaaaaaataacagcctacagacttactaggaattgtgatagtgtccaatttaatagagttaaaaatgataataaagtgaacatgccatgtatccgaatgctccatgcaaccaaccaatatgcctcttggctgcttaattcaccttcggatttgatgcatggatatatggccccatgcaaccaatgcacataagcacatgcctgagtatatagccatatatgacattgggttgctctcgtgcatgtttcaatcctacgtgtaagtgcgtatgcaaatgccaccttttttttaccccttgagatacatgcatttgcatgcatggcttggccttagccattaagcaagccaaattaaagtgtgtgtcatctgctctgcacaccacaagtcaatcgcaaagcttgcttaattagtcaattaattacccattcgatcacttgctgcattgcccattgggtgctcctacgattagcctagctcgctagctagctcttcttttaattggcggcgataataatccccactaacccacccagatactgctgcttttcttttgctaatataatatgaactgaatctgccattaggacgtttcttactttctcgttcctttaaaggctttaattacttaattaattagtctctgtgcctgatcacaaggaattaatcaaatagggttaagaaaaatcaatcccttaaagtacgtactcaaccactgaaccaggagaagaagaaaatatatagccacatatgcagagcgtgtgtgagaaaatatagaggtcaaatggggttcggaccccatttggatcgccgatccacccgctctgaggttccggcttcagaaactacagatgctttaatttgcttagtcacatgcaacgcttcatcagcagaaacacgctgaaattttcctttcttgatacgagaaaattgctgaaatttcgaagaaggaacaagaaaaagaaaatgagactgcattttgaatatacaaattaagtcccttactgtacttattagcatatcagacacaaatttaaattttaaaacttaatttaattttagagtcttttcgctgtattctagctattttctagcatttacttttaaaatactaataacacaaatacaaaaacttataaattattttttattagttcgtccatttttcggcatcttatgtgttgtaaccttttattatacactggtcgatcaatttgttcaccacgtgcctgtttagcttaattgttcatatttagaactaattattattttaatggtaggtgacgtatccgtcgacagcgagacggtcgtggtgacttcgttaatctcaagatttaccggtccagtcttcaagaaatgcttatagagatagggtgtacgtatatgttcatagaggtgagtgcacgtgtgttgtgagcgcctacatttgtaatgcgtttataagaagaaaaagtttaattgtgcatgcatgaataatagtttagtagggcgacaagatacataaaaagcagatgcccaccatcaattagttaattcagcacaagctttgcaccacacaccgatcaagctagcggctcgtttatctacactattatactatatagctaatgctcggcgaaagtcgcttaaagcttcactaataagttttttacaaattgcattattgcccttaaccaaaaaaaaaaaacgaaacagctttctgtttattcagcggcaaactgagctccagtcgacagcttcgtcgtctttatcaacaaagatacatatggatgctattgttaaagtcttgacattgcaatcctatatgatcatatagcatccaaaagattaacgcacttgcaaccaatataatcatagattagcattgacgcatgagaaatccgacaaatctgacgtttttctacgccaatagaaaagcattcatgcagtcatagataaaatgttagttcatggaagtgctttcttgtggtgtggccattcggacttggatgtgatcttatcatagctttggagaaagaagaggagtagctggctggcccaagatcgaggcagtgacacagagaaatctaggaaaaaagatactacgatgttatcaagcctgaaatcgacatcgttgatctctgcatgaacaatggcacatctctctcttttcctgtctgcctctccttatctcctaatggctcatgatgattcaggaaaagttgcccaagagctctgcaatctgctcccccttttcctttcaacttgatgcctctcaaaaaagtgaaaaccaataaaaacttcctcatccaaatttcagaaacaacatgaccacagttaacttattcagaaatattcagtgaacttattattcagaaatattcagcgaacttattattcaaaggaataaaccggcaactgatggaaccagttaactgctagctagctacctcctgattctagtagcaagatagatgtaacagaatatattctgctgacatgtgctgattcccatttgccttaaactcttcaaggttaagccatatcagcagctgttctcatctggtccaatgaaaaaactttgtctgaagaaggatacagaaacagatttctgaagagagatgtgcaaacatacttgcaccttttgcccatatgatttccagagatgagatgaggatctttcaagtgcacatggcatgagtgagtgaccaaggccagccttttggcatggtcatgcttactgtccttctgcaacagctggtccaaaagctcaatgttgctattgttctcaacttgtcatagtactacatttttttttcttcttccttcttgttgaattaaaggtggctctccttcagaatgtttgagagtttgtattgcagattatggccatgcatagatcagtgcaagaactagatcaggatcatgtgcgatagtcatcggagaagaaagcacctttatctctgaacctaaaacttttgtcaaagcatttttttgtgttggcaagaagcaatgctattggttactagtgttcagccacgtcacacgcattgccttctgtttgcacactttttttcctgaatgcaaaatgacatctcagacttcagatttcagaagcatggcgaatgggttagcaaacaaaaaatttgacaccattttctcctgaaaatgttttctccttcagagctgctgctgttcagctgttcagggttaaaaatgatcccagtgaaatttttttctcttgaatgcaaggatagagaatgcatttaacttcatctgctcaaatcccagacatattttctccacaggaaaaaaggatatatgcacttcaattctgtattcaaagtaaaaaagagcatgcattgtatttaaaacaattattatccactttgccacttttcccctattgcatatgctttttccactttgcagcagacaacctttgtttccctcctccttaagttccattgccctcctttctcctactcttccttccacactgcccaatttccatctccatttccttcatcagaggttgttctgctcagtcagaggcatcctttgccaaaaacatttatctgcttcaatggcaacttcttggtctgttgctttcactatcttcttctcctgtattctcctgcttgaaaccatctcttcttcaggtcagtatcccatattttgttttctgaaatcatagatcatgatcagcataatctccatctattgatgcaattagcatgcacctaagtgtcaagagcatgtgtcagattgtcacagtagaacaagaatcgatatgaatctctatcgaagtatttatacctctgaatctgatgacaatttttttgttgttggtgatatttcgtttcagtagcatctcttgattgctcatatggttcagctcaagtgaagatactgtccagctcggtggtcagtgagcagcaaaatgtgtacctcttcttgaagccgtttcagagcacgagatcatgcagcgcgaggcggctcgccggcgaattcgtcaatggcgtcgtcgtgcccaacctgcggctcaacgtcaccggcgtcgtggtcacggccaacgagcggcagctcggcgcgctgcgctgcacgctggagtcggttcaggcggagctcgccgtcgccggattgggtcggagcgtcaaggtctcgccggagctctcgctgccttctctgcgagccatggcgaagtgccgccgccgcggcgagaagcattggcgcagagtcatggagttcgtgaggaggtcaggctcgtttgtcgtggtggagatgggtgcagaagagaaggcagacctcgccgtcgccgatgtcgccgccgcgttcgaggagggcgtcggcgtggcgttccgtatcagcggccgcgcggctcggagcgcggcggaaatggcgaggctgatcggcgatgcggataaggggaggaggtggacgggtgttcttgcggaggttgcgtctccctctccccggcgggagctcgccgcggcggcaaggacgacggcgcgcgacgtgttcgcgccggtgactaacccgacgacgacgccggcgacgaacccggtgacggtgcccgcgacgaacccggcgatgaacccggtgacgccgggcatcgtcaccgtgccgtcgaccaacccggccacgggatactccaacaaccccaacctcccgccgctgtacccggagccgacgccggtgacgatgcccgacccgacgacgacgacgacgccgacgccattcatgaacccggtcaccgcgccgaccatgccatccccggtgaccaaccccgccacgacgccggccgtcacaaacccaacgacgatgccttacccgtacccgccgcagcaaggcggcgtcatgccgacgactccgacttaccagccgccggcgacgatgccggcggcgggcgggcagacgtggtgcgtggcgaaggcggggctgatggacgcggcgctgcagagcgggctggactacgcgtgcggcatgggcggggccgactgcacggcgatccagcccatgggggcctgctacaacccaaacaccctgcaggcccacgcctcctacgccttcaactcctacttccagaggaacccctcgccggcgagctgcgacttcggcggcgccggcatgctcgtcaacatcaacccaagtaattattcattttacttcgtctgttttatattataagactttatagcattgtccacattcatttatatgttaatgaatttagacatatatatgtattcattaatatttatatgaatatgagtaatggaacgtcttataatatgaaacaaacgaagggagtattaattaaccccactaaacttcgtataattactcgcgttagcgtgcatcactgacagaatcacactgaatgattcttgcaggttcaggaacttgcttgtttcaggcatcatcagcagggtaagctttgatccctcacttatgcttatgcttatgagcaaaaatttaaattttaacattaaatttaaaactgatttaaggtttttcatggaagtttatttttctacatttgtttttatatcgctaagaacatgtatataacaattttatttataaaatatttttcgtttgtaaatatgccgttgaataagccaaacgatgaggccgataatatcgtgctagttactgcgatgcattgatcctgatcaggatttaaacgtttgcagctacggcgcgggatacagcccgggggtgacggggacagtgccggtgggcggcggcgcgggcgccggcgccggggtcggcgtcggcgtgacgccgatgggaccggcggtgggcggcaccggaggcgccggagtgacgccgatgggaccggcggtgggcggcggatcggggtcgacggtgctcaacgccaacagccccggcgggaactcgatgtacggctccgacagtaacccgacgagcctcaccggcgccgccgccgccgcgctgtcatccggctgggtcctgtgccttgtctggatattcacctttgcatatgtcaaggagaaagtgtaggccttcttcttgctgctgctgctgctactgatgatgaacaacttgttctacttgattcagctgtgtacagatgcatactagatgatttgagtgaattttcataggggagaagaaggatagatgttttgtgagtctgtctgtaatctgtatatgactgtttatgagctgggtaggcagaatgatgcttaggcatcttagccatcatatatgttgtaggtgagcatagagatccttctctatggagacatgcttcttgttgtagtgcttgatatgatatcagttgatactattcttgttcttgggcagctttatctttgcatctcttccatgatgacactacctcacatttgggtttcatggtgcaaggtgagtgacatgtaggagtaaatcagtgtcggtaattgctagcaagacctgaaaaagttgtcctgactttgacaaattgttccccaaaaatgtgcatatgatttccttgggtgagtaccctgggggcgtgacacgacagggtccagcaatttttgttcccaagttatcatttcaatataaacggtttatatatgttgcagcataagcacatccaatgtgcatactaacaacacattttcgatgtgcctaaacagcaatatttctccattatactagtatttcaattaacttaaagcccaatctcaatggcatcgccgtattagataaaggagatacaaaagtgtgacaagacatgatggtatgatcagacaaatcccagcaggtataaaatgcttgggtcaaatctacctatgacatataccacgcacttcgacaaaattttagcccaggcagcaaatgaaacctctcaacttgttgctttgcagttacaaacagagcttacaggagacccagtgttcttgctgcactcatccatcctttgatgggattcatcatcctgttgttcacgaagtcttccgagcaagattcttcactccagcaccaacacatttcaatgtaacagtatttgaatttggatcaggcttgataatgaacttgacatcaaggaaatcccgtatgttgcgaagtgtttcgatagcgtatggtgtcaactgaccaacacgaacctttgacacatcaggtgggcttagagcacatagaataaacagaaggccctgaaaagtatttagaagaggaacacaatgtcaaaaggtaaaataatttaaacaaccatccgtttttaagagggaaaaacacaagttcaggcatcaatttatatgaaaaagaataggtttcttggcaaactttctaatagactaaatctatctgtactatgtaaacactttaacagaaaaaatattttcctacaccatatgacagccaaaggaacaattaccaaactggtgttgcagggctgtattatagtagcatatagagaataccacaaaagataatgattgtcaatggttcaaacaacaaagaaaatgtttgtttcaaagaccacacctgatgtgctgagtcaacaactcccccttgagcaacttcttctagcaacatcgatgcaacttgaacaccaagatcctctggagatgttagctccaaattctcagattcctcattcatttcatcaacattaggataacttacagtagcatctgcagagagcaggcagcctgtggtagtctcagcaactacagatacgccatagcctgctgacctgccaaatagatgaagatggttaaaaaaggactaatcacaattattgagttgcaagacatcagagtatagcaccattataaatattcaatagaactatttgacagtgaaaaaaaaatacctgccaccagcagaaccagatctatgatcagtgaatatatgaacatccggaataaagcgattgaagatcccacgtgcagcataaatgatgcggttttcaatttgtggagatactctagttgaaaatgatacacctcttatcctcttgaccataccttcatcagcccagttagctgcctggaaaggcatttagcatcagatggaaatgccaacagacatggcataacattagaggggcagcaaacaacacacacctttaatgtgctctttatgttgggaactcgaagaaacacttcaccaccaccaagaggaggagctccccggctttcaatctttaactccaatccctccagaggaacaccgaattgtttgagcatatgcaaggtaaccattcggaaagtatccacagaagggtcctttgtatcattagtaattcctaaaagcagggtgacaaatttaggtctcatagtaaagctgcttagggaaaaaaaagtctgcatgatcaccaattatggccatcaattttgtgcagaaggtagagggtaactataagtgccaatttcaacatgtcagtaatatggtttcaatagataagcatgtacaaacattattgatcaccaatttctaaacggatagataagtaatgggatggaccttccgctacttctaaacggatagataagtaattccatctccaatttctaacgaataataatacaagaatgacgagtaagttcaaattagtgaaatcccaatcagacaatctctatcgaatccaacaaggcccttgaagaatatggtccaggaacaaaattccactgcaaatttcgaacaatctatctgactaaacactagacagaaccataacttccccctgagccacgaccatggtgtcaacctaatacagcagaggtcccctaaattttgctaattctgcaccactattgcccaagtgttacctgaacaagaacaaggaaagctcacctttgagccgaatggagatgggcgccctggcgaagagcccaagcagtataagcggctcaaggaagtagccgatcccccggtgcaccccgcagtcgtgctcgaggtccctcccgccgacgatcacccccggcttgtacctcagcttcgtccctgcgaccgcacgcacacacgcacaaaggaatcagccagccaccgatgaaaacctaggcgagccacaccagacagagataagcccgcgggaggaagcgcgcgtccttgcctgtctcgttgaggtcgagggagtggtggtcggagatcttgtggaggaggtggaggagggagacctcgtgggggcggaggcccggcgcggcgccgccggagcggatgtcgtcgatggtgatggcggtcgacgtcagcgtcgccagcaccaccctctgccggaagtggcggctgccggagagcctccgcgctttgtcccgccccatctcgccggccgttcttctcgcgcgccgctgctcgtcggcggcgggaggggctagggttctgggctttcttccccgcgcgcgccgccgccgaggcggctactaaacccttgagctcttcttcgcggggtctcgctgggctgtgggcccacacctcacgttcgtgggcctcacgcaaacggcccatgaatggcctactactcctatatacaggaggattaggcccaaatgcagaaaaggaatggccgtcaacttcgtctagtggaaaatcagtgtccgagagtgatcaatcaccatgaagacttgaaaagtaatctaaaactaaaaggggattaaaaattaaaatgtagtctttctcaataaaaataaaatgtagtagtataaaattatgttaataaaagaaaggaagtgcaaaatttgtgtgtgtgtgtgtgttttgaagaaagaaatgtgatgtatctgtatgacatgcaaatcgtttcttggagatcatgcatgttgtttaggttcagattcaggtggttgtgtgtatcttagttatgcagaaatcgaaagtgttttgggataattctatcggctcgatgaaattggatatttggatgagtgcaataaaccttctgtcatccaaaaagctccatgttcaggttcaggatccaacgtgactcaggtcaggctccaattcagtgcagagacagagaaaggcagagatcgatacggaatcagttcagttcatatgctctcttgttaggaaacgatagacgaacaaacgataaaaaaaacagatcaatcataaaaaacacaagatttaacgtggaaaaccctcctaaaacaggaaagaaaaaaccacgggcgccagccagtaaaatatcttcactatatctgaggtaaggttacatcgccgcacagcggcttacaagagctatatatatagtggaaccctaaaatggatgatgatccataccgcgggagctccgcccccgcacccccgggcatccccatgcgcacagcccaatgggccagcttcagccttcgctccgctacggcaaaagctggcttttattaagtgcaaatgaatttggatcacaactcaacatctctattgtttactagccagccatgtgagagaagctgatgtgccaagatacagagagagatagggcatcagagagtaggtacggcgccggagcagctgagagatcatccacggcaagcacaacaatttcggtgatgtgcagaaccaagtacatatgctgccatttttctccacgtactttcttcagtgcattacatccactgcattcaatcttcttcttcttcctcctccctccccgtgacctctccatgttcctccatgtgcacccaaattaatccttcagccttcactactcacactgaatatagtatatctctacctatctacctgtatttttttttgactgaattaaagcagatactgtgaacacatgttgtttcctgactaaaaagtcaagcatatacagggaaatggttttttttatcattggacagttggattggtacactcatcgtacatatcatctaaaatatcatgaaaaacttttaaaaaattctaataagatatagataaaaatatgagatatcgctccacaaatatgtcagtttcaaattcaaataatacaattcgaaacaaaaacaacaaatgtcaactatgaaagttacgcacttttggtagccacttttgttatttttgtttcaacttgtgtaaaacgaatttaaatttgtatgcttgtagagtgatatatcatatatttatctatctcatcaaatggtttcaagatatttgatgactttttgagtgctgtgtatgaaacgagggtacatccacttgagcaataagaagacttttctatataatgtaaattaagatcagattcttcagttaagacgtaattttcatggctgaagaacagctagattatgtctccattcatgtctcataccgatagatgcatgcaggtgacactggctacggttagctggttagctaatcctgcatttgtagcagaggcttgtctaaagtgagaattattggtggccatatgcaggttaattactgcagctgcagcactacactgctgcagtgccataatgggcatgcaactgcacactcttggatcatccatcaatagtgtctgccattggggaggaaatcaaaagattaaatgtaggagaggaggtacctgacctgcatggtgctaagctatatatgagagatatatactcatctgttactactactttatccataaggccaaaagatgttaacagcttagctgctagtcatggaaaaaaagagaagaccaagaaagaaaaatgagtagccatcaagccatgagcctcctccattacttcttgcaatggcagcataggattctttcagtttctggatgccaggttgctcaactgttcatgccttgccggcctgaaatccagcacacaacaccaaattttcagtgatcagttttcagtatctgtattttgattagtatggctagctaagctccctgaagaaaattcatgcatgtctatgcagttgtgcacgtcaagttccaaaattacccccaagcttcatctatctgatagttacgaatttatgatcatctaaattctaaagtgaaacttttagataataaaagtggtttacatcttcggtctctgctgttgggacaaacccccaagtctctcttataatagatcagctgagatgatttttcaaaaacacatagattttagcacttaattctaattccaaagtgatgaattcatgtgccattgcccttcctctgatactccatgctacatggccgattgcatccaagagccatttgctttccttcaatcattaccctttcttttgatctctagaaaactagtgcatgcagacatgcagcttctcttgtttggattcagctattgttctagatgcatgcattgtagcctacctcttgtctgtttcggtgttgtttcgcgaggcagtaaatgagtaggggctcacacacacaacacactaataattcttttggtagctagttaattagaccggccgatcaaaatatatacaagtacacatggatcaccagatcgattcatgcatggatcgatctccccaagaactgttggtcgatcattaggcatgtgtccaaaggtaataagaatgagatgtcactttgctgcgttgggacctatctagctatcaagcaacctactagcttgattcaattacacttgagccatagcaaactcttccatcttttgttgcatgcttgccacagctaattgattacacagaaagaaaggtaatcggtcggttgattaattagtactgtagttaattaacatgcatacccgtatatgtgcatgatttaattactctaaattggccggcaaggctggttcgacttacctgtccttgtttgtcatgcaggctcgcgtgccttctgcttgggaccctgcatgtctgctcctgtttgctgctgttgctgttgctacatccaattgcaaaagtttcagtgccttaattttgatgtccaaacacttggcaacaaggtcgagatgatcagctgcttttagcctgacagcaacttggaaattagcattagtatgagatcgacatagatgccagacagtactgaaaatgtcaagaagttcagcgagccccataaatgaaatagctactactggtaggcttgttaaggatgatactacatctttctatgtaagttgagcatgctggtcgttggaggaatctgaatctgtcatcttccaatcagcagctagctagtatattcatgcagacacaaaagacacctgcattttttggggttctctcatctttcctggagagataggtagtaatttgatattgctcttttgtttttatttctagagatgatcaaacaagataagatagacacttggcaagcatgcatggatgaaaggagaagaagatctcaaggtagtacaagaagggtttcagtaaacagtagcaacattaaactctgaaaatgttcatcgccatgccctctagggcaggcaggcaattgccaatcaggaattagctgtgcaggaaaacaaacagtacagcatgctgacaatgcatgcaattaacacagtgacacaaatgattgacatttatcatgagctgccaaatagcacgaagcctgtcaatagaaaagctaaccacagttttgcaagttaaaaacagctggctgttacctgttaaccccagtgaatgaaaaaaagcttttgtctgacagtaacaaaacacctacactgatcaccaacagagaatgtgggcaatatacactggcattaattaagtgaataggattagcttgagcagacaaagtaattaagcagcagtaattaagtgagtgtgtactcacaggatgaacagagagcagaaggaacacaggataccgttgggccgatgggagccaaagccggcgcttttggacgctcatgccgctggaatccaaagacgagacctcaagaagattcctctccttctctctctagaacacagtcacattctctctttctctctctctctcatggccatggccatggccattggccatgctgttggttggcgccgttgcagcagctgagctgaggctgacgagatgagtgagtgaggtgacgctgctgaaaggcacaccacgtttcatgcctgcctctgcggctcgctgaccagtgggacccacgtttcatggagctaggggggaagtagcaagtacggactggaccacggccgctgaccggtgggacccacgggccagaggccggctgttgcagctgcagctgcagctgcagctgcagtagtaagaggggagtaatttagtcttgtgtcgtttttggctcattcatttcatcagcagcagcagcgcatcgctgccaagatcacggttcacgactgctctggaattgtacacttttatctctctccttttcagggcaagcacagagccatgatacagcctgaaaattattaatgtaaatagtaatcttcgtgcaaaggagagtctctaataatttgatcccatcaaatttgttcatgaacaacaagaggagagaaaaatagtttttttagcgattatttcaacagagttgtatttggaacctagcaatcatgtagtataatgctgagtttagttccaaactttttcttcaaacttctaacttttctatcacatcaaaactttcctacacacataaacttctaacttttccgtcacatcgttccaatttcaatcaaatttttaattttgtcgtgaactaaacacaccctaatttacggagaataaccttattctgatatcagaacagagaatcccgtgtattctgaatttctgatgccaaaactgttcaggaacaacaagaggataagaagaagaacaaaaggaaaatagcaatcgtttcaatatgtaagtatttggaacctatagaagtaacaatcatgtgtaatttgcagaaaccaaatccattttcagatcaaaacaagagaaaattctgcactatgacagcatcaccatctgctcccccttcagccaactgccctgcacagtttgcactgccactataaagcgctccctgctcctcctcctcctagcttggctcgcctctgctccgcttcgcctttgctccgacccggtcggcctcgccgccgtcgccgccgccaccgcatcacgcgcgcgcgcgcgcgacggcgcgagcgcacgggtgaggtgagagaggggtagtagagcagcagccgcccccgaccgcccacgcccgggccgggtggtggagcacaccgtggcatgattgggtccatggcctcctgaccccgcctccctctcctcctcctctgctccccttttgctgctgttgctgcttcctactctcactctgcttctgctgctcaatccacctgctcctctccttctcttctctctcccgagcggccgagaagaggcgaggggagaagggaggacttgattcttgcttgttgctgatccattctttcttgctctgctctgctcttgtgtggtgtggtgagcaatctgtgctggctcttctcctttcctgctctgctgattcttcgtttctttcttttctttttctttttttctgacgagcttggctggtagctgttcttgcagtgtgtccaggcttgccgcattaaaggagaggtggtttttgttgaccctgtttagcagcagcagcagcagcagcgaccaagatccgtctcgtcggggaagatgaggagatctgcatctgtatgcttccaatccctctttagctttgggataatgaggttgtgctctgctgacactgtagctttcttgatctctctgggggagatggatgccggtttggagggtggtagcagggttttggtgggatccaatcatccaagcacacacattgcagtttctgttccttccttctttagtgagtgagtagtggattggggattggggctggtgatctagctacaggctattacaacacaccattttgggggcttcttctgcggtggcatgggcactggatagattggtgttggtgctatgatgattttgtttggcattgggtagcattggcgcgtgtttgatctgttttgtgctaaggttgtgttgagcactggcattgggaggaactagaggccagatgttcatgctgcttgcgtttttcctgccacttgattgaaatgttcttttgggatcataatatcatgtgcttggctgaacagtgaacacttttgttgagactcgtcatgattagttgcgtttctttgatccaaaaaattgtttttccatgtagcaacttcagaggatacatggacacattgtttagctaaatatttggactttctagtttattcatgtaaaatattttttttgataggaaaaatacatgagactaccctaaattgtgcttgattggtgtttctgacacaagtagagacaagtttattcagatctatgaagaattatgctctcaaagatgcataattctggacaatttgcatcacttgtgttcatagatggaagtattcatgcttaatctgtttagtgttgatgctaatatgtgatggatactgatactgttctatttgaatttatgctagctactccgagtccttttggttttcataaccatggttgggactcaatggtccaatgtatccagtacatactgcaaggacatggcatcaagcgtatatcgaccccacagtgtcacaataactgaatttggtgctgttggggatggtgtgactctcaataccaaagcattccagaacgcaatcttctacctcaattcatttgcagacaagggtggcgcacagctcttcgtgcctgcgggaaggtggctgacagggagttttagtcttatcagccatctcactttgtcactggataaggatgcagaaataattggatctccggtaggataactcacatactttgcacatgataattacagccaaaatatttttgtgtgcttatgacatggtgctcgtgcacacagtatcatatattgccaaatcttatgttgatcaattgttccctaagaaccttgatatgaacactaaaatggtatttcgtagagacttgcacaaattcagttttcttgaagtttagaaaaaatgattaattaaatatttactttaattgatacagaatgtttttgttataatttcccaaatgtatttttcaggattcatccgattggccagtcattgatcctcttccatcctatgggcgaggtagagagctccctggaaaaagacatcagagtctaatttttggaactaatctaacagatgtaataattactggttagtaagtactatatctgcaccatgcatttctcttgggatgttactgtagttattttgtcagtatgtaaaaatctggtactcttggcaggcgctaatggtaccattgatggccagggagccatttggtgggattggttccacagcaacacactgaattatactaggccacatcttgttgagttgatgtactccaccgatgttgttatatccaatttaaccttcaagaactcaccgttttggaatatccatcctgtatactgcaggttggttgtctgaatagccacttgctttctgttaaatataagaattcattcacaactgtaaatttattgtctagagtgcttttgctaaataaacagccaagtgcttgtccagcatgtcacaatcctagcgcccctgaattcaccgaacactgatggcattgatccaggtaatatgaagttctgaatcattatctcccttcaatttaacctgattgttcataatgtcttacttcctcacttttcccatttagcattgcattgcattaagaaaaatggcaaaagaaaaaagtgactgcaatatcaatatgtcattcacaggctctttcttcaatttgccctgctttgtgcttcaaaatttgaaaaaaaaaaagaatccttagaacttccacttactgctgagattctggacatagaagttctcaaggaatcttcacccaaaaaaaattctgaaagaagattaaaattgttcttttgtgaagtgatcgtttatactctgctagagttttgaggtaccaatagaaaaggtattactgttttatgcaaaattaccaaaaaaagatagccctttaccactttggcaaaaaacactgctatgcaacagatacatttattttgtgatattctttcttgagatgcaactttaaccaaggttacggtacaccagttatgtattaacactatatatccatttagcatatttgcatctataactgtggtactaatggagcttcaatccattcagattcgtccacaaatgtctgcattgatcattgttatgtcagaaatggagatgatgttattgtcataaaaagtgggtgggatgagtatggcatttcctttgctcgtcctagcacaaacatcagtatcagcaacatcacaggagagacaaggggtggtgcagggattgcctttggaagtgagatgtcaggtggcatatccgaagtccgggctgagggtctccgcatcgtcaactcaatgcacgggatcagaatcaagaccgctccagggcgtggagggtatgtgaagaacgtgtacatatctgatgtgagcatggacaatgtttcgatggccatcaggatcaccggaaactttggtgaacatcctgatgacaaatatgatagaaatgctctcccaatgataagcaatattacaatcgaaaatgtggtcggcgtcaatgttggtgtcgctggcatcttggaaggaattgagggggacaacttcagcagcatttgcctgtccaatgtttccctcagtgtacagtctatgcatccctggaattgttcgcttatcgaaggttattcaaactctgtgatcccagagtcatgtgagcaactcagaacagattgtggacagacaccaatttgctatgatggtggaagttcttcagcaatacatgcacaggcagccagacatagattgtcgagtgccagcagattgctaaatcctttactgaagttggcgatgctgtagagtaggtagagagatgctctatttatttgctgcagaggggcttttgcttcgtgggatgcgtcatgtacatctgattcttgcgattgttttttttttattagcacgatgtttgcttcttgtatatagttgtgggagatgaatgttggtgtaccatgcatgtttttgtcaccatctttgatttgtgatgtatctgttccatagccttttgttgggaagaaaacagtatgatcctccttccaatatgtccagttttgtggatagggtcatcaaaattgtaacttgtaagttgagtagcaacaagagagaagagtcagttttaatcattcttttatttaaagatgaagagagcagtcagtttcaggagcgtgaaaacaaaatgagtagcaacaagaggcaggatgtctaattcattctctctttatttttttttaaaaaaaaagatgaagagaagagtcagttttaatcattcttttatttaaagatgaagagagcagtcagtttcaggagcgtgaaaacaaaatgaaaaatggtgatagctcctgaggtccaaggaaggaagcctcgttcaccagcaatatattaccccgggcaacaaattttggggtcaattctgcgtaggcactccaaactttggggccaaatgagcaatttttttccccaatcaataaccgattggacattaaacaagaaaatgagatagaacaattttctttcctcataatgagagtaacatatatttaaattgatagcttatggtccactaatggcagaatgccgaaggttacattattctttctgacttctgaacgtttggaacttttgcgatgtgaaatcccacaatgtatttacttacaattagtacatccgaaacttctccttagtgttctcgaagacttgttcagcaatcagggctccattgccatctgcccgccttatctccaagttggccttctggtagtaagcagttcccctcaaagcatcagcaatgaagtcatcgaatccaatggcaatagcagcttctgccttggctccatacaccagcctctgcattgcagcattgaaaaatattgttaattaagcaaaagctacattcttccaggtgaaccataataaggtaaggaactaaccttaatccgtgatagatgcacagcgccgaaacacattgggcaaggttcacatgatgcatacatttcacagtctgacaactcaatttttccaagctttttgcaagcctatagcacagaaaaacatttattatgtgaaaagataaccaaacaatggaaagaaactaatgttaaatgcattatcggcccaaattggctggcaaagaatacaatagtcatactgctgccaatcagtgtctcagtgaattgttcctaataaataagagcttgttttattttttaaagcatttctgttgttttatccgccagcttgaaattatctactccatttacaccatcagccaaagaaattctgagagtgcaaaacaaaaactaggaatttctgtattcactcatgaccttgttttactggaatctaaacaatttttaggccaataagatctctgtattttaagttaccacctgccaaaacatagctatttacagcacttttctatagttagaattgagtacctctgatgttctgatacaaaggatgaaaggaaaaggacaagcatacaccatcctagctgttgtaacttgtgaagataacatctagtatatttttcaagctgcggcactaatatcaaaatgaaaaggtgaatctatttggctgtccagtatatttgcattctagttttaagttagagcgtgaatcaggcacatttaatcagcagagatgaggccactactaaagaatgctaagtatcaacgaaatgtaaagagtaaacaccatgtagctggtagccacagtacacagggcaagttacctctcttattgcagttacttcagcatgcgcagttggatcagtgtaatccaaaaccatgttatggcaactaactactatctcatcattacggacaacaactgcaccaaatggacctccatggccacaatctactccttggtaagcttcttcaactgctttagacaaaaatttgtgatccctgtcttgtacggctgtttaatgcatcaaagattaaataagtgagtgtttaacagtcctccaatcagcagaaaataacagatgttggacatatataatattcattggtcaatcatgtccataagatcaaatctggtaataataccttcctgatgaccagcaaatgctgaagcaactgagatcgttccgtccttggattccacaactgttaaaaatgaagaaaataattcatttgactgcttggaaatgattgtttcagctcctcccaacaagaagtgattatattaaagaattttaggctggaggactgaagaaatcaacatgcaggccattcacaactatggtaaatagctgacaacagaacaagatttacttccatggccatagtcccatgcccccatgtaagacctatctatgatgaccaaagccacatatctatagtccccaaattgcatcatgtcgcagaaaccaccacagttcctaattctgacaaatgcagaatcctgttttggtttaattgaaaccatggatttcttctgaatgagttccaggaaggaagcaaagtaagtagcatgccagaagcggcataacaactatagtatgacaaatttggaagacatgaagtgcatgatctatactcctgtgcatgagaaaggaaataaatagcatggttcaacaccaagtcaccatcagcatcagccaacatggaacactccgtttgtcttgcaatcacccagagcaactcaaaactcttaaatcctacccctcttaccgcaatcacacataaaactaagcctaagaaagtccatcgcagcctacccatgaggcagaaatgagcaatctcttcctatcccaattgcagcagtcggttaattcaccaaacacagaatcgaaaatccatcctactcctaacaatactcctaacaggtagatagcaaatctctcggccccaaatcctcaaagaactccaaacttgttggatctcatctcactcacgccccccttttctagaccaaatcatcaagacacaaagcaggaaacaaaatccaacagttcccgccccccaagcgccgcagcaagcaaccactggtgtgcccgtatcattgacgtcatagcgtaccctgagcctcctccatggcaggagcaggagcaggagcggagcgcgagatttgggggagaggagaggtgacgggtgtgatgagatgtgttcgtcgcttgcagggatggatgggcttgggtggccttgtctcccgtgctggctgtacatatagggcctgggaggggacactgacgggtgggccagcccatgggcctgcgcgaggccgacctcgtgtggacggaaaagcgaaagggaaagcgcggatggcggatgacgcaacgaaggggcgccttgtcaacagaattaggggggccccaccagatgtctttgtccaccgtggcacggcctgtgggctaagcacatggtgtccaagggcccatttgttactagtagctcaaaaatattccgtgtaaactttaggtgcaaaggaaaaaaaaactagagaaaatccaaataatgtaattgacaaatgtacgagcctaaaaactgtcatcaatgggtgtaaattctgtaaaatatcatcgtacaaactaatttgtttcataaatgttatcgttgttagggttttgtccagcctgtcctgttaaatacgttgttcatcctataacatttaaaccttaacaatgatagtatttatgggataaagtcaattgtacgataacattttatggaacttacacttgttttttatatttcttagaattgtgcgccttgccaatgatatttattgcattttctcataaactatagtgcacctctctaatagtgactatgtaatgtgtaatggtattgaggagatataacttcttgattttttatagacgatagttaagaggtaagaacaaatttattttaggatatatttggaactctatgaatcaacttattttatgatggggaaattaactgatatcaatcatacgctgtccctctttcaaattcaccacttttgtattttctgaaaaacattacaaatatttttgtttatcatagtctatcttaattcgttgtaaaacgtgaaaccatgataatagttaacattgtcggttatttgaaaatgaagggaatgctagttcgagttggatgtaaattagtttaatgggtaagctatcttaaattaaaatagacgctctaaacgtgattcgtgtgtattgttctggtttgatttgtttcgcacttaccaccaaacttagattatactatccgacacatctgccattggatgctccctctttatcatgtcttttgatgaaaaaaaaggagcacaatccctctctttttacctactcctttttctttcgacgattctgcattctacacttggcagaaaatatatgttatttaactcttttaacattactaacattactttcgacggccatgttttgcacgttaataatggtatattatactaacttgaaacggtgctatgctctgtttaaaactgaagttgctttcggctcgaaagagatgctagaataaaaaaagataaggggggaaaacgttagtacaatgtactcccttcgtttcaaaataattttatttttcatccacactacatatgccaatacaaaacaaaaaaaaacccactttattaaatctcaatgcaattattctctactttatctattcacaatacaattatttcatatattttaaaattctaatacaatgattacttaaaaataaacttatttaggaacaaatggaggagtaattttatttatggaatggagggaatattattttttaaggggaaaaaagggagaagttaggatttaggtgggacccacatgttagctcggttggactaagtcaacgtgccgccttagtaaaaatcgctctcaaaaccgtcccatcaagaaattcaaattataccaatttaaatagttgggatcaacatatccgttatcgatacgaatcagtgtagacctatattaagggaatcaaagtggacttattcgttaattcaatgggccaactaaaagtaattatggccatttgcagaagcggaaggtggaggcccatttatagcattgcacggaaaaggcccaagttaggtactatagcccattccgaagtctatcgctatccacttcgtccccgcgtcgcgtggcccgaagcgagggagcggaggctgctcgccgcgccgcgccgcgccgccgcgcttggtcatctccgccgccgccggccgtcgccatgggcatcaaggtatatgcatatatagcacgctcttatcaccgaagcgctcgatgtgacgtcactctcgctgactctcctctgcctgcgcgcgtgttcgcgatagggtttgacgaagctgctggcggagcacgcgccgggggcggcggtgaggaggcgggtggaggattaccgcggccgcgtcgtcgccatagacaccagcctcagcatctaccagttcctcgtgagtttccccggccgtggcggcgtccctccctctcttatctactctactcccttccgcttcagttgtgagtatgattgtagcaatcgtgttatcttgttttgggaatgccttgattcggggaaaatttagtgatacctgcctccgtggttaagtggtggcgatctacagtcagttggagttgggttttaacttctaattcacattaaaagtttgagcaaatgcaaacagtggcgaatggtggcgattgtgcagtcagttggagttgggttttaattcgcattaaaagtttgaacaaatgcaattgtgcaaacacttcgtatcaccagtagcttctatgtataggaagtcagtggcttaatgccatgagcggagcctcaatttctacggtgtaagatagtagcaaacttatatgtagaattgtagacaaaaaggacatggctaatgatgtgaattcactgccaccaataccctttgcattgataccctgttctgattgactgggaaaccacttggtagcgctcgccatctaactagtgatattattttatgctgggaaaaaagcttattgatggattgttttgggggtaaggggattcagatgttctgtgtatatgacatttctgtagattgtggtaggaaggaaaggaacagaagttctgaccaatgaggctggtgaagtcacaaggtgagggaaagtacactgtaccctgctggtgaactcatgtggttatgacttcttttagataaaagaattttacatgcatgtgaattgtagtcatctgcagggcatgttgaaccgaactgttaggattctaaaagcaggaataaaacctgtg

SEQ ID NO: 66421 - DNA, 2578 bp, Oryza sativa
agggctgatgtggacaagctgacatgtggggtctacgtgggtcccacgctgccacgtcggaaaaaaccgggttcaaaaccaccgaaggacctaaagtaaatgtttttgtaagttgagggatgttatatatctggttttgcggttgtgggacgattctgtaactccatgataagttgagggaccttcggtgtactttttccttccagtgttccaccgtgttatggtcaggctcctctttcacgttgggccgtcagaacacgcggcccaaataggctcgtccctctctgataatttcacagcccaaacagggccgattgtcggcctgccacattccaggccgcctaaggcctgcgtatcggaattatggactggccgatatatgcccatcgctgttacgatcgtgggcgtgaacgtgaatgcgtgatccttgattggaataagttcaactgagatctcaacgaatccgattttcgtccttcaaccggaaaaccatatataacatgtccctcaactatcaaaaccggtgcacacaaaattcctcggtggtttagattgcggttttggcagacatggcatctatgtggctagtttgactcggtcttcatttgatgtggcattgacgtggcgtttatgtggcaattcgatccagaaaaaaaaataaaacacatgggaccccatatcattttcacacacacaataaaaaaaaatggtgggacccacgtgggccccacaagtcagtctactcacccctcttcttcctcctctctccccatctcccctttcttcatctctctcttgcgctcgggggggggggggggggaccagacgcggccggcgacgacgacggcggcggagatggagaagagcggttgccggccatctctctcttgcacacgctcgccggtatgccagggagctcgaggaggggggaagggagtactaatttcactccagtagtaatgatttatgaatcaatggcgtgacgcggactagattccccttcgattatgatactcagtctcgcaggcgaggtaccgcatcctcgcactctccaacattctcccaccgtcggccgattccgacgtcacggtgctccctgactctgaccgcccggcgcgcgcgcttctttggtcacccaacaagaagcgaggagtcaacgacggtggcgcccaacgagcttgagctgcgaaaaccaccatgtgacatctggggccatcgtaaataagtgccacatagctgtcacaactcacggcagataaagatcggatcaacataccattaccatgtaggtgctaagtcaatcaaaacttctggaggacttgaattgtactagttttagaagttggaggatgcattataaccggttttgcagtgaggcatgcgaagggaactggacatatagttaagaggattcagaagtagacttttgccttgcacagatggacgcgtgcgtaggattgggccgagcatatgccgccgtaacaagttagtaaaataagttggaaaaagtccactttgactcccttaaatgtataccgaatctaattcgtacccctcaaccagaaaaccggttaggatgactcttccaattactaaaaccggtacaaatagactccctcagcggtttcaagggcggttttgctgacgtggcgttgttgaattggtcttcgtcccacgtggcgttgacgtggcactgatgtaagattagatttaaaaatatatacgtgggaccaatttgtcattcacacacaaaaattataataggatccactgacttgtggggtccacatgtcattctctttccaacctttctgcctccctctttctcccttatctctctctttctcttcccgtcggcgagcagcgcggagagcttgccgagggcacggatggcggagcagagggcggcgagggagcggagtggagggcgccaagggagtgcgcgaagccgtgaagccgtgggcggcggtgggtggagaaggccggcgtgaaggccgggcggagcggcggcatcgagagctgccagtcgccgcggtcgctcctgtcgtgtatcctacagcgaggcgacgacagcggtgggaagatcgggagccgggtgcggctgccgtggcggtacagctccacctccgtgttgatgcgatgttgttaacactccgccaccgccggtagtggcggcggcggcagcggtgggaagttcgggtgctggatgcggctaccggcgccggccaaggtcaaggtcattgggagggcgccggtgtcatgccctgaagttcccctcccttgctctaaattcataaaataaatcgtccgaagaaattgtttaatttaacctagagatgaatccctaattaataaatgcaaataataatcggaatcgacatgtggaatttttcttggattctacatgtcaaaatatgctaacaggatttttactggaattttcagagcattggaaataattttaaccaattaaaataagcaaagtgcaaatattaaatccctgggaaaatcctttttccttttttttccctctcttttcctcctttgggccgccggcccatctctcccgggctgcagg

SEQ ID NO: 66422 - DNA, 1158 bp, Oryza sativa
aaaaaaaagacaccctggtttccgtgcccaatatttaaccgttcgttttatttaaaaaaattataaaaaaaattaaaaagacaagtcacgtataaaatattaattatgttttatcatctaacaacaatgaaaatacgaattataaaaaaatttcatataagacggactattaaagttggatacggaaacccagggtttgtctttttttgagacggagggagtatatcacatgataaatatgctgcaaataaaatactagtagtacgtttttaagggaaaatatactgcgtatttcctgaacaccacatactgcaactactactactttcttttatttatagctacttatattattccaattccgaacagtgatacccattaggagcatagcgaaatcacctgatattccaaatttcccagagtcagtactacgtggcaaatttttaaaacacaaatgaataattgattttttgtatttcagagaataacacaggaggttccaaaaattgtagagggattgagatagatgatgacagagagggtcggacaataaatctgatgcagatggatggaatcaactcaagactgagggaggccaatttgagcttccatttcgcatctctctcagcctcaccgtcgtcgcctcccttaatctctcatgcttatgctcatggcagccgacgtctccatccccacgccgcctctctgctctctgctctccctccacacctactgattcttcttccccttcccttctccgctttccctgccttgcaaatccgccaaaggttcgccctttttcctcttccaccggttgcgttttttttttcttttttttttgggggtggaacgtcccgcgagtgttgggattgggccttcctcgttgcctcatcttgatctgatatggtgatattctcttattggaacgggttagggctcatcttagtgttcctcttgcgtgattccgagctaaaggtgccgtctttcctcccaaaccaccaccattcatttagtgttccggtggtgatccagtgcaacaaattgggtagtaattttgttggtttttggagattgctcaattttggggcaaaatttgagaagaggatggttaagttctcgtcagagcctcatcaggggtaaaaatatcttgctcctcct

SEQ ID NO: 66423 - DNA, 698 bp, Oryza sativa
attcctgcagccccaagtatctcaaaatacacgatctaaataatatagaagaagatttttattagagaaattatttttcgaagcatgtggagtaataatatgatttaatgatcgatgaaaatttgaccggatatgtgttgacgtgaaatttttcacctgacgtgtcagatgtgcgtcgatcgtgctaacactgaggcatggaagatctgcttaactctagtgcaagatcctagatcttgatgaggtgcggacgtgctagtcagtttaaccctgcaactgacaatacgtcgatgtagcagcgattagctgataggttgaacgatcggctgttagagacttggaggcccagacgttgatgacaattgtaggctcgagtctcaaatgtgccaaaagcgtgtgtcagccgatggtttgatgtagaatcagctagaggatctgatgttagtacctagcgttgaacacctttgatctttgaagatagacgatgttgagggcactctaggttgtaaggttgttgtagaaatagattggctagaagtcagatacaaatagattcaaatagttagataaacaatgaagcttttgctgcaatcgactaaaatcaacttgtgtataattatcgacaaacatttatttatcaaagagttgatgtgggacttagaaatagtaacaagatgactcactggctaacactctaa

SEQ ID NO: 66424 - DNA, 1530 bp, Oryza sativa
agcatatgaatcatttcgtttcagagatgtacggtttgatttcccagtatgctgagttgcttggttaaattaaacccaaacccctacatgcgttctgctttcttcagattgtattctactgtactatttggtttataaaattcctgtacatgttctgaacttttcagtgctgatctaaatgagttagcagcaagccaatacctgaacttggtccctgttgctttgagaaattatgggctattggttgcatctgctctttcttctcttctgaacttttgttcattgtcaatcgctcgtaaatcgtaaatctgtttgaattggcgctatttctgaacttgggaacataattggcactatttctgaattgggaacaggggatagcacgctcgtaaatctatttgaattgtcagtattttttgaatcttggagcaggctattgcacagtttcagtcgacatgagctttttaaaatctcatacttcagcaaactgaaaaataatttggagggtttcagtctaatgttgatctaatgcatttcaatggtagcaaaaccaaggtcacttgggtgcctggaggtattcacatgcctgaaatatctgtatgattttttttcttctttattctgaatgacccatcgtcccatcccaatattgttcccatgttaattatgtgtggagcttgttagtcagttaactcatttgctgtgaaatttaatcgggaggctcaacaacaacaccctgtctggtccattcccttctgcatcagctaacttgtcacatcttgttgtcgagtgattttaatatatgtgcacggaagtttgagatatgtgcaaattatgtacaaaatttaatatatgggcaaatttgtacacaactggagatatgaccgtttggaccacaatgctctgttttttttatcctaggctctaatctaattgttgtgctttgttaaacaccactgtctgaagatgattttcacttgaggaaaatcttcagtccattgtgacaaagtgactccttttctgaagaaattctttattttttgaagaaattcaagcatgcttgcagttttagcccagttacagtctatatgtattgtagttacatatgtaacttttgttatttctcactgtaactaactatagatatatagtccttgaaaatttatcaacgctacaatctctaatttgttgtatataattttatgctagattatattgtctgccaagatcattttatggtgcataatgctaggtgagcatgataactgacctttcaatgttttcttgcttcttatttctctggacaaaattttgtcactttcatatctctccgattgcatatcccctgatttttcagactgtaacccatcagaccctgcatgtttatattatttgtaacataatttagaacttgttataataggggaaaatatttaatgctgctgcatgagtactgaatttttttgaagaaattcaagcatgaaagctgttacagcctagttacagttcagatgtaatgcagttacatat

SEQ ID NO: 66425 - DNA, 661 bp, Oryza sativa
agggcgaattcgagctcggtacccgttatcctacttttctatgcgttatttgtgctggcctctttaccgggcaaccgtgtgggataaatgtttcatgccattatcgatggcgatatgatgatgctgaccccccaccactatcatattatcgatggcgaagtggccatgtgcttgtgttttgaatggccaaagacattaattaagtaagaagccgatgctaattaagaaagttttaggaagcaccttaagcactctgtcagaatgctcaagtcatcttttggactatctgttgtctgctttgagtcaacaaggtgtgcattcccctgcttttacagatctttttgacttgctatccaactttaatttttatccgtcatatttatgcattaagccacaatcattccttgcaggaagcaaaaagagcttaagacctgctcaaggaccgcttcgacgacatcttcgccaggatcatccagaagaggaccgagtccgaccatgccgccgccgccggcgagacggcgtcggacttcctcgagtacatgctcaagctggagaaggaaggcggcgacgggaagaccgccttcaccatgaccaacgtcaaggccctgctcatggtaagtgctcactgctcagtcactgcactgccggcgtcggtgtcacc

SEQ ID NO: 66426 - DNA, 668 bp, Oryza sativa
gaacgcacgcacgcacgcgtgaccgcctgagcgcggaagtgtcgacatgcacactatgtacacctcctactctctcggctacttgcgcgacagcgtccacggcccgccgctccgcaaacttggggcttatttggattgctacgatgccaatttttttttggtagtgtcacttgttaccaatataagccaacattcgaattctggttaagattgttctaaattaatgtgaaatctaatatgggcattactaataaatctatctattatattattaaaacagctttaaaaggaggctccacgttcactgtgggggctagaaattcccacattaatcagagaaaaagagaaaaatattagccattggattaaaatagatctagattaatggttgtgatttaatatgagtctacatattttatggaaacaaaagactcggaaacagcatcaataaaccaaaccggaaccaaccagactccagtctgatttttggaagcttggaagctcaggaaccaagccggaatataaatccaaaattagcaaaagaaaaaaaaaagaagaagagttcaagtaggaatacaatttaaaattagctgaaattcagaattaaaaataaacactgttaagattaattcaatttagaataaaaaataaaataatatccaaaatta

SEQ ID NO: 66427 - DNA, 651 bp, Oryza sativa
atccgattataccgttgtgtttgtaataattaaatctttacaacaagatctcacatgattatattttaatgaaaaaccacaaattactttatgatatgtctaaattacttttatatttcactaaattacttctcagacatataaaagtaaattcagtaaagcctaaaagtaatttacatatatattatagaagtaacttataacaaaagaaagaaagaaagtaactttaattaatgccttatttcattgaacaaattatcatatatatatatatatatatatatatatatatatatatatatatatatatatatatatatataagttacttttatatttgattaaaatacttcctatacattcataatgctctgaggtgattacttttattattatttcagttaattccataatttgtgctggttaatttaatttctagatagagtcttgtttttatctctacaacggatttacttcaaatgacatgctaaagttaccttcgttttgttctaagttacttctataatatatgtaaattacttttaagttttactgaatttacttttatatatctaagaagtaacttagtaaaatctaaaagtaatttagacatatcataaaagtaatttgtgatttttcatcaaaatataa

SEQ ID NO: 66428 - DNA, 2821 bp, Oryza sativa
attcctgcagcccagtgagatgtttttttggtaattgagacggataatatttctaacctctgcatttaatattattttggaatgatttgcaattacaccctccagttaaaaacatttggcattggaaaaactaaactcagtttagcttacaccttacgtcaaattagtttgactgaagagagaatttaatgatgtcaataactgaatcgaaatggcatgcccagctgggagcgagatcgaccgatcgatatatatatccatcgctttctccagtggagcatcaaaaaggctagcatacacatgctgtacatgcatgatgcagcatggctatctgatctgtgtctgtcggtctaagactcttagtgtctatccatctacatctaactgaaatcgcctacgttgcatgcatccatggctgtgtcctgtgtagtgtttgcatgtcatcaaaaccgcctcttcagcatacacattgcctaatgccaagaagcggcgacgcacatacgcacactttgcacaataacctctctagatatatttagctacttgcacatgtttatccacttggctactctgtctaccgctataggcagatacatgtgacatataaaagtcgagaacttttataattaatgtttgcatttcaaaaaagataaaaatccaacgcttctcgatatgataggtactacgtaaaaagtatttaagtattggtacagatatttacgtaccaaagttaaaaagataaatgcacttagttgggagaaaatggtagaattgtccctaatttaattggtaccgcataggtactagttaagtcatttactaggtcttagtgtttcttatttgcgtggtttcctctagatttatgttttgtttcagaaaacacgttagtagtgtaaaagttattgtttgtgttcttttctctagatttacgttatgttctaaagaacacgtcaaaaattatccttttaattcatttgagacttatatttattttatgcgaagagattatattgtgttttaataacataacctgttaaaatataaccgaatgtttgcatcgttgtaagttatacattttattgatttatccgtataaaacatgaagtaagcttcttccacactatctctccttgtgggtgcacccgttcaaaccctagaagaacataggaggagatctcgattcaatctcttattcaaggaatttatgaactacataaatagctaatcaactgcgtaaatatgccctagatatcttaccgatacgcttgcatctagccgtcgaccgaccgatctcatctcctcttcaaaccctcaaccatatcggtgcttctccctttgtctcctttggtgaaccagttcaaatcctataacaataatgaagtgaaagtagagaagaaaggagacatgatctttgatttttttccctcagtacagaccgaatcaatcgctaaatcaacggattatccatgattcacgcttttttattgcatcaataccaatacgtacaacaataccaatcaatggagcctagtattcaattcatatgaaatgtccatattttactagttaattactccactgccatcacattattataattttattctgtactttgtccctctcttgatcaatagttcatattgccccacctctaagtatatctaattacgccgcaaacactgtaaaaggtctcataaaagtcatgctttatacgagacaccgaaggtctgacatgatgatatacgtggcaattgaggtctactccggaaagatatgagtgttttccgtgatatgatgtgcttagagcatggccagtatttggtccataggccctattggtgggccctacagtgagaatagtatcatgtgacaatttttgcatcgtataggagtagcaaaggtcctatggatagacccactatggatggcgacaacgagttcatgatggatgcgacaacctctgatagatgagtcttctctctctctctctctcccctttaaagcaaggtactatggttgtattcggttcaaggttgaaaacggctggaacaagtcccatagtgtatagagtcggtccaatcccattttgtctcttatataacccccttcacattgaacaccgcaatgctcttagtcacgtggcatccatgtcacttctgcaagcaacacatgaatgtttttgcatgatatgctactttatgtgggcacctgtcatacgtccaattggcaagggatgattggtttattatggtgcgatgtaactagctacgctttgaaacataggcatctatcttgcgcatgtacgtcttcatatttttttccatatagtcattagagcatttgcattgttgcatttggaggggtactagaggtgagagagaaatatggagccgccctacatattgcaacattttctccaactagtctcatcaatagatccaacactagccatagagccatattcaagtggagagaacatgcgtagcccacatgtcatatccaatgtgcaacttgtaagttggagagagttatgtaggtatctaggatgatacttgtatgattggtttacacaatgcagcgattctcattggttactttatttgacatgtaccccacacctaacaccccgcatgaattatataatgtggatgcttttatatcccaagttgtatacgtacgtgtatagtatactaggttgtatttctaatgtatgtttattgaagatatctgtgttgatttgctttgatatatattacatatttcctatattcctttttttattaccatagtaattattttaatgtttatctatctcgagaag

SEQ ID NO: 66429 - DNA, 4156 bp, Oryza sativa
tagattcattaacacctaaatgaatgtaggcaaatgctagaaagtcttacattgtgaaacggaggaagtactgttgttgacaggaactaaatgctaaaatttcataccagttttgtgtttgatggtgagccacctgacatgaagaaaaaggaactggcaaaaaggtatactctgaatagtgcctttgctttgattgtttcttgtgagtgtcagtatttttatttcctatgtttaccactctttaggtctttgaagagagatggttcttccgaagatctaaatagagctattgaggtcatctgatcctaaccgtagtactattgcctccttcttattgtacctttttacttttggggtgatttatctgttattgcattgcacctctgaggcagcatttatgttacaggttggagatgaggatttaattgaaaaatttagcaaaaggactgtaaaggtaattacctacgtttgggggaagtgagccaatcaaaagtttttacagtaactttaggaaatacttcctccgtttcacaatgtaagtcattttagcatttttcacattcatattgatgttaatgaatttagatagatatatatgtctagatacattaacattaatatgaatatgggaaatgctagaatgacttacattgtgaaacggagggagtaatatgttaatggattttttataaagcagcatcacaaaatctgccatttcgagatttgtcttcacaactcaattagatcgtctataaaatcctgctgttgtccaaagcattaatcaccttttttttcttcacaggtcacaaaaaagcacaatgaagactgtaagaggctgttaagcttgatgggtgtccctgtagttcaggtacaattcgtgcttaatccatcagtttcttcctagtcttcgttttaccacaagatgatcagacgagacaatcaactttcctctttgatatgctttcccaactccctggagagttagcagaccatttggaaattcttataaccaaaagaaggaaattgcaccagcctcactcatagagttgctgcttgtgatccggtggtcttaaacttatgggtcaacatgtcataaagcttagattatcttacatagggttctattgcaatggcttcaggcaacagtaaactacgtaagaagtccagcttatgagaattctagatgttaaggcctgctcagcttttgcatgtgtagatgtttgtttggtattggcctaagttggacttgctgttatgcttgagcgctagctaggataacccggctttggtatacatgcagtattagattggtggaactttagcaatcaacaattggttcttatgttatagacatcaccacacgtgggacataattctatttctttttgctccatttgagcaacatgccatacctatgatctcagggcaaagatgcaagcatgatacttggctttaatgagttttcactgttatttctaatcaattcatggtatcacatatgcaggcaccaggggaggcagaagcacagtgcgcagcactctgtgaaaatcacaaggtctaacaagccgatgattttattacaaatttatgtcgatgccctcgtcacatgaccgaattatattttactctgagttgtgactgtcaggtctttgctatagcttcggaggatatggactctctaacttttggtgctagaaggtttcttcgccatttaaccgacctgagttttaagagatctcctgtaacagaattcgaagtgtcaaaggtaatgctttagtaaatttcatcatcaacatttttccgagcatcatggcaattatttgttggcttccaggttttggaggaacttggactcacaatggatcagttcattgatttgtgtatccttagtggctgtgactactgcgagaatattagaggttttatcacgttttttcttttttcacacacttaatattagattctaccaatgatatcatattaccatgctgtattcagaatttagaggttgcttcattactttctcatgtcatgggtgctttagacatagcattctccattgctaatgtatctataatagaaatgtggaagtgtgatatcctattcttgagttaaaaacttcaaattatattttctgcaattgcttttatagctcaacgctttgtgcttctgttggctaaatcttgaataaatgccactcaaagttctaagaagattgtagagatatcataatgctggagaattgaatgttgtgtatgctgcatccttccttgactatctttatcataaatttatacaagtccttgcattttattattacttcttgtcttgttttgaataggtattgggggacagagagctttgaaacttattcgtcagcatggttatatagaagaagtagtgcaaaatcttagccagacaaggtatgttttccatgggatttatgttaaattgatgacctggttcaactggcatttctttagtttgttgttccattttctgagtaatcttagtttctaggttttaccatatgcttcattttttttttgagaggtaccgtatactttcttgatctgtaggtatagtgtcccagaagactggccttaccaggaagttcgggcattgtttaaggaacctaacgtttgtacagatattccagacttcctgtggaccccaccagatgaggaggttatgcttggtagttgcccataccacacggcccctgttgtttatcatgctgacagttcttgttttctttgtccagggccttataaactttttggcagccgaaaataatttcagtcctgatcgagtagtaaaggcatgagtgcatcttttatttcacttatatattaataattccccttatgcatattattgtgaaacaattgaccctttcccttatattcattcaccagtctgtagaaaagataaaggctgctaatgataaattttcccttgggcggtaagcaacaacagttaacatgttatcttgtggagaaatatccatgcagttctgaagtggtgttttttaattgtttcagagggaagcttttggcaccagtagcgaacttaacaggatctacatcaactgcagggaaggtacagagctacttattgtttcatctctcttatttactttggctcactaacatattgcacgggctacacatgcaatcatgatatccagcctacaccctagctctctgaaaattggttctatcgcattattgcataacttactgttctttaggtttcagttaattgtggtgtgtattttctctatctgggctgaaatatatctgctgttccatgatttgaattctgatagccgtttgtagctccagaaggccagggtagtgttgttttctattttactttttttacatggattctttttttacccttaaagtatatttcttcatagcaacatgggtttaatttttcgttgagttaacggatgctacataccactgcaattcgtccaattgtaacttcatatatagttgattatcatcttttcgctcctactgttctattgatacgtgctcgtgttctttgttctttctttgttgttctttcttctgccatcttaccatgtcgggatacattttgtgtaacatatggaaaaagtaggattagtgtaacatggatccttacctagtccatcaattgtcttggataacaggaacccaaatgtatcctgggtggtccagggcaagtcatgaaggttaggtcacctctacaagtgtgcaagagctcaagcttgaacttcatacatgacaattcaaaagcgttcatgctgggcaggcgatcaggatttctcagaatatctacatatgcttccatctgaatctggagctgctctatttccatgagttggttggctgaagctttgactgacaccatctacagcttcatgaagaattagtgatttcttgaaatgcgttgagcctatgctattattgtagttcagccttttgccttgtaaaatcaagttgaatgcttgagctttctcacatttagcactggttctcgcttgagtgttgaacggtgaccatgaagaatttgatcaccttttggctataatctgaaattttgtcaaggtgccagaacgagcaggaaactggttgaggctgcttaactttcctggtgt

SEQ ID NO: 66430 - DNA, 2443 bp, Oryza sativa
atgtaacgaccctcattgtttaatgccacttaaatagttataatttttttttaaaaaataaaagatatattaacatgtgatatatcacttagcaaatatacaagtttgtccgaggtatgggcctgagggtatgcggagtgaggggaatttaccttcccatcctgccacgtggtcctacagcttggccctacccccacacctcgcgaatcgcagaagcagccaggggacctcggggtgccacgtcatgcccctcgagccctcgcgccgttttgccccgagtcccccgcccggctgccatgtggaggggggagcaagcggagaagggacccatgttgtaccgctatcaatgcgtgcggcgccccaactgcccctcgccgcattaaatgcggtaggggcagacgtgcggtgccgcccgactgacgcgcgtcagtcagaaatgaccggtctgtgaccggcctgtcgccggtcgcatctgactggacgggcgaccatgcccccacgtcacctctgtccccggcggagtggaggtaggtatgacccgtccctcccctgtgtcaggcgggggacggcgctgggtcccactcaaggacgagctgcggcttagctttcaagcgaaggcacggatcaagatccggtcaaggtagggtgggtccccacccggtagaagagtagatagaggcggtgcatgtggtatccccttgagctatgaaaggaggaccttacccaccgagaaaaaggatgattccaagcagacctaagctctagggaaaaagaaggagaacgttctccggagcttagggacccttgtgattcaaccataatcccacacacaggagtagagtattacgctccatagcagcccgaacctatataatcctctcgtctacgcgcaactagtaacgttgagggcggatacacgatctctagatgcgagccctttcccccgaccgaactcacaaaaggggatctcacgatctcccgctagagaggttcactcctcgacaaagttaaaatttaacttttacaaattaaaaaagacaaattaaattgcagttagttaaattacatcccctctaaaatttagaatacccatctacatctaactgaaactgccaacgttgcttgcatccatgcatggctatgtgttacatgtcatcaaaatcgtctcctcacacacgttgccaaatgccacgaaacggcgacgcacatgcttaaaatgcatactcctacctccctagcaattgctacctgcacatgtttatcctagatgaataggacaagagtgagcagcagtccggccaagtctacttggctcttttggatgtacgctgctaccagttgttctgccgcttgctaggtatatacatccatgggaaactagctaaaatgtgacttagaagttagaagtagcggttttcgaggaggtaaatgcgtgacgtggttggcaattgggttcaaccgaagaaatatgaatgttctccgtgttatgggtgcgttttactcactcgtcatctatggtatacttctagcaaaaaaaacgtgtgttctccatgatatgatacacactttgtgtgatatatatgatatatcgagttgataagacaccattagttttttatgataaagttacattttcaaacttagacatctatcttaagcatgttttgatatgtttctttctatagtcattatatctcgagttttatgactacgatatgcttggttgtatttgtaacgctcgtttccacgaacaatatctttcttaatttactttgatatttcgtatttccttcactactttattttaatgtttatctatcttaagaagggtttgatgtatttccttccatagaaataacgcataaccgtttgtacatatctgtttattgtgtttagtcaaatctattagatatgtaatgaataaggtgcctcataacaatttattatggtcaataataagctcatccattttaaaacttgtaaacttatctctagaggtgtatcaaagcaatcgagttgatcaaaaaacaagtacaaagaaagaacttggttgcaggccttgaccggaaaccgctcttgagcagttttatcggttcgcaaaaacaattgaaaaccattgaaatttgaacaaatttggtaaaagttttgaaactaagtttggagttttttttgtaaaaaaaaaagcattgctgatttaccaagcggtttgtcaacatgagttagctcgaaacctcaaaatttcatgaaaactgatcatttttatcaattttataaatccggctaagaaataggaacctcaattcaggtatctgaattcagacgaagaggatttccaaaaacatgcgaaaatgattttctacaaacagctagttaaagtcgggcgtctgtgaaatggatttccaatggaaaattttttcataggtggctacgcaacctaccgaaa

SEQ ID NO: 66431 - DNA, 4009 bp, Oryza sativa
agcactaatcaatacattaactgtagcatatgttagctagaccccaaaaggagcattgatgctggctatagctagtctttaaaaaccctggagctgagcttgcagaaagcgcatgcaaacagtgtactgatactccatctcgtaggacggccggtactacagagaagagattagcgatactggaggtaattaaataaactctcatcgtcctgtacactgtacgtagtactgggggtgtacagtaagtaagcttaattaactgaagtgaacggacgatgcataggagtatttatgtggtgtttaagtagccatgtggagtgtgttattactgaattctgtcactgctgctagctccagtgtctccaggctccagctgctactactagcgcgagtagctaacataagccctctccttgagcagagataatatccagatgctgacactgagatcgatgcatatgcagctgggcagagatgaaaaactgaatctgatcgatctggatggatggcatgttgggggggtccttcatagcaattgggtccagcaggagatgatcagcaagctagccgatctaaaggcgaaagccagagctactactcatctgctactctctctgtcttagaggatagcagtaatttctactcactccgtcctataatatactatagagtaaaagattttagataatgcaacacatcttagcaataaatctgaacagacagtctgtccaaatttattgtactagaatgtaccacatccacccaaaataccttattatgggatgaagagagtagcattttaaaaaatatttattctaaaatatatcaaatttatcgtctacttttccatctcttttatatcaaccaactttcagttagcttattgatctattatgtcatttcaatgccaatcatgaccttgtttaggtccaaactttttttcatacttccaacttttccatcacatgaaaactttcttacatacataaacttacaactttttgatcacataggttcaattgcaaccaaacttgcacttttggcgttaactaaacacacgccatgtgaccatgcatgtgtcttatttgtatagtttcacatatctgcttgaaattaaaaagcttcgagtaccttatactattttgtaacggatgtaatacctagctacagatagctgcaatgctgcagccaggtgcagtggctttgaattaatagatgcaaatgcaattcttaaattctgcaattgcatgcatgtactatccagccgggtggcacgcccatgtgagtgcccggccgagtaggaatagcaaagcaaggacttatttggcacggctagggcttcagctccatctcttctggagcttcatctaaaatgagagcgcacggagctaggtagaactctctcacaaaataaactagagagatggagctgagtttagacagctccataacttcactccagacccaacttctagagctaaatttaggagtttggagctctaacaaacaggcatccaaataacttcatatatatgcaagcattgatgcgattaataatattgcaaaagtaacagtaatagctcggctctggatcaagaacgtacacgttgttgattgggaccagttcgtccggcagtgctctccccaccctatccatggctatggattccccatgaagaaccctacgtacgctgtctgcaataagctactcctactactacactactactgctacagctaggtctatggctgctgcatctgtctcattgctgctgcatgcatcgattgctccatgaatcgtccttggcaatggccggcatgtattggcatttctctcgatcgacccaatacaatgcaacaagctgccaattcaaagcatgcattgagtactctcgttaagagcaagtttaatttaatagtatagccaactatagctcgaattcatctatagccaatttaatagctcattcatacaatagttacatattacactattaataactggtcccacctgtcatatacacactgcgtcttagagtccgtgctacagctggctacaaatctgtagctcactgctcttctctctcatcatttatctccttaaaatatgtttgcagctgatttatagcatgctattctacctgctctaattcgttactacacttttatcagagatttcagaagaacaacggcgcggcaaactagctagccaagaaacagcagaggcatatacactgtagcggcggcggtaaagatggagaaggccggccatgcatgcatgcagcattgcgcagcagtacatacggtagctacagctgctgcactagtgcaaactgctaagctttatttagaagcaagtttaatagtatagccaaccactggctccaattcatctatagataatttaatagctcattcatataatagttatatactacactattaatacctggttccacctatcatacacgcactgcgtcttagagtccgtgctacagttggctataaatttgtagcctgctgttcttatctctactcatttatcttcttaaattatgtttgcagctgtcttataggctgctattgtacttgctgtaacctttctttctgctctccttctgcatgctacatcgtccatgcatgtacatgtctacacacacacgtactcctatacaattgtttctggctggagctagacagacagggccggaaaaagtcgatgcagtgagatacaaattttgtattgttcatttgtatgtcatgtgtaatttgttcttactaccaagttgttctctctttactactgtagctggctatagtagtacaactagatggagacgagggtaaaggagataatagaagacagtagtaccactgcacccgtcacatccatgcttccttccttatttctgccctttacaaagggctgcaaaaaactcaagggagggggaaagggaatgtgtgtactcactttcatttctttttttcttttttgcaagggaaaagaagtatattccaggacacaccctttactttgcatatatactactgctcccttggccattatcatttccaagtttgcccttatgtagctcctttgcaccctcctagctaccttagctggctcctatatatatgtggggtctgatcagtccccacaccttggttacactttctagggtagtcagattaactaagagtaattattatttatattttataatctaataataacaaaaatactaatcataaaaagtttcaaataagacagatggtaaaacgttaaaaaaacaaactcacaactacacttaaatggaatagagagagtagctaattagcgagtgagtttcaaatctcacgagaatttgcatgattggttgagctatggcttataaccataagtagaaaaataaacaaattaactataaaggattttagggtgtgacttaacatctgcttttagtggtttaaaagccaatactgaaaaattgaaaacaatgaaaagattaatttagattttaaattgtggttgcgcagctgataagctgacgagcagccaatgaaagtgactactgaaccgaacataccaaattaaaaatggaagtatacatatatatggtgctaaaaaagaaaagcaactcatattggagaagagttgcctagatttgataatggtgtcatccattattccacaaaaaaaaatcttagaattaaatggctagtagaatttttttgagagaagaaaaattaatccttgttcattttcaggttcctttttagcatactactagtactaatttgtactcccattgaactactagaaaggtacctatattttggaatggattcagtagtattatttatgctttctccttataccaatgtaggagtactactttttatttgacattttgtgcagtaattgacaacacaattaattttctgcagcattaatttggaaaaaaaagttttgtgcacattagctgaagcacctaaatatataatttat

SEQ ID NO: 66432 - DNA, 2173 bp, Oryza sativa
ttaccttctttattactcttgacttcccctcttgaccattgtcattgagacatccacgcccatctcttcttgtacagtctctttcagttctctagctttccatgacggattagccttaattacactctcgtacttatcacaaattctacttgtagacaaccttttgttttttagatctgggcagcaactatgatttccattatatgtcacgatctgaaaccaatcactccttgagttgtaagaagcatgcagtaaccatgtacaacctttccgcatacaaacagccctaagtctgtctctgtcatttttgataaattttatatttaccttctttttcaacgcataccttgttattgcatccttcaattgcatctttcctctaaagcacatgtcgactgcattttgtggtaattcagcatggttatcaaatattggaaaccgacacttcctcctctctgcagaatccccactatcatcatcataggatgcatcatcctctgaatcaaagtatgcaatgccatctccctcgtcatttacctgtgttatggtgttggcatcaacactttgaggaagatccaactcaactggggtgtcaagtggaatttcttctctccttttcatttttttcttgaattgcttataattaattcttatctcatctgcttcatcatcttcatcctctgtaaaaccagtggcatcagaaccactatctgaatctaagccttcagtttgtatgttcgcgatactgctattgggattatcacattgtgtgttcgtaccgccctttgcaataactagagagtctggaaacatgctattattatcccgaaatagatcaaatacagcttcatcagaatgagcctctaccaatgtagaactgcaacccatatccaatttaactatttcagtgtaaatgtccacagctccagtagttccaacaattttcaccatctccaagcaggactgatcatctacaagcagcctcattccattatttagtgcatcaccaggtggtaaccagtacattctaacaggctgttgaaaggttgtgtgatccaacagatggccttcaagttctgggattcaaattttctcaatgtctatatgtgacaagccctcatccccattaatgtactgaacttttgacccatcaagaacgaaatgaccattgaaataaaatttaatagctaatagctcagaatctgccatctgctttcgttcctagacaaatctgctacacagtagtggtgaaaaatcaaaacatatccaaaaatttaatgcgatcgaacaagaaaaatgagaacttgcctctactggtgtgatccacgacttctgcaaactagcactccaactgatcgcttggcaaaaccccagagcagtgcataccatgacagagcttggcgaagcttcttggagccgtacgtcggcgttgccccgtgctgcggcgacgcggctgaacaggagcaatcgttgtgcagcgctgcgatgccgcgaccgccgttcgccagcgaccaaaccctatcagggtttagacggagaaaacaaacagtggagtaatgggccggccttttttttcttccttcctgttgtttcctttttttttccttttctttcttttttatatggtaagggtagaatggtcatttcatttgtattgttgcatgcaagaatgacttggcatgcttatgtggtatttttgtgggaccaaggactatgttaacccaaatgattaatttggaggacttatttggacgttttgaaacctcaaggactaaactgagcccgaagcgaaacttcagggaccatattagctattcttcccaaaaggaaccacattaggagtcactactagaaaaccaattttcccaagcggccaaaactaattttcgcagacgggagggaggttcgcctgcaacacaacgactgtaaaaatcgatgattttcgcagtcggggcaacggccctcctgcgaaaatgcaaaaaaacgaacaaaaaaaaaaatcgccgcaccgccgccgccacgcgactcgccgccgcccccctcccccggccggatctgagaggggaggggaggggagccgccgctgccgccgtcgtcgtcgtcgccgccgccggcctcccccctccctcctctggccagatctgcgagggagggagggaggggagaccccgcc

SEQ ID NO: 66433 - DNA, 38650 bp, Oryza sativa
ccagccagatctgggagggaaggggcgaggggagacgccgccggccgcgcgtcgtcgccgtcggccccgccgcgccgccagagatgaggggagaggagagtcagtgagggagaggagaggagaggagactgagtcagtggagggagagggagagagagagagagttgagtggtgggaggggtgggaggagaagataagggtgggttttttttttgggtaggtacgatttttgcagtcggaccacataaggttcacaagcgccgcttaagtaggccgcctgcgattttcgcaggcgccgcttaagtggtccgcctgcgaaaatagattttcgcaggtggacatcgaacttcaccccgatttatattttttgtaggcggtcatttagctataagagtcatgtccgcctgcgaaaaaaaagtccatacgttggggaaaatgcgttttctagtagtgagtttaatccttcagtgataatatatgatttggttttacgaaattgaatatttaaaactctgactaataattgaactaaaatttaatcttggatgtagtatcattatacttccttcccttcaaattggtaatacttgttgttttggataaaactatggtcaaatttttaaaactttaactataaataacatttaaaatatttatcttagaagtacggagagcatacatatggattagtcttaaaagtagtttaataaaatcatatatttattgatatttctatatatatattatattgtaataaaaattagtagttaaagttattttttggagaccatgttattgtccaaaacaataagaattaccaactcgaaaggtgtatttatatttaaatatattttcatatgatattaactttatagttgttgataatgcattatgaaaaaaaaatcaaaggtctaaagtaattattacgaatgaaatcaatggaaaaaaaatcattactactaccacagcaactaaagtatcataaagatgctctatagaagacaaattttacctgccctatacgggctaattggcaggcgtgccaattggcacgccaattttttagtttatctcttattcggaatgatttatcatcctttctctttggggttccgtaagaacttaactaaatgtgttgaaggctctcctccaaagagccaatagtcaacctcctatcccctggtggtggctctcccgttatactctctctagggaacaactcattactcatagattgggccggcgtatctcatcatcagagaattcttcttgacttctccgcatcctcgaggcaacatggaaaggcccacaatggatagggcagggtggctactttcatgctcgttcctccaggacctcgaggccacttcgcatagggcccacactgagctagagtgcgatggcaacccgccatgtctttgctgcatccgcgtaggcatgtgatgagcaggaatgactgcacccggttgggtgttagagcaaggctaataagctggtgattagccggtacatgtcatcttgatctgatgtggaaggaaaaattactccctccgtcccagaaagagacgaatcctggggggagagctttgtcccgaaaaaaaccgatttctggacagaaaacgagaaacttcccatctatctcatcctgtgtgggccataggtggaccgcgtatcctctcgttcacaccacgcaaaccttatcgcctcccagttttttttctgtcgcgtctctctctctcgttcctcctggatcgattccatcgccccgtcgcctctctctcgcgtttctctccatcgctccctcaccccctcccggatcgattccgtcgaagcggcggcgtccagatgagcgacccttcgaagcttccgactccctccctactgccgtcgtgctcctccccacacatctctccccgctccacgccgctccccctcacttccgcaactccctgcggagttccccatccaccaggatgcgggcgcttcgatacagcgggggagggttgcgagcggttagatccgatgccggaggcggctcctttcgaaggatttgcctcgatggcagagttcgaggcagcggcggaacagtttagggttttcattcaagagacgaaagccaaggcggaggaggcgtatcagcttgcggttttgatccaaaaggcggcggcgggagggggctcagatgtggcagcggccttggaggtttgcaagaaggcggcggaggcaacggcggcgggtggagccagttcagatgcggcagcgacatcggagatttgcaaggcggcagatgtgatggtcaaggaggtggcggcgcacgcggatctgatacaggaggggtcggcggaggaggaggcttaccgacctcctgttctgattccggtggcaacagctagggactttggcggcagtatgcgtggattgactcaaaggtatcttcaccttgttttccctacaaccaatctgttccccttatgcaatgagagatgctttcaatgacgtgtgtagatcagatgcactgggtgcggttgcatcccaaaatttttttgattgtactgcatagaatatcctaggttaatgttgttcggtgttttgtatctttataatcatccagctgttatatgtcggtcagtgttaccaatgttgaagtaatgcgggttagctgggttttacattttgttttctgcaaaatttggcatggagtgagaagggggttatgatgacatgtttcaaataaaataaattagtgttaacaaaaatccaagcagttttaaacctaaccaaagcattcctttctgttttgttgcccataggtatattctgaaattagaaatttttattgagtataggaaacaattataaactgtaagaaatttgatactgaacatgcgaattttatttctcaaagttttttttgactgctttattgctcaatcaagaggctgatgaaaaatccaaaattgtggtgacactgtaatgcatgaatattaatacctctgtttttaaatataaaacattattgacgtgtaggacatgatgcttgattgatcatcttgtttaaaaaaactaagtatatatggttaattattttgttctgacttgtttcaatatcagtaaagaaacttactcctgaatgcagctcgtcgtactcgctttgttggctgcagctacctagccagcgtatgttgcttgcttgacttgttcattttaacactgaaacctatcgttgagaagcttcaacttgctccaatagtacaactgcacccacagatagttaggctgtcattcatagctaattaaattaactaggtaaccttgatgttgttctacgagaattaccgtggatgctatactttgatttctgcaaatctttttcgattgttatacttctattattcactggatttgatcctttaactaggccacgcatatataaactgatgtactctacttttggctttcattgcgttcagtagtccatttggtctatacttcaatttagacattgcttatttacatgggtcagcactatctttttaaaaaaaatgtatcgaatatataatgtaatcgaagtacatttcagtttgattccatgatagattcatctttacatcccatcttgtattaactgtcactgtgttttatccgttacaggactatgttgggagatgatagcgaccacatggccatgttcgagaagaaggcaagcgtcacgcaaactgacatgaaggagaagaggggaaaagctaaagatgttagcatcgacgaggacaagtcaagcgatgatgatgttgatatggtcattgggggatatgcgcaagatccatacgatgatagcggcctagaagaactcctacaagaccaagacgcactggaaaaatcggtaaaaaaatttctagagtgttttaatagtaaaaaatttagatgaatgcttcaattatgtgttgattgtgtgcctgtttggtgattatgaatggtggcctaacaaagtacctcgaagtaggtacccttttggtattgtatgaaattatgtgtaattatggtagtactttagattaggtggttattgatagcagcctaagaaggtatgttaaagtaggcacccttttggtattgtatgaaattatgtgtaattgtggtagtactttagattaggtggttattgatagcagcctaagaaggtatgttaaagtaggcacccttttggtattgtatgaaattatgtgtaattgtggtagtactttagattaggtggttatgaatagcaacctaacaaggtatgttaaagtaggcacccttttggtattgtatgaaagcatgtgtaattgtggtactggatgagattaggggattatgatgatgcatgtaatgttgattttacattgtgacatatatataaaactccctcgttcccttttgatcagcgcataagtaaaactgaaatgttccaatttgatcaacgcattagcctaggacggtggccatgactcttagatttgcatgctgatttaatttttgcatgcatgcaaggagacgctggccattcatttcgcatactaggcactagttttaataaaaaaacggggtctctctctctctcttccgttttgcatgcaagtaactgaagtgctaattgtgccttttatgaggtgggctttaaatgataatgggagaaatttacttcaccttggtctcgctgcacgattgcaatacgtcgatcaaaagggaacggagggaggatgaaatttaggcaaaagctcaaaccatgataaaactttccacatgacatgatactcaaatgctgatactgcattgtcatatatacaatctgaaatgtagccaacaaaagctgaaaccatcataaaacttcatattacatattacaaaagctgaaaccatcatagaacttgccacattgcatgattagttgcatttacttgagtaatactgatattactttatcatatatacaacatcacatttaaccaaaagctgaaactacgatagaccttcccattttgcataatttactgcacttgattggctaatgctgatatgaccttttcatacagttcacgaccacaactaagggtattagggagaatgtccagacgctctagcctctctttacccatatgaggtattctgtatccatttccaccatcagcttccataacctctaacaagcaagattgtagtgttaggaacaccctatttagcttgttgtcatcataggcctgaaattcctgctcaacattatgtattagctcatccatattcctagatatccttctatatgttaatgattgtagcgatgcaaagaacccaagatctaatgcattcatatctggggaattaggaggctgatgcataaggcggatgtcaaaccctgtttgggatactgcataggcaaattgataatcatccactggcacatgagcaggagcattgtcttgctgaatccatatagtgctgtgtgcatcgtctcgaggccaacttgatataatacctggtagtactttagcaatcagaaacgaccttacggtgtctcgatcaaccttgattgtcttggtgactagagttccccttggcctgttttgacttgtcctttgtgctggttcctatgtatataacattaagtaagttagataagcaattaagtttcacatcacatcactaagtaaaaatgcatatattaagaggttataatacctttttggtgaaaggccacaagcctatcttgccgtcaaaagtgcagataccttcttcattgtatctaggcctagcaactgctgccaagaacatcactttatcaatagaattcttgttttgcacgggtctgtacggatcatcctcccaatggaccaggtaaaaagttcttgtctttttagtggtattgaaccatttttcatcgatgtgcacaatgttgcgcatatcaacaaacttcggttcatttggcaaagtatgccaatctaacatggaaatacaccattgcagccttgatcgtttgttctcttccttcaacaatggctttaatgtgtttgagtgacgtcttatcagcccttctttcaacatcctatgaagcgtgctttttggtatacccgcggctgatgcaaatgaccgtaatgtgccccttagttgcagggggacattagcaacatctgacaagtcaatttcattcttcttgcgaccagaattagttttctttctagaacttacattgactggaattccctgtgcacggcactgctttgctcttcgccaaatatcttgcactctaccccttttgatattgaacatttcagcaacttcagttgttgctttttttcttagtcttccattgatagttttcttaaccaatgcatcatatatctcttgcctttgtatgttggtaagatttttgtttggatgttcatcttcctcatctgaatcatccaactcctcttgttcaaaaacaatttccacatcaccagcatacacatcgtactcctgcatgtctacaacaacaattacaaggtgagtcgtctgtaccaatttagatggtggatattttattatcatggatcaacatggttgtaaacttatggctgattttagatttcagaaggacatagaaacattgacacaatttactttatgtgctgaaatgtcaaattgacatccataatttgcaactaatgcatccaatgttatgtttagattattctaggtagttcgcatgatgtcatattagtatcttctaattaaaaacatggtttcagttaattaatcttattcttcagtggtgctttatgtacaaccacattttattaattttactaagtttgttatccatgtcagctaaaagtgctttacctgcttgcatttgtagatgttcctcataggcatcagagttaacatcaaaaggaaagccatgttggttgtgacctccataaatttgcagaatttcatccatggcatcggcaccgtctacaataacaattaccatgtgagtaccaagtctaatatcaatattttgttaggtacaatactattgcagctattttattacattctacaataaaataattatgggccattatactcagatagctcacacattgcattattacaaccaatcattagtgctgatacttgctatttgacatgccatgcatattggcctaactggatatgtgtgactaaaagtaataatgcttatactactcttccaatgtagccaaatagttctatgaataactgatctgttatgctatatatataatggaaccaatgattaatataggttactttgtgcagtacaacatcagcaaaggagattatcatatctgaaaaccacaatcaaggtaccaattttatatccatctcaaatttagttttgttgtctacctattttgttattgtactcttcaccttgtttttcaatagaggtccatgtcagctgtaaataaactcatggaagtgctcatgtttctttttccctaacttgtgctattcatgattgtgattttatcaaaaggtgcttgtgctgtagtcaggagaaccattgggtattttgctgctttagttatattatggccatacttgaatgacttttctacattgtacaaactttggtgctgaagttcagggctttttgtgatctgtattgaaggtgcaatctaactttgatatatactaatactagctcaatatcagtggtactgtaaaggaaattatacatgtagaatctagcatatgaggattgattgtagacagaagataagcatcatgtgagcactatttgattagttatagctagatacatgtataacttgtgatattatggaagggaatgaacttcaatatgcccaactcattcacagaatcgagctggtaaagaacaaagagaaaaaaaccaagaacatagcagttccatcaatgcacatggtatcttttttaaaaaaaaatgccaaagatttagagtgatttatgcaagtcatatgtacaaagatcgatcgtttactattcttgcttgcaaggtcacctggatggttatggttggcacctccctgcacatcacctccaagttgatcctcctcttgaccaacatgcatttcaacttctgcaaccactggttcattaaggtcaggcacatcatgctcatctccctcatctgccactggttcattaaggtcaggcacagcttgctcatctccctcatctgctagttcatttagatctaaagccatgaaggtggtgtttttgcagactcatgaagtgataagttgggagggaaacttgtgagaatggttcattttgagcttttatagggtatcttgtgctggggtgtgctcaaatttgtatttcttgccgccaagcaatggtgttgtttgattcaaattagttggcgcgctggattagtggcctgtacagatatttggtgcccatgattggtgtactacttgtactactctactcaagttggctgcagatattcaacttgtattattattttatttgtaactaatgattggatgtacttgtattgagggcattgttgtcttttgtcacttgtcctaaagttgcattgggattctagggtttgtgattttgtgggacggagggagtaggtgtgagagaaagaagttggctcttctgcaaccgcctgctctgcacaagcgcctagacagactgacaacctaagcccacattcagcgaggggagaaagagtagaccccgggtccacaacaaatataaaagatttatttactaatacgtatagcgtctgcctttatttaggttggctattacatgtagcgcccgttccgtcgtggcgcctagcgggaaaactatctcttaaaaaccctatttgtgaaatccgtttctttgcttgttgtctagtgtccgtgccatctcagatctcaaatccccgatctatcgtcaagttcaatcccgaatccaaatccttcccaaatcaaatccctccgcaaagtctatttcgcctccctcgggttcgatgggccgaatccctctcggcccatctccccctccctccccggctctctctctctctccccgctctgtcgtaagccgcgccgagccctccctcccgctctcgcagccgcttcccgccgatgccgcccaaatcgccgcgccgcccgcgcgcgcgcgcgccgtggtggccgaccggccagtcgccgccgccgtcagcgcctgccgcgcctgccccgcgtctgccgcccgtgtcgccgctccactccaaaccgccccgccgtcatcgccatcgtcatcgactcggccccgcctctccccgcgcgtgcctccaagggacggatgcagacctcccccctctgccgcgtcgccctctctccctcccccttttccccaagcggcaaggaggcaagccccctttctctcccccccttttttctctttttcctcccgccggcgtcatccttccccccctcctgtcgccattttggccgcgagcgccgagcgccagctcgctcccttgaccgcccaaggtcggtttccaaaccgacatcgccgccctataaacccaagcgcttcccttcctctttcccctcccaatcttccccgtttctcgcccgcgccattgctgtctctctcgccggccgccgccatcgcgtgtgccggaggagccggtgcgcgttaggacgcggaaggggactccggacgcaccctctccttcctcttccccggcccgaggccggagagatcactcccgtgccgtcggcctcttgtcacagcgccccgcctcatctcggtagtgcattcccccgttctccctcctcgatccatctcctccccttagttttcggtagtagcatgtgtagccttcccgtagctagctggtgccgccccgaccgttgccgccgctcgctgtgtgctcgccgctgtcgccgcccgtgctccgtagcgcccgctcgtcgccggcctcgctcggcatagctcctcccaatccgacgctagtaacggattcccgtagccgcgtagatgctctcaccgctgggaatcggcccctcgtgacctcatcgccgtttcccccttctcccgccgtcggttgccgccgccgctgcaatccgccgccgtcgagcatcccccggcgaatccgagccattggctcgtctcccctcgtcctgtgcaacatcccggtgtgctcgccttcgcctgtatcaccatggttcgctccgccgctcgccgccgtcgtccgccgtccgttccggccggcgtcgtcgtctacctcccgccggcccgcgtggtagccacgtaggcgccacctcggccgcgaccgggtcaagcagaccccggtccgctgcttccctccgccctctcgcgcgcgcggtccaccgtgagccgtgaggctgcgcgtgggcccgccgcaccgcgtcctccacgaaccgcgcgcatgcgctgcgcctccctccccaaaccctagcacgccccgcgtgcacctcgctcacggtgagccaagtcgccgacaagcgggtcccacccaggatcacgcgggatggacccggcccaccggctctctctctcccctccccgcccgcgcgcgcgtcttgggccgccttcttgggccggccggcccattaagcttggacgagccgccccattctctcgggccgcgccctagccgcccgagggaagtctaatttccctccctccttcttttcttttcttttctttttcaaaaaggatttaaataaatccttttcctttagaccaaaaatccaataatcttagaaattcaatatcttcccaatcgtaagtccgtttgactccgttcaacttccaaaattcctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagtgaggcaagccacctttgaacatcttgagcctatatttgaacttaattatgttgcttaaaaaatattatgcattgataggattacacttaatctgcttgtcccgtttgcaaggcagattgacggacctacctaacttgttgcatttgacccttccattgtaattgttatatcatgttcccttgtaaccacctagttgcgcctcggtaatcgtgcactctgtacgagtatcgacggtcgccttcaaacttaaaatctgagaaacatcttgggtaaaacttgggttttacaaaagacttggaaaacccgacacctgggtcggtgcttgcgaacctaaatgaatttccaaaatcgcggaccggggaacgtaccgggtgtacggtttcccgctcttgcacttaaggaccgtttccttgaaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctggaacctaatctggtgttggtctgggacccctctcgttggtatatggtgaacctgtgtcggctttcgaaatgccttgtcattaaagccttaaggtctctagtcgtggccgttctgcacgggctggatgatccgggttagtaatgtcgtgtgggtaaagtgtaccccctctgcagaggttattaaactgttcgaacagccgtgcccacggtcatgggcggatatgaggtgattcctagcgtagttttgtttgactactgctttgtgaaatttgctgttgtggaatgggtttgatgtttggaaaatctgcggctgatgggatcagccaggcccgggtggccgtttgaaagctgttggccgggtgccaaccttgatcgattcaaaagactgatacattgcacatactccgaccggatgagacgcactgtctcatccgtgtcgtttgagaagcactcacttagttgtttcagaaaagagtttaaataaaatcaattgcaaaaacaacagcctttctttgaagcctacattaaacacttatttcccatggcttgctgagtactcccgtactcacccttgctctatataaataatcccccccaattgctgaagaagatgaagcggatcccgctgacgaggagttcttccaggagcaagccggctacgatgagttttaggatttcggcctagttcccaagtcgcgcctgtgatgtttggtccaagtcttggcttccgttcccctttttaatgcagttgtgagctcgggatctgtccgtagcccaacatgactgtactcctactctataataaagagacctctgttgctgtgatattctgtcttcctgtgataccagcactgtttcctgggactggtatcgattaacaggttaatttggagcgtcacgggctagttccggtcgggactagttcggggcgtgacaagagaggtgtaacatcctggcctagggcttaataggattaatagaatactcatatcaacaagttgtaacttttttttcggaagccaatctccaaagaactccagggttaagcgtgcttggcctggagcaatttgggatgtgtgaccgaccgggaaattcttcccgggtgcacacgagtgaggacaaagtgtacagaaaagacatgtgttggtctggacacatggacgtggccaagaaggacgttcctggcctggggttgatcaacgggggcgtcgatctctcttaagggggtgagggtgtaacattctggcctagggcttaataggattaatagaatactcatatcaacaagttgcaacttcttttccggaagtcttggcctggagcaatttaggatgggtgaccgaccgggaaattccaacttctttttcggaagctaatctccaaagaactccaggggcctgccaatctctaaagaactctagggttaagcgtgcttggcctggagcaatttaggatgggtgaccgaccggaaaattcttctcaggtgcacacgagtgaggacaaagtgtgcagaaaagacatgtgttgatctgtgaggacagtctataacctatgaaagctatcagatgtaagcggacccggtctgggagaggcggaacgttacattacatcagtgattagtcgactgcgggcttctctattatccatgctcttagcccccttgccattgcttggtgaaaatgcagtaaaaagtgtgggtcccagctggcgtgcggtagtcaaccgtgcgcccttggtttcctacgcccgtgtcagagcctacacggtggatcagtggatgtgatcaatggcagtggcaggagttgtcgtgctactagtactacctttcatgttgtgtgccgtcaagtagataaccatcacatctatcttaaaatgaagggatccttaagcggcaccaaggcccaaggaagcagaatggttccgctttcatgaagagttgtcctcgagatgtccgagaacaacaaatttctccgatcattcacaataaatggtcgcaaagcaaacaaccctagcaaaaaaaaaaaaaaaggttggtggaagggacatgtggcttcttgttggcgcgagccatttgctacggggatctttggttcatacttcattggtcaccgacactatgacactagtccctccgtctcattataaaccatgagttttcgcgtctaaatttgatcgtctatcttatttgaaatttttttataattagtatttttgttattataagatgataaaatatgaatagtactttactcgtgacttatatttttaatttttttttaaataagacggacgatcaaagttgggtgtgggaaaccatggctgcacttaaaatgggatggagggagtatatacctaaatatataaggtggttgtataaatatatgtgatccactagattagaaaatacgaataatctagcttaattctactactaataaaagatgatatgctaccaataccatcataaaacaccgtagtatttaattgtgaggactagaatattgctagatgataagtgtttctttttcaacaatggaatatgcaatatgtgagttctcatataattactactacattttttttcaagcaactagcaccattacatacatgctactagatgtgtttttgcctaccacacagttcttacaaccatccgcttcttctcaaccaagagatgaaattctatatcgaccataaaaacgaaaacagataagagcttgaacacaccccaattttcataaaatcccatgaccacaatcctcaacaataaacggaacagataaacccaataaaaaaccgtataataaaaatcgaaagaatccaaaactcccaagcccaaacgacaaacctcaggccgggaagcatccaaaccctaactcgatcaccaccgctcgtttcccttccatccatccatccatcgccgtcacgtgtcctcttccgccttcctcctcgcccctcgctggctgaatccccccaacccgcagtccgcaccaactcccgcaaaaaaaaagaaaaaaagaaaaaaaaaagagataagaattattttctttactaataaaagaggcggcgcctttcgattcgattctcgaatccgaattttactacgaccaggttgccgccgccgccgccaccgccgccgacgagctgggcgccgccatggcgctgctccccatccgcgcgcggctctccgcgctggacgacgacgacgacgacgccgccaccgtctcctcctcgcgctcctcctccgccgccacgtcgccgtcccgctcgccctcgccgctcgtcccgcgcgcctcggtcctcggggcaccgcgcgtcgcggcgcagctctcgtccaccgaggacgacaacggcggcggcgaggatgaggtgttcgacgaatccacggactacggggacgacgaggcggcgggggaggtgctggatgagttgtcgaacggcttcttccgcatcgccagggtgccgccgccgagcgaagactcgagcccgatctccggcggcgagccggtggtgagtgtctcctctccgaccgagagtgggtacttcggcgcggcggagggttctctgaaagaggagggcttcgtgggcgccaggaacttcgccgacgtgttcgacgctggctccagggtcgggtttgaggatgctaatggtgtcactgcgggtgccaagaatacaggcgtcgagagctcgttggaggggagcttccagagctcagggagcgtcgtcggcgtgttcgatgacactgacgtcaccacaataggtgatttggtgagtgcttcagatggttctccgctgaatgttgataagcagggggatcaggattctggtgctgaggttgtcaatgacgagcctgttgatgctgaggttgtcaatggtatagagcctgagcctttggtaggcgagtctgttgatgctgaggttgtcaatggtgtcgtgcctgagcctttggtaggcgaatctgggggctccgacggtggtggtatgcatgttgaggatgaattggagatggagggtggaaagtctgacaatgggattgctgaattgcctccagtggtgagtgctctagagaaacaagatactgatctcgagcttcgcaatgatgattctggtgcaaaagatggcgcggacaatcatgaggatgcaacgaattttgttgattccagtactggatatgttgccacaggagatggcgcatctgagcttttagaggttcctgccaatgttgacgacttgcattttgtcaccgatgacggtcataatgatgacgctgaggaaactgatggtggttatgaagcttctgatggttatgtgtcaatgccaacctttggaaacaacaatgctgttgaaattcctgtaaatgaatcagagcacaatgtacctgcttccaagggcaggcgctttggtctgggtgattcagatgatgagtttcatgatgatgatgtggaggaggaagagggtgaggtgaacggaaaggaaatagagtttttcgactatgcagctttagctgagcttctaagagctgccacacctggacaaggcatggccaaggttttcccaattgaatcatctgtgcccctgcaagtccctcctactacggtcagtgttcctaggaaaaatgtggcttctagccctgtgttggaagtggctcctaaccctgataatgagatgactgaagaggagaggaagttgtacagaaaggtggacgtggcacgaatcaagtatttgcgtcttattcatagactggggtatgacactgaacatcatatagctatacaagtgttgtatcggcttagtcttgttgaaggattcaggcgcataaaggtggcaaatcattcctctgagcttgagagtgcctggaagaaggctttgcaacttgaagcagagggaacagaggacttggaattctcatgcaatgtattggtccttgggaagacaggtgtggggaagagtgcaacaataaactccatatttggggaggacaaatccaaaacgagtgcttttcttcctgcaacaactgcagtgaaggagatttctggggttgttggtggtgttaagtttcgtgttgtcgacaccccgggacttgggactactcacatggatgaaaaatcaaacaggaaagtgcttaactcagttaagaagtatatcaagagatgccctcctgatgttgttttatatgttgatcggattgatacccagcgtcaggatgcaaacaacttatccttactgcaatgtattaccagtgtgctaggctcgtcaatatggtccaaaaccattattactctcacccactcagcagcagctccacctgaagggcctagtggcatcccgttgaattatgagatgtttgtcactcagcggactcatgcaattcagcaaagtatccggcaggcaactaatgatcctcggtttgagaacacatcagctcttgtggagaatcatcacctctgtcggaggaacacagagggtgaaaaggtgcttcctaatggccttatttggaggcgcctgctcctcctcctgtgctactcagtgaagacagttgagactaacagcctgtcagcccgggttgcttctcccgcaaacctctttagcctgcgttttcggatgcctccacttcctcacttcttgtcatcattgttgcaatctagagagcacccaaggtgtgctgctgaccaagatgttggagatattgatcctgatgagttgataaatgaggatgaagaagatgactacgatcaacttccaccctttaagccattaagtaaatcacaggttgcgaaactctccaaggagcaacagaaattgtactttgatgagtatgactaccgaaccaagcttcttgagaagaaacagttgaaggaacagctccgaagactaaaggaaatgaagatagagggaaataaccatgatgtacttggggacaatgataatcctgatgatgaatatgagacagaaagatctgtcatgccagattgggccttgccatcttcgtttgactctgatgatccagcataccgttatcggtgccttgaccctaagccaaactttctggtgcgtgctattaccaaccctgatggatgggatcatgattgtgggtttgatggtgtgagccttcaatatagccttgatgctgccaatgcgtttccagcttctctgtgggtccaagttaacaaggacaagagagaatccaccattcatttggtgtcctcaatatcagctaagcatagggaaaatgtttcaagccttgcaggcttcgacatccaaaccataatggaccagcttgcttacactcttagaggggagagcaaattcaagaactccaagaaaaacacaactaccggaggtttgtccatgactttcttgggagatactatggtgaccggagcgaagtttgaagacaagctatcagtaggtgatagattaacattgttagcaaacactggtgctgtgtccattagaagtgatacttcatatggagtgaatatggaggcaactctgcgagagaaagactatctgatgggtcaaagaccttgcaatttggggagcatccctggttagatggcataaagaatggagcatggctgcaaagttggattcccagttctctatgggaagagcttcaaacgtggctgttcatgttgatttgaccaacaaattaactggacgggtcagcataaaggctaatacatcagagcagttgaagattgccctattaggtgtctgttcaatgacaatgtatttatggaacaggatgcatccttttattgatcgtaattattaatagcactggttagtacaacaatttagaatttcttgaccattttatgcttttcttgccaattctgttgtgtttctgcttgttatttcaaacttccgttaaaattcctccagctctactgtcaactcatgttcgccttgtgttcttgtttattttgcacatgtataagtaaaaaaacaacataggagggctatgtttttttgttagagtactattgttgctgactagatttcctcctattcattactcatgtacactgtggcttttcattgtagaactgttttctacatgttctttcttttttaacaacaaagggactgtctatctgttatcctttgtattgtataattatccttggttccttccagccttccatatttaaatcattttgagaagaatttaggagctcatataatatactgtatatatattggaccattttttccagactggttggaaatagggattatgtgcataaaaatgtgatgggctaaattcaatttgtattggccaattgggctaaatggctttgagagaatgagggttacggggtcaaatgactaaaaaaggaacaaacttcagttgatggctacatttcaactaaattaacaaactctaattcccaagtgttttaaggtcaggttataaatctaattcccaagtgttttaaggtccagttataaattagtgttgtatgacaacccattagacaaaattcaaacagctatatgaatctactttcttctgctcaggttatttatatttcaaaactgaatttctcttggaaggtcatgtaaaggttctgtcctttcttggagtcctccattccaaggtaaaccatcatagtgcccaatctttttaagtcttttataattttagtagataaaagtcacttaagtgaaaatcagtgttttagctgataagttgctatatgggctagtaaaacttgtcagatgtgcaacgatcattagtctgtcggtaaagaagctgggaacttattgttggttacttaatggaaattgtgatggtgaactgtgttttacccaaatacttattagaagtagtgagtgaagctttgttatgtgaattttgctgatacatctagaaaatgatattgtgcccaagttcttatacatcattttcacccttaacttgtgattccataggtgcgttgggaagtgctcggaagcttcagagttcaggctcctactactcagctagggatataagttgaaccatcactttcagtcaagaatcaagacaagtgtagctgtgctgccatttgatgtttgcttccctccctccgatgtgcagttggtggacaactttaagagcagaagaagatctactcttgttttggagaaacttgtgatcagtagcagctgttaaaccataataccattgtaagttattaccatcttaccatctttttttttctctgtgttgcccctttcgatgaagcaactaaagttcgacaaatacaagaaatctagatgttgggtaaaacaagggccatcatattgtgctatgtcaatggttggtaaactttttgaactactatgcttatgccctttgtgctggacatctgataagcatgacacctgagaaattatagtttctgttagttgttgccttgtgttagacaatatatatgttgtcctgatctacacactgaaatcaaagcctatcacatcggttgtgccctttttttgtttggtaatatcaatgacaatttctttgtggatatccgaagataagataaggtgctggggaaagagagcaagaggattggcccactcggtgttggtttatcctttgcaagtgggaggggttttctttcatttcttgtcttttagaataggattctcaagtgattagtttatacaaaaggagaatcgaattcaaagtcttgccttctctctcttttctttctttgaagtgggggcttataacaaacatatatgatatcatcagattttattagggttgcaaattatgttcgaaaatatgaattcctgtgtttctggacttgcataagcgaaattattgcttccatatcaaaagaaacgacacataaaagaaacatttgcacaattagcatatcagaatgtccttcagagcaggatacatgcttcctgacatgtaacagccatcccagatcacaagaaatgaaaacgaaaaatggataatttggttgagaaagtattcacaaggaccgtctgttacgtgtaatactgaatatagcagatatagttttttagacgcaagattcggtcttccactgaatgaaaagcagaacttgtgataaacagcctgtcactaacccaagttcccatcttatttgcatgaaaacatgaacatgaaaagaacatgttctcatgatgagtattcatggctgagggttccaacagccatcagcttcccagatcaaaggacaaaacagaaagataataatttcatagttagaaagctcaccaaccacatagtatcatcagagtttttctgcataggtaatctgaacaagaacaacaggcaacaaagtgggacatggagtaggttttctcataactttgcacaagactctactagtccatactttcttgagttcatgttcatggctaaaaggttttaagctccagcaccacatgaacatctcaatatctcatcttgccaagaaaaacacgaactacatacctccttgttttccttttagattacacccacccatcatcactacctagttagtccttcatgcatgagttcatgttcatggcctcatactcccatcattcataattttacaagacttactcaatttccccccgttttcggttcagtttcttgcagatctgaccaatcaagacatggccatgcagcatgcccatgcatgtttctttagttcagatctaccttttcttttttatgtgtgaccccagggagccaagaacatgactctccttatggggtcctccgcggccgagccccggcagtcgtcgccgccgtggctcgggccgcggctgacggcggaggcggccggcctcgccgcgccggcggtgccataggcccgccggagcttgtcacggagggcctgtttgacctcgtgagcccaagaacctgaaccttccccggtaaagtgaggaggcttcatggcgagacagaagaaaaaaaatcctaatggcaactcacagagagctagaggtagacgaaggcaggtgaggtggtggtagtagttgtagaagagatttcattcacaggcttagcggaggggggctatttataggcgaaatgggagggtgcaaaggggaattccactagcaaaaacaaaaggtttggtggcttggtgtggtgctcacggaatcgggttccttctatggcagatagatgcaaattccaattcccaacccgattagtagtagacatgataattatcgtttggttgtggctttggtggcgttgtgatgttgatggaaatcgttaatcagggttccagttggtattgtgatgtttgtttaaaactgttgtcgtcaaattgctttttgataagcagctgtatagaaaagtgcgagtggatatttttttagtgagtgctaatacatagctactgtatgatctgcttttgtacctcttcgctcttccttatgatctgctgttcttgttccttttggtttgctgttcttgttcagtattgtataaccacaaaccatttctctgacgaatcttctaatttagagaggtctgtgtgttgagtgtggggttagctatacaagcaaaactagatgacacctcataagttgatggggggaaattgtatgaagcatgcagaaaattgtataaagcaaaatccaacagtttgagtaaataactagagtatgatagacaagaataaatagaaacattagtcgagtttctcgatgacgtggcctcacatatatttgtgggttgcaaacttgcaattgtatggaaggaaaatattggtattagtatagaagatgattacaattaattatgcagcatagttgtgagcttgatggtagagactgaggatgtaatacattttcattatctaaaaacttaattatgcaacactcaatactttaattgtgaaattgaagacttaattattattttccaattaatactaaatgaactgtgcgttgcataccgagatgtaataaatcgttgaacgaggcttatgtcagaattggtgtgtggtcgccttcctagagaaaatgacattaagcagacagagagtatccaacaataagaaccactattacagagatgttgatggtgattcaaaatgttggagatatgaccaaaaaagtgacagttgtatagtagcccagtaaaaacttgttagtaaaaatgttactgcgaaaatcgcctttaaataggtatattatggttgaaatccctaactatcctctgagcccataacaaaatgaaagaattctgatttatctgtggaagataaatcgattaaatttaaattcctctgcctaataccagataagtttgaagtttccaatgcgttcgtttgtgtgagatagggtgagaaaacaccttattttccgcgcgcacgcttcccaaattactaaacggtatttttttgcaaaaattttctataggaaagttgcttaaaaaatcatattaatctatttttgaaatttaaaatagtttatactcaattaattatgcgataatggctcacctcgttttacgtatctttccaatcctctcaatcccctaaccctcaaactcaccctaagtacatcgttgcgtaaccttaatattccgcgcctccataactgtaattccaatactccaatcgtttaccctcagcttataaactgcaaccaaaacttttaactttaaattttaattttgagatattttttcactatagtttattttttagtatttgtttttaaatttctaaaagcatatatataggttttgtatctaaattatatgctttcattgatgataaattgatttataattagcaaaacgaaacgatgacagtagcttagtgaagttatagagaagagagtaatagagaagattgcgataagatattaacgtataattaattaaatattaattttttaaacttaaaatggactaatatatttttttagagaaagtattttttaaagaaaaataaaccgtttagcagtgtgcgtgtgaaaaaggatgtctcttctcttttattcaactcttttttgccggaatcttctgttcagctctcaaaagcagttttaaacaaacaggtcatgggtgcatgatagatgcttgtcgatcaaacagctggatctgggttgaaaaggggattgattgggtcatggtgtatcatcaactcaaccgtattgcacttgggcgtttgggttggcttgtcgtggcgttgagagggcgaacaattggggtgtgtgtgtgtgggcttcaggattaggaggggagcgattaattggcgggcaattattgacttgtgttctgggtgtccaccatgcaggtggccagctggctatcatccactgccctgtactagactctagtaccggctgatggtagggcagccctaaggacacccataatgattatttataggctttttacaagagatccatgtcagcatatctttctacttgaaagagattaaatgaagagagagagcaaagttatctactaactataaaactcaggtgtatgcaggaaagcgtcacggtggacgcagggtttcgtgttgattcactatatgcaaaaacgcgctgagtttacagatatatatgcgtgcagatgtgttggttcggtgatcctaattacaagggattagagtcctatcctctatctatccgaaccaacatgcatccgtgcatatccatacagagaatgataagatatgataagatctaacactcctcctcaatcttaactctttctaggttaagattgttcttgaacatctccatttgtctcactggtatagcttttgtaaaaccatctgcaacctgatctttagtagatatatatgcaatttcaagcaactttctagctaccctttctctcacaaaatgaaagtcaacttctatatgctttgtacgagcatgaaagattggattagcagaaagatacttagctccaagattatcacaccatagcttggctgctcgaggcgattctactcctagttcttgcaacaaagtctgtacccacataatttctgctgttgcattagccagagctttatactcagcttcaatactagaccttgatactgtagcttgttttctagcactccatgatacaagatttgggcctaaaaacactgcaaaacctcctgttgatcttctgtcatctggagatcctgcccaatctgcatctgaaaaaccactaacaagcagagagggattcctacagaacttaagacctgtatcaactgtatatttaacatatcttaatatcctttttacagctgcccaatgagttgtagttggagcatgtaagaactgacacaccttatttatcgaaaaagaaatgtctggtcttgtcaaagttaaatactgtaaagcaccaactacactcctatactgagtagaatcctgaggtccaagcaatgttccctcatttactgatagtttttctgaggttgacagaggtgtactgaccggtttacactcatacataccaacccgtcgtagaagatctgatgcatacttctcttgactaagcatgagaccatccttcactttatggacctcgattcccaagaagtagtgcagatcaccaaggtccttaagagcaaagtccttgcttagttcctgcagaagtgttgaagttgcatctggtacagaactggccacaataatatcatcaacatatatcagaagaaatatagaaacctgtcctttcttatagaagaacagtgatgtgtctgcctttgaaggtacaaagcctaactcacttaacttagtacttaacctggagtaccaagctcgaggcgcctgtttaagtccataaagagctttatctaatttacagacatagttaggcatagacttcttttcataccctggtggttgcttcatatagacctcttcttctaggactccatgtaggaaggcatttttaacatccaattgtctaagactccaacctctagagacagcaagagacaaaactattctgatagtagcagctttaacaaccggactaaaagtatcttcataatcaatgccatacctttgcttgaatccttttgcaaccaaccgtgctttatacctgtctagactgccatctgctttccttttgaccttatacacccatttacaatctatgacatttcttcctttctgaggaggaaccaaatgccatgtcttgttttctatcagtgccatgtattcagcatccatggcctccttccagtgtttattattcactgcttcttccagactctgtggttcaccagaagaagtaaaatttagccatttaacagttccatcagtatataccttttctttcctgatcccgctttggagacgtgtttttggtctgatcggtgcaacagctgcttctggcatggcctgatcagtttgatcagactgatcagtagtcacatcatcatgcacgccagccgatgatgcaacagatggcgatgtggacgacgctgtttgtggggacgcctgcaccaggtgctcctcctggattggattgccatgctgctcagctgccgacgccatcgcatcatctgtcacaggcgaagagtgctccggcgacgcatcatatgccacaccatgcacgtcgtcctgtgcaccaccatttgctgctgctgctgcattttcatctgctgctgctgctgcattttcttcaccgtttgctacaatttcttcaccgatttctgcattttcttcaccaaactgatcagtaacattaggcggataattaagcacatggttattctgttctccccctaatgaagaaagatgcggaaccaaggatggtggaaggagagatatttccgctctaaggcgtgcgccggcatttgagtggagttcggagaaaggaaaaatgctttcatcaaaggttacatccctggagacatagactctgcctgtggcaatttctagacacttgaaccctttatgtaggttactatagcctagaaaaacacatctcttggaacggaaagctaatttgtgtttattgtaaggccgaaggttgggccaaacagcacacccgaatattctcaatgctgtatagtttggtttttccttgaacaattgttctaaaggacatgcaaagttgataaccttgctaggagtgcggttaataaggtatgccgcagcaagaacggcttcgtcccaaaatttaattggcatagatgcatgtgctagtaatgtgagtgcaacctcaatgagatgtctatgttttcgttcagctgaaccgttctgttggtgagcataaggacaggaaacatgatgagagatacctatcttagcaaagaaggtgttgagtttttgatactctcccccccaatctgtttgaacagcaagaattttgtgaccaaaaaatctctcaacaagagtttgaaactcctgaaacttttggaatacttccgacttatgcttaagaaggtaaacccaagtaaatttactataatcatcaataaaactgacataaaacttctttccaccaacagaaataggagcagggccccagacattagaaaaaataagttctagaggttgacttgacacacttgaagacttaggatagggaagctgatgactcttgcccttttgacaggcatcacaaattgagtctttatttgctacggtagaacaaggtaaattattcttgctaagaactctagtgactatgggcacggctgggtgtcccaaacgactatgccatcgggagaaggaaggagttgtggcggcatggacttgcttggcaggtgatgtaggaagggagtagaggcgacggcggcatctccccttaagaatcgtgttcctcgtggctcgatcctttatcaaaaaataattggaatgaacctcaaggaaagcaaaattatccatagctaaacgatgagcagagataaggttctttttcgcttgaggaacatgtaaaatatttttgagatgtaattcacgagtaggggtatgaatgacagaatcaccaatgtgcttaatttccatacctgcaccgcttgcggtgtgaatcttgtctcctcccttgtacttctcccgaacatctaacttgtcgagttcgttggtgatgtggtcggttgcccctgtgtcgaggtaccaattggtgtcgatgccatatgcagctgctgcagccgcactcctttcatcagggacataggtctcatcgtacctatgccaacactctgcagcgacgtgccccctcttcaggcacacttggcagatggggcggtcattaccaccccgagtctgatttcctccagtgccgcgcccacgtcctggagcagcaggattgctgcgcccacgtgtgccacggccgccgctgcgaccacgctgaaaaccaccacggccgcgttcgccgaagcatgagcttgccgaagagcttgcctgttctcaaagttaagaagctgagagtacacttccgccattgtggtcgactcattgcgtgccacaatagcagatacaacaggttcaaaatcatcatctagcccattcagaacataagcgactaaatcttcctcatcaaggggtttccctgaactagcgatttcatctgctagtgctttcatcttgccacaatactcagatatactcatgttacctttctgggtattggtgagagtaagccggacgttgagcgaccgggctttggtttgtgcagtgaacatggcgcacacctgctgccatgcctgcgccgccgtggatgccgtcgccacttgggtgagaatgtctcttgacagcgtggagagaaggaagcctaggacctgttggtccgaggcaaaccactcctggtaggcggggttgacgatcttctccgtcgtcttgtcgctcgccgtcttctcgatctccatggatggagcggcggtggcgccggtgatgtggccatcaagacgggcgccgcgtatcgcggccaggacttgcgccgaccagagcgcatagtttcctttggtcagtttctctgaaacttgaacgccaaagagaggattggtggaggcagtgcttgacgaggaacctgccatcacgccggactttgaggctctgataccatataaaactcaggtgtatgcaggaaagcgtcacggtggacgcagggtttcgtgttgattcactatatgcaaaaacgcgctgagtttacagatatatatgcgtgcagatgtgttggttcggtgatcctaattacaagggattagagtcctatcctctatctatccgaaccaacatgcatccgtgcatatccatacagagaatgataagatatgataagatctaacactaacctggaaatagtctagagaaaaacgaggcaatccattagagagctatacatacccatgtagacatactattgagatggtttactattaatctagtatattgctgagatgtacatgttttatagagagcactttactttaccattgtgggtgctctaatgggtggccatcgttctcgtgggccccacggctgactaggattcctattctttttctcccccgtgtgggccccacccatcactctcactagctcaggtcatcgtctgtttctgcctgcctcgtcgtgagtgtgagtgtgagtgtgagtgcgaggtctcactctgtctctctgtgtgtggccatgtttttgtgtttggaggcgtgtagccttcactgatgatgacgacgatacaaagcattcaaactgtatattgtgacttctgtaaacaaatcggtcctgtttactagaggctaagatcaaccacacaggaaatcattatagtctgatactctaatgatcaagtgataacatgatttagtttgcaaactggcgtagctctagttagattctagtggaacccaagttcaagtaccagacttaaacatatgctcatatttacggctaattattttttaaatagtaggcaactacccgtcaataatgaaacacatgtgataatctatgtgtcgtcgacttaatctctcagacatgattatagagataaagcattaaagcgtgcacatgtatatataaacattattgttcgcactatgttttatgttttaataaaaaaaaacatgatttaatttgggcatgggtggccgagtagatcattttgaaattggaaacaacaaatcaacagttttgaaattggccaatctattgctatggcatagaatattgggcctattcatattgaaagcccagcccaattattacaagtttcatttactgcaacacttattaaatcactatatttgctaaatttatttttaaaatataccccatccgtccaaaaaaaacccaatcctaactataaacctggacatatgcgtatccaggttcgtagctagggtttgtctttgtttaggacggagtagtattttttttatccctaatttattaatattgttacctctgcacgcaatccggcccatttgttgaattgaatactagtgtggcagaaatataacattgaatacatttttgatacattctcagtttttgttttgtattagaaatattattatattttagtaataaatttgactaacaaaaaattacaccgattttaataattttgggggtcaagatatctgtattgtggttaagggatacaaatcagacttggccactagttaagggagtcaaagtgacttactccactgaagctcctctgcaacaatccggcccatttgtatggcagaaaagctaggcccacttgaatctggtagattcctcctggttggttgctgggctcgccgccgtcttcctctccctcgccggagtatagtagtacaaggccgatgcaacactgacgtggccatcaatttgatcccgtcacgtctccgccctcttctcctcgcttcttctcgccgccgcgcccgcgcgctgctgctcttcgcttcttctcggcttccctccgatctgagagagcaagcatagcaggagatcgggagacctgtgttgcgcgccatggcggcgatggtggtgggagcgttgaggaggggaacggccaccgccggggggagctcgcggtccttcgcccgatcgctccctagacctgtaagcttcttcttccccttgtgcattcgattcgattaataagcggttggtggaggaatgtttcgagacgatttctcctttcgatttcatcggattcgtcgcttttgcgctcccacgattggctccgactgtgcctaaccgcgtacttgctctcatgccctgatgatgctaggtgagcacgctggtcgtagcggagcacgaaggtgggttcgtgaagccctcatctctgagcgcattggcggccgcagaagcaatcggcaaggatgataatagggtttctcttctgttgggcggatccgggccggggcttcacaaggctgccgagcatgctgcgtccagccatccattggtatccgaggtatggtcatgtgctacatcttgttcctatgtgttgttgtgcttgagcgattgaattctagaagcctattattgattcatttcagggatggagatgataattgataacctctgctcttcgatattgtgcttatcagttggcttgctttcgctgcaggttcttgttgctgattcagatgtctttgcgcatccattggctgagccttgggccgagctacttcgttctgttcagcacaaaggtggatactcacatgttatagcgtcatcaacctcgttcgggaagaatttgcttccacgtgctgctgcccttcttgatgtgtcccctgttacggatgtcacttcaatatctgagccacgagtctttgtgaggtttgtcgtcatacattcatactcctttccatgaagcttagcatttcaaggagaattgcccgtctgccattctgtgtagtgcacacctttcgcagatacccaaggttatagcacgaggttttgcaacacacgatgcatacatgttgtgtagtacatgaagcattttctatgcatttcacatgttttgcaacttagctacatgcaatctccagacaatctaaccactatttgatactgaatctgctaaatattattacaccactgtttttcccttttctaatgctgattaatagtggtttttccattttcccttttctttggacactgatcttattaatttatggtatcctatgggctaaagattaatcttatgagcccatttcccatgagtgcataatggcattctacatttctttctgcttgcaaccatgtgtttcttttgtggggatcattttatccgtatgaagaacaatggtatgcagggaaccttgggtggatgaaccattagccttgtgcgcgcagcattgcaatttgcacccccaagagttgttctctcttctaatccatatgtattgtatacctttatggtataataatatttatgcttctgaattcaggcccatttatgctggaaatgcgctttgtactgtgcgatatactggagaggatccatgtatgatgagcattaggtcaacatcattttccccaactgaggctatgtcagaagcaaaagttgcacctatcacccaggttgatctctctttcctcagtgaaggtttgtttggtttcttcactatattcttctattaagaaaacaacgttcttatccattatgttttgctctttttggatattgatattgaacatactgttgagtgttgagttctgcactgaactctggaaatcaacagataatactagatcgattttgttgtctatgtccttattgtgtttctgatgaagttgaaccttgctgcagggaaaataaactgttttgatccttaatatggacacttttctgacatcaaatataggtgtatacatgcttacttttttcttgtcaatgtacaggaagctctgggaaatctgcatgggtgaatctgaaatcccaagatacagaacggcccgatcttgcaaatgcacccgtagtagtaactggaggcagaggtttaaaaagtgctgagaatttcaaagtattggagcagcttgctgagaaacttggagcagcaggtttgagcctttttttttccctttgtccatctatacctactaggtagcacccatattctttgcggttggtatttgaacctatcaaggctcgtgaaattcatttcgctgtgcattcgttttctgacggattatgtttctcctctgtagtgggtgcgaccagagctgccgtagatgcaggatttgttcccaatgaacttcaggtaagctctacaaactgagctctatgccacgtcaggagataattaaatagatatgattggatacatgccatgtcagaagataattgaatggattcagctgatatgaaactgtaggttccagcatgtgctactacaagcgtagtgaagcttactgcattagcgccctaaaaaaaaggcttactgcatcagtgcattgccatcatgatagctgcaaatttacgcgcacttttatctctttcccttggtgcttaatttattacttatgttgcaatgtgttctatctcccctcaggttggtcagactgggaaaatagttgcgcctgagctctatatggcatttggagtatccggagcaatacaacacttggcaggaatgagagattccaaggttatcgtggctgtcaacaaagatgcagatgctcccatatttcaggtaaatcttgggtctacagagcttcatcaaagattttgttcttcatgtcctttgccagtaggctttcaaccttaggattttaagattcttataatcatgttggccaggttgcggactatggcattgttgctgatctattcgaagttcttgacgaactgttaaagaagctacctgacaagaaatgagcgtgctaacatgatgatccgtgtccatgtcatatttgttctagtgttcttaataatatgaagcgcccttgtaatgtgattctgcaaaaataagtgtcatttcatatgatcacacaagcacaaacaatagacgtgatgtcgcttcctgtgcaaatacacttggactagcaattaacaatcatcattttcactagcaggtgtcgctgaaagtacagtacaggacagcgaaacaggtacagataaatcacaggctaacaacataccatgaacatttcacatggaatttgccaaaagttcatagttacagtggcgggcccagctttttaaacttgggtattcgaaatgggaaggggtaaaaaaatgtccatacaccaaaaagccaaaaaataggcttgtatattatgatacactaataattataatttagagcgtatagaataaaattgatcattagttcacacagtgatagaattgatcatcactagaaattgtttaacttatagaaatactaataccaaacatatcaaagtgtcaaaatatggaatacaaaaatgatagagaataataagttaggaagaaaacttacaatttagatattaacttttcgacgcttgatattttggaaataattgatgatgtccttgtccttagcttgcaaaaagaattctctttcaatgaatgtaaccaaacaatcattcaaatactacaaatttgctaatatggtatgaactatgaactactgtccagtgtccaatatactcaattactcaaatactcaaataggcaactagtcaactacaatcctacaaactaaatgtctaaatcaagcaagcaagcaagcaagcaactacactaaaatactaaatgtctaaatcaatgaatttttgtgcttgtcccgttgtccggagtttagtcactcactgtgctaatgtgcttatccggaatttgcaggtcaggcagtcgccggcgagcaggatgccgcacggccgcagcggcagcgcgcagccgccggctgcctcgggcctcggcgcggaacggcggacgccgacttgcaggctgcagctgtgcagcgcctgctcctgctcggctgacggcctggagcagcctcctgcctggctgcctcctgggcccctgcaggctgccgcgccggctgccgcacgcggcacgccgtcgcccgtcggtcacggtgcgcctgccggtcacgggcttggcgccttggccttggcggctcaccgcctcaccggtcgccgtcgccgccgccgcgcccgcgccgttgcacgccgcggccgcgccacacgccgccacggctcccgccgccggccgccgcacgctgcacgcagcccccgccggccgccgcacgtcacgccgccgcacgcctcctcccgtcgccgtgctgtactgctgtgttgtggtctagggtttgcaggtttgggtggccaaggcgccaggcgggtggggaattgggggaaaattgcaaatgggctgagatgtggcccaattagaccacaggtagagaggaaagagggaggggagtggaaaattttggcccaatagagaagaaatggggaaacaaggcccaatataagcagtttaagttttctttttatttttttaatacctatatgaactatatagtatatataccttttttttttccaaaaatcttgggtatacatctgaatacccatgaatacatagtgggcccgcccctgcatagttagatttgacacgcaaacataatgtccaaagaatgcccacaaaaaggtgtatacaagcttttttacgacctaataagaattgaatgcgatacaaggatgagctaacaattttctatgagaatatcagataacgcttgccaaaacgccttattgttttgtcgccaaatgaacacgaatgccagaaaacgataaaaagaaaaaggaaaaggaaaagtgtagaagacattcaaaaagtttatacatgttacacgtatatgaatctgcgcgatccgtatgagattgtcgggtaaagatagataggtgatcaagactcggacttatcaggtggggttcccaccagccagccccacatgccactggaactttgcctttgctttgcctccaacgctgcttgctcagaggcagccttctgtcttcgaagcagctcaacctccctttccaatgcatccatactctggagcttctgccgtagctccgcaacatccacctagaaaagcattttggggaaaccaaagtgtgatcaggatatactcatcacatgtgctacacaataaccaaattgtttactactacttgttgaactcatttgtctgccacaaaacacacacacagtgcaatttcggaaagaaaggactaggaccctgtttagataagttttagttcctatcacatcggatgtttgaacactaattataaatattaaacgtagactattaataaaatccatctataatcttggactaattcgcgagacgaatctattgagcctaattaatcaatgattaccctatatgtgatgctacagtaaacattctctaattatggattaattaggcttaaaaaatttgtctcgcgaattagctttcatttatgtaattagttttataagtagtctatatttaatactctaaattagtgtctaaatacagagactaaagtgaagtccctggatacaaacaccacctaggtttatcatgttctcccttgggaaggtcgttcaggaggttatttcttatgcgggttaatccgagctattactgctggcaacgtagtaaaaatagcaaattttgttaatttgtacaatgtaagactccatacctcaagtttgaaacatcttgactgttcagcagcaagttggccacggacagtttgaagttcctacaaaatccaaaccaacaaaattgaggatatatcgttccaaagaagtgattcagatctccacatacaccaaaactcgtgaggtgtgcatagcactatgcacaccatgtaatccaaatgtacctttgcaaggtcaggtcacctacacggttcatcttacgttcctttgtggacatgtatgctaggcaaaatatgtagtgcaaaccacatctgtagtggaaacctgaaaactattattggatctaaaatggacaacggagatttgtccacgttaccaagaataaaaattttactcctagattcaaccatgactcatgacatggagaaatctcatgcgtccatttttttatccaacggtagtctacaggtttccactacctatgtggtttgcacttcatatttttcctatatgtcaggaccaagacatgttagaaacagcgataatacatactgctagcaatgaacatcacacactattcagtacagggtaagctcaatcctagtgcatgtgttaaatagtgccatagggtgttgtgtgtagtactcagactacaggttacaaagcagattataaaacaaatgaaaatgtaataataataagttacatgcagaagaatttgtaaaaataggttcattgcataattgaaagattatgcaggaggctcaccttcgtcagctctgcatttctagcctctgcttcagcaatctcttctttaagctgtatagtttgcacttgctccctgttaagtgctgcttctagttcctctttctcagctttaagagctactaaaagttcgtttgcgtcatccttcttctgaaaaacaacacagcatcaccagacagaacagctgagtgtcttaaagcatcattcctcatgggtaagacataatcagcatggtagcaacaaacaatactggaatgattattcacagaattttattttcacagacactaattttctacaaaaaacccatatttgcaaaaaagagtcaacacactttctgttcaatcgaagtgtactgcacaagagattaccaggtctgaatcagcactgtccatggcaatctcacggatcttcccatcatgagaaagttcaacctcgggttccagaacgctggatgtaccatctgatgcatgctcttttgtttttgactgcaaatctgatttgagggtaagtttaagagcaaagacctgtccatcaggaaaaaccttgttacaaattacctccacacatagatactaaaaataaatctaaaatcctaaagaaaagccagttacctcattgctgtatcgtccattgtatcctccaaaagaaatgagataatcatctccattgtaattgctatgcactaaagtcatgccctaaaagaataacagatcaaaacattaccaactgaaacaaaaccattctaagcactgcgtaatactcaagagtcgtacctcactggcaaggggaacacgaccttctacagagctaacaactgaccatgttaaagttgacatattaagcacaagtgtttcagagacacctgcaaagaataaagtataagctaaatacattctaactgtaaataaagtatatatataatttaaaattgatgaacctacagcaagtgtacaaaaaatacaatcaatttgttactatttaagaactccatgtggcattagaatgaaagtaaccttaatcttcctagtttcaaggtacaatttgcatatcaagatggcaaggatagttgtactggctttgtgggttttactggatatagtttctaggttaagtgatgcagattgtaccagacagtgaacattgatctaaaaaagcttcctgcatataaggcaccaagttgacaagttgcatagacaaataataaattctaccactatctaagtgttggatcagggctgaggtgctatacacagacaaggattggcaaaaaaaaaggtggcttccaaactctttgcagtgcagcaattgacaaggtacaataataagtgtaggaattatctaaggaggtgaaaaaggccagcagtagtatgaagacatctttgcattgcaattagtaagaaaatatttttcacactgcaagtgtacgcactaaaaagcataccacttttgttattgccaccaccaactatgtaccagttttccccaacggttgcacctgcatggccagctcgtgggcttggagccagaccctgttgtttgggtcttgaccactccatctgtaattccatcgataaaattagaaatcatgccacattgtatagatgccaatgtttgtgaattccagcaagctaacagttcttactgtttgcaaatcgaggacatgcaagtcattgaaacatgttgcatgagaccctccaccaaaaattaaaagatagcgatcagcatggcaagcagcagcatgatctgatcttggaggaggggtgcctttacaaaaagccaaaaaatat

SEQ ID NO: 66434 - DNA, 709 bp, Oryza sativa
acattagcgctatacgctattagcgccgaaacccctgcgtcacgagtcaagcgcggacgcgcacttcttccttatccttcgcgcaacatgcttattcccgatccgttgtgttgccagctgcttgtcgccgcacccccggaaaagagggtggcagagccgatggaggtgtggatcagtggatgggcgcggaggttagaaaggacattggggccgacggggcggtcgtagcttgctagatctccagatcctgactgccaggggcggatccagcatgggggcggcgggctcttgagcctccactactgtcgtgaagactatgaaagcccccacgaaggtcccagcaaatttttttatcatatatagatgggagggggaactgtaactttatctagtttgtttagatctgccgctgctgaccagcgacggcggtgtaggatatggctcgaaggagtaggggattgtcggccatagctgttgtcgacctcgagtactcgacagacttgacaatgacgaacggtcaaactatggcctgttggtgcacactatggccttatgtggagcaagtgcgttcttcttcatctttttgctctactaagaaaattggatttggtcttatggttcatgtgcatgaacatacagaggaagaaaaaaaaaatccaattgtgcttaaattatgttgaatttgttttgtctatctactacttgtttc

SEQ ID NO: 66435 - DNA, 4822 bp, Oryza sativa
ttaacatctgcttttagtggtttaaaagccaatactgaaaaattgaaaacaatgaaaagattaatttagattttaaattgtggttgcgcagctgataagctgacgagcagccaatgaaagtgactactgaaccgaacataccaaattaaaaatggaagtatacatatatatggtgctaaaaaagaaaagcaactcatattggagaagagttgcctagatttgataatggtgtcatccattattccacaaaaaaaaatcttagaattaaatggctagtagaatttttttgagagaagaaaaattaatccttgttcattttcaggttcctttttagcatactactagtactaatttgtactcccattgaactactagaaaggtacctatattttggaatggattcagtagtattatttatgctttctccttataccaatgtaggagtactactttttatttgacattttgtgcagtaattgacaacacaattaattttctgcagcattaatttggaaaaaaaagttttgtgcacattagctgaagcacctaaatatataatttatgttctcaggattcactggaaatgttatcgctgcaagccctagagggtggtgtctccagcagaaaaggaggcagattgggaggaggatggtggggattagggaagcacacttgtaaatatatatctgtcactgtccaaagctaggtttgatgatagggaaaaaaaacacaaatataattaatcttcgaaaaaaacgcagatattatatacaaatgcaatagcattgactttgtgtatgcgcatgcaccgaatcggaagcgtatgcatcgcacttctcagaaaggtccaaacaaagtcacgtacaaattattcctactcccatgccttttcattgaaaggaacacatgccaaagagaagagactgaattgaagccatccatccatatctatccctaattcccttgcagttgcgtgagaaatacataaacatgcatgggttagtaattaatcctagatgaatctatctatcgtcagtgattaacttaagtttactgatggattggcatctcggattctgataaggtttttaagtgattttcagatgtcacttggttactttccaagattgtttaaagttgtcgacacaactgtagccaaaggtcttattgtactgtaccccatgatatgctagatcttccttaggtcatatgtcttgtcctcgaaatcttgctgccattcctacaggattatccgaatatttaaaatgaactatcggcgaacagaatcgaccaaccgattcagcacaacattactgcaccatatgcattttatccgaaagtatcatttgagttgattatatagtgcatgccacaaataatactcaaaaaaattgatggccttaattgagtgactgacaggaatttgagattaaataaacttaacggtgcaatgatcagtttatgccgaaatcaacaaaactgagctacagtattcccacaaaatttaatattgtaatgatcattaaagtgtgatttcgaaagcagcaatgaccagacatatatatattagggaaaaaattaatacttgggaataaaaaaatatcgaactaaacgcagatggcatgcatatatataagatcaaatttcaaaagagtttgaaattagagttatataatgcccagaagatcagggaagaataatcaccaaatgtgtgcaccgcagtattaatctgaaatacacgtagcgatctccataaatatggaaattccagaaagaaaaaaaaagtaaaatacaaagggcagagaagaccattcataaaactcaaatgccagcttccaaaaggcatgcagtacatgcatcaattagaataccaaataaagctctgcacctactacaaaaatagaagaaattgtacaaacactagcagtagaactttggaaacccagatgatcccattacaaagaaattccatatgcatggggatcaggcagtacacaaagtcatgtgcagcagaatgatcaccaaaacattaaactcattcgcaggtctaaatatctgaagagaaaagaagaaaattaatacagtactaaattttgcatataacttaaaggttctattgacagtaccttaagcgaaacagaaatcctaccccaccccacccaaaaaaaaacaaattaaaacatcgataatattgtatgcagaaataattaagatgtgcccgctataattctaaaaattataatttgacacatgcatgcaccttgtctctctttgtattaatgaaaacaacagagctcctgccatgtagctaggtcaaaaaggaattcaacgcatcaaaaattactaacctgattatattgactaatactagtataaataatgcatggtagcaactaattttccctaatgcttttgtaaacacaataaaacagataattaagttgcaaggtacaatattaattggtggttcaatgcatggtaccctgtttaacgatacgcaaaattcaaaagaaaatttcccattcctcccgatcctttctttggtgagaaaaaaaacagagcctatacaaattacaatgaaaacaaatccagcatgggaggaaatcacaaataaactcttgtgatgttcaaaagagaaaatatattgtatgagcttaattagtacaaactgaaatcttaaaattaataaacaaaggaaaacgatgaagaaaaacataacttttcgtgagaaaaaacaacagcctctatggccagctagcattcaggaatcaaagataatgtgcacgtactgctagtctgatactaggtagtacggataattcaagaggtgaaatgaatgtcacgcaactccaatgaagtaaaatatgaggaacagttatctgtcaattaagctaaaagattacttatcgcaagctagctaaccttccaagagaatgttgaatcgcacaaaaattaagttcctaacagatcactacaaatattatccagcaaattaacctttattttgggcagagtaaaattgcacctctagaaaaactacatactcctgctggagagaatgttccgagacatgataggatcaacgatagatttggcttatggacttagccgtttcaaatcctgtggtacaactctcagtttgaacactgtaacagcacaacaaaaaagtgtaggcgaattactaataaacctatctgtaagataaatttcatggccaaattcattttactttaaaaataacaagaataagaacattgtcaataaattaaggacatgcatgggaaaatcaagcttatctcttactactataattgtagtatttcttggaatatgaactggatttgaaaggatcattcccagcaaaagaagaagaggaagaagaagaaaaagaactaatttgaatgaaccgttaatttcatactatgcgcattgctacagtatcccaaattaatgaaattttggttgaataattacatttaataggtgattataaacttgatatgttaaatgctaactactgcaagagtgatctcatcatttgaccactgcagcttagctagatctctcttgaagtagtaaaattttctttgagcatatgatgactagaggaaattaatctctctcaatgcaagtggcactgttgagcacagcaattattcaaacaaaattcccatctaagtagaggtatagctactcctagctagggctcagcttttgaagagcaaattaaaggtaaagcaccaaagttgtgacaccttatggaggagacatagataggactagaagctaggagtattgagcaaaggcaaagaaaccttaactacttgcagtactagagaaaaaagacccccaagggaacagcatcatcaccatcatagaaatgaatgaagagcatgaaagaaagaaaagaagaagggcatgcaagagaatatagggtgagtgtcaatcaagccactcccccaagacaccaaaacttactaactgtcagagatttttcatttttaatcattgctccctagctagctagtactactagttccaactttatggagtaattaacctcatggatcgatggatgatggatggctaactacagaagcagtgagatgcagcacatcaatttatgcatcagtgatgagaagaagaagaagaattaagaagaagcaattgatcgaatagtaattagaggagctagctaagctagagaatgaagcggaggagctagctaggtggacgccatggatgcctaaagcaaagcaagcggccgatcgatcgagcttagcgcgaggtggccgtttgatcacctcgggtggccgtggaagaagtgcgcgccgccgaacgggccgggcgtcgggtacgggtccatcaccacagccgatgacgacacggccgccgccgccgccgcgacgccgctgctgccgccttcgccgccaccgtgcggcgccgcggccgtgctcggggaggagcccgcctcgcccgcggctgcgtggcggccgcccatgccgccgccaccgccggacgagtgttccgggccgacgtcgtggaggatgcccttgaagacgtggccgccgatgctgacggtggtctggtacgccacctcggcgtcggcctcttcgaccggccccagccgcacgcagcggaacaccgcctccgagctcacctcccgcgggaacctctcgcccaccatcatctgctgctgctcccctacaacaattgcacacatctatcgtaagaagaagaatcgaagccatggcgggcgagcaagcagtgcataattggacgcagcatgtacctgaggaggtggtgggcgtggtggaggtgg

SEQ ID NO: 66436 - DNA, 5524 bp, Oryza sativa
cgcgtagaacgggtgcgcggccggcggcggctgctgctgccatagctggaacccgccacgggacgcggtgctcgggtacaggaacgcggcggcggagtcggtgggttaacgggaggtcggtggtggtcgtcgcggccgtgcctccctccgccgcctcctaacgggaatcccgccatgcgcccagatccatagggtcgatcaatccgccggctcccccactctcgttccctccatgccgcttccgcctccgcctccgccgccgccgccgccccgcagcatcagcatgcagccgccgcgtggcgatcgaccgaccgatctgggatagaaaaacaaaatccacgagctcctaaagctgcctcctcttgctgctggtggtggtggtggtggtggtggtgggaaattttggcttgtgtgcggcgcggcgcggggggtgagagagagaggaggaggaggaggacgcggcggaggcagctttttgggcggcgagtgatgaggtgggggggtggagttaatactactgggatgggatgctagggagaggaggaagaggagacagagagagagagaggaggaggaggaaggagggtgagatttttactgtgttgcgttgcgttgggatctttgtttgcacgcaaaagcacaaaggcgcagccggcgccctgcctcccgctgcaacgccaactgaataaaaacaaggcactacctgcactgcactgcactgcactgcatgcagctagctgatgcaggggctgcatgccttccttcgccctcttgcttcgataaccaaaccaaaatactactagtgagttgtgatggaatcatattacaaaaagttttagaccctctcataaaaattttagtccctcctatagaagttgtgatggaatcattgtgcttttattagagggactaaaatttagtcattcattcccaaacacattaaccccccccacccccacccccaacacacccaagtatagctgtcgaccgaattaccttcctaaattaacaacaaaactagatatttgacatcctcaaatctctaaaccggacaaataacccccatcaatcctgtagaaggtggttttaatcctgcatggcatcaacgagcgtgataatgtattaatccattcaggaacatttcaataaaataaatattctaaaattagatggtcccacatgccatgctcatgccttttcctttcttccaccttccctctcttcgtcctctccagggtagacaaggaaagcagcgggggaagcggcgaaggcggcagcactgacatcgacgccttcaagacaagtcagaggaagaggaaaacggtaggaaagtggcggtggtagcggcaaggcgcccaccggatctgccctctccatcatcagcgtcaaatctgtgggagcatgccggtgccgagcggcagcaagcgcggtggggaaggggaaccacgcaggtactcgctgtgtagcgacaaattgcgtttgtccacgaacatgagggatctcgcgcgttgccgacatggcctcggcgcacgtctccaccacttgccacccctatcctctcttccacagaggtgatgcggacactggcgaggcaagtctcaccactgcaaacccagtcgcgctcgtcggcgcttgctgccaaccaaagcttcctctcgtagctcctgtcactacctggaactcactcccagccgcaccctctccccgccattcccactgccgcctggagcgccctcccatccgcgcccgcctcggactggttcccctcctatccacgccagccagccgccagctggagccacccaaccgcacctgcagccactcgcctccaacgctagcagcacaaagaaggaattaatatgacatgtcgctgccacgtgtctgccatgtaggacaaaaaccgctccgaattaagtcaggggggtaattcgtccagtttcaatagttcaaggtttaatatatgtctggttttgtggttcgtgtggggttaattcgtattgtcgtaatagttcaggggtaattcgcacttttcttaatcatatttagggctttgtttttgtgatggaatcgtagtatatactagtgtttgtttgagtttgctaacaccacatttgagctgacaggccaaagctttggtacacagtgataaaatttcgtgtatttatcatcacaacttttaaaatatgacgtgtactgggagaacattttaaaagtacgatgaaggcaggttttaaaaagttttcgagcaggtcgcagcaggagcagcgattcatccgagcgacgaggcgccgcgcgcaagggcacggtcttccgtatacgtattccatcccacatatcccaccgtgccgccgctccgcacttaattttaattgttttctccccgaggcttaaccaactttaattgttttcgatccatcagggctttcctgcctagcttttcagatatacgtatgtactgtactgtagtacatgcacctcttcagctgaaattctgaattgtacacacgtacgtacgtagagaggtgtataatacggacgtacatgcactacattaactctgatgcacttggacttcacacgtacgccaacagatcatatatctagccagccgcgttctagcgccgccacgtctctctctttctcatcacgtactactcctacatacttcctccgtttcgaaatgtttgacaccgttgaccttttaatatatatttgactgttcgtcttatttaaaaaatttaagtaattattaattctttttctatcatttgattcattgttaaatatattttttatgtaggcatataattttacatatttcataaaagttttttaataagacgaacggttaaatatgtgctaaaaagtcaacggtgtcaaacgtttcgaaacggatggagtaatccctaaggttttatggaccagttttcgtagaaagtcaaaatggttttataaagtggctagctaacgcgcttacccctattgtttctatagggaagtgacagccacataatcgaaatcctgaatattatgcaaagctagtcgattttttttggcatatctccttatcacacatagtcgttgcatacgggtcgtctatctactccctccgtccaaaaaaaaaagataaaccctaatttccgtgcccaacgtttgatcattcatcttatttgaaaaaattataaaaaaaattaaaaagataagttacgcataaaatattaatcatgttttatcatctaacaacaatgaaaatacgaattataaaaaaaatcatataagacggacagtcaaagttggacacggaaatatagggtttgccttttttttttttggacggagggagtatctctgttctctttcaacattaaatggaaaataatggatgtgcttgcttctcgagcttataaatgacacgtttttacaaaaataagaacaaattctatgtagtaatttgttatagaactattccacataattaatttactcctcgcttgcacactcacatcattttcatatatcatctagatattacccgtgctaatactttattggtttgtgtacgtacgtagctaaatatttgctgactgatgctctctgtcaatggaagaaggaagcaggaagtcatccaatccggtttgtaggccgagcaatatactagtactagtccatgttggaccagccgtggacagtggacttggcttcaattcttgcaaagagaaataagaactcaccatttgctatactgtgacaagtcacataaggtgtgatcaacagtttattggttataactatgataaactttagctagcaaataaaattacgatgcgtgaaccaatgcactaataaagtgtgacttgattcagcatgatattcaatcaaacactaacgtaaattttttttggcacgtttaaggcttggtgtggcaaactactgtcaccaaccaaacagaccctcgaactctcagtactggagtactagtagtagtacacgcatgatgcaatggttcacaatggatcgatcgatcgatcaagctggagatgatgttgccaaccaaggaaccaataatgcaccaacagcatcgcctacaccttgctgtagatgatgtacaaaattttcccgtgctgtactcgatcgctcgcggcctggctacgaacgtgcgacggtaatattaagcaaagataataaactcacaccgtcccataatataaatgattttgagtttttttttcactgtttgaccactcgtcttattaaaaaaaatagttttttgacttactttattattcaaaatactttaagcacaactttttatttttttatatttgcataaatttttttaataatatgagtgatcaaagaatataagcaaaaatttaaaattccttatattataggacggaaggagtaaatattaaggtgcccggggtccactattcggccgtgaccacgtcctctctccgttcctaaactgcatagaaattataggactagctagctacctcctccgtcccatagaaatcagcatagtattgatataacacatcttaatattatgaattgggacatacatctatctaaattcgttgtattagaatgtgtcacatctaattctagatttgttttttcttggggcggagggagtagtgatcactccctcgttttgctactagttacgacagattttaaaaaactagaacagtagatgattatttggaattatcgggaaaaataatctagcacgacatgcaatctggtttctgcttttgttttaacacagtacaaatgtagacgctcatataaacatatgcatactcattcatataaatgtacgcacgcacaatatactgctatgagttcatgagcaatttcgaatactgaaccgatacatctcaagatttatgagccctacataggtgtttcgctattgacgagctaattaatatcttgagatttataaagtctatgagttttgaacccggtgaaaagattccaccacactaagaacctaacaagtttctggttttgacccaacaacatactagtccctccgtattttaatgtatgacgccgttgacttttcgaccaacgtttgactattcgttttattcaaattttttgtgcaaacatgaaaatatttatgtcatgcttaaagaacattttatgatgaatcaaatcacaataaaataaataataattacatgaattttttgaataagatgaatgattaaacgttggataaaaaattaacggcgttatatattaagatatggaggtagtaataactaagtaaaagaataaaacagacttataagatttaattcatactctttttacttaatttgggctctagacaaaccggccccgtgcatgcatgtgttggttgttttacccctgcaactatcaactatgacaaggtgcgtgcatgcgtcctagctaccgtctaccgaacgtttcaacgacgacgtcgacgaccactcgatatatgggtgctaaaggggttttcctagctatggctactaagcta

SEQ ID NO: 66437 - DNA, 670 bp, Oryza sativa
atgtatcttgtttattttttctgatttatcacctcgccatgtgctatggagtcaggagttcgttcatctgatccccaccaccttccatggtgatctcaccagcaagagagtaaatacaactctaccagtcagcaacgtcagcacaaaggaccagcacaacgctagtacaattattattgtcacacaagttccatttcatgtatactcgttgtctgttccatttcatgtatactcgttgtcttcttcagttgtgattgctgcaggatgagaaattggaaggtcactggcattttggtactgcttgtaattggcagaatgatgtgtttgtgttgtgtgtgtaatgcgtgtgaaactgatggttactttacctctctctctctctctctctctcgcaccaattagcaatggacccgttcttggattgtccttggcgtccatctttctgtcggtagagagacaggcttggtgggagcactgtttctgaggagatgcagaaaagcttttgtcgtagggcgcctttgaatcaaaggatttataaaggaattttatagaatttaaatcttatagaaaattttcctatttgaccatttgattcaaaggattgaagttttccaaatcatatgaaattcctatggaatgacacattgtatgtggatttgggaggaatttt

SEQ ID NO: 66438 - DNA, 4331 bp, Oryza sativa
aatatactatggagcatagtacactaatatatatttgtgtagtacgcactgtacgtggtagggctcgatctccctgaacaaaattacttcgttaaatgtcgtgcacaaatataatcggcacatgctacacatgtatgcacatcgtttggtgtggagatgctagatgtatataaagcaggctaacattaatttgaaaagattttctataaaatggatagttgcctaggcatttcacagcttatatatgtttacatttatagttataaattaattcttttttagatgaaaatttaacaagagcttcaacctcttagaaattttcctttgagtccatctctcttatccgattcttgcatttttcctgcggtccaatcaaactatcatttttatgtttttttttattttacaattacattcatgtcagaatatcgtgtttttcctatttctccgtttttccatttctacgatccgaaggggccttgactccttgagaatcgtacatatagagctgttccatatacttccatgtcttgtagtaaaacagtaatatggatttatggtgttgtacgttggacgacagaacgtttattacttttccctacagtacacattattccatcctttgcaatttactcctacatcaagtacgtggtcgatctgagagacccggttgcctatagtcggtcagaaatctggtcccagctgctgctggtggctgggcactgtttgaattaatcagtgagagctatagctgatgctgatcgatgctggaaatctgcaatcattcagtatagctaaggagggcccatacccattacgtgaaaatgacaaagcgtttgttgtatatcgatctcgacacagtagttcatgtgtcatgtgcatataattaacaggacgtacgtacgtacggcccgatcgtacgtgggacatactgctgctagctacatgtacagccagcggcatacagtgaaaacaacaagccaaaaattgaaatgcatttgcatagtagtactcggcagtacgtttgccgggtaaattagttaactctcatcaactagtattgcattggttaatgaggatgcatgcatgtagagcattttgcatgcatgatctcctattcacacaagatgcttgcacgggttataataacgcaacgcactacaccagtagttatgacttaatgacagagaaaaggatgaattaacatgcatagttatgcaacacacagagagcatatgcaggagtactgatcgagaggaatataggagtctcttcagtctttacttacactgtgagcaactaatactccatccgtcccatattaatatagcaacctaaaatcggatgacacaacgtatcctatttctataaatctatacagagagcatattcagattcgtaaatcctatattactatatcctaggacgggggagtaatacagtaaccacacaagcatgcatgcatatctcatcatgcatgtgtccatataagccaaaagccagctgcaagattgcagagatatcaatcgatccggacaagaaacctgagtcagatccctgaaagaagatggtctctgtttacatcgacaatacatgcatactactgcactagacagtactccatgagcactaccatgcagctagcaatatacatatactgtactaaggtgagcaatacagtaacgacacatgcgtatattatagctgctgctggttccttggatccgtgtggctatatatacacctacctagctatatacacgtacgtacagtacacggggaatatcgagatgctgtatggaataattattggcttgcatattgcttctttttttttaaacgacccattggcttatactcctagtacgcaagtatattgcaatatatatgttgtgcaggaaaattactacaagtagtccctaattaactgtcaaaatgccatcatcgaataataagtcaatcggtcgatcggtagagattgctgatcctatgatatgcactagagctacatagactacagtgagactctgtatttgggcatgcatcttgttaattttactcttgagaggtcagctaagagagcttcgtgttttattagctgagcgagcatatacatgcaggctggcgagctagtagccgcggccagatcgagagctagctgcgttcttcttcaattaattgcttgcgcaaaacatgcacacccgcccgttctgatgagcgcatgtggcgcggtttaatgcaattttaattatccatctctcgtcgtttatcgatccatctgcgcattgcatatcaatatcaaaccagtgccgtcccctctgataaatcctagtactggtaataactacttcatctgaattgataatatttgtcgttttagataaagatattatctcaaaacacaattgtaaccattattttttattataatataaaaagaatatcaacaaatacaaggtttcattgaagtatttttaagactaatctatatatagctaggatcttcatatttctaagataaatattttagaaattatttatagttaaaaattcaaagtttcacatcactcatgtccaaaacgataataagtattatcaacctggaggaagtatgtgttttatttttaaaactaaactttggccaatgttttctcataaaattgcaaacacgtattttattagtatatctctaatagtcataaaaccaatattgtgtgaaagtacttggaagtacttcgcctgtttcaaattatgttattctagcaaatcacacataaactaattagaagtgccagattatattgttacctttaacaagtactccacccatctaaaaaatctagtaatagattagacacaacctatttcaacgaatatggagacggggtctattcatatttatagtactaggtcgtatcgtcacatccgatagtaagttgatatatttttgcgatggatagtctagtgagaatcataactgtattaataattgactacattaatgaagttagagagggaatgtcacctctaaaagtgatttggaacatgtgaacgacaagcttttgataaaaagaataaagtttaaaacgacatgtaacataaatctaagggagtataagcctaacaatgtcccttcattcgtttttatatagcgttgattagttcaaaaatgaattaaccaacatcatataaaaaaatacagagggagtaaaatttatagctaggctaattaaatgtatctatacattaatctatttatcaagatatatatgacttataaagtgcacggagaagtatgtatgtacaacaatcaagtgagaaaataattactcatgttaactccaaataaacctcaaatagttggtaagtactaaccatacaaaaacaaccgcggattcgtatcatgcatggggccatcaacaaatcgagaacaaatcaaaaagtccttgtctccgtaaaatttactactacgactgccactatagcagtggctgttaagatgcatgagactgtagcagtgcaagatggcagccggctccattgtagctgtatagtgcaagtcctacatggtcgatgaatgcatgatcaactacaggcaggcattgacaaaatggccgcgacgcatgcagcagtagtactccctccgttcccaaaatgatcatcatatagtttttttagattattcctaaataatcatcatatttatatttattcattaagtctattcgttatttgtgcatttgagtaaatagacattgatgcatgcattcatgcatacaagtatttataacccacatgcaatatcttgatttgttattggctaggaaatagtgggtatggtgcatgcatcgaatttgttgctagagtaaatatagtatgagagagttattagtttttcttgatcttgatgtactacctatgaaatatgtagatcaatttggaatggagagagtattaatcttgatccgatccgttagcattgacaaacgtgggagagatccgctgtgttcggattccatggatgggagctaatccctcgtgcacggaaaacggagcgattcattagcacgtgattaattaagtattagctatttttttaaaaaaaatggattaatttaattttttaaagcaactttcatatagaaactttttgcaaaaaaacacaccatttagtagtttgaaaaatatgcgcgtggtaaacgagggagaggggatgggaacatggggttacaaacacagcctacccactagctactcgatcgggtgtataaaacaaagcaaattaactcgaccgcagtaataggctctcgtctttgtttagatacgggata

SEQ ID NO: 66439 - DNA, 4496 bp, Oryza sativa
ccgtgttttggatcgtcttctcatggagtcaggacaaccttcttttccccacttttgtgtagtacgcgtacatactatcggatagtagcaattaagttcgcgtttggcgtggtgtggcggatcgatgggcgacggcgtaaccaattctggctggatagtagccacgcgtaaccaacgctagctagctagatagtagtagccacgacgtctgccgcgtgcagggttcgttcaatcacctagcgaggaaattatcctaaactgatatcagctcgtcatttacatgtcacataaatagttataaaaaatattaatttatgatatattattccacaaaaaagtaacctaaaattcaacttttacatatcaaacgaaattccaaatacccgatacgctcattcagagagcgaatatgtgatatataattcgaaattagtcttgcatgtatgtttcatcacgaaacgtgcgcgtatgcttctctccttaaacattgtcggctctttttattttttattttttgggcagccatcaatggagatagagagatcgatggagatggcgcattcaatttgcaatctttaagacaaggcattgcggcattgcctgacgacgagaaattggaaacaaattcagaaaattaattaatgtatttcacgtacaaatcacactatgcatgtataagtcaaaattcctacgttctaaacgtacttggtcagttcattccagcagtttgtaagtcctaaggattggattattactgtgcattatctgctccacatacacccctgtcgtcctcctgtcgccagagttcacaggttgaggaaggaatcatagttgagaaagcctgtaggtttttcttcgtcggcgttcctgtgccaggaggcaggcaaaaaagtaaactttgctaagctatagattaatgacgcaggttatatgggttaggccctcttcgtttcttctgaagcacaagattaaattttggatactcgtgacatgcttttcaaactgctaaacggtacgtctcgtgcgaaaactttatatatgaaagttgctctaaaatatcatactaattcatttttcaagtttataacaattaaaactctattaatcacatgttattaatacatcgttttacgtgaaacacttaatttttatcttcatcttcatcttcatctttaagaggtggtgtttgaatctcctgaagatgaagatgaagataaacatagaggagcgagggttgtatatctatagtagaaatatattcatgaatgaagtctggagtcatcatcgaattaacggtataagcagacggcaggccgaagcagagaatgagacgaaaacgaaaaaaaaaacacgatgtaacctagtacatatagttttttgatgcatcaatccacaaaagaaggtttagtgaggagtagccctaagtgcacttgccctttacattcttctctcagtttttcttttgttttgcttcttaggtcttctcgccttaactcgacggtctaatgtcggatgcatgtaacttctttcaatcttaataaaatttggtcggtgtttcttccgccgaaccggcaaaaaaaaaagaaaaccacaaaagaagatatccctaatttatcgggcgcattatccgttctcgttcatccatctaaattaaagttgtaaagcggattttctttaaaaataagaataagagttaagcacaggagcggagttacactgtggtccatggaccaccatagaaatctagcccaaggcccatcacccctatgcgttacttctagaaaaatatcaatggcaagttggcaactgttttgcttcgttttttcgctgcaacaagcaccgcgtcctttcgtttccatcgcaattgtcattcccaattttcgatcgcgcgagtgaatgagtcagcgacgacaactaaggcagtgaggcacgaacgtgtgacggcggcagccgcgggcaggcaggaagcgcgcagcgccgcagcagaccagcggcatccagcatggagcaagcagtcagcagcactcatcgccagcaggcatgcagcaccacagcacaacacggcagtaggttctcaacttctcatctccccctgcagcccttgcttctctctttctcctctaaaggccctaacagtaggaattttcctttaggttcaaacgttcaatctcatttcaattttaggatatccgattggagttgggatggtaaattgaaaccttgcaatcctgtataatcccattgtagatttgctgaaaaatgaagaggggtggagatattacatctcttttttagaaataagcaacttttagacttatttattttaagatattagtaagacctctttaattatttgatgagaatatggttgttaaattttatctctgtgtgtacgtcggcatgttacatccatagtgttaaaaataataagtttacatctatagtgttaaaaataataggttgagttggacaaccccaccttgaaaatatagtgttaaaaataataagttgagttggaccaccccaccttgaaaacctggctacgccactagttaagcagatatcctatttctttttgttgagctcacaaattaaaattaatgcagcatttgcatttcattaggagatgaaaaggagagggattaattagtgcatggtgcattgtgtccctactgtagcccgtggagccatggtgaaagctgcgccacgccattctcatcaagcgatggattcacacacgccgctgcagtagcgtgctattttttttaacgattcgtacgaagttctacttatagagaaggaaaaaaattacaagattataacctaagagggtcgtaaccaggaaaaaagaagaaaataccaccacccacacaccgacagcgccaacacacaacccgggagaaggctagcactggatcggccgccgctaagcgtgaccgaccgccataagactaataaaggagcacagacgagatcgccccctaagggatgccaaaacgacgtcttcaagaaaagaagcgacagaaaaaccattgccgccgtccgtcggggctcaaaggagccaagattgggctttcgcccggcaaccacccttgaagggtgagacagcacggcaacgccctcaagaggggcatcgttgtcgggccagctaatgccgggctgggttttcacccgccgctcaccacctgtgattcaacggctgacgcaccgatgctccatcaccactcaagctctgccgacatgagggacccctgcacaggcgtcccccgccggccagtcttcgtgcgccgaagaccgcgccacacccatcggcagctcctcctcacaccgaggtcgcctcctccatcgccggctgcgcctctcatgccaagccggcctcctccaccggacgcgcccctcgcaccaatccggcctccctccctcggccgtgcctttcgtgccaagccggcctccatctccgccgcccgcgcctctcgcgccgagctggcctccgatgccatcggctgcgcctctctgcgccaagccggtctccaacccctccttcaaacgatgccgcgccgatcagatgcagccgtctgccacgccctcggctagccgttcgaggccgccatgccagtcaccgccaccgcagccccagctaccgaaaggccctgccgcctcgccgtcgccatcctcacttcctccgccgcagccacgtccatggtcgccacggccattgccacaagccgtccgccgtcgcagcctgtagtcaccggcacccgctgtcgctgcccgcgaggccactgcatcctccgccaccgtcgccagctgccgccgcagtaggcaacgccgcgagcacagccgccaccgccaccacgggccatagccgcggctgcctcaaccgctgccgtcggccatcgccgtcgactgccgccgccgtcaccacgacggcacctcatccccgctgccggcttaggagccgacctcccgcgccacccagccgtgcctcgccgcctcgtgccgcctcatcaccgcagccggctcgagagctggcctcccgcgccggggaggccggattcggacgagggtggccggatctggccaggggacgccaaatctggtgacgccgcgtcgctgtcgtcacccttgccgacaccgtctctgcccgttgttctggtcgtctccgcctcgccgtcgacgctgccgctctccccgttgccgccaccactgggagctagcccttcgcccagctccgtcgaggccgttggcaccccagatccaggtggggtcgtgggctccaaaccgcgtcctcgggggaagaaaggaggccccgccgccgccgtccttgcggccacgcagtttccagcggcccgctcgggtggcggcgaggcgaagaagggaaggaggcggggtggtagtgctgcggtggtggcggtcgccacccgtgtcgcccctgccctagcagcgacacgggggcaagaatccttaattgcagacattatgcatagaaaagtttt

SEQ ID NO: 66440 - DNA, 20206 bp, Oryza sativa
acgatggccggcacggcggcggccatggcctcgcaggaggcgtggtagaagacgctgccggtggagaagaggacgaagccgccgccgtggaagtagaggatgacggggagcttggacgtcggcggcggcggcggcgaggcggggttggggaggtagaggcggagcgacgtggcgagggaggcgtcgagcggcacgtcgcgggagaggaccgggccggtggcggagggcggcgcgtcggggacgaaggggcgcgtgatggtgccgtccgggtggacgacgatctgcatgaagaggttgttcgacttgtccgtcgacggcgccgcggcggcggtgacgtcacccatggtgtcgggggcttgctcgctctgtttcttcttggatttgggaagataattagtgcttaccagcctcgtgagcatatatagtgtgtaatctttggttgaagtctttagtttgtgtttttttcatatcatgtcagtgtgggggtgagtttgtttacatatgtattttataataattgagtgtagcttatttgagcaaatacctaaacgttattgcattatttataataacatcattaattattacactctatttaaagatgatatcagatattttaaaataaatagagatgattttaaatgctcgaacagtaaggttatggacaatggcatgatgtgcacgtgtagtttttttttttatggtgatggatcatggaagcaagaaacagagttgagctaacgagtaggcgtcgttttttaagttgtgataataagtatacttgtactgtcacggttatcaaaagggaattgaagtcttggcaagttggcaactaagggcctgtttagttggtaaagagagaagccaaacaaaaggcctgtttagtactttagttggtgaaataaaatttttgggtgtcacgtcggacgtttgaccagatatcagaaagggttttggaagacgaatgaaaaaaactaatttcataactcgcttggaaatcacgagacgaatcttttgagcctaattaagccgtcattagcacatgtggattactatagcacttatggctaatcatggactaattaggctcaaaggattcgtctcgcgatttacatgcaaaatgtgcaattagtttttctttttatctatatttaatgctccatacatttgttcaaagattcgatgtgatgcttttacgaaaagtttttttgtggaactaaacaggcccaaaatagaagcgtgcataagggtaataagaaaatttagtaataaataacatttttataacagttaaagtatttcttgtctcaactattgtaagtagatagtcattaatttaagagtcccactacgatgctctatattggtagtagaaaacaataagaaccattgagctaatttgagcaaatggatcagatatattttactacaccctaattaaaggtagtagaaacgtggagacgtattattgtaaaaaaaaatatattgaggggggtataattgtcatttaaacaatgattgaatcccctcctaagctttttagatggaacatgagcgatgtcagcacaaagaatgactatagatcgatctagtcggaaaaaaaacataaacaaagttacgcttaatcactatattagtaaattactaatttaactttgataacgaacggttcaaatcatttctactggtagtataatattattaatatagagcagcggagcatcgttcttaatttaaattacatatattttgttataaaaacatatttgtttaagaggatatatcacacactatctttgaacatgtcgacaaaggttgcatacttccaaccacccactttggcgatcgaacaactaatgcagactgtttgtcgaactttcttccttgttcgatctgcagaggaagctcaaaaaggctacctgtggcgcaagaatatcgcaattgtggctgtcgtcgagtgacgcatgcaccattgctgctgctgcatttaaacaggataaataaattgaataaacctgcagctgatcgagctcatctccggccttcgttgagaatttgtctccttaagaactgtggctgattgagctcctccaaattcgtttgtattaggagggtcacgtccctttctaagttaagttatttttaggacgaagtaagcagcaagtagcagtggcagttgtgctcccttctcttaagctctttttgcttcctgcaaggaatgattgtggcttaatgcataaatatgacggataaaaattaaagttggatagcaagtcaaaaagatctgtaaaagcaggggaatgcacaccttgttgactcaaagcagacaacagatagtccaaaagatgattgagccttctgcaagtgcttaaggtgcttcctaaaactttcttaattagcatcggcttcttacttaattaatgtctttggccattcaaaacacaagcacatggccacttcgccatcgataatatgatagtggtggggggtcagcatcatcatatcgccatcgataatggcatgaaacatttatcccacacggttgcccggtaaagaggccagcacaaataacgcatagaaaagtaggataacgacttaacgagtcataaaaaatagagaaagaaatgagaaaaagcagggaaagaagctttgcattgcacaccatattgtctcaaactcaaaggacacagcatacatatatgaatataggggcataggacacagcatatcggcacttataatctcttctctactattataaaaattaaagatgtttttgtcagtattttggtatgtcattcgtatttgagtcggtttttaagttcgtttgcttttgaaaatacagatctgtgtatgagtcggattttcagttcgtttgcttttggaaatacaaaagatgtcatataagaattttctttaaaaaacttgcacgctaacttgagatgaaagtcggactcctaattacagctcattattttctaaaaagaaattcgagagaattcccatggtgaatttcatcctagctaaaccgtataagaataataagattaaaatagcattcactcgttgcaaagcacatacattttttctagtaataatattgcaaccaaggattacttgcggatcagcccacaaaccatttataggccattaaatgggtcatagcccatctacgggtgtacgggctggcccacttatatccttattgcaacctggtccaaaatatttattactgtgtgtactaatcgtttgtactagaaaataaaggatcaaaattgcgtgagaagagtgaaagtcatcatcatataatacgtaggataaccaaggatcaaagtcgcagggcttatgtgaacttttatccgaatttttattttcggcccagcatatgttgggctgtttctttttttgctcgtgtctatttctctttcgggcttagtaggccttcttttagaataggccgaattcaggcagatgggcctcactgcccatgcacatgtttttttctcaaaaaaaaagtttttttttcaatttatataacacagagtttgtatgttatttgtatatgtacaacttttgtacgtattttttctttctcaaaatgttttttcaatttgtagatacaaaacttttacacatatatgtataaaattccgatgtatttttttttcatatgtatgtgcaaagcttatatatatgaattatatatataacgttatatgtataaattttctgtgcataacaattttgggccagtccaataattaagcgtaagaaaaaaaagaacatgagagatgggaggaaacagggacgaccgagagaagtgggtctctgaggcgacatgtgccgctcccgcgcgcgtgacccactgtgtattagcgctgcctaaataaaagaaaagaaaagaaactgaggaactctaactgaggaatcaattcatcctaaaataagttaactaaaataagttaactttgtacaatatataacacatcataatactaaaaatttagattggattaacttattttaagacggagggagtacgttgtttttttttccattccacacaaatggaccaaacggtttataagtgattatatttcagctcccatacaacctatagtgtgctaacgtaaccttgaattttagctcagtggcttgtcgttttctcgttttctgataagtaatatcaggattacgttctgtatgaactctttttttttttaagtaaagctgggcgaaagccttttctccaaaatatcaggattacgtctcagctcaccacaaagcccacaaatcatcggattcatatttccgtctctttcagagcaggatttcagttatccaggtgtgttctccaaacatccaaagatctagacagaccaggttacaaagaacagtgccaacaatggtgtaaatttctatctccatcctttatttatcggcaatacacacaatatttgtagtatatatcattatcttttcatacatatttagctgaaaatatattaagtatacattcctagatgaaagcatagatggacattctccagctaacacaccagctcggaaaaattgtttcgtgccgatgaacagagccgaacataactgaactctcactaacatttgacttgagtgtatttgattgatggagtgacatcagcatctagcagtgttttaaatagcagactaagatattttgtggtagattatctcaaacggtaaataacagctaaaatgcatatgagagtaaatagctagatcattttcgaatagctagctacaattatagcccgagatttaaaacctttggtatctaggcggagtagagctgagggttggagagcctcggcgtgggcacggcgaccagcggcgtggccttcttcatcacgatgccgaaccgctcggcgaggtccagccgctcgccggccggcagctcccagtcgaacgcctgcaccagcatcgccagcgagtaggccaccatccgctccgccatggcgacgccggcgcagatcctcctcccggacccgaacggcatgtactcctgctcgctcccggtgaagtccagcctccgccctccgccgccgtccgccggcaagaacctctccgggatgaagtgttccgggtccttccacaccgccgggtccctctggatcgcccacacgttgacgaacacccgggcgcccgccgggacgcggtggccgcccaccgtggcgtcctcgccggggcagtgcggcaccatcagcggcagcgccgggtgcagccggagcgtctccttgaccaccagattcaggtagtgcagcttcgggaggtggctctcctccaccacgccgtcgcgccccaccaccgcgtcgagctcctcccgcaccttgcgcagcgtccccctgttctggagcatctccgccatgccccattccacggtgttcgacgtcgtctccgtccccccgatcaccatgtcctgcagccaaatcacacagccatgaatggtggtgtcgtcgtctccgacgccggcagtgcagtgactgagcagtgagcacttaccatgagcagggccttgacgttggtcatggtgaaggcggtcttcccgtcgccgccttccttctccagcttgagcatgtactcgaggaagtccgacgccgtctcgccggcggcggcggcatggtcggactcggtcctcttctggatgatcctggcgaagatgtcgtcgaagcggtccttgagcaggtcggacttgttgcggatgccctggatgtcgagcggcgccagcgccgggaagaagtcggacacgttgggcgcgccgagcaactcggtgatgtcggcgacgagctcccggaactccttccccaccgtcgtccgctcgctctcgctgccgacgttgccgccccacagcgcgccggtcaccacgttcatcacggtgaggaacatctgcgcgccgacgttgacgggctcgccggaccgcgcgcgcaggtggtggagcgtggccatgaactcccggcggcggaggccgtggaggctgtcgaggccggcggggccgatcatctcgtggacgcagatgcggcggaggaggcgccacgtggggccgaccgggttccacacgatgttctgcccgccgccgtaggagatggagcacgcggcgtcgggcgtgtcgcggttggagaagacgaggtcgtggtcgcgcagcacctcccgcgccagcgccggcgaggtgacgacgacgccgagcttggagccgaggcggatagagaagatggggccgtacctggcggcgaggccggcgaagtaggtgtgcagctccgggtcgagggacagcaagctgccgacgagcggcagccccgtcggacccggcggcaggccggcgccgcggccgcgccggaccgcgacggcgaggtacagcagcgccgccgcgaacagggcggcgtagagcagcatcgctggggtggatgtcacctccatgactgccaagcaatcgagatattaatgcactcttaggtggaaaatggagctaatccatcaacctatttagggtgtattcggcaccctcttttctcaacccctctctctcaatttttcacgcgcacactttttaaactgctaaatgatacgttttttgcaaaaatataaaaaatttctttaaaaatcaaattaatctatttttgaaaaaaaatagatataattaatcacgcgctaaatggatcgctccgttttccataattacaactcccttcgtattttaatggatgacgccgttgactttttaactaacgtttgacctttcgtcttattcaaaaaatttatataattatcatttattttattgtgactttatttatcatcaaatattttttaagcatgatataagtatttttatatttacataaaaaattgaataaaatgaatggttaaacattagttaaaaagtcaacggcgtcatatattcaaatacggaggaagtattccggatgggaaccaggatacccgaacacagccttatagtataaatagattaatatggttttcaagcaatttttctataattgtattttcaaaacacaatcgtttaactgtttgagaattggcttattcgaaaaacgaatggatagaagttaggaaagggaagaaaataacatgccctaagctaagctagctgcaaatccacatatataaatcctcttgatcaaatgcaatcccaaccaaacacggcaagacgacgaggatttcatggattgctccgccggaaggatcagtgcgagtggacggaagcgcgcggtggatggcacgatggagatgccgagtttgtttcgttctcgatcgacttctcgcgccaaaaacaaggagggacgtaggaggaagagaaatggacagggggcactggccagtgacatctactctctccgttttataatataagtcattttaacatttttcatattcatgttaatgttaataaatctagacatatctatctatctggatttattaacattaatataaatatagaaaatactagaatgtgtaacggaggaagtactaccaatctagaagaatcttgttatgttttctcacagcctcatctggatatttttgttcaaggaaattataccatgattgctgacgaataaacgaaaatgggggtaaattattgtgggttgccctgtcatgtcaggtactcaggtgtagtgtagctcgtgcatgccctcgtgcgaataaacaagtcatggaatcaggcacttaaaccaagagtaatccatccgtctcaatataaatacaacatccgttatattttaaatacaaccatgagttttcgtgtttaactttgatcgtcccttttatttaaatttcttttatgattagtatttgtattgttattagagcaagtataatagtagggtataagctggctaaatgctgagtcggaggagaaaagagaggagaaacgagctgtaaatttacagccggcttggatacaagaaccaagaaactctgtgagagagacaagtggattctgtattaattgtaaagagctaactattagagaagtttaatagtatagcccactacaagctctaattcatctataaccgatctaatagccaattcatacaatagttgcttactatactattaatatgtggtccaacttgtcatacacacattgtgtcttggagtccgtgctgcagctggctacaaatctatagcccgctgctcttctctctcatcttttatctcgttaaaatatatttatagttggctaatagtctgctattgtacctgcttctatgggtagactgagaaaagactacaaagaaccttatatccaataggttgtctgtattattagccttgctcttaaataataaaacatgaacaatactttaggcatgacttgttttttaaatttttttttaaaaaaatattttaaataagacggacgattaaaattgaacacgaaaactcgtgactgcactcaaaatcggacgaaacgagtgtagaatatactcatctgaaatcatctgaagattgcatatccttgaccattcaatctcagggaggggaggtcaggtcacatgggctgtcttggctgggatcgttacttgtgtttggaagcaaatcaccctcccacactaaaaacggagtgacctattaacacatgattaattaagtattagctaatttttttaaaaaaaataaatttatttatttattttaagaaacttttgtatataattctttttaaaaaatcacatcatttagccatttgaaaagcgtgcgcgtagaaaaagaggggagtgagtttgctacgggtagtacctagtttcaatgattcggctatggccatatatctctatcttgttgacacgaatcgataacaaaagtactaaattttcatatatattccaattaaattgttgttaaaatattgacatactaaaattttgataacaaaagtacaacaaatttcatatctattcatataaaaatgttattaaattttcactaatttgtagaaaatataccgtttaacagtttgaaaaatgtgctaaaaaaacgagatagaatccacatgttaataaaaaagcggaggtaatgcagactttagcacttgatggtggtcgagtcattaacattttagacagtgttttattcactgtttccaacttcacccactcatttttcacacgtacgttaccaaactattaaacataacttaaaaaaatcatattaatatatttatttaaaaaacaagtaatatcaattaattatgtactaataagtagttccgttttacatttgcgagaatgagttcccaagtcagtttgccgaactcagcctagtgctgttaatctcagtctctttgcccgtgttccgggggggaggggaggagggacacacacatccacgggcctgtctggtgcccatgagtaaaaggaaaatactttagcttacctaaattggtgacaaggcaccactgatattaaaattattagctattacttcttttgggatatgtccaaatttataatattatgatatgtcaaatttctcaaaatcccttatattttaggacggacggagtaacaagtttaatggtagaataaatattagctattagctcatattaaacctaatatgtagtataatatataagtttatctctatatttttcttatatcttttttcatccatacatttatcttagagtacatgactatatgagccaacattctttttttctataagttctcttaccttcatgtaaatttatagttactcgagtttgagtagtttataggcacttgctccaatttgagttgcggttcccaccaacatgtgaggaagacactgatcactgtgttagtcacttcagctctctctctgtctgtaccacaaagtggagccgggtggattaggcagataagcacagatacaggacagcaaatcagctgtgttaaattcagcccattttgctacagaaaaacggcccaaaaaaataagttgaccctttaaggcccatatggccgtacacagctcatccagattccagaacactgatccctccggcctttgcagcccataaaagcccattattctctctctccagtctgcaacactaaatgtttctacactaacttgacagtcttgaatgactaccacttttcatataggtcacactccctaatagcaatagggagtactcccttcactaagttgtttagactttttattagttaaacttatttaattttgatcaactttacgtagaaatatagtaccatttctaacacaaaacaaacatattatcaaaatatattcaatgatagatttaataaaactaagttggtgttttagatactgctatttttttctataaatttgatcaaacttaaaagaatctaaataaaaaaaagtcaaaacaacttttaatataaaacggagggagtagtataaatttgatcaaacttaaaagaatctaaataaaaaaagttaaaacaacttataatataaaacggaaggagctgtagaaattaagcaagtaatcgacattgggaggtaccaggatagcaacctgcctcctgtttcagtcatatcaaatacagtaataatttataaaagaaaaacatagtcgtaagtcgtatcatatcattatgatacttcatcatcattacagctttcttaatctgtgataaactagggcagcttggatctccctgcaccattgatcagtatgtgcagtcatcactcttgatcagaatctgaagtcatgcatacgaaatcttcagtgtttaattccaccattgatgagggattaaacaaatgtgtgataaagatcacccaaccttcaaaacattatctaattccattacgcatgcatgaatttgtttgtgagggctagctttcatcgcgtcgactttgttgcaagctcaagaaaatatctgacagtgatggagccgtcagggtggtagaaagaaagcaagtcaatttgcaaagcagttctttctgacaggtagccatcctgcaacgagttatgagttctaatcctctcattgttgctcgttaccttagttaccttattagcacaacccaaatttatttttttaaacggggtttgtgggttttatttcactgtactatattctttaagcattggcttataaatcactaataacacagatataaagttattttttttaccatgaattatgtttgtaacttcgttccattttctgcagaagataaacgcaaataagatagcgtagaattgatcatttgtaagtttagtatagatatattgcatctttctataacatcagcagtgcgaacagctgacgttgtcctagcttactgacccccaatacatgataaatctttgtcaggaagacggagaaaacagtgcatcgttccaactctgaatgtacaaaatccgagttggtcagtttcaataaaactgatctaccgtgcaattgtcgttatcgcttaccaaatccatgttaactttattaagcaatttgctcttgtagtagcatcaacataatccattaaaatgcattaagtataacagaaccccccaaaaagtatcaagcaaacaacgtttattcatatacatgtatggtggtgaatggctagtagttcttgtgagctactgctactaaccggtggagagattctccataggaaaatgccttatcaagagaaaaaaaaaagtagtttacactgccatctatttggatatcagagtgccacgtcacctggagaatggagatgacctctcatatttctgaacagaagcatgtatacatgcaaacgtgtctataagggtttctagttctacaacctttcatctatgagaaatataggttctataaacacaaagcccttggttttaagggtggaacatcactattctatgttctgaatatatcttgtgcttgtgtctgtcaaggcacctgggagaactggtcttgttatcatccacagcttgggacacagtgcaccttgctctcttttcacaatcttctgcacctaccagccatgcacaatttgtatgccccttcagtctaaaagttcaatccatctgaattctgaacccttgcaccatcaatcaagctcgaatcgtccatgctgaagtcttggtagtcaagcagccagtctgttgtgcttccatcccatgctgactgcttaacgatgccactgaagtcatcttcattgctgctagtaaaatttagccatggctcgtcagctggaagctctgcctccaacagccagttcaccaatgggtccaggccatgactgctggtgttcctgcttgactgctccatcgagtctgtgggcactgacatgtccctgctgcagcctccctcgggatcgaacggatatgccataccatttgacttggctgattcggttgtggcagtggacagcgtggaggttcttgtttggctaaccaccttggtgttgggcagaggctgatgtgtggctgggtcgatgcccatcttgatgagcttcttcttgatgtgcgtgttccaatggttcttgatctcgttgtctgttctccctggtaatttggcggcgatcttggaccatctgtgtacggatacaaggtatcaagaatcaagagtaatgaaaatggtaatgttattccagtaaaaaaatatggtaatgttatcttctttgtgcaaggaaccgaaagggtgaaaaagacaagccattcgaccaatttcaagtattttcccagtttgctaatgatagcagtgtattcgatatcatgtttcaacattttttgcactaagctaggttgattacgacatgattggtgctatcacttttactttgtagcctttgaattgttctatttctttctctctctggttcatctacataacatatggaggttacatcaacataacatttgtcggtttagagggcaataacaaaaacaagcattactattccattattcttttgagtcacattagcatcattgtaatgaccaaaggcacggaacaataaatcaacaacagaggttacagagaagaagataataaaaggaacaagaatcactcattcaggacctagtgaaataatgacatgcaaaacccacgggttaattaactgtcaaaaatgtcgaacgctgatacagttgcacttagacagctaacagtaagtttttagaagatatgaggtcctattatcagcaatttcctttccagatagattattctaagcagttccaacaaaaatgttaaccaagggtagcttactctcagtatataaggacttgtttcattctaaacaaagtactaatagtttttagataagcttgtagtgattaatagtcatggaggcagactggaggtttgagatttgacaaggataccgtgtgcatatgactttgacgctcttggttaaattcagctggttgagtattgggcacatatagtcatttgctaattagttgtatacaaaaataatctcaattattttgttgggacgccaatactgatattagatagcaatctgtcatactatctatgctcctttactttcagctttagaaattgatatgatctgtagcacacaccttcgaccatcattttttctcaatcaagatttcaagtataattatacgaagaagttacatgaaaaattaaaaatctagtaatctcattttgaaataacaaatccaaacagtttgatgcatattagtggtcaaagctttatgagtttgatccataaaagaaacagagggagtgatgtatcactatgcatcttgtaataattaataaatgcatgcatgcatacatcatgttttttgttcatatacatagtaaacatactacaagttaagtgctcatacgatctttagaaacacaaatgcactgcttctaaagcataccaagagattgatatgtaactacacactgctacatacacgatgcacacactaactgcatgcaatttggtttttgagaagcattgtggcaccactgctcattaccatgaagttttgctttacctatattccgtttttcctggatgcttctaaacttaatcaaaaggaattcactcatgggttcatgcccaggaatgcatgcagatagcattttctagcatagcaggaggcagatggatcaacatatgagatgccctatatgcaagcttataagcgtgctacaatatatcatatcatatcatgagatatccatgcaagtaggcgtacctgttaccaagcttggcatggaggtccacaacaagctgctcctcgtctgcggtgaggaggccacgcttgaggtcagggcggagatagttggtccaccgcaacgggcagctcttgccacagcgcagcagccctgccaacttaggcactgctcgccagcagcagcggccatgtgtcaggatgaaactgatgagcttcttgtcctcttctgccgtccatggccccctcttcaccttcttcttgtcacagcacggctgcctccccatttgctagttactgcagacttgcaccagatagatggaatcctgtataaaatgaacacttataaatttctagtgcttgcacatgtccagtgagctgcaaaactcctgtgcacaagcgtcagatgaaagggtggtgacagctctgttgcaactgcaattggtgtctgtgcttgcatatttataggtcagctcctcacttcctcagtttctcgaaaaaaatgtgtctttcatgaattttgtgtggtggtgatgatgatttggcttaatttagtgtgcttagaaagcaaggcctcaatccgtgctacagtagacttgcacccaaaaatccacatatatgcattgctgcaacgtggtgcatctacagtttagttgttgatcgaatttacaaattaagtataaaaaatatgtactattttattagcacagcagcaatttggtcgcacatgatgctacaggaaactcagatgtgattttctctggaatgaagttgcattttaactagtatttttaaagcttttgctgctttcatttcccacaaggctacacatttatgctgcctttgctacccacctatgtagccatttcgtcatcagctgtgaactatagctaactgctaaccaaagtaccaaaccatttgaggagcccccctaacttcatgtgattgctgtgagctgtaactcatcgtatggaccagaataatgactttgagcacatggtggtgtatattttgctacagtaatatgtagaaaaataatcacgatcagtgactccagtggtgaaaattgtcatacaagatacaggcaatttaggatgtcatagcactgaattcatgacatcagctttcagtaggcaagaactcaaccaagtgatttcttctggcatacatgtacaggtgcaaattgtttttctagggcttgttcggttaataccgaagaggaagggattggaggggattaattccacacctcaataggtgtggaacaaatcccctctaattccccttcaatccccttctaagagggattaactgagcaaagccttaaggaaccaatgctaagtctgttggggaaaaaaattacaagtatacctggggctgggacatactttgtcaatagcaacactgaagatggaaagagtcacaaacataaaaatatcaaccatgtcatatatcagcttcctcgaatatgcaattactcatttactttacgatcaaccagaaaaggctagcctccaatagctctgccgatatctaggcattaaagcatatcaggaaaaacagtaactaattgatttgagttgagaaaacagtgcccaccatcagtaactttcaagtaccctgttccatcaaacaactgattcaatgtgcaagataactgattattttgtagcaggatacaaaatggaaaactagtgaactatgaactgtatgatctaggcatctaaccacactcttcagatcctactcaccacaggaacgggaaaagaaatggataattgtaccttcacccagaaatgacagcaagggatagcttattatctgtgggcacacaacagaatctgccgacatgaagaagaaaatgaccttgtgctgtaacaagataacaatgtcagcttggtgatacatactttggagtattgatgtaagaaggggacattcaatcaatcaatcagcaagcttgtaaccaagctatctattagtagatgtaagatttacatgtgtacttagaatgttgaaaccaagctcattgtgtattttctggaagtcatactccagatttcaagaagtgatatataaaactacaaaaagtgagaacaaactcttgagaaaacatatgcttaggaaacaaacactctgtaaggaatgcatctgttgtatatttacacccagtgccgttgcatgtttctgagatgaaacagtaaataaacgtagcttttagaagaaggaaactcccatcatcatgggagtaattttctttctagtcggttggtctattccatcctgccttccactatctgtagtctgtactagttagaatcaatggactgcatttctagatgagaagatttagctgacatcatccagttggtattatcatgcaaaattggtcctgaaaaaaactaaacaggagggattatctgggaatagtaacttcaacatttttctcttgtttttccccctcttatgtgagaggggtagttgattattcagtgcccaacttcaagcaagcttgtacagtaggacttagtgggaggtctgtgtgtcctttcagtataacttctggctgcttccctgaagctctgactataccttgacaggataggaagatattactaaaagaacaagtgacattatctatatatgaggtcatttaataataaaaacccttcaaaattacatgtgcatgtaagtgagactaccaatatttaggctcctcagtcctcaccaacccatctgagttacagctttcaagtaaaagacctgacactttcaagtccgtaccatgattctccaatggttgagctagtcaatgttatagataagatcacatagaagtaaccactgagctaccatctcgtgtttgtgcagtaaccactaaccaacaggctcatgattccattaaaatgcaaggttttagacagattacatggatttggtatacattcgatggatatggttagttgattactgctcatgtaacggaggtggctagcttttaaaatgcatgaaaaagagaatgggtctagtatttccatcactacatcagctaaatgcactgaataacaacctggattaccaaccttccagctaagaaaacgcgtaatcgatgccgcttaacattaaaggtactcttgattagagggtaatttatatatttaggttttgaatattgatcttcatggagactttgcgttttgaactaaggtaccctcagtaaggtatccctcttgctttatttagcaattagcacaatgactttctgaaaaggttgaaagaaatgactgggcttaaaggaaaatgttgtgcctgcctcttcagacaaaaatataattaaaaaatgctaggaagtgtagcttgtctacctacaaaatcatccaagattgatcactctatctgacagataatgagagcatggaattagttctagcaggctgtaccaacggcatatgcatgacaaattggcaatgctaatagtaagctaacaattagaactggaatgctcctcttgttcattcattggcatcgttcccgaatacgacccaacgcagcatggagatcttgtgtgcattcctcgattcagtctcaagctatattgttgccgatgctgaattacatgagcacacggaagtattggtcttccaagatatcatcataagacaaaagtaccagaagaagggactagactgtacaaaacctacaccctcatgggtccttgctgcaaccaaactctacgacttcgcgtatctgctcatgtcattgcagaggactactactgaaggttgcaaggtgtttcacatattgtcattcacatataacaacacttcactaaaaactagtgtgagaggagacacatgcctctaaatttggcctacatcaaagttgttcttccacccccaaaatcaacatgcatcgatcggttcatctcatggggggacaagacaagggcgacgcattcagatattgcgaccatgtgtgtcagtaagacaagcaagtatacccaccaagatcgcggcaagatcggaaagctagggcacggatcgcagcgaggagatgtgtacaggagactagaaagcgaagcgagcaaaagtgcagtggaatctttggttggtaatggacggaacgggcgcacactgaccgagcggaggcgcggacttcgccgaggtggcggtgacggcgacctcgcaccctttcccttcccccaccaccggaggaggaaggggagggcgccgtcggaggggagggcgtacggcccgcgcttggaaggggacgccattgacgagggcgcaacacaacagtgcgttggatggcgatggctggagggcgaactcctgtctttttcagaaagttcagattgttttttgtagaaaacaataaggatttgtttggaatgaactccctccatccttttttatatgtaacgttggttaatttaaaaataaatataaaagcgtcaaatatgaaaatacagagggaatatgaatttcgtagtcaattccaccttaaatcccttcgaaattcctatgttttttttaagaggcctaaactcttttaaaggtacacatttttttattcaattgttatggactgaccgggtaaataaaaaaatgaattcttggaatttttcctatgttgacttcgttatatatgaaagagatgcatccgaatgaaaaataaaaattgttcatgtagcaaaagtaaaaaaaaagagcaaaataagggtggtgatttgttttaaagcggaaaagatatactttgacaccctcgactatggtatcaactatggtatgagtaattcatattcgaacacacaaataccggatatattgatttctccaactattaaaacgagcataaacggtgaccctgattgatttggaaaacagttttggctgacgtagcatctacgtggcggtgttgatctactatctgtcccatgtggtgtttatgtggcattagaataaaaacaaaaacaagaaaaatatgtgagacccatatatcattcacccaaaaaaaaagatgggacccattgacataagatgcacatgtcatcatttgtctgattgtctcctttcctttttcctctttcctcactccccatctttttcctctttccttttcccccttgctactgttcgaagctcgtccaactcccttgtcagcatcttgttctccttccttgtctgctccaccgtcatcattgtatcctccttttgcgcctcggtagcgctcgtcaccgccgtcgatgttggcgatggccacttctcgaccattacctcgccaagaactaagaatgacagcctctgcatcgccagcgcagacgcgcccttctccctgccggtggtcatctcaacaggtattgtcaacacttaccggacgcgcaccactaccgtatcgcctcacaccgggatggcgctcctcatcgtcacctccgaatccgatgtagcaaccgcggtgggggtcgacatcatcggcgccaagccacctcagttagcgggagagtcaaaccgcttgtgcacgacaaagtcacccaacaatggcttgaggatgagcgagaaggacatggtatcggcggttttaacctcgataatcacagtgatggctaaggtagcggtgccgaagataaagaggacgagaagggacaaccgccagggctagagctacgtgggacgaagactaaatcaacaccaccccatcagccaatactgcttcccaaatcaccaaggggcaccagttttgatagttgatatagttggttttgtgttggagggcatgaattatactcgggccatcgttgagggagtcaaagtatactgttttccttttaaagctcatccatcaatccccttagccagcccatgcacaacaggtcattcaccagcccaacacaccgtaccgaatgggattcggcgctaccgtgcggccgtagcagatgggccggaacgggattcacgtcaggcccgtactatatgggctgtaactcacgtgcgggccgtatcgcgtcaaataacgtgggtg

SEQ ID NO: 66441 - DNA, 11242 bp, Oryza sativa
atcccggttgctttgtcaccgctgtaaaggcgcctcatctccttatcttggccactgcttcatctcctctgtagtcttcgccgcagttagatgaatgctactctcatcactagtgcatccagtggtctggaatagtatgtttcgatgccaattctgtctctcatggcgacgacctttgctgctgcttggtgatgatggagggtttaattgattgattgtggagtcctaatttggacactaatccgatctgggacccacccagatgagctttagtgatcccatggttgatcaaagcgtgctgcatctgctaatctctgatgtgaagcagattggctgaagaagacttagatatcctttcttctttttttcccttgatagtactccctccgtcccttaatataagggattttgagtttttcttacattaaccactcgtcttgtttaaaaaaattgtggaattattatttatttttttacttgcttaattatccaaattactttaagcacaattttttattttttatatttgcacaaatttttttaataaaacgagcggtcaaacaatgtaaacaaaaactcaaaatgccttgtattatgggatcaagggagtatgtattagctggagtaattatattcagtgctgatagagtaataattgtagcttctactaactgccagtcatgattctaaaaaaatagaaatgtagagtagtatatatctgaatcttagcaaaatattattgtatgatcagatcgaccaattaaggcaagcccctcgtatgctgcttgttcgcaggtgaagctgacggtatgctgacagtagatttacttccttcatctataaatataagtatttttaatgttcagaatttggttatagatataagcatttctcaagtactactttttcaattgtcgtatcgctgagtgtgaactttttcaagtaatctctcagtggtattaaagtaatattattttaagtttattttttctaaactctaaaaataattatatttataaacagaaggactaataattaattaagtgaataataaaggttgattaagtagggtggtacttgcacttccctttccgttgctcgacttgctccaaggggagggtgggtcccaggtgacatgcgagtgggtgatggttggttggttggtaaagtgtgcgtgagcgtgtggggccgaggggccccaccatagaacggcgaggtgagccttatccgaaatggggaaaaaagggtgggctctcttgttgaatcggcaaaaaaaaaaaaactcgaaaaacatttttatttttagtttttggtttttgatttgtcaactgagacggagagagacaagttggttgtcacggtttctcttttcggcgaagcttaggccaatgggagcggtggtgtgtgtgggcgtgtgccacccgcaccaacatggaggcacaagtggtccacgggatcatcatgctttccgttgatccttctcttcctcgagtggcaactggcaacatttgttgtcggggatcttttgttaataagaaaatattttaattacatgcgagttatcgtttactctatccgttatagaatacaacaacctaaaatccgttaccgaataaaataagatgaaacgtatctaaaatcatccagattcatattattaggatatgccccatctaattctagattgcaatgtcctgtaatggagagagcatgtatgccatggtatgaattttttttaatgacctttctgatattcgagctacgagtgataagttaagaaacataagccaactaaaaataacttataaataattttttttatatctatgttactagtgatttaaaattcagtgttggaaagtagactacaagagagcgaaataaactttaaaattcagttttaaaatttaatattttattgtgattggtaagctaacggttagcaaagtaagtgtagctcaactgatttggtttattgtagtaaaaccagtcctgtgtttcctaaaataaaaactgatataccttttttcttacgtgaaacaacagaagaggtcctactgtgctatattatattaaagaaaaactgatatacctcacactactaaaaggagcagtagaacaaatgagcagtagaacaaaaaagcatgggctccagacacaagacgagaagttggcccagatccccgcgacggagagcagcggcccgcactagctcatagtactattcttcgttactgtctacaaccaacaggcaacagatatattcatacataaaaggagacccactgagtggcgactgacacgatgagcatcgcatcagtgttgtgcagcatcacaaagcatataggatgaggatttactccaggtaggctgatcagcagatagccatatacacttcaggtgaaccaaacagctctgcgttcctctcaaacaagaacagaaaagaaacaacacatgctaagagagattatgctgtgctgaatcatgatgatcaggtcaagtttctttcggggcgcccttcttcgcggacatcgcggcagccttctctgcttaaatctgagccacgtactcgtcgatctcaggctcctacagctcgcggaggccatccttgtgtgtcatcaccgcaatcttgatgttattgccaccgctctcgacaacctggagacatcaacccattactcaaatttaagatatttgttgcatataaaatgccaagcatcaaatgatatagctatgatggagaaaccaactcagcaaaaaacactgaataaacaaaggtcaaaggccaatgagttcgtcatgaaaaaaaaaaagcaaagcaagcaggcatctctgtctacagacaagtaaaaaaggatgacatttgttgcactaaaagagctcatcagaaaattctacatgtgcaacagactgacaaaatgcttaattacctatcaaatggcagtagtaatgtcattataaagaaataagtaccatggactcaatagttaatatgcatatgtgataaccatttgaagccaccaatgaatgtataagcagagtaagaaattgatttcggatatcatgaactgtgcatatgtgataaccaatggcattggtggagccagaatattcttaatgaggggttcagaatctgacctaagtggcatgattattagaatatagtgacatttaccagtaaattatcaaattggttcatatatggtatatagattcatgaaagttcaaatctaataaaataagtgactcttcattcccttgaatagctagttttcttatttgagtataaattgtatatgtttatgtatagtgtggttggttagcaaagagtttggggtacacatgtacccccatgtacccatctacctctgccactgaccaatggaaaaaaggtcaatgagtttgtcatatgtggcaactggcaaagcatgaaacaaagtactaacatactactttgtcttccaacaacgaaaaaaagcaagatatttcactaaaagaggtacagacatatacgtatatgacaaaatgtgcaagagacgtgcattttcacggtctgtatgagcaacagattgcaaaaatgatcaactgcttaccattagctagcataaactcaatggtggctgtgcatatgtgttaaccatttgaagccaccaataaacgaatatataaccagatgcaggctaagaacttgatttgaagtatttagctatgaactatgtgtccttgaggaacataaccatttgcagttagagacttacagtaatgaaaaaaggacatttagacttaggccttctttgtttaggcttataagctagcttatgagccaaaaagcctaagcctaaacaaacaagcagcttatttgtttgccctttttaaagccacaagccactcttacactgttaagccaaaagctaggttggagaaaccattttgttggattatatgaagtggaggtatgactcaaccattgaacttaggatttcaaatccaccggtttataaaacatataagccaataagctgacttaaaatctcaagccaataagtctaagcctaaacaaagatgaccttaatttgatatgtatttttgtaatggtgtatatacattttttttacctagacagtaaatacaatgaactaggcatccgtgcctatatctaagcagcaacatactaaagcggcagcagagttgacaaaatacatgcaagttgcagcttctacagtgcaatagaagagaactacaggtgcagattatcaataacagaaaaacaaaagtttatatgccactaatcaaacaactttaataacttttgaagagaaaaatgtactcacataagaatgcctttaaaaacttttgaaaccgtgcttaacacttaaaatatgagatgcagatgacaatcaaaatacacaaatgattaaatagctagagacgatttactacggataaagagttaaagacctatagccaacactacaacaataaaatttgaggtgcagatgaaaaccaatatacaaatgctgaaatagctggagatgatttatgagattacagatccaagccataccaattgctatgatcactccaggcaccaataagtatcatctttaagatggaagcaaacacaataaaaccaatcccatccatcccactctattttaggttcatgactgcatttatagtctcagccgattgtaacaaagattcagggaactattaatctttgcaccaaattgagtcatatggaacttaacgaagataacgatgttcaatcgtaggcgggcatcttacaaattactgaaccagtcaacataagcaacacaaattagtgaattacttttgagtatctgtcttcagaagcacagttactgattcagtggtagtggatcaaagctagaggtagttttaactagtaaaattattcagtgtgaagtgtatatatatacctcaaggagggctcggatggcaagcttgatggtctccttgccggaggtgtccttgtaattcttctcgaggaactcgcgcatggagttggagttgcggccggtggcgttggccttccaggcggagaaggtgccggatgggtcggtctggtagagggcgggcttctcggtgtaggggtcgaagccgacgatgagggtggagaggccgaaggggcgcaccccgccgctctgggtgtacttctgctgcagtccggcgatgtagcgcgtgatgtactcgacggtgacggggtcctcgacggtgaggcggtggctctggcactcgacgcgcgcccggttgatgagcacgcgggcgtccgccttgagccccgcgcaggcaagcgcgatgtgggtgtcgaggctggcgatcttgcgcatggacctggatttgggggggagatcgatccgcgggtgagatccggcgaaggggagggggcgggttgaaggatttacctggagtcctggagcttgggggtggatttcttctcgacgccgaggacgacggtgtcggtgccgcggacgccgacggcggcgttgcccttgcggacggcctcgagggcgtactccacctggaagaggtggccgtcgggggagaagacggtgatcgcgcggtcgtaccgggccatccctgcctgctggtggtggtggtgtcgccgccggcgaggttttcctgctctcgctttgcttttccttgtcggttgcgccgccgcctccgccttttctcgttgctgctcctgctccgccttttctttcttgcaagaaaagaagacgacgacgacgaagacgaagacgaaacggactcccattggcccatgggccggatcgtattccggcatggggctcgcgttatgaagcccactaagaaaaggccagaaagcccatggtttcttgctcacgaaggttactgcaggctgcatcccatgggcccatggttaagagggatcgaaattttattctccgttccccctttgattcgaggaaaaaaaatcgattttggctatatcttactcgaaaattttttttcttatctttcactcgattttctcacttaaacttacagtgcattttcttgtaagttacagtgcattttcttgtaagttacagtgtaatttatgaaacttacattgtaacttttgttttttaagctacaacgtaatttttaaatctttacatgtaagttttgaaatttgtattggatttagtctttttcttgaagatatggtaatttagtgtccattatagtgtttcttagttgctttttgccttttactgtgtctatcgaattttaatccaaagattaaaaattgcgtgatactcataaaaatctttcgaaaaatgcataggtactctaaaaaaataatggtttgtgtgtgtgtatatgcggtttatgtacctatagactacgtgtattgactgcctaggaaaaaaatataacagtatatcaaacaaaatgttttatcaatagttttgctgcatcataagttcataattttggccatgtcaatatatattgcctcacatgggcataaatttaatttgcaggcatcgagcagtcaccaattatccatgtctccccatcaaaatttgccaatgtcaaaactagagtcaaaccaacactggaatactaggagcccttgtctaaaaatgctttaatttctaaacggatggatttgagagaataaaaaaaagtaagcatgaactagctaattgaatttgtcgacatcatcagggcttgcaaacccatttaaaatctgaattgggcctttcatctatctcctcaaaagggaccaaatctgactcaaacttgaaaacttgttggatgcacttgtggcgtagtggagcttccgctatcttccccctcaaaaaatcatacctgcaaatcataggtagtgtttagttcgtgtgccaaatttttttaagtatacggacacacatttaaagtattaaatgtagactaataacaaaataaattacatattccgcctaaactgcgagacgaaactattaagactatttaatccattattagcaaatgtttactgtaacaccacattgtcaaatcatggcgtaattaggctcaaaagatttgtctcacgatttacatgcaaactatataattttttttttcgtccatatttaatgctctatgcatatgtctaaatatttgatgtgacggtaaagttggaagtttgaaaaaaatattttgaatctaaacacggccatagtatgaattaacaaacacatacctgtaaggctcctttgggttatatgattctcatatgaaaaattgcaatccataggaaattttactataaatgccatttggaacaaaggatttgaagtaaagccctgtttagatttcaacgtttttcttcaaactttcaactttcccgtcacatcgaactttcctacacacaaaaaattttaacttttccgtcacatcgttctaatttcttcaaacttttcaattttagtgtggaactaaacacagcctaaataaattcctgtggattgagttcctaacttcctatacaccaattccgtaggaaacaaacaatgagctcaaacttgtctctctactctctctatagaatccaccaaattctcatgttttttttttcctttcaaccatccaaacaatacacatttcatattcctatatgttttgcctgtttctgtatttttagaatcttgcgttccaaagagtaaaactactactgtttagctaattatttgcaaattgatttagatatgtgtaaaacggaagaagcaattattaagtatatacagttagcttaattaccacagcactctgtagacgctgttgaagaatgcaacgtcagatgcgtagagatctctgagtatgaatgagttgccttcctccattgccagcctcgtcaagctcgccgtcatcttcttctcccacctctcctgcctgtagccggccagcacccagacctcgacctcctcgtcgaccaccaccaccaggcacagcttcccctccaccgccgccaccttcttccgcgcccacctcttctcggtggtggcctccggcggcaggccgatgaggcgccacgtctcggtcttcacgtcgaacgcgaagatgtcctcggcgccgccgctcagcctgtcgggccaccggagccagtgcatggcgccgtgcgccctcaccgccggggcggcctccacgagcgactccggccacaccgcgacgtccgccgaccgccgccacgccatcccccgcgagtcgaacacctcgcagcggaggcagttcctgagcgtggggacggagaagcggacgatcttgaagtccgccgcgccaccgccgccgccgccggggcgcgccagcatcgcggtggcggccgtgcggtagcgcaacctcgggttaggcagcgcgcgccactgcctagtcgccggcttgcagacgtagtaggacgacgccggcttgcgcggcgtggcggcgtcggcgtcggcgtcgacgcagcagacgagcccccggtgcggcgagacggcctcgacgcggacgtgcggggaggggaggaagtcgagggacacgaggtcggccggcggcggcgaggggtgcatggaggagacgaaggtggcgtggtagcggttgcgcgcgacggtctggacgaggtagccggagacggcgtcggcgcggcggcagtggagcggcgcgaaggcgggctcgtaggtgaggcggcgccagcgggtggagacctggcggcaggcggcgaggtcgtcgagcgagacgcgtgtgagcatctcgaacacctggtcctccggcaggctgatgacgtcgcactgctccgacgaagacgaagacatcatggagaagagaagagaagacaagttggggcagaggcaggtactaggtgaggatctagtaattcagaactcgatgtgtgctagctgcattgcattgcaggcttgcagggcaagaaatgttggaattaatgaatgggccttagcccactcgaagattaattctttggaaaatcacaaaagcccacctcatgggatggcatgcatgtggagtttagtaccatcttgcttattctaggagagggggacctccttaaaagggaggatgtcctcctagccacttgaagcatgtgtggtggagagaagaggggaaacacacgcgcgcgctcgctcgcctggcctggcaggcggcgcgcgtgcacgacgtacgcgtcgaatggtccgaaaaattggctcctcacccttgcgcagatgcagcctccttttgcagttttgttttgctgcaaattcggattcgtttttgtgttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcatgcaatatatacgcaaaatcaatctagggtttgcctcctactctgtactgcgccgtcgctcgtagcctactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagtgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgctttttcctttctgatttctgcaataagtctgtgaaccatatttgtggcagtgtggatgatgaggctaatgtttggcattcacgtttatgtcatattaattttg

SEQ ID NO: 66442 - DNA, 7865 bp, Oryza sativa
atattacctaggaataagcattccattccataaacttaacaaggagagaaaagaagcaaaatatgatgattatcccaaatgcttagttgtatgaaacaacaagacttgtaaatcccttgcttctaaaaaattagaatcaaacatagcaggtatccagtctccatacgattctgaagccctcattttactgcacactatactatcattaaataaatcaaactcttagttcgaacaaagcatatttagctgagcccattgtgcataagcactctccacaaacttttaaagtatttacgttacacgtagcaaactgtgttcaaacaaacaaactccgctaaaatcaagcaaagtacacagaattttcctttttaagacgggtttactaattaaagcacagtgaaacaaagaataggtagttgattacatttaaaggtctttgttcagagcttgctaggttgaagaaataattaccggtggttttccataagtcttgacaatagaccatgtacaagtatgcggatcaaattccttcactagcataaaatacaagaagaaaaataatagcttagaagaaaaaaaatgacagcaatggggacacaattggatcacagtactgtgttaaccaaaaagtgagttttagcaaacctgtaatgttctcagacggatcttttgtgtgcccagcaacagagaaaaatttgttgccccaagatatctacaaaatagcatcagaggacatcaagctaagcatcatctgaaacatagatagtgacatttgttccaaaatttaccaacgaatgtccagcacaagaagagacttgtgctgatttagatgaatcagtggatcctgcttgaaattttgcatcaatcttcgaccaagtcaaactcttcagatccaaagcctgtgctcaatatagatagtgaaagaaatatgcattaggtcaatgttacttaatgatacaaagttatttaaatatagcggatgaattgccatttttttgggtagattcaagttattttcatcatacatgtcttcaaactactctttctgaatattatgcaatatgagcctcccattctgcctaattgagtcaacttcatgcaggaaatgcttacatcataaatcatccatagtttcatttgtaatcccttttaggaatatttgttgttatcttctcgtttcaaaaccatctatgagtcatactgtaaattttgcataagcatgaaaggctggtacagattacaagttacacatggttgaacatcacaccacgattacaacatatcaggcttcttatcatgaacataaatgggcctttatccagatagcatatccaataaatacaaacacttcaggacaattctatgacaaacagcagaatggcaactgctcatatgtctccaagtccaagacaaaaaatacttaggaggtccacatgcaacctgcttgactgttatatttagcttcacatacctgaaggtcgctaaggtaacgcccattgtggtttcccccaaatatatacatcttatcttgcaccacagttgcgccatgctgcaggaataaaagttcatattaatgctatgaacagaggaaggggagaactgggataacagttcacaacttaaaaaataaaaataaaataggcaaggtagccaaggccccaggtgcatatggcatacctcgtaacgaggtttgggccgctgcccattaacagataatggagtccattcttcgtgaacactgacagcactaagaccttccagaataacaactttgtcctgtgtctccactgaacttccattctcagatatggttttaggttctggaaccgatgttccatttgttgaagccagaataaccttgggatcttcctttggtttcttgtaaacagaaatgcagtaagcaaaatgttaagtttatttcacaaacaatttattaatcagggcattgagatgaaactacagctgatagaccaatactttcaaagattagagtgaattctaaatagataggcaaaaaaacataagaaatatacttttgacaggaaacaacccatgcgtacccactgcatttatgaggttacagaatgcaacttacatgcatttcaatatctacaacaggctcagggttgaactcaggaacccttgagtaccatccaggatcttcctcctaccaaaataccagcgcattaaatcgttgtgcacagggtgaagaatacaatgtaaatagtcatacctctaagattttaacaaacagccgcatcgcctctgccgatggcatacttccaagcccatgccagctgaaaatacaaatgtgtaaagagacgatcatgctttaaagacatgcagtatcaacatttgattgaaggtctatggatattcctgccaccggtcagctctctagcttatcagtccaaaatttaaattacacaagacagaaatcctcttctaacttctgggcatgtgatagcattccgttctaatactggcccaatgataagcaataaaataaggcagcagcacaagacagatagcgacatcatcttatattaactaataactagcatgtgaagtttcaacctccaattcgatcaccaatgtttccgtttctccataaatttaaccagaactatcaagttcgctaatacggagacaacttcatgcaggatcgcactgtaggtgatactaaccttgtccatttgctctgctccacagggttccatgccctgggtttcggcacattgcaaggccccactgttgcctacaccaaaacgaacgcaaaaattcattccgacagccaaagcaaatcctccctcccaaaagccagtgatcaacaaactaacgctataattcaaccctgcgcatcatcaattccacctagatccactccacgcatttcccaaccccccatccaaccgagacaaatcgcgtcacctgctggtagaggccgtagaggaggagggcgacgtcgttctggaagcgggagatggcggacgaggaggtggccccgccggccccgaatccggcgtaggccgccgcggcgtagaaacggtcggggtaggcgagtccggagctcgccatggccgcgcgcccgcaacgcaagccctagatctctccccgcccacccactcggatgagatctcgcgcccactgcccgcgaggcggagagcactagcgttcgcccctcctcctcctcctcctcctcgccgcggcggaaatggaaatctgcagcgattggagacgagagaattcgagatctgggaggcttcgctcgctcgaccgacgctcgcttcgcgggcgatgaatgatggatggctttaacgctcgttctccgaggtggcgcgggggtgtccacgtgtcggtgacatggtgggggcgagtgacgtggtaggagagtcgtcgcggtcgccacgacgacggttaatatgaaccgggtctacggcgcgggtcaccgtcaccgtgaaccgcgtctagtctacgtagaggagggtaggcgcgggtgctggagtaacgaacgtgtgggaagaactaggaaggttgtcgtggtgttggtgggagatccatcctcattcctcgcaccgcggtaccactagcaaaaaaagcgctaggcggctttatacactgcaaatactgtattcaaatatgctaaaggtctcaaacaaaacaaacttctctgtgtttgatgattgcaagctgatgtgggatgggtttggtacaatttctattgagcactgtaatagaaactccaatcaggtggctcatgaattggccaggttagcgtttaggacaaaaaaattttgtacttgggtcgatgaatcccctggctgtgttctgaaccatctggtaaacgatgtaacaattttatcctatcaataaagctagccgaatggcattccccaaaaaaaaaaacttctcacgtacttcatccgtcccaaaatataagcatttttagcatagtgttaggtcaaacatttttaactttaactattaatagaaaaaaagttaaagagatcaataatgtaatattgttactagatttttcattaaacaaattatcataatatgcaattctttttatttaaaacatcttatttttatatatattgttggtcaaattagcatctcgaagactgtgtcgaagtctaaaaatgcttatattttcggcgggggagtataatttacactttacattactcaggtttgatagtgctagatttttaggttaattagatccatgttatgtcattgcaaatttatctattcaaaaaaatgtcattataattcatttattcgcagtcatgctaccaaaaatttacaaaattaggatcatgccaccgccatcacatttttcatccatctccttccctttctgtcttctactttctttctcccgtcttcttccctcccttctcctctttgctcagctccttcgatgaccttatgcttcacctccgttttgggcactataacgaatagcacaccattctttagctcggcgcggaccttgctcttgtcgcccacattggggagcacgagccgcatgttgtaggagctcatgctgcgctccttccaccacccatcgtcggagccccccgttccttctcctccttactgtgctccccgcggatgacaagcatgttgtcctccaccatcaccttcacatcttcccgtgacaggcccagcatgtcgaaccgtatttcacctcgtttgtcatcatccatgatgtcccgaagcatatccgcaccttccctgtcgccggcgatctccacagcgcgacggggaaccccagcgtgacattgttgaacattcagtctatcatgtccagcatctatcgtatcaaccgcatcggtgatcagatccacgagggcgaatggggatatgttgttcaatgccgagcgcgcgctgcacgacattcccctgctggttcccaccgttctattacctgacgtgctcctccaggcggcgcggatggggaggcacgccacaggtgagacccgggtgacgagagcaaatggaccaaccgttgcactaccaaatagagaggaaatcaaaagcattgagatggagatcgttggagaggtcgcgtccaccatggcctttactgtgccaagcatagaggaaaggagaggaaagaagataggagaaagaaggaagaagatgggaaaaaaggagatggatggaaaatgtgacgacagtgacacgatcctaattttataaaattccaacggcacggttacggatagtcgaattgtaataacatttttctaaatagacaaatttacagtggcatatatccaactaaccctagatttttagacatatgtttggctatgacctcatcaattttattttcaaatatataaaagtataagctatgcttaaagttcctttaatgtaaaagaaattacaatacaaataaacaatagctatgcaataaaataaattacatatgtttaaaatataatggtgtcatatattaaaacagaaagagaataatttttccataaggcttggtaaggttaacttgcacctatatgaattaaaaacattgttttatagcaatactaaacggatgcgaattaggtgtgtttagttcgcgaaaagaaattttttgggtgtcatatcggacgtttgatcggatgtcgaaaggggttttcggacacgaatgaaaaaactaatttcataactcgcctggaaaccgcgcgacggatttattaagcctaattaatccgtcatagcacatgtgggttactgtaacacatatggctaatcatggattaattaggctcaaaagattcgtatcgcgattttcatacacactgtgcaattagttttttattttatttatatttaatatatactttatacatatgtccaaagattcgatgtgatgtttttgggattttttttcttttttttttactaaaacatgctagggggagtcagctagagggccttgggcgggcagaaaaacaccaaaaaagctggagaccgaacaaaaccgagcggaccgaaccaaagtatcgatttattcggttgtcggattatgcttaaccaaaccggctttactctttgaccaaaccggcccaccccctctcgctccacctgactgcgtgtgcgtgaggttgaggtatccccaaatttccttccgccgccgtgctgctggtcaccgccgtggcgaggcgaggcgatcaagagctgagctaccgtggaggcgtggattgagagtctgagagagagcaatgacgccgcagctgcagccgaagcagatgcactgggcgagggccgactcctccgacttcggaggccaaatccccgcccctcggaggtaatcctctcgatccaatccacctcaaatccccgccgccgctgccgccacctgaaaccatgtgaattttcgtgcctctgcagcgggcacacggcggtgagcatcggcaagtccaaggtggtcgtcttcggcggattcgccgacaagcgcttcctctccgacatcgccgtctacgacgttggtaataagccccaccgcttgcttcgcctgattgcaagtgccacgattcagacgattgattctgtttagataagagcgctgaaccttattagctgtgtgaacttccggatgcaactcgtgtttgcagagaataggatttggtacacacctgaatgcaatgggagtggctcggatggacaggcaggccccagtccaagggcctttcacgtagctatcgtcattgactgcaacatgttcatctttggcggccgatcaggcggcaagaggtctgcgattcatacggctatttgctgggatttgaaaagcaccctataaagaattgccttatttgttgtttataacatgatgttcattgcgcagattaggtgacttttggatgctcgatactggtaaacttctatactttctcaagcattttaagaccccttccttaatttgtttgggcgtatagtggaggttcccgtgattactaataaccgtcatgttgcctctttcatattccagacatatggcaatggtcagagttaaccggctttggtgatctaccatcacctcgagagtttgctgctgcttcagccataggaaacagaaaaattgttatgtaagcattccatctaatgcaagtttccctttcatttctgggtaccatcgcttatgagttatgaagaacatttggttcatcctgattcaggtatggcggttgggatggcaaaaaatggttgtcggatgtatacatcatggacacaagtaagttaacttcctgttcttattcaatcagggttgagtatttaatttattttgttcaggatggcaataaaaaaatcaatcaattaataactacactctctattggacagtgtcacttgagtggacagaattatcagttactggatcagtgccacctccaagatgcggacattctgccacaatgatcgagaagaggttgcttgtatttggtggcaggggtaacttacatttcttgacttgacttgtatttgctgatgatttttaattattaatgaatcaatgcataacttttggccatcaacatatatttctgattatttcatatatttttttcaataggtggagctgggcccataatgggtgatttatgggctttaaagggtgtcactgaagaaggtacatcttcctagttgcttgtaaatctacttatattgagagggaaggagggtgggatactaactgctatttaaaactggaaaactcaactatttgcctgggagggagggggagaagaagaggagtggccgaatggggaggtctcaggccatcctaactgctatttacaacatctgacacacaatagttggtggtttaaccatttgcctctcaatag

SEQ ID NO: 66443 - DNA, 2969 bp, Oryza sativa
acataaaatggcatccaatggttggacatgaaggatacggggcatagccgcatagggatacatatgccatctcaaattctgaaatgtacaggttgatgagctcattcgtgcacatcgaagaacgaaaaaaaactatagattagagttacgacttacgacttatgagtagaggcctcgtagtaatcctatgttacaaaaggatgaaaagctacgaacataatgtgcacaaatgatggcaagttcgcagccccaaaccccaaacggacaaaccaaggaaaccaaaggattcaggattcaggaaaccccaaccccgctgcagattcagtttccacgcgagagagagaggccccagctaaccacacgcaactgcttggcgggagagcgagaggggagggggtccgaaccggaggggagcgccgcggctgcagggaagcgtcggggaggcggagcccagccggggcccggggccaccgccatctcgtcggcgcggtggccgcggtggttgagcggtggcggcggggcgtcgacgagcggagaactcggcgtcggaggtggggagttgcaaatgggccgggccttcgcgtgcacatccgagacttgaaaatctctcggccttaaaagacagcccatgtgagccaaatgctaattggtacggcgcgtacgctgccaaaagcccaaagcccatacggagtacgtgtgtttctttcttttcttttctttttttcttttttagcgcagccacgtttcctttttatttttttccttttttcatctcaacttttgaaaactttcaactgaaatttgaaactttcaattcagttttgaaaactttcaacttaaaatttgaaaactttcagctcgaaatttgaaatttttgaagtcaaattttgaaaactttcaactttccatctcaacttttaaaaacttttaactaaaatttaaaactttcaactcagatttgaaaactttcaacttctcatctcaacttttaaacactttcaactcaaatttgaaaactttcaactcaaaatacaaaaacttctaactcggatttgaaaattttcaaatcgatatttttggaaaactttcaaatcgtattttgaaaatttacaaaatcaattgtttttatttttaattgggaaattactgtagcattctcactaatctaccctataattcaccaactacactcttacaaacctcattcatcaaatccgatggtcaagaatgatcgaatccaatggttcgagatcgtcgtggaccctctcccttccgcacgcgcttggcacccacacctgctgcattcctcctctccccttccctcacgtgtgtcccctaatcacgccgagaaccccgtctctgccctcctctctctcgcactcacccagctccgccgatgctgcaccctcacgccgccgacgctccgccatcgcgacgccgcctcgccacccgcgacgccgcctcgcccctcatgccaaccgccgccgaccggcgccgccaccagcatcgccgattctccatcgcgccctatcgtggcctgcatcgccgatctaccccgaccggtgccgccgcccgcatcacccatctactccgtgcctccacgtcaacctccatcgcctccccgggctcgagaccgtcgccatcatcgggaagaccaatggcgccaacctcttcgcctgggatgaccgccggggcctccttgctgtcggctgctggaagcgcctgaccatcttccgccttgacaatgagaattcagctccgcattgcctattctttctcggttgtgatttgagtgtttatggctatggtttgactgttacatcatttgggtttcggtggaaattgagatggcctgttggtagtgctcaatttggagaatgggaagtatgatacgggggattatctaattaggttgaaatagatattcagtggaaattaaatcaaacactggaagagttgcttccaatcctcactgttctgttgttcttcttgataatagctgcttctagattcttgcctgatgcttgcttggttgggttttgtaaaggattaatgcctggttgtcgtgcattgtatccggcaggagtgccccaggtcagagctacttgttagtagaataattgaattcttcatgctgataattttcaggtgcttttagccacctgtagcaaatgttgactgcatgataaaaaaaactaaactttgtttacttgtgaattgttgcattacggtgatctacaaaaatctaccttttcattttatgtttgaactagcggtgtcgattttggttaaactttgacacctgaaggatcttagcttgaagataaatgtgcatctgctgttttagatgcacttggttctgtttagggaagattaactgtgattctttagttactgattattagtctttacagtctagcgtgtgaaaccgtgaatgccacttctgcgtctcattcacttgtgttcaggttttagcaaacataattcagattggtctgtttggcatagcatatgaatgattattgaagctaccagtagttgaataatactttgaccataagtagcacctcgaatattttatatgcaggattatcagtacttgtttgtgtttgttgcaccgtcttttatttttgtagccattgtctcatgatgaagcaagatcattatttgcgtttgttgcaccgtatgtcaatgaagccaaggagaccaagagcagtagttctctacctcaaaaggtagctgaatctgaaatagaattttgccttttcatttatgttatatattttcctttctgtattgagcttggagatctcaacatgatttaggatttatacatgttgattggtgaatgttagcacttatatacatgttctatttttttttcttaaagataattgcttttttttgtatttcgttgtttcctaagatgtaccaacatttcttaaagacgatttcctcacggacttgct

SEQ ID NO: 66444 - DNA, 15021 bp, Oryza sativa
  unsure (1)..(15021): unsure at all n locations
acgcccatagtggtgagtactcaaggttgtttgactatgctcttgagctgatgcgaagtaaccctggaagtagtgtgcatgttgcccttgatcctgatgaaaatgagcatgtttttcagcgattttatgtttgtttagatgcttgtcgaaggggattcttggatggatgtcggagagttatcggatttgatggttgttttcttaaaggtgttgtcaaaggagagttattgtcagctgtaggaagggatgctaacaatcagatttatcctatagcatgggctgttgtggagtatgagaatgcaagttcatggaattggtttcttggtcatcttcagaaagatcttaatattccttatggtggtgatggttgggttttcctcacagaccaacaaaaggtattttgcagctcgttgctctgttgtagttcacttgtagtttatgacacttcacagtttacatgattaacttgttgtttctatctacaggggcttctaagtgtcattgaacatctatttccaaaggctgagcatagaatgtgtgcaagacacatttatgctaattggagaaaaaggcaccgtcttcaagagtatcaaaagagattttggaagattgcaaggtcatcaaatgctgtgttgtttaaccattacaaaagtaagttagctaataaaacacctatgggatgggaggatttagagaagaccaatcctatacattggtgtagggcttggttcaagcttggatctaactgtgattctgttgaaaataacatatgcgagtcattcaacaattggattatagaagcacgattcaaacctatcataaccatgctagaggacatacggatgaaggtgactcgaaggattcaagagaataagaccaacagtgagagatggaccatgggaatttgtcctaatattctcaaaaaaataaacaagataagacatgcaacccaattttgtcatgttttatggaatggttcttctggatttgaagtcagggaaaagaagtggaggttcactgttgatctctcagccaatacatgctcctgtagatattggcaaatatctggaattccttgccaacatgcatgtgctgcctacttcaagatggcagaggagccaaacaaccacgtaaatatgtgcttctctatcgatcaatacagaaatacatatcaagatgtcctccagccagttgagcatgagtccgtgtggcctttatcaactaatcctagaccattgcctccgagggttaaaaagatgcctggtagcccaaagagagcgaggagaaaagaccctacggaagctgctggatcgagcactaaatcatcgaagagaggtggttctgtgaaatgcgggttttgccatgagaagggccataactctagggggtgcaaaaagaaaatggtatcaatacaattacctttaaatattccttacttttcacttgatcacacaagatagtaacttttgttggtatcacaggaacactcatcctcacattacccatcacatccagatcaagctgcaccttctggagaagccaatgattcctcggttgctcatagaaggggaaagaccttgctctctcaaagccaaggaagtgccgtgcaattggcaattggagccacacgatctaggcaatccaggggaaaacaacctgctatttcatctaatagcaagacgactaaaaagggaaaaatgcctgaaggttatggattgtactatagtgaaaggaccggttccacatttcttcaggttagtaaagcgatcatgctaataattcaatctgcttgcattattcaattatagagatgtacactactttaatcgggtaaactaattttctttttgcagtctggacataaaaaaagattggtgtcttttccaagtcgagatcaatagctcaagcttcagctacctatggcgtggcgcatcagacgagcatcaacaagatgttggatggcaacagaattatttgttcttttttttaagacgagtccagggtacctgtgtgaacctttgcttaattatgtcatgcatgttggctataacttttatattgcaatttgagttgattgggtaaaatatagttgctacttttacctacttacacgattttgttatttctaggattttgataattccgtgcggtacagagttgaattgttctatatttgtttgcgtgcacgtttaactactcacaataaataaataacatatatcattagatacaatacatgcaaaagaagataaatggttcacacattataatcggggtttagatggagaaaacaaacagatagactgagagagtaatggtccggcctttttttcgttcctccatgttgtttcctttttttttcctttatttttttcttttctttctttttaatatggtaagggtagaatggtcatttcatttgtattgttgcatgcaagaatgacttggatgctcatgtggcattttttttgggtcgaaggactatgttaacccaaataattaatttgaaggacttgtttggacgttttgaaacctcaaggactaaactgagcccgaagcgaaacttcagtgaccatattagctattctcccttccttttgaaagtgactgtttaccatattatcactgtggattgtttatttaattaacgggataaattaaaatttaaagaaaatctaattcataaatagattacacatgtggtcaaacaaatgcattagaagaaagttgttttacaaaatgtattttcagaagcatgtagcaaataacccgtttcaaaaaatatggaaaacaaatctaacaagaaatggcctagttagtgccctactctctccacaatttgttatgacgaatttgaacaaacatctgtccagatttattctcataagttatttttttccgatatggagggtgtatatgcatactccgtaggtaaagagcaaatgaatcaataaatgacagtacattgctcgtactggtaccaggcaagtatatgtagctgcacctttccctctgcgtgtagccgtggatcaacaagtgacttttgttttggaatttgcaacacacatgagcccgcaaggctcttcgtaggtgattttttttttcttcagtaaatccacttttataacaactccacgtggcagaattttggagatttttagctaaatttttgggctgccacgtggtcctatgacaaggttaattcttaaccttttccggctggagggagtagcatatttattcagaatgattctggcccactggcccatgtatctttaagcagagcaatgaaatactctatatgcttatccagctgtaaaagataactgtgtgtgtgtatatatagccaagtattggtccttaaccgcaagtttttaatcaaatcatgaagcattgttggattggtggatcagaagaacatcttaaggtgggaaaaacaaggctaaagcactcaagtcaatccacttgttggtggtatgagaaatatggtgtgaacgaaataggagggtgttccaaaatcaagataagaccataccgcaactcctcaccaaaatacaagacaaaatcaagctatggagcatgtgtggggcaaaaaatattgcgagaatatccgcttagattttcatttcatttagtgtgtgtttcttttctatttttcttcatgtttctttttttctctctttcacctcccatggtgatattgtaaatactttctattctccttaatataactccagcttagcctggctacggtttcaaaaaaaaaatcctgctcatcaatatgctgaagtcattttacagattaatggtctgcgcctctagctacatagtgttgttgattgcgcttttgcatgaactgcacattttatattagctatttttctagatgatacattttcagagtccatggtatgttgtatagtataccttcatttaaatttgacgaaagcccttccttgaattacacacaacattacaagttaataagccacgcaaccacgcttaattaggctaactatttcttaccagaatacaaaacataacaatctctgtcaatcattcttacttagggcttgggctcttcagtttacttaggctcacacagattcatacttcctgtttgcagaaggccacacaattgatattgttagttactgcctccgtttcacaatgtaagtcattctagcatttctcacatttatattgatgctaatgaatctagacatatatatctatctagattcattaacataaatataaatgtgaaaaatgttagaatgacttacattgtgaaacggagaaagtaattatattactcatgtatagatgcatagaccgaccaggatggtcatcatgatacaacaaaataattctcatagctgaaattgcaacacatttccttagaaatttccgtggtgttttaatctgcaaattatattaatcacattttatctatttgctatagtaattggaatcatggtttgtaaatgtgatggatgattggatgcatagtagaaacaacttgttatttgttcgttctgggatctggaggactggggaggagctgaggagcttgtcggtggcaatacaacatctacagattggaaaaacatgtatatatattaagcttgtaattaagcatatgctaacaaactacaatagctcgatcacacatgatgatcagtcacaacttaatcaattgagtcaaatatggtgccatttattaatttccaagctgttagcaaattaaatgaagtggtggatgcatgcatgatgcatgtacataccagtttacataattatattggagaactcatacaggcgtcctcgactggagaagatgatcagtccgatctcagcatcgcagagtaaggcgagctcgtaggccttcttcagtagatcgttcctatgcttgccggatgtcacctgacggcttgtcatgctcttgattctccctatgtcgatcagtcgatctcccttcacaaacatatacacaaccgcaccctcctctattagcagttcattacagaagagcagcccgacgccgctgaagcttggaggagatattcatcagctcgcggcaacaggacgcctgacaacgacgctgtccgtcactgcggcagctggttcagtcgccaagcagtcccatgcgccattgtcaccacgcacatggcggtaaaccctggggattcatgctcgcgtgtgccgatctcgtccgtcgatagtggagggacggctgcggagagggtcgcgtgggaggagagggcctcgccgtcatcggagctagtcactgctgcccacctcctcccccctccccacgcgcagccatcgagcttattatcatccccatccagcgacgaggagggggcagcggcaggctggatctgcaccgcatctgcttaaggagccccgtcgccgtgctgccaccgagcttgatctaggagaggggacgtcgtcatcagatgtcgtcgctgccagtgacaacaaattttgaattcttgaggcgtggaagagaattcttctctctatattatcaggtagcattactaaagttgtgaaagcactgatggtctgatggatactcatccgggaagcactaccagcaatctgggcttcagatggaaggatatagatggacgcgtggcagaaatttggaggtgtctaacttaaatttttagggcgccacgtggcccaataggagacttgattcttgaccctataatcggttatagagatttgtaagatccttgtaagaagatataggaatccacaccacataagtagaatactatacctcggggtgacccgaacctatatagttttgtggtcgttcattctccattggtacgcgaggggcacaattattggtctcaagtgcacttggctccccgaccggactcacgaaaaggggacctagtcggatccccgtgatcgggagctctagcccacaacacataggcgtgtcatagatgttggaatagtcaagttcaaacatgtgaatatcacatttattttgtctattgcatattaaaatttataagatatttttggtttatatatccataacaaagcacgtgcatttttgaaaaaaatttcttactctattgtccaaaaagatagtcaagttcaaacatgtgaatatcacatttattttgtttattacttattaaaatttataagatatttttgtttatatatccataacagaacacatgcatttttgttagttctccaaagagaacacaaaggatataaaatattagttaaaacaaaacttttcttactcttattgtccaaaaagaacacaaggatataatactcccattctccaaaaggttgaagcaaatttttttcttactctattgtcaaaaagaacaataaaaagtacgaattacccccctgaactattgcggtcgaccgaattaccccctaaacccgaaaatcagacattgttcaccccgaactttcaataccggacgaattacccctctcaatccaatccggagcggttttatcctacgtggcgtacacgtggcaattcagtcagcattttcttttttaaaaagttgtgggacccatctgtcgtacatccccatcccctcttcctctctctctctctctctcacggggtgcgcagggggggaggtgggcggcggcccgagcggtggcggcgggcgcggctgggtggcgagcggcggcggcgacgccacctcctcaccatagccgctccaccccttcccttccccttcttcctccaggtccggcggtgacggcgcggaggagccgccgcgggggcgttgtcctccgtgtcgcagccggcgttcgtgcacaacgcgcgcgtggcggccgcggcggcgttcctgctcgacctcgggggcctcctggtgttcgtcgtgctgcattggccatgcttgtgcgtgctattgggggattgattggttttggtttggaacgattcgggcgccatgatccagaggaggattcagtgaacttccctcgcggttgttccgaccaannnnnnnnnnnnnnnnnnnnnnnncggtggatggttttcgtgtcatggggagttgcagcgaatggatgcgatgtagccacgcgtgattcttgcgaggtcgaagggcagagtgatggatttagtaaaagaagtgagagttttcctatctgattatctcgtcctccatatgttgtgctaattctggttaaagtgagtgccgacggttaaagttcttttcattcatactttagcaaagcacaccagtaatgcaaacagtcttagagtcttatgtgatgataccttcaatgcaaaagttattctgaagactgacaagccggcggcgagaggaggaagaaggggagaggccggcagctggccaaggcgagctcctcctcgtcgtcggtcgtcctccgtggcctcgtcgacggcgtcgtgggccagcggctccaccgtcatggactgggtgagccctgagacaccgtctcacgccgctgcccactgcccggcccgcgcgccgccgtctgccgctccctcgtctcgcgccgccgcctcacctcgcgcccccgcctgcccctccgcgccgcgaaggtgaggtcggagcggtcgcagccgcggtcgacggagaccaccaccttggcaccgaggtgcttcacgaggcggacggccacggcgttgccgagaagaagaacgccacgtcggcggcgatgagcgtggcctggtctctgcggccaccgcggctggcgtcgcgcatggcgacgagctcctgccggttcccctcctcgtttcgcgtcgtcgccgccgcacaccgccgtgcccgtgcgcgcctgcggccacgcgagagagagattgggaatagctgaataagtgaagagtaggtatgacatgtgggtcccactttttttttaatgaaaaatactgactggattgccacgcggatgcagcgtaggacaaaacagctctagattgagttgaggggggtaattcttctggtactaaaagtttagggtgatcaatatttggttttctagttcagagagataattcggtcgactacgatagttcaggggtatttcgtacttttttttcaaaagaacacagggataaaatactccaattctccaaaaagataaaacaaaaaaaattccgttgccgggactcgaacccgggtctctcgggtgagagccgagtatcctaaccagctagaccacaacggattctgatgggggagcactcattaattatttgtctgtgtatgacgttatcaggcgattacagaaacccgcagtgtataggatatagagggcgcgtgttacaaacaattaaacggcctgatcttgctatgattaagatgaagagcaaagattggctaatgcgaattattatcggagaaaaggtggctgagccgtgtttgttaatttgacggctcatctcgatctggggcggccgtgacactcggaatactgagacgggattgagagtttgagatcccctgataattttaggggttaataacaaacacaagtaaaatgtagatttatttacacacaagtagtataagatgtagtaatcggacggacgtggtagagggagacgagagagaaaatggaaggttcggaaacgggatcccgaggctgacatgtggggccacagttcccgtccgttctcgcccgcgtgaggtgtaagcagaaagacgatcaattcaattcgggtcggtttcgcctcgtctctctcattcagatcgtctctctctctgggggggcttcaaggagacgacgcgacggcggccagagagatgaacatcctcccatggcaatggcaagggcaagcgcaagcgccccgaacagccggcgccggaggaggaggcggaggcggaggcggagctcaactcgatcttgctccgcaagatggggtgcacaaatatgttgtcgccgtcgcagctctcgaaaataaagacgatgttgcagtcgaggcccgatatctgcaagaggaacagccacctcaagttctgctacagcctccgcaaccgcaatgtgttcgtctccaaaacccacaagccacggctaggccctctccagtacaagaaagggtaatctcatcccatctcatctcctccttttccttcgcaatttcatttcctcgcatacaaatgtgaaatactacaaatttgtatcagggggttgctataggattaagttgatgataggaatctggatcggggtccccttcctccaaacatgccctaatgttttttcttttactttgttcggccgatatagcattatccattttacaatcaaatatacactaaatgtttcactatgttcagtttaacatgatgttttttttttgaattagattggtgtaatgcaatcaagacttgattacctataaacatgtgaatggtcagcaaattgattaagctctctgcagtccacatcgatatgcatgcaatgcgcaaaatccagtttaggcattagttccattgaacatgatgtactcttcattattggaacacctgtaaacaagatgttgcatatttagagcattttgaaagatatttcgttgttcctgattataaatggcaacccaggagcatttttgttgtacaagtgttgttttagagctgttgcagttatcaacagcgtttgacaatctggttggtaatccaattgtctgtgcacttgttgactaacgtttgaactgtttttcatttcttaatatagttggtttgtagctcaaaaagaaaagaaaaactgaatcgctctgaatatagttttccttatggcagctatttatcaacaattaactgatgactatgctgtctttgctctacttccttgcaggaaggaacctgtgtatgatgggtcatggcagaccccaacatgtgcaaaggttgctctagaacactataacagatcaaatgaggtgtctgcttaaacacttttcatgtttattctctatattatttgtgccataggagtacccacttatgttggtgaatatgttggcaggatgaatatgagatggttaaagcactggacagtgtttcttccttcttcaatggtgtgtgggtgcatgtaaatttccttgctaaactcaaaggggccacccaatgtcctgaccttgttcccaagttctttgctgaagtgaaatccgattttgatggaaggtcatgtgtctcttgtgttaagattgacacaggtatgttaagttacaaaccacgagattgttgttgtattggtaacatttctatatgaatgatggtctacttctttctctttctactgctgcatatttcaagtttagtttggttcattgtaatcataggttctgttaagtcataggttgacccaaaaaataatttgataagtatgcatgcaacacttgtgaggttttactatgctaacaaaaaaatgcgaagcagataaggcttgttagtgaaaaataaaccatcgcatccacgttttgataaaagaaaacaagagatcattttcgctcgttgtttcatctctagtttgacagtattagtttttggactcaaatattattatcatattctgattggtgcaaatcattcacataaattaagttctaattctgacttatttcttgcaggtaatccagaggcaacaccaattcgcggttgtgggatttgccaaaataatgagatctaccatcctgctgttggagggcaccgaggagacaggaagagtgcatcataatgtacgaagggatgtaagcgggccgaccggataatctacttatatgttaaataagtggctaatccgcaggtttccgcatcatagcccgatttaccacacctagaaatgtaagtgggtcaattcataaacccatccataggttaaattagtaggtaatccgcgtgtcaatccgcggcctgagttacccactaattttgcctataaacggcttcacgggttagctcgcttgtatccctttaggctttaaccatagttcttttagacagaagacagctgcccagctttggattgcaagcataacagttggtacagagcttcttttttccccattaactacaagattacagattagggcgaactccgattgagttgtgtatatacagtgatcaatacaatactctgatgaagatgaacttcattaattcacaaacatcagaatttacagaaaataatcaattcaactctcttctcattaattacagatcgatcgagaagagaagcaatgcatatgcataacctgctgcaattcgatcggaaaaaaaatcactccgaatctttgatgaagatatttcattttagtcacaaaagggcgtgatatcacactttacagaaagaatcagttcaactcttctcattaattacaggtcaatcgatcgtatcttcacgcatctcagttgcaaggcacggatcaaacaaacacctaattgattgatccatgcatgtctaactaaacccgctcttcgatgaaaaacactacattactgagtgctagagccgctcactatggatcaatcaaactcatggcagttaggtttatccgggcactaaaaatttttctacaccggccgctgatttcagtacatttttggttccttctctgaaagtttagcatttttctctgatgatgaaacgtaactaccatgcgttgcatgaggcaaacaacgatgtttccaacagccggagctggagttgggacgtcgtcagtttcagaggggttcagagattgaaactccgaacaatctctatacaggaaaaatcatttttttaaaaatcttgttccttctctgaaattaatttcaggatttttctggttatgaagagtgaacataagtagcacgtgcgttgcatgtgaggcggcaaacatgtttgaagccggagctggagagtggagaccattcagttccagagagggttcggagattaaaactcccaacccctttgatccttcctttttcaggctatcttcttcttcttcaggtttaggacatagatcgtcccatttagatcggataacaaccatttagatatgcatgcaatgcacaaaatccagtttacacattcaaggtcagtggcagttagttccaggaacacgatgtatcatgtatgcatttttggaacacctgtaaacaagatgttgcataattagagcctcttgaaagatattccgttgctcctcattataaatggcaacccaagagcattttcttgtgcaagccatccactacatttacttctcaaagttctcactaatctatccaagtacaattgatacaattccatcaatactggaattcttttatccataatctcttacctactactatatgcatgtcagcatgtgtcttctgtttgcacccatgaatagcaatctttgatatactttcatcaaacattcatttttgcacaatataatatccatggggcaaagtatgacacaatcaagcaataaccgttgtctcagaagcagtggaagcaagaacaacatcagattcagaccaaccgtcccatatctcgggcaatgcttccttgatgttatgaatgctttcaagagcgtgatcagcacctggaaccagcgttggcctcccaacctgcagcaaattcgtaatattttattttaacacgattacacgaacaaagaaaggtaggagttttcaggttttgaactgtttatgcagtcttacaatcacagtgtgaaagcctgcagcttttcctgacgctatgtttcgaacgctgtcatcaaagaagatctgaaaatacaagttcaagaagtcagatttccgccgcttgatacggaagattttgggccatgtaacttaagaaaagattctcactgttttctcaggatcaacattcgcaatccgaatcgcagcttccatggcttcaatagagggtttgcagagaattggtgatttaggtctgaagccatcagattcatccaggtcatccaaatcagaagatagttcatcagagatagaacttaggggcttgtgtagaccatggcatgttggggttggtggattcagtgtctcgaagcatattatgccttcgaagcagtcctgtatacccaccctgcacagaacctcctctgcatgagctttatcagagtttgtgaatatctgcagcaagcaaatcaaagattataaaaaacctgccagcaaggatcttccaaaaggcaaaactatagggaagtatcatactatttttctctgtggaatagaaagtagaagggtcctcaaaacagggtcgaaatgcagattgtcatatggcagtgtaccatggacatttgcatgaaattcatcgttatcaaactcgtaacctaatgcctgcagtaacagttgcatgattagaaaagaataaaaaggcaaaaataatattggcaaaatcaagttttttttttctttatgcaaaatcagagaggtttaccttaagaccagccatcgtggtgccatattccttgtacagttccaggcacatatctgcaatttggctttcttcaattcgcagatggcgacgcatgtaatctggcagtcaaaattaccaaattgcagtctctcccaacatttgtgagaataaaagtgctttataaacaggaagatacggaacatgattagtattactacacaccttgtatatttttgcgacaagctagattgatgccagagctgaaggggtacagggtatcatccaaatctgaagatgccatagcaaacagattcattggactgtgcagttatattgaacaaacagtgtcctctggttttataaggaatggaattgtggaacataccaaacagcaagcactcatacttcgatccttcaactatagcctccattcttgatgatcaaagctgaaagggtgatttctaaatgaaatcacaccaatttgagagcctgaaattacatgaggaacttatagaatgacaatatgatctcaagagcaaaaattggaagggactctgcaacatgcctggtaaaacaagtaacacggatttcaagtacagaaccaatcaaactgaagctgccagacctgaacttcagcgattcacagtcatgttatattgtttccaggggcatataatcgtttttttttccccgagaaactcgggaggctgtggtaggaaatatatttacagggctgagcttttggcaggacactcttggctttgagtcctgacaaccccagcaaaatatttttgtggttagaatttggtgtgagcatgtgatatagacgatgtaaatcaaatccaccattgtttttactgagagggcatattctgacattagctaagtttaagtgtatttttaaagttcaatcaagtatcatcatctcacaactgttcaagatagaaccaataataggacacaacgtcctctgcaaaaacaaaaagggacaataataccaaaataaagccaaacaatggagagcacaacgagagagttgctcacctcaaaacagtgaaggcttgaaggctcctgatgaatggtgttgaagctagcactctacttatagcattccaactccccaaggctccacgtacagaagagatgcccactgcatttgaaggctgacatagacatgaagaacaggatatccagccaatttgttgcccgtcactgtagctgtacatcaaggcaaggatgcctcttaacaagagaacagatctagtgttcaactttgaaggctggcatatgctcccaactcccaagtaagatctgcatgccaggttcctacaaagtggcaggggaatatatggcaacaattgaaagaatcaaagaatacagagtacatcatctgttttgaataccgtggaattttgcgtagatgaagaatattggagcactttgaataccgtggaaatttgcgtagatgaagaatattggagcactttggtagcagttggatgtaccattcgtctattccaagtgctgttgtttatccagcaccctctgttgaagtcataaaggatgagaaagaataagaatataaaatggatatattgcgaatcagaattcagaagcttccaa

SEQ ID NO: 66445 - DNA, 6618 bp, Oryza sativa
cggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaagaaatccgattaattggatcggcagctagaacagttaataataaggcgagaaaaatcctcgccgcacgcggagagccgaatcgtgaaagaaaaatgcagcgagcacgtaactccatgggttggaaacgataacgaggtgaagaaacgcgtatactatcttctcaacgataacgagatgcaacgatagtcaagcatgtcaggatatcaggactggagctttgggcatgccgcttccgtagcggccaagcctaccagggtgtgtttagttctagggtgtaaaaattcaaaagtatacagacacacatttgaagtattaaacgtagactaaaaacaaaacaaattacagattccgcatgtaaactataatatcattattagccgattggtttctactggattatattgttatttattacgttatcatcagccgaatgtctctagatcattatttacttaagtatcagaatatatatatagccgattgctcaaaaccctatcgacataggctagtattggcatcgtctgaaagtactccatcatcttgtcagctgatcggctctttggtgatcaatatatttatctatcttgtcagttgcaagattaaactgactggcagatccacatctcatcaagttttagatctacactggagctaagcagatcttccagactgttgtgttcgtcgacttagttcgcgcaaacacagttccgacaccatcaaccgagcgcggatttttaatgaaaagatatccccaaaagaagagtctgttcactttgatgccaaaaaaaaccttaccaaaatttggcattgccaaaattttgacaggatttcttatatagttaccaaaatttggcagtaaactaaatgtagctacttttttagcaactttaccaaaatttggtaaggttgaaaatgacatcaaagtgaacaggcccgaagcaagctgtacggcccaatccagcccattgggaggagtagagtagcccagttatttttttcttgacctggcccggcccaaaattgatttgctgtcttctctctccaggtgttagttcatccatgatccatctgtcgttcgttacagccaagaaagaagggatcgaatatttgcttgagtcggcggcatgatgcattgcatgcgactttgagcgcgatatcgtcatgactcatgagttgatgtctgctgatcgatcgagacgccctgaaaccgtgctttccctgacggttcagaattggcttcaggttaacctcagatcggggagtttcatcattactcactgacgatattaattaattcttctagattagatgtggaaatagtagtaggagttattttaatataatgatctttcctctaaaaaaagaaatagtagtaggagtagatcatttccttgaaattttctcatgctagtaaattgacatttttcacaggctgctttagtaaggattctgtcacatcttatctgaatcagcactagtatttcgttactgcttccttcactgaatggttcatctgtcactaagaagaaaataaatcaacaatttgttcagaggtttgaaaaaaagataagcacttgaaagttacaccctctctgaatttaccctcttgtttctttccccttcatagaagatgagatcatctcttgcggggacttgttcttcacgctgtcactgttatgtaagatggggcttcttcctcacctcttgcataaaaatcaaggaactcatgtgatgatggccgttggccgacacaaaatggccacctgaagcataaccatatgaaagcagagatccaggctcataagccctttccctttacagggcattttcttcaggtgtgtgctagcttaacactaaggttatcacataccaaagtaggttcaatattctgcttttcattgtcattgatgagcacaactcacatcttttgcctatgcctcccccttttgccttcaccacattcagaattccttttgcatcttgtttcttcagagttcagacaccctttcattgcagatcagaatgattgattggttggttaattataccaacaaaccctcaaaattcttatcaggtatacatctgagacaaacaggatctgtattactcttcccagtttacctccaaagtgattcttatcctctctataaagacaagagagaatctcagattgtgctacttgctgtgcgtcttgctcaaactttcagaaagaaaaaaaaaaggagcttaccagatcagaatatcagatcatatgctcttctcgtttagattcaaagcagtgcatctggagtccacattgatcaggacccccaaaaaattaagcacagcaaagaatgtaactagaatagcaaggttttctgaaaggcaaataaagcaaagcaaacacttaagctgagcagcaactacaactgccaaacttgaggttgaggacgcctgcattctctatccacaaacaaaaagtcctaaagaatgtgctctccacgtctcccccttttgatcactcctactaccgatcaagaatccttctcacttgctactagctgaataatacgggatgctcctgctgggcaagcaggatcaccactgcaattgccaaggcagattggaaagctaaggatgccggccatgatgccgcagttgcagccatccccgcgccactgctggccttcaagctcgccagccacaccgcatcttcgagctgctcgtggctcggtctccgtgatccgttctttgaattcccactgcaaacataccaaattcatgaaacagttaatcaacctgaaactgatgatgagaatttgctgttgcaagttccttccatgcctactaggaaattgcaactttccagtcaaggccagcttaggtacaatgtgagtgaagtggggacgaatcaaaggagaaaaagattgctcctccttttcttagcctaactctatcacatcctcaatgaacctttactttccccaattcatgttccacatcgaaatccccaattttagcccaaaatctcaatgtgctgcaatcagtccactatacaattctatcatacacataaaaatctcatactggtaatcgaaatctcaatgcaatggattcgctgcgattgatttgaagtgtacaaacctggatggagtggatcgggggcagaaggtgatggtgtaatcggtgtggttgcaggtgaaggtggaggtggcgtcgtcgtaggcgtagctgtaggatttagggcacgccgacttgaagagctgcgagtactgggaagggtggcaggtgtccgggttgccgtaggcgccattgcagcagtactcaggtcggccgaacgcctcgcaggcgctgcggcaagcgcggccatcgtcggcgcggagctcggaggggcagcgctcgttgaggtcgacgaggcagccggtgtcggggcagtcgggggcggaggcctggacgagcatggggaggttgtagccgtcgacgaggctgacgtcgtagaagtccttgccgtcggcgccgttgagggtgaactcggcgagcgtggcgggcggggaggcgcccgcgccgcggcactccacctggccggagccgcagtcccccgtggcgcaggagcccttgccggagtcgtcgaattcgcagccggagcgcgcccagaagcggcccgaccaccccgacggcgcgtagagggagcgcgacccccccggcgagagcgcgaagccggtggtctccagcggcggcgtgccggagcccgacagcacccccggccacaccgtgtccgtgcaccggttggtgaaggtgaaggtgattgcgccgacgccgaccgagcctgcgcgcgcggaggaagaggaatcgaatcccccaaaccccaagaaagaatcaagtcaagctccaaatcgcgagctccagtagatagtaacccagcaatggaagtgactgaccttggaagaaggagaggaggagaacggcgagcgatgtcggggagccgagcagctgcatcagcatcagcagcatccgtgaatccatctcgaaaatcgaatcaagaacgactcacacggttgattgaatgattgagcttgggggatctggtgttcgacaagatttgctcgctcgctcgtttggattgcttaaatcgcggcggcggcggcgatggcgggggagtgggcacgatcgatgcccataaccccgaatccgcggacgcgcagctgagctgaggtcgcgcgttgcgtggtggagtggaagggggaggtggtgctcgtgctcgtgctcgtggccgtgtaaacctctgggcgatggcggctgctggctttataaccagaggaggccgttgcttgctccgcaaattcgcgatgcttttctttcttgcaatcaatcttgcgacttgcgtccgctttgtgtactttttgctcgaatcatctctcaatcagcacgcgagtcaaatgcagcgaccgcgagattagtactccattttacagtgaagaattctgaattggaatccatctggtagcgcactgctaaattggtactccatccgtctcaaaatataatattattcaactttaacataatctttgatgtgctactttaaccaccataattaagatttttaaataaaaagagttgcatattatagtttgttcaatgataaatctactaacatcaattttatatgattgatcatttttattttttttactattaataacaaaagttaaaaatatttgatttagcactactttaaaaatatttatattttgggaagtattgaatacttttatgaacgtaattctagcaccggtcgcctgcttaattccggcttcggtgagccagcagctcgcaaatgcacaccgaactcaaaattcgagccggttcgttttggtaggattcgatgaaatttccagtgatttgcgacggggttcatgttctgaccagtttgaattttgtgaacgttgaggtagtgggacaaaatttttgttgtttgttttgttggtaagcgagtggcttttgttctgtttttttgcttgtcacgttgtgggcacagtgtttggacggtttggatcggcccagcgacgtccatcagacctccgcttttgcggcacaaaacgataggagaaaggggagcatgcaacatgccgtccgaattttcagccccagagaaaccgaaagctcttaataattatcggatccattctgatcaccgatctatacctgacataagattttcttattcagtgaaaaccagcatgttgtcatgttgttccaaggttgatgctcccttttctcccaatgatttcatcaccgtaaacgttgaatggatcacacacgtcttgagtagatgagtggatgacacatttcttgagtatatgaatggatcacgttgaatggatcatatataaatttattataatttctttttaaaaacaagttttcagctttttaatagttaatctgttcgtttatatttttcatcattctattacattcatcacaaaatcattcatctattcatcgttccattctattaaaaaagagcatactcaatcaaactttattcagctcgatcacactgtacctgtgtatacaatacagtactgtgcgtgtaggctaactcatagttcttggcgaattcttcgcacgtaagcaaacaaacgactgatcacgcagcatgcactaccatgcttctggtgtgcaagtgctactctagtactactacactgagtggagtaatcaagagaatcattaggcactaagtcttttaaaaaagagggatattaggcacttgccaggttaccaccgctgcagcctgcagatcactctcagcttcaaccttttctgaattaccactactttttagtactacgtgataacctttctcattcttctttcctaaaaagaagaaaggaatgcagatcagatgaagagatcgctgatcagtagccttagtccacatcgaggactggtttagttcccaactttttcttcaaactttcaactttttcatcgcgtcaaaatttttctatacacatgaactttcaacttttccaacacatcgttccaatttcaatcaaacttttaattttggcgtgaactaaacacaccccgagttaaaatgttgcttttctgaaatctgaatccgaacaaacgaaactattgcaaattaattggttcagatttcagactgttactagtactccagcctagtttagtttccaattttttcttcaaacttttaacttttctatcacattaaaactttcttatacacaaacttttaacttttccgtcatatcgttctaatttcaatcaatcttttaattttggcggtgagcgtgagacaggccagctccatggcgaagtcaagctgtgaaacgcaagcaggagctgtctgtttcagccgacgtgcaatctgacacgctgaagaatcagcatcgatgtgacggccggccatggcctgagggccatct

SEQ ID NO: 66446 - DNA, 769 bp, Oryza sativa
atggcgccattgctacgggacaccgacaccttcaagttgccattgccgccgggcatgtcggcccctcgcgcgacgccgttgccgaacgcgtccctgagagcgaccgacacggacgccttcgatccggcgacgcacgcgccggagtaggtccaggaggccagcgacgccgacgggtgcacgccggcggcggcgaccgcgaactcgagcgtcgactcggcgacgccgaaccgctcctcgccgacgagcacgacgaagtcgccggcgcgcagcggcacgaacgtgatgttccaggcggccggctcgccggcgtggtgcgccgcgacgtcggcgatgtaggtgctgttgccccgcctgccgttcaccgtcgccgtgaacgacagcgaccgccgcgcctcgtccccgggcgggaggtcgagcggcgtgatcttgatcaccgcggtgtcgccggcgacgaacgacgacctgtagtcgagccaactgaacgcgaacgacggcggcatcggctgctgcgcccgcgccatcgacgcgcgccgtgctgctgcgacgacgcagaggaggagaagccagagaggaggcaaggacgagcgcggcgagcccatggcggccggcgttcttggccggtgtggaaggacgtggagggctgcagggtggatgaactccgacgacggtgttactgatcgcaagtttctgcaactacatccccttacaaagaagttttggcaactgcaaggcggcaatcggcctgcaagtttttgcaagggctgcagga

SEQ ID NO: 66447 - DNA, 8236 bp, Oryza sativa
cacaaacctttaacttttccgtcatatcgttctaatttcaatcaatcttttaattttggcggtgagcgtgagacaggccagctccatggcgaagtcaagctgtgaaacgcaagcaggagctgtctgtttcagccgacgtgcaatctgacacgctgaagaatcagcatcgatgtgacggccggccatggcctgagggccatctcatattagtagctgcccggttgatcgatcgaccagcctgtaattgatgcaaatgctgttctgtaattgatgcgtactatgctgttgtgctctgcttcagtttccttgtggttatacgtcactgttgagttcggctaatcctcatcgatctgaaagctactgctactgatcatctatctgaatctgatcgagataatttagctctctactcagctagaatatccatctctaaccatccaaccctgacaaaccatggcatctgcctacactgcttttcttgctcatctgataatctttcatgcttattagtagctcaaaagaaagcaaaagatctgtctttttcttttctttttcattcgcaaagcctggctgctaattaacaggtgacatctgctgctgatagctttcagtaaagggaagcccacgtttcatttggctgcatcattagcgtacgactcatagccataggcatcatagctgtagaatccctgtaagatctgaacaggagacagggaaccgatagatcagaatctgaacatggattcctgtggattcagaagaatcttgatccatgataagataggaccatgcaagttgcaacgaggataagatacgccttctgatcttcagatcccgttcatctttcgtcaagttcggtggtcacaggctaggctagtgaatcttgtcaaaatctttacagagatcatatcatctcagcttttttctgcatgagatttagagtctgaagctcaactgatgccagaactgatcgaccacctgtagtcaatcacccttacagaatactcctagctagaagtaatacagtagatgaattaccaagttttgcgagttttcatcttgtcacgttcttgcaatcacggaaagaggggaaaacctttcaaattcaaaccaccaaactcaaaacgaatgcattttaactgggttgattcaaatcacccagcaacgacatgttgggcgtgggcctcatgtttttgggccggttcgtagcaagtaggtgaaattgcatttgaactgggccgattgctaagttaatcttccttatcatgggcctgaaaccgactgctatttggcccacaagtactatgggccggcccacccactcgcctccttcctccatacgcttccatccaatcggatttcagcaactccactctactccgtcgccgccttctcgcgacgcctcctcctctactccggcgacggcgaggcggcaatgcatccgcctcctccgacgccgcgttcctcggttagctccttcaccggattccttatcccacgccctctattctgcggtcctaggtttcgtagttcctcggttagtcggctgctgttcgatcgtgaggaatcgctgtggcgcgggagggaggaaccgccgccggacttctgttcgccgacgaagcatgtgttttccgttcgccgtaatcctccctcccatcaccggcagtagccagctcgggtgtaaattatttttgtttttgaattttttgattggtcactgactcaagcgcaaacttgctttgcagcttaacttaattgtcgattagttcaacatgttttttgtagattggattggtatttcaggggatatactgttaaccatctgccagtttagttaattgtagggtataatcggctgatgccttttatttttaacaacagattcacagttgtactagtattaattgggttctgagtgtattctatcagttggttttacaggttcaggttggtgaatggggaattcgcacagctgtagtgttgttgcttgagcacttctcagaaaaagcatcccaacaaagcttcgagccgattacaagacagtgggcaccaaggttgcctattgctttatgatcagcaatgcagagaatgtgctcaagctaagatgaactttctgaaccttgcaggtttcatctcactttatgcgttgtgtaatatgtaattgttgcatgacactcttgctctttgccttactaaattcacctggccgtgtacatcctaagcagaagagaatgctggacgaaccattgatcagtccataattacccatgaatgctataggcagagcaaagtaactcgtgttggtgctgtgtcaatggtctgtctggtaagttgcctatcacacaaattgattctcatttatcaacaatgcaaattctacatgtcctcttagttgtgaaatacaaattctagcatttgttcgcatcatgtctatttcctagtacgatccttgcatatatcaatgtctgtgtacagtttttgtgctaatgttgctgaaataaacatgattttgttcatgtagaattttattgctagttctatgtgcaatccttttgggtgttcacgaaaattgctttacattagtgtcccttgaatatagtgttgtactatatgtcataccactcggttctcacccagtaaactggtatatagatatttgctgagagatacaatgcattggccaatcatatgaattgcgcaaattagtcaaataaaataattggcattaaccaacctgctataaaccgtctttgcttggattggagcaaactaaagtattctggaggcaagatcttgataacttctcctgaagtctaggacagacaggattgcattaggaaccaaacattggagttatttacacactggcacatgtagaccaggtttggtgcctcaatttaaattgacattgcagattgcatcagttcctgacagtgactagtgactacatggtctgtacatgcagctagtactactttgatagactagaggcgtcaaatgggccaatttgctgttgcggacattgtatcggtatcttacttggatactccctccgtcccaaaataaatgcagttttacactatttatgttcaacgtttgaccgttcgtcttatttaaaaattgtttatgattagtatttttattgctattagatgataaaacatgaatagtactttatgtgtgactaaatatttttaaatttttcataaatttttcaaataagacagatggtcaaacgttgggcacggatatccacggctgcacttattttgggacggaggtagtacaaggtaagatgataactacatgtcacagtgtcactgccaggttaaaatgatgtgttagaagaaatgtcaaaccaagatagtggcaagtttattccatcttagaaatcaataaggagggttagtaatctatatttcaagtactccgtgatgggcctcatacaagcaagaaagttcaagtagtttccttaggggaagaattcggtcagaatgatgattgacaatataatattctaggtctctgggatttttttttttgttgagaactattcaataaggatgactagcaatagaatgctgtgtgataaaattgaattctagatggacatcctgcaagcaatgaagcaagaaagttccaactttccaagtgtttaactacaggacatatgatccaaaagagctgaacatatacaaagttaacttgtcaagcacaacaaaaataaaacgcaggcatcaaatttgagaatcttccagtaaatgattgaactttttaatatacatcaagtatcagggtgaaatgagagtacaagatgctaaactccaaaggccaaagctatacatgcaaaccagtcatcattagtcaccaccaagggatacatacgtcaacaaggaacaccaacccccctacaaaaaccatttgatgcccgggacaaaatcaatctcttccaaccaaacatggaatccaactgattgcatcaacaattcaattcaagtcaaccaaaaaacacctgaatatatatacagtagtcagctggttgatgcaacgaagacgacgacgaagaagaagaagccggtccatcatcttggtagtatcatcctacatgtgcctctttctgcatcaaaaccgtgcatctcagtagtaaccttttgcccctctggattggtagagctccattctaatcttggcctccagcaacaagttctcgatcaatggatcttgcaccatggccgcttgctttgatgcccactcgagcaaggtgaggatctccgcttgcgcgagctcctcgttgtcggggacgttgtgcgcaatgtagcacacgaggaggagcgcggcgatctggacggcctgctcggcgaagtagacgagctggacgaggtgcttggcgccgccatggtggatgatcgccttggagtggtcgacatggaggtagttctccgtgcaggcgaacttggtgagcgcggcggccgcctcccggctgacgtcggcttccctctcgtcgaggaggttcaccaatggcccgatgatccgggtctcggtcgcccggaaggttctggaaaaggcagccgagcgaaatgatgcatgggatgaggagctcgtcgtagtcggccttgtggacgacgcggaggagctggtcgacgacggcgcgggcggcgggggatgtcggcttgaatgccgatcgccggaggtcggcgtttctgctcggcgaccaggcagatctccatgagcgccatggccgagttgtaccgcacgtcgtcgacgcctttctcgaggaggacggagaggcagagcagcgccctggactcggtgatgttcttgcacacggccgcgttgcccatggcgagctgccacagcgccttggcggcgttggccttgaggtaggctttcgttccgggtcctcgaactcccgcgccttggtgctcgtcccggacagcgacgcgttgtgctgcttcgtcccggcgacggtgccgccgacgctgacgctgctgctcgaggtcgtcccggttcctgctgatcctgcgcctgcgccgctcgagctggcggcgccgcctccggtgggcttggccgccatggcggtggtggtggtggtggtggcggcggcgtggtcgacggcgtctagcgcgtcgtggtggtgcgaggaggaggtggagccgttgttcttcttgtccatgaggacggtgtgtatggacatcttggaggcgacggcgtacttggagtgctcctggacggtctcgaaggcgaggtgggagacgaggaggcggatgacgttgctctggaggaaggcgtcctggcatttggggtggttggtggcgagctcggagacggcccagtgcgaccattccctatgcactcttcatggtgtgcgatcctgtgaggtatcttggtcgataggcggtcgcatgactgccgtgcgaggcaccatcgagtctcgtacgactactctgggagctcgtcggcgctgaggggtaggcctgtatggcgtaggggcaggcggtctcctggccctcggaggagccctccttgatgaggcggagcagcggggggacgccgtcctcctcgatgatgagcctgccgtagcggtcgttgtcgcgggcgagggagacgatgctggcggcggcgtcggcgcgcgcctccgggttgccggtgtagaggacggcgatctgctcccagatgaggaagaggatgggctcgttctgggcgatgggggggagtccgatgtggtcgtcgtcgaggtcgtcggcgttggagtagttggagacgcggaggatccaggagaggtcgccgagggagttgtcgagctggttggaggtcttcttgaaggagcccgcggggatgatggtgaagacgcggcggatgaggccgtggccgcggcagcggtcgaggagggcggcggccttgtcgagggccttgccggtgtcgtcgaggatgcggcgggcggggcgctcgtagaggtcggcgcgggcggcctggcggaggagggaggcgaggcgctccaccttggccttgaggtcgaggcactcctgccggcacgtctgcgcctcctccgcccacttgatcacctgctccgccaactggatcggccgcgccaagatcgccttcaggtcgtccatctatgatgatccccgccgacgatcagcaatggcggcgagacaggaggaggaggagcacctcctcggcttgggggggattccggccgtgctcctccggcggcggcggcggagaaaccggcgggcggtgggggtgggatcgctaattgggggaaggggagcggcatgtgcatgtgaggcgagcgccgcgcgagatgtggatgccctgccatggattgccgccttcggatggaaagggaagacgagaggtttccacgcttttcggggtttgtatttccgatgccgttggatcccccacctcctcactatctcctacctccgctcttctaattactagcattttagagtatattcccattggtagttatactagaaattaaggattttttttcctgaattttagatatagattgtaccaaggttttttttagcatgttttttataaaagccaatcattggttttagtaagaaaacgtttttaaaaatgttgttgtaaaaatactaccaccgtttcaggttataagactttctagcattattcatattcatatatatgttaatgaatctaggtatataataatttataacctgaaacggaggaagtatcaaatagatttattttttttaaattataataattaaaactcaacaaattatgtgttaatggttttctcattttacgtgatcttacttgatacagtctccatctcttgcgaaccgggcttattgaaacggattattttctccatgcttcagaaaaaatatgtttttcctttagaactttttacttgtttcttaaaatatttaatttttcctataataaagtagataatcgtcttgataatctaaataaaatggctccgagtaattttacatgtagttagatttccagacactatacctcatagatacgagcacgactcttaacttttggtttcatggatacaattggatttgatgttacaaataattcatacaatcgtattttctatacaatagatttttaaagtttacttacatcttgtatacaattgtgagctttatatccatggaaacatgtattccttcatctacaattgtgtaaatcattttttgcctttcaaatttgataatttctagatcctcaagagcgaacaatgacattcattttcgataacagatccaacaaatgcttgctacaattgctctttcatttgttgtctttctcgtaggttagtagccaaggcatgtctaacgtgagatatcatgtcctactcttttctcctatttaattaactctatgcaaatcaatagaaacctatcctacatctacatggcagcaaaataactatacataaacactatcctatccgtgtgacatcgaagcaaagtggatcccgcttttctccaccatactgtatacggtgtaattttcataagaactttctgcacgtgaattttctataaaactattttcataaacaattaacaatgtgatttcatttggccaccgccatcgacacggattgagacggctccctcctcttcttgttcgacttcgaccactgctatcggtgtagatctgggtgactccctcctcgtccgctgcccatgtcggcggtggcatcttcccgatgatggcctccaagttcctctattctgatctctccaaattgtcatcctttcttccaacttgttggactacacgaattggtttctctctcctagagccaccgcttcttctgcaagctcttctgacacactgcaaaaccactcctcccctccatgatggcatccaaaccttacgtggaggctgagaccccacgttggacatggcctaacaagtcgttctcgtccacaggaaaacgcccatggatgtatcaatgcatcatgcacgatcactctctttaaaccttgtgatccaaaaaggagaaaaaaagatcgtgtcatgttgacttgaatcacacccaagtactgtatattgaaactacaagttggcgttctatctgagttgccgcagaagggaacagaaatacagaatcactgaagaagatagaaatacagaatcaccgaatataattatacagtagattggttcatgtcaaccaatctactactccatccgtctcacaatataagggattttg

SEQ ID NO: 66448 - DNA, 24403 bp, Oryza sativa
tcctcctcctcctcctcctccctgatccgatccgcctacccaacccaacgaatcagcgtaccccgacgaactcacctcctccctcctccgagcaccaccgccgccgatctaccaatccattcccgcgctgctcgatcgcgcggcggccgctgtaaattcgttgcttcgcgtcggcttcgcctcggcgcgcggggggtagcagctgccaaggtgaagcgaggaagaagaagaagaaggcatcggcatcttcccctctctctccacttttttttttccttttttattatttttggattattattattattattattattattattattattattattattttgggttgctcgacgtgtagtagtggtagactggtttgggttgggttgcttgcgcggtctccggtttggggggatcggatgatgatggggagcgtgggtgacgtggcaggtttggatcgtgcggctgggattgatccgcaggcccgtggtccagactagaggcttccgagtggatggatggataactcagttttttggatggtttgacactaatccccacttctagattaacctagctctgtatggacgtgttcggcaaattgtgggtttataataaaaaaataaaaggtcattttagtttagtgtcaattctcatcgtaggagtaccgactattttttttaaagcaactcaatgtgtagttttggataatactttttttttttaggctgggaatccttcccctcagcgcttaaaatggatttacagtctcacagattaacataaattattaagtattgattaaaaaactttaaaatagactaatataaatttttaaaataactttcctacgttttttttaaaaagacaccgtttagcagttccgttcggaaaacatacgtagcaaaaatgagagaataaaagtattaaaaaaggaaagaaaaagcacattcttaggcagtcatttggattggaacaaacttttaccaaatctatagagctgagatacatctgttcaaataaaaatttggcaacattaaaagttgaaatattacacctaataaaagatgttttaatcttaggcatccttacatctcacaccttttattctaaccctccactagtttgtattttctaatcttatcctttatagccctaaatgcccctattttgattagaaaatcatcgctctatcggcaaaagtttcttctaataacttagcatacattcataatattcaaagttgaaagcgacaagttaaaaatgagctatgtatatcatcaacccgattctctttgttttccctctcacaacatatatagggattttttttttcttctcaatacatccttacattcttcccctctattaagaacttaaaaatgacaacgaaaagtaggatcctcgtcatgccggcattagagagaaaatgtgcgattatccctgaccttctactacgttcttctccatcatgacaatgtgcgagtatagtggaagcttaatgtcactttacattccgatacaagataatcactagggtaacaaaaattcagctggtttcaaaaatcaagattcttcgtgtaccatgtgtgttcaacaaatgaacaacttttacacgtctagaaaaaggaaaaccttatatataatgatctaacacctcattggtttatatatgcatttctctctcagctctagataacttaatttttactcaatgctataaaatcatagtagttttaccaagaattttacgctattccttcaaagatcaaatcttcataaactatcatttggaatttctaggtttgaccaagacagctagacctactaacgttggtcttcatctactccaaactctgttcacgtttcaactttttatttatttgtaacaaaatagaagccttcagtttttttttctcctttaattttcggtaaaagtggttgcctcctggcgatgatgagttgtattagccggcaagtatagccatgaaggttttgtttgactttcaacggcagatttggaaccatgcagacacccacattcattggccgagaagcgtataagcactggggccggctctcctgttgcttaatttgtcgtttaattaattacactattttagtgaccgagtcgccatcgtcttaacggactgagcgtctcaagctacagtaaaagaatttacttagctgcatccaggtcaagcagggcggaggtaggaagttatcaagagtaggaccatgtagatgtagtttcattcattgtgtttaaatttcgggtttgtttggtttggaaccaatttttactctaccaaaatcttggtagtgctaaaatattagcaaatattggcactaccaaattaggtagtgttgaatttgaactattgtggataaaatttggtagcaaatcaaatatgcacttgctactattgaagttaccaaaattttggtagggcaataagttggtatcaaagcaaacaatcccttcatctaaattttagtgtttttccattgattattttttgttacatatggggcccaagactaaggccctgtttgattcagcttaggattattataatctagattattatgagtaagctgaaataaacagatagcttattatgatagattattacaatctatacgccagattattataactagctgggtggcccgcgcaattgcgcggctagcacccaaacaaattcatataatttttagtatgattttacttaaaatttattaaatagctatctcattatcttaagactttgaaagaccaaaccttatcatcctcgtgtttgtacatatagtttttaaaagtcacaccagttgctacctcttatgtcatctccttttttatttgcttgctcgatctaccactattttaattcattcttcttgaaacctttaaaaattggattttataatttttagagtttattgtcacgttgggttttgcttttataatttccatatatcacgttaaacgttgctattatactgctctacggtccatccactgtttcttctctttattgtcatgagatattaaaaatcgaacataattatcgtttgggttcatttttactttctagaagtcccgccaaaccgtcagcggctttgcgattgtactcctctacggctcacgcgctgcctcccttctttattgtcattgagattttaaaatcaaacatgattatcattggggtttttttttacttttttgaagttccaaaccttttaaaattggacttgtaattttattttttataatttttagaagtcccatcaaacggtaccactatgcccctctacagctcgtccgctgcctactctttattgcactgtgattctaaaaatcgaacataactatcgttggaatccattttttattttctagaagtcccatcaaccgtcggcggctctgcaactatactcttatacaccccgcctgctgcttctcctttttattgtcattgagattttaaaaatcaaatatgattatcaatgaggtttattttttttactttctagaagtcccggcaaccgccttacttgtttgcttcacggcctgcctgacgtccctccttttaatcgtcattaggattctatttagtgttttattaacagtttttatatgtcgtaacaaccgccaccactatactcctttataggcatgttacttaatttatctcgtcatgtgttttagatggtcatttcttttaatagtctttatttttatcacaaatttagttatttataaattgtatttctaattgaaatcttatttttctttttctaattttagaatttatttttttaaaaaaattagttaacatcgtattgtgttcttttagtgtttttattttttattttcaatttcagttgtttcaaaattgtattcctacttgatctctcttttaatttttataattttggatattattttattttttattcaaaattttaattaatctcgtattgggttttttatatggattcttctttcaatattgcttatttttaattccgaatttcagataatgttaaattgtattcctacttgaactcttcttttattttcttttgcttatttcggatttatttttatttttattctgaattttaattaatcttatttttaattctgaatttcagctatttttaaattgtattcctacttgactctcatttccttttttaattttggattttattttatttttatttcgaattttgattaatctcgtattagattcttgtattagattcttatatggaaacttctttcattatttcttatttttaattccgaatttcagctatttttaaattgtatttctacttggactctcctttccttttgtaattttggattttatttaatttttatttcgaattttgattaatctcgtattgggttcttatatggaaacttctttcaatattgcttatttttaattccgaatttcaactattttttaaattggattcctacttggactctcctttttctttttctttccttttctaattttggattttattttatttttatttcgaattttgattattttcgtattggattcttatatggaaacttatttcattattgcttatttttaattctgaatttcagctatttttaaattgtatttctacttggactctcctttccttttctaattttggattttattttatttttatttcaaaatttgattaatctcgtattgggttcttatatggaaacttctttcaatattgcttatttttaattctgaatttcagctatttttaaattggattcctacttggactctcatttttcttttttttctttttcttcgattaatgtgagaatttctagcccccacagcgaacgtgacgccacctttcaaagctgttttaataatataatagatctggtaatccactctaaatgtgctttttttaattattagatagctaacatctaacaaacagctaataatctagagaaacaaacaactaacagcttattctatatcaacttattataatccagcttatagtaatttggctcaataatctagattacaataatctcaaactaaaacaaacagggcctaagctgccccacaagtagctccgtccctgagcgcttgttgcatgctatgcaagcatgtatgtaaactcagtggcggagtcaggaaatttactatatgggatcaattattattattttagtatggtcatttatgtaaatttgaatggatttataggaaaaattaagattcaaagggcaatagtgaaaaagttgtggggttagccgacctcacaacttacacatagatctgccattctcagcgtaaacccggtttgtgccatcaagcaaaacaagtaccggttcgatggaaaatgtatgtcatcgctattattattggatcgccagtattgacgtaataggctattttaagtaaaacaaatttgtatttaaaaatgactggctagcatatatgagagcatagtataaccagtaagtttttttttcctggaaatatcttggggagtgaaagggagctagtggcatcgtggctcatgcatggctgtctacacatgtgagatggtagatggtactatctcctagttgagcattaatctataattatcgattgattaatcaaacgtgtgcttatgtgtgtgcacaactgcacatgctgatcgatgcaagttgacttatgcacacgggttcgtgtatgtgtatccatagctagccgacctattttgtcttgaagcaaagaattatacacaagtggctcgacctgttgacttatagtattaaaaaagggtacttttactttgcaacaaaataaagcacttgaattgtttatcgaacaaagagaagaaggagatacatgatggggtcaatggttagtgttatccaaatccgcttgcatcccaagggagagacggcagagcaaaatatctagagaagttttaacatctagacatatatatgtttagattcattaacatctatataaatgtgggcaatgttagaaagtcttataatgtaaaatggatgaagtatttcatatgtgtggttggtgtagacggagaaaaaagctattattttggaatttgtacaattatctaggcgatttcttaactcatccttttggcgtatgtgaaatgagaaattaaataccgaccattataagcttggaaaataaatttatttaattatttttatacaacttctatatagaatgcttttaaaagagtatcattttaacagtttaaaaacatgctaaaaaagagaaagttgaagtttgaaatcaaagaaaataagtaaataacatagcctaaacattctacaatttgatccttttaaaaatttatattacaaacagaccttccgcaaaatttgttctcccgttctctctctctttttttccacctttcggtgttatcatcgaatgggcctccggtgtaggcccatcatttcatcatgggcctcattcctgccagcccattcgtcagcccaagccgtcgagcggcggcgcgtctccgccgcgagcggcgccggcgagcggcatctcctccccacgccgcctcgccgtcggcgacgacgtccccagcgccaaggtcagccaccggcgccgccgccgcgcccccggtccctcctcccctttctctctggcttctctcatgtcccccctctatgccctccaccgcgggctgctccgccgcttcgcggcgcgcggccgtcgcgctcatccgcatcgagaagcggtgagctacaacccttgccgcattgcgatgttgtgacacgggcgagtcatggccgtcgccgccgccgccgccttgtcgtgccatacgccatcgcaacgcgccgccgcgcagcatagcagggcacgcccgtttggttccctctcaaatgggttcatctcgagcgatcggatgaatcggaatcgtcgaggcgctggaaggttcggttcggtcggttgatgatcgatttccctgtggtacgtacgattcaggaatcccatgcctgtattttttttctctttgcaaaaattccgtttcatcttccgctgcttaattctgcttgtgatgcgtacgaatcaggaatccacaggttctcttcagtgccaactagtattagttggtcccaatcttccagaatcaccatttctgcttggatgtttctaagcatgatggtattagtgaggtttgctcaatcaaactctatcgtgcacctgttcttctattttgacgaatcaccaacgattattttgtaataatcaggtgtcgtcctgctatgaagattccggtgccggaaatagaggagatgtatctgaaggagcacctgggtgttgatttagtgtatcattactttttttctttgacaaagaaagaatctatcatcactgatgatgatgtgaagaattgctagcacattgcttgactcgctcagcaatactttctggatcggtgagtccttatccttccctttttttttgctgcttctttatgttagcttccctgcatattgatctagattggttctgaaagatattacacgtggtaatacaggagttcttattcacattctggacagttaatccttatccaacatctctatcaaaaccatgtaactcttggtcactggctgggtaggacaaacacaaaaaaacaataagtaaatcttttcaggatgattagcctgacttttatgatgtgcaagagaagttgtacggacagtggccagcaatttcatagttaaatgaaaaatgaatagtttggtatgatataggtatgactttacgtatgccagcacatgaatggcattgatttcttctttctttattgttttatgttgatgaagagtcaaggtacaaaagtaaggaaatgtgaaaagagacatgcaaagaaatcacattaactgtgcttattctacagtatcctcatttaccaactaaatgcatgtgaactgtgaagtatcctacactatactcattttcttcctgctgacatctggtggaaagatttttctttttattttttttacattcatcaaccttgggctgcattcacttgcagttatttattgatgatgcatttttcctctcgatctctattccttaggaggttacatgaagtcaagtgcctgggctatagcagattcaattataaaaagaaaaacttgattaggtatctagtaatagaaattgagtaatgcccggcgaaaaagaaattgagtaatcgtgatagatatatatgcctgaaatgcatgcttgacggataaattgggttgtatatgaagtagtgtgtgtggtctacatgcactgatgcggatatttcagcatgggatcttgccaacaagattgttgaacagaaaattatttgcatttgaaagctttcactacatgacattatttttgtgtgaacccttttaattggctccgtgttcataactgtctcttttgtttcagcaatcctgtccatattcaaggtcaaaacaagaatgattctaccttaacatgggaaagctcgtgctacttgacaatgtcataatgaatcgcagtcaatctctgatattcgtatctgaagtctcctgcttgtgtccatttaccatgaaaccatcctggatgaagcccaatgaattgtggctgagaacagttgcctgattccagtcattttcatgtgccctcagttcactggcacttgatctgggaagaaaggtacacatttgttcctattgtattgctgttgacttgtcactatacacttagttctgcagttcctttattgtgtaatatcctggcattatttgtgatgtatgactctgcaatgtttggtaggcaacctgtttgagaggaactgcccatcttgaggtaaaccctccaggccttgtcgacaatggattcgagtcagcagtgctttatatatgcaggtaatttgttaagaaaactcatatcaatcaatatgtcactttcatctgtagactacccagacttagatatgtctatgcagaagtttctcatggcattccatacttcctaagttcctagtcccgattccaacttcagtttgcattgccaattgcccaattagcgtatggaaatcttttcatgcttttttgtttggatgtcaagtctgattgattagtctaaccaaatactgaaatactattctttattgcatcagctcgcatgatggttatttatctctgaattttccatctttcaagtttcaaacatggtcagtagtccaacatagcggcatacatatatattttttctttcgcaaataagcagacatgctgcttagcagggagcagatctggtgcagttgtgcgtagtccttaacgtcaaatctttttcacttccattgaacggaagtgcctgtcacatgtccttagacaattctttgctcctttagtacctttccaaccagattaatcctcaaggtgcatgacttccaagtactttcaaagtacgataggggatcgatggatacttcggtggttcttagtccctcgttctgttctctgactggaatattatgcatccatggtccatatggatctatatctggtccctcatctagattctttctgggtagttttccaacaaaattcaatgatcataacatcaatgaaaatccacaggaactcatcaggcatgtcgggtttgacagcaatgcgaaaggatcctgtctatgattggtgtctggtgaccatcagcagcggctggtccgggaaaacggatgccacagaaggatatagcggctcaaattgcgacctgtccaccccaccaacacaaaggtatatttggtttttgacctaagttcgctacacccaatcttagccatgccatttcatgccacaatttatcaggaaagcgtttgattaatttgattaatttctgcgacaatagcaacccatctttgttagtgttttggcccacttgttaagttgttattctaaccagactgtcaacaacaaaatgtcacggtttgtatgccgcggcacaccttaactaattttgttgtagtaaagttacttatcaaataaatccttaaccatataatataactttttaaagatgaggcgttccacaatttttatggctaacaaattattttccatgaggaaactgggtctacgataagagaggtactaaatataatgttttgtggtgtgtgaaattttagcagtaaactagttggttagtcttgccaaagatgtatcgaagtgtggccaccaatcgaaaacccttagtagccacaagccggcaatcctgaacttccactgttggaggatttccaattagaaaaagggcggtcaaatgttacagttgaccaacaagtgaaacattaagttatatatgaaaaaaaaaatcagcaactgaagcatttaaaaattttgtgaaacacggtgaagatacacattgaaacatgttgctatcacatataaaacaacgagtgttaacggattgaaaatatatgttttttttcatcaaaatataatcatgtgatatcttattataaagatttaattacaacgaatacaatggtgcgatcggattgtagattggataactaggtaggagaaaaatcattttgaagatcgctaaaatgcatacatacatgcatagagtggagagagagtagtgacaagtagtcccgtgaattttgtgaaacacaccacatattgaaacatatcactatcacgtatgagacattgagttttaatggtttaaaagacatggttatattttattataatataatcgtatgatatcatgttgtaaagatttatttacaacgaatacaatggtgtgatcggatcgtaaatcggataagtaatttaggagaaaaaaatatttaaagagagaagaaaggaagaataagaagaaattaactagttaggagtatgcatgtgagagtgtagggtgctcgagtctgggcaatctctcatgcatatgcaaacaattctctatgtatagaagggggaataagatgaaatttgttgctagggtcttagtggacaacgcaattggtgttcggatctcattgtatcccaccattagagtttgaccagtccccaaaattattattcgaacaaacatatagtaaatccgtagaaaaaattgccagtttaaaatatatgcatctgtaaggccgtttacacacaaagttccatctcttcctctctagaacgcagttcaaccatgttgtaacaccgggctagctttgtcacaagtcacaaccctgttgaactacatcaagaattcaaaaagaatgcaaaattgcagcaatatctgctcccataccatccgcccatccccaattagatcctaatcgaatggttatatttctcctccattttacctcaaaagcttaaaaagaaaatctaagctgtgtttggatccgaatcccagaaatttcccagagacgaaaacccctcatcctccaaacacccgcttcaaaattccaaaaaaaaaaaagagaaaatgatcttgatttgaaactgatctacttgttcaagccccaaatgcgtacgtacgtgtgcacgcgtcaccaaccccaacttctcgaagaaggaagcgcacgcatcgatcgatcacgagctggccggaccaggtcgaggtgagggtcaaagccgacgggctacggcggcggcggcggcgccaccaaactctcgacggccttcgcgatagcttccttgagcgacgcttcgtcgaattcgcccgcctgcaaaggttgtcgcaagaatataaagatatcaatcattttttttagataatgataaagatatcaatcatatgctatatacacatggttttggtaattaaattctccagcatataaaaaatacacatccacgtgctgcactgtctactacagtactccctccatctattttctataaacttaatcaaacttaacgaggtttgactgaaaaaaatcaacgacttataatataaaatagaggaagagtatatacaacctcattttaataaatgacgccgttgatttttaatcatataattgaccattcatcttattcaaaaaatttatgtaattataatttattttttttataagttgttttatcgctcaaagtattttaaacatgatttatatcttatacatttttataatttttttaacaaaactaatggtcaaacatgcgtttaaaagttagtaacgtcatttattaaaagacggagagagtatatgtttaccgtggagaaacatttttttttgtgtgtgtattgtaacaagtatttcttgattattgatacggtgtgaggacctaattggagccttggaccactactactttctactggaatatagcgctaagttctaatttgattttctttttttgggtaagaatctagatatatgtagaggagtaaagatatatccatactcaagattcaaaagttttgccgcacatatatctgacattaattaggaatggacaaaaagaaaaatcaaatatcatggctcagcttggatcggctcattgcaaacttgaccatggatcgacttgaattcatatatcgtaatgagttgagctaagcttgaggttgagggaatcatgcgagctacccgttcatagcatacaaggtcaccatatctttttatacttcggcttattaattagtggttaaccctttaaattactttcaatccatcggataattatccactggtttactagttagtgtttattattttaaaatagatgataaattagtatatgctgaaattatagaggtgatataaatgagcctaataacgagcaacgccctatgaaccgagttggctcgttatgaccgtatatgtcacaacgggctcataattaagtagttttaggcaattttggtctaaggttatggttccatcgtttgcttgttggcttatcagtcacaaccaaaatttaaattttaaaattaaaaattattatactttatttttgtatattagctttcaaatcactaatgatatactgacggggttaatttcatggactcataagaggggcaactagccaaaccactggcctggtcaaagtcaaggcgagttgattgaaacggcccggtaattttatcttgttcctcctcctatggctagatgaagctcttcaagcaattctgcagatttggtgcagttaccagatgaagctcttgataaactgtttgctgaaaggaacatgacatcgattgggatttggatggaaatgaattgaaaacccgggcctctagtgttttggacttgtatgctgtctgtccgtgacgtcatgcatcccacacagcaacagccaacaggggcagtcaagttttccagttgagttttctccggtgggccccacccccgtcgctgtagggtaaactaggctgatctggttgactttgacctaggtttgaacaaccaaatctctctttcttcgtcactcacctctctctcatgagcccatgacaatgaacacaaaatggagcagctcaagatagtagaccagctaacagtttggatatatatatatatatatatatatatatatatattgaaataattgttataaacatttgtgatcattgattatgactagttaggtgagatatgcacaacaattaacagacgtctggaacggaatccaaatataacatatatacgaaacaatacaatctctatttgtaattttataaaatcaatcttgtgtttcaaataaaggctacatataaatattactagcattaagcttgcactacgaatgatatatataaaaacggatactccctccattttaaaatacaagacatagttcaatcttgataactttgacaaataataaatcataatatttatgtttagtgtcatgtatataagttagatttgtatttgaaaatattttcacatttcatataatgtgtagcattaggcaccgtataaaaaaactatatgtgtcttataatcttataatttggtcagaggaagaatgattttttgcacgaaacatacgtttcaacagggtaagcatccgtaccgttgctcgtagtgttaggctggcctgagcgacgccattgccgccgccgccgcccggctgcctcgcgtcgacggccaccaccgtgaagccgcccatcgccttgagcagtgcgagcacccggagcacgagctccgacacgtcggcgccgccgcgctccggcgcccgcaccgccaccctcacggtcacctctggcgccgacgacgacgacgatgccgatgcgccgccgtcgtgatcaccgccgccgatcacatggacctgcaccctctccggcgagccgccggcggcggcggcgacggctagccattggtgattatggtgatggtgaacctcgttgactgttcggatcattgatgatctcgatgatgatgatccattggcgcgttggtggatttgggtttggagtgctcggttcttggcttcgagctccgagatttgagctatcagcaagttcatgtactctagtgtcttggcaagaactgtggccttgtctttctgaaatgccagtagttgatttgattaagatcgagaagctattaataattagtagaacagattaattagcagagttaatgtgcaatacgcaaaataaaattgtagtaattaaaactggaaaaatggcaatgtgtagtatttcattggttagataatggaaaaacgttaatgatttccgcctgatctgtacttcaatctgatgagaacaatatgcaagtaatataagattctaacaatttgaactagcaaataatgtttagaagcatttcaggttgaatttgaacaagattttctggaagctaattaaaatgggtttaatttgcattgcaacaaggacacaagccacaaggtcattaacatgatggtgcaattaactcatgttaattattaggagtatagtttacctttgatcctggaggaagcaaacctctcaagtgctcgaagctctcgttgagccgctcgcgccgccgccgctccgatatcatatggtggagctggctgctcgtcggcggcggcggcgcggccgtggcgtcctcgtcgtcgccgccgccgctccgctgtgccgcggcagcgctggcagcggcggcggcggcggcggcgcgctcctggctgcacctgaccatgtgcatcctcctcaggatggagaagcccatcttgatcatccgctgccccggcgcgcccggcggccgccgcgacgccgccgcgcgcggcgccagcgcggcgttgtacgcccggaacgccgtcgtcgtcggcgtcccacgccgcggagaccggatgatctgcgcgcggtgcttgacggacgaccacggggcgtgcagcgccgccgccgaggacgacgtcgagggggaggagatgacgtcgagcatcgcctgtgccatggcggcgtcgtcggcctcggcgctcgggaagtggaggacgccgctgccgccgacgccgccgtggcgggagaacggcgacacgtggacgtggtgcggcgccggagggcgcggagagccgggacgacgacgacggcgtcgtcgtcgtcgtcgtcgtcgtcgccacctgcgccgcgagctctcggggcgacggcgtggcggatgacgaggccatcatgggcgtcatcgtgcggagcagcgacgtggaggcggcgccgtcggccgggctgccgacgagcgaggacgacgacgcgacggccgcgtcggcggcagctggaggagctcctcgagcagcgactgctggaagaagtcctcggagaagacctgctccacgctcgcctgcaagctgccgccgccgccgccgccaccgtagttctccgccggcgccgtcgagaagccgacctcgatctcgccgctctcgcatcccatgaacgccgccatctgcacgccaccaagaatggcccatgtcagcttcatccttctcgatttctaacacgatcatcttacgaaacaatattatgaaatggattacgaaccttaatgccagcttcctgaaagaattttaccacaaaagatcatacgaattcgttagtaaatccataaatttctcaggtgtttgatcaactaatggaacccaaattgatcaagaagcaagtggatcaagcagatcgaacaagtgcatgcaccggtgagttccgagttctgacctggtagaagctttgctgcaccggcagcgaggcggaggcgacgagctcgagctccgagagctccatgaacacgccaccgccgccgccgacgtacgcccaccccggcacgcacccggtcacggcgccgcagacggatccccggtacgcgtcgaacagcgcgcgcacgcagccgccgccgtcctcaccaccggagagccatccgtcgacgcagtagagcagacgcgcagcaccggcggcgccgccggaagaaggacgctggtggtgcaggccggcggcggcgacgagggggaggggagcccaggcgcagacgtaggcgcagccggggaggcgcgcggcggcgcggtggaggatgcgctgccgggactcttggccgagcacgaagatggtgtccatgcaacggccacgatcaccacatggtctccatgactacctaacttaattagccaacccaaactactacttcttcttggcccgcctcggcgagatggcgcggttgccgtcgacgatagaatgggagatttaggggtatatatatgcgcgcgggaaggaggggagcaaaggtgaagactgaggacgaggacgacgacgagggctgcggcggagatggggatgcatgggaaagacatgcattgatgcatgtgtggatgggagtggatcggaggcgggaaaagtaggaaggtagcttaggaggaataggagaagcaagaatggtgaaatgatggtgggggtggattggtgaagggtttggtttggggagaatggatggagacattcatggatggatggatggaaaggaaggaggttgaaaagtactaggggtagtgttatctattggaatagaaagtcgttcaaaggtcttccctgtgtgatggtgggtgatatgatgctgggtgccttgatagcttaagatgatcttgaaaaagggtcaaacaaggtggcacaaacgtagctaccatggggggctgcccgctgccctagttctgtgcatgtgttgtttaaaaggccaaaaaaaattgataagatatatcaatatgcggatatgctattttacaaacatgtaaattcaaattcgacttatacaatttaaaaaataaaaaaattgataattgtataagttgaatttgaacctgtattttttagaatgacatcacatattgatctattttactatttttttcaaatctttatagagaaaattaatttaagtgacatgtaaaaataagaggatatctcctcaagggattaatagagttccctaggctggctgtacttggaggagccaagccactagccatttttcggttagctacttaggcctagttcgaatgtacaatttgatttgtcttttcggcaacatataaaacgatataagttattagcacatgattagttgaaataaattattataaacttttaaaatatgtttgtttgatttcttaaggaaacttctacataaaaagtttttttttttagaaaaacacacatttaacaatttaaaaagtgcatgggctagaaaaaaaagttacaaacaatggagcttaaggctcaaatagtggctgagcgtgaaattactcaacattaggactgtactagggctcaaataccaaaatttatatagtgattaaacttgattttggaggcatgtcggctgtcacataaagcttgattaatctctatggtacgtatgaacctcttgttattttaatttcatcctgttttattttctgcaccagcagtatgcaatttcatattgatatagcaaaaagaattaaaaaaaatatggaaggctacaatcaagaaaaaagaaacataacaatccaagaaatggactagcaccaagccagatgccgttacctctacggagtggtcacaaacgcaccacccatcaccaactccaagcaaaaggtcgcccaaattagactctcatatatacccacggagaaaggttgccgagtgagagggtgagagaaaaagatacactcgtgcatcacataaacctaatggtgaaaccatgagagtcgctaaagactaagatgcttgaaggcagcacatgtgagaaacaaggcatcttaattactccctccgtcccaaaaaaaaggcaaaccctaggtttccgtatccaactttgacggtccatcttataattcgtatttttattgttgttagatgataaaacatgattaatattttatgcgtgacttgtccttttatttttttcataattttttcaaataagacggacggtcaaacattgggcacggaaaccagggtttatctttttttgggacggagagagtagacaatacttctagagaggtcacgatgtcaagagaatcgccaccacctggccaagacacctcggacttgattttcacatgaagagccccactagggagggagagagagatgcctcacaatgtccagccccaaggggggaccgtgacgctcaagctattgttgctagtcctaaaaaaatgtcgagccaggctttcgcctacaactccctcccctttgagggagtgcccaatagaagatgacttgccgccaccgccattgatattgttcggttgaatcgaacacgccatctagaggcaccctcctttctgttgctgcaaccactagcctcacctgctgcaaagaaacattcgctagccaggaagcttgcccacagcctccggtagcctttgccaacatccaggccatgactaccgctagcctctgccgctcacaccggccacccgctagagtcgcgcacgctagctcccaccaaggcttcaatggacgtcgacgcgtacccaattgaccttggctagatctgccacagaggcatcggatctagctatagcagcgctagatctagccaccgatggcagtgtcctcttaaagccttcaaggccacagacggtgcccaactcaatgtggtgaagccccactgctgccttcattgcagtcgtgcagacttctggtggctcactgatcagacgacagtaaggtgtagagaaggaagaggaatgacaggggcagtgacgatgagttccacatgtgtcaccctagagatgatgcggggatgtcatgttttattaggtctagtttggaacacaacaattagttttccttagatttatagaaatagaattgactaatgtggaaatcctacatgcattgtgttagtatgatgattattgttatcatgcatattttgttttatgcttgagttattcaagattagtaagtgcgtgggggtactttagttgttttttatatatcaaatatttaattctcacataatggaagagtttcatgaaaataaaaaaacaagagggctcgagatagagcaagttttaagagaactagctgggtggcccacgcaattgcgcggctagcacaaaaaaatcatatattttttaagtatgattttacttaaaatttattaaatagctatctcattgttaagactttgaaagaccaaaccttatcatcctcgtgtttctaattatatactttataaaaatcacaccagttgctaccccttatgtcaactccttctttatttgcttgcttgatctatcactatttctattcattcttcttggaacctttaaaaattggattttatagtttttagagtttattgtcacgttgggtttcgtttttataatttctagatgtcccgtcaaacgttgccattatactcctctacggcccgtccactatctcttctctttattgtcattgagattttaaaaatcgaacataattatagtttgggttcatttttactttctagaagttcccccaaatcgtcaacggttttgccattgtactcctctacggctcgcccgctgtctcccttctttattgtcattgagattttaaaatcgaacatgattaccattgtttttttttactttttagaagttcagaacattcaaaaattggacttgtattttcattttttataatttttagaagtcacatcaaacgatgccactatgcctctctgcagcccgtctgccgcctactctttatgtcattgtgattctaaaaatcgaacataactatcgttgcaattcattttttatattctagaagtcccgtcaaccgtcggaggctctgcaactatactcttacacaccccgcccgctgcttctcctttttattgtcattgagattttaaaaatcgaaaatgattatcaatgtggttttttttttactttctaaaagtcccggcaaccgccttacttgtttgcttcacggcctgcctgacgtccctccttttaatcgtcattaggattctatttggtgttttattaacaatttttatatgccgtatcaaccgccaccaactatactcctttataggcctgttacttaatttatctcgtcatgtgttttagatagtcttttctttcaatagtccttagttttatcacaaaatttagttatttatgaattttattccttattgaaatctttttttttctaatttcagaatttattttttaaaaaaaatagttaataccgtattgtgttcttttaatgtttttatttttaatttttaatttcagttgtttcaaaattgtattcctacttgaactctgttttagtttttctaattttgtatattattatatttttattcaaaattttaattaatcttgtattgggttcttatatgaattcttctttcaatattgcttatttttaattccgaatttcagctaattttaaattgtattcctacttgaactcttctttattttcttttgctaattttggatttttttatttttattttgaattttaattaatctcgtattgggttcttatatggactcttcttttaatattccttattttttaattccgaatttcagctatttttaaattgtattcctacttggactgtcgtttccttttctaattttggattttattttatttttatttcaaattttgattaatctcatactgggttcttatatggaaacttctttcaatattgctaatttttaattctgaatttcagcaatttttaaattgtatttctacttggactctcctttccttttctaattttggattttattttattttatttcgaattttgattaatctcgtattgggttcttatatggaaacttctttcaatattgcttatttttaatttcgaattttagctatttttagattgtatttctactcggactctccttttcttttttttctttttctccgattaatgtgggaatttctagcccccacagcgaatgtggtgcctcctttcaaagctgttttaataatatattagatagattgagaggtaattaaacacttgctctattcttaacggttgcaataatttgacagctttcatcatcatttcctaaacggttgaacttaccgcgaaaactcgcatcccggccatggcattggacttatttttgcataaccgaggggagctacatatgtacagtatatatcctatggtcaagctggtagagtttgatcctttttatgaaagacatgatagtgccatttaccaaacgcctccttaattggatctcaaaaccacaaaaagtatatgcagtcaaaatcattgatagacacaacttagagaccaaaggtttggttatccttatattatatttctattagtccttcaggttaaaaaccctgagagattcagattcttcgtttcttttctcccctccttttcgtcagttgatttggcaacaagcagtttggttaatttaattaagatgcataaatatgaatacatggggtccatggagatcattaacaccgtgcacttggtccactgcttttgggcctttttctctgctaaattgggatttggtcttcgcccgtataccattcttcagtaatcaggccaggtcaaggatgcaactgctggagtgctggtgcacagcacagggtgcaatggaccatggcatctttcgtactatcctcaatagaacaaatgctaattaatcggttcatcaattaattaatttcattgttacattgcacaatactacatttgcagtagtactactactagtcgtagtcaaagaaatgcagtggctaaatggctaatgtgtgctttgttttagcttattaattaatcagctgatgatcatacgaacacagcgcgtgacactggttcacattgaagctctagttgttgattgggatttcattattagtttaagttgctgctggaatattgtatgagccatttgggtgcgtaccaacctcgatcacaatctggttgcaattgactattagatgcatgctgtcaattagttgtgcagaattgtagtggtgattggtgaactagtgtgatgtcataacatttgatatttagagcaatatgcatagtgtgaacttaacctagattgctagagaagatggtaagatgaacaatatcaaaggcaaaaacagaggaatattatcatagtaaattacaattcattcctatacacgacagcttctttggaacatatggattttacaggattttcacatgaacaattagttaaatttccgtataactcctataaaaatatcatccattcgaaaggaggattgaatagggaaaaaaaatcgtattccagacttggaaagtaaagaagcctttcattcacaagtgttcaccacctgtgagtcattttaaatgaaaccttagttaacattaacatgggtgctagtttcagagccagtcaaatttcagtcttctttcgcacacttccgccataaatctaactaaactttagatagtactctgaagttgatcaattaaatttgttgtctctgaaaaagaccacaaaaaagtattagtattctccaatctttagatcctgccaaactgcatagatatgctatccaagtccacccggaccaaatgaaaactacatatatgcatgcacaaccgaatcttgatgccattgacagtatctgatttgatgcagaaaagtagtcacttacttgatgacatgtcttgtataattttccctttaattaatgcagataaaatgttttgcttagatcatttgattagttgactgggatccacatccactcgatctagtacctcataagttgagtttaccacttttaattgattccaaatctagctaacacctatttgtttatcgatttaattacttagtgccacatgtctgcacttttagaggtttgaattaggttaaccatgcttgtacccgtaaagttgtaaacctccctttttgacaagttcggtgagattcttgtataattaaaagctccaaaaggttagtattaccagcaaacaattaattgctaggacacttggcaagcctatatataagtattatatatacaatgtgccgcatgtcttatatggtggttatactggaacttgatcatttgatctacaaaggatatagcggtttttttcgtaataccaaattcatcataaaaaaatattcgtaaaaaatatacggcagttttgtatgtgaaacggacgtgactacgtgtccttgagacaatgagctgcatacgtcaaatagaaagacacaaaagaaaataataagttgcaaataaattaaaggaacttataaaattctaatggttgacaaaagatttgtcttggaaatggctatcatacgaaacaatgaaattgtttggaaaattacgaagttcattgaaaaaaaaaagagacatctttgaaacgttttctcaattcatgcctttgttggtgcagtctttggctggtgagttggaacttggaagtagcggcagcaacactgcattttctttttcattttttgacgaaactactgcaggagataaattacacgtagttaatatattaaaagcaaagaagcttatgtacaagacaggaaaaaaaatacaaaagggtaagccatgcttctacgtgatttctcatttctctagcttttgtctttattttcaaaagatcttccttcaaaagacgtctccaagtagctatcaaacctactttagctactttagcatcaaaaggttactccacttcgctgattactccattacgctgtttctaaatatgccaagcagcatagagagtcatctcgataaaatttaataaactataaaacttttagcagtgaacatcgtattggaaaaaacaaactcaactaggtacccaaatgcttcacaacactttaagttttcttacaattttaatccgtgcgtcctattaaagacgatctgttggc

SEQ ID NO: 66449 - DNA, 703 bp, Oryza sativa
ccaaatgcatctcgtcgtaaacgaaaatatggggactaaatgccaagagcttcaacaatgcgaaaatataaatgctttctcatgcgaaatctcctacggaactgattatcggtatataaaggattggtagaaaaatatttagcaaacaatctgttgtggtcttctgcatgatctctattgatgtacctccagttgtagcctctacgtcgattagaagtaccagcttcttgtgcttgcatttgagcttgaagttcagcttcaatttgagcttccatctcagcttcaatctcagcctccataggatcattgatttcttcccacatcaacccttcaagattgtcactagagctagaatcatctgactgactagattggtttggtgactcgctggacttttgtttgaaagtgggaggaaagctgttgggatgaagttgaaggaaatgaggatgactggtcctgctgaaccacatcacctatttgtagatgatacattccaatggctagattccaacaactagtttatttagtttacaacagctctattttgcttttgcttttatcagtgctccaacagctagctcttgctttttgtcaggttttcaatagatatgtatgcttttggcagtgttccaccatctatcttttgcttttgtcaggtttacaataggcacagtacaagtgatgtaaaataagcagatttggg

SEQ ID NO: 66450 - DNA, 1784 bp, Oryza sativa
tttttgtagttaaattccattgaaatcaattggtattgttgtatggctaatactgtccatcacaactgttgtcttgttacatttatcagttgaagctacatgtgaccaaattctttgtagaaaaatagctgtatgatagatgtcagtgcagattttgcctttatctccgtgctgcctcatgttcttaatattctccctgctcttacaggtatttgatttgtttgacacaaaacacaatggaattttaggatttgatgaatttgctcgtgcactctcagtatttcatccaagtgctccacttgatgagaagattgactgtgagttcagacgtactgtagctagatattttactcctcatctatgcagttctaaattatgtattgtcacaataatggcttggagcttatttgcaaaagtatttattgtagacttaaagttgatagtctgacttctatgctgtcctccaggttttctcttgtttacttatcttttctcaacaaaaaattctgaagaagctatgcaatttttgcagtttcattccagttatatgatctcaagcaacaaggctatattgagagacaagaggtattgatgccaaattactcattgcacagtgctccttcaagctagcatgttggcttgtctatatggctcacacacttcgattaattcaacattttcttttattgtttctgatacatgaaatcgtggttttattcatgtaactattctgtacttgatggtctatatttgttgttttgttatggcatactgcagaaagaaatgtcattttttcattaatactgtcagatcactgtcgttgaattttacaagattttaaatcacgtagtagcagcaatagcttaatcatgtgcgtttaggtgagttaggttttgattccaatgaattgcactgggctttgttgctgagagatgatgactatatctgccaatctttaaatagctgatatgccattatcaaagctaaatattttaaatagttttgttgtggatgtcattcttttgggtaggatatttccttttacttcatctatagtttataaaattgatttatcaggttaagcagatggttgttgctacacttgctgagtctggaatgaatctttctgatgaaattatagagagcataatcgataaggtatgttacggtttccatttatattttgttgtgtttggttataccctgtattggatggtatttttttagttggtattttgtggtaatcagtaattctcagcctgcttatataggtcagacttttgtatagcctagccttatcatactacatatatactgtatttactttgcaaatgaaaaactgcatcggtatgtttccttattatataagatgttggtaaaaaaaacattgaacttcttggtgaaacatagtaagaaatgtgccaatttgtaacaataagatgacacgtactaaaagaactataaatgtgtaatattatcatagtattttatgtataaatttactcttcattttcatccaaattatatattaatatattatagacaataatgttcgcacaaattattgtggtttaattagatgtgttctggatggcactatttttaaactgatagaagtaatactgattttgtgctattacttttttttaatagatagatatttagatgacatatcctcaataggcttggcataagatatggtcagtttatcttgtttctttttaattgtaacttccaatgctaaactattttttcttatttgtagacatttgaggaggcagaca

SEQ ID NO: 66451 - DNA, 7449 bp, Oryza sativa
gtcaacataacactgtgggtgtgtttcaataatgggaaatggagggtgagattgagattaggaaatgaatgaaaggttaggattaaatagatgagggagaatgaatggttaggatttaaagatgtgttggaaatcatttccctttcccatttgccaaacaccacctataagaataagattctctaaagattcttcagggcagacagtgtagtgttacgttttctgaatggttgcctgccctgcccggaagaacatcaacacagacaggttgatgtttttccatggaacacaagcttaagacaatttgaaggcgccatcgtaatattcatattgttgttccctcaaaaaaaatatttatatttttgcagactttccaggccttccatccaccaatcggcgatgttccctgtgttcgctgccgttgaataaaacaactcgtctgcctcgtcgtcatccagccatccacgttctagaacaaaaagctagccaaagtcgtcggcatatctcgccagaatggaaagaacgatacgaatcgaacacaagaagaagaagaataagcagaggcagggcatgcattttccttcaaacctcgcgtcaaaacacgctagtacaatacagtagtaagtacatattcacagtacatgatgatgattgggttaagtctggattcctaatacgctacctagtctcaattttgcattttacattcatacacaagggatcgatgcgaggaggaagattttactttttttttacataggcaggcatgggtgatcaccgtaactaaaaatttgtgaggtgagcggccatggccgtgaagagacagaaatcgcgtgtgtgcgctaccagcactggtcggtctcccaggtgcggcgtgggcggcggccgtaccagcgcggcgcggcggcgggagccgccatcgtccggtggtgcgcgccgcgcgccatggaggcgacggcgacgacgtcgcggtcgtagcgcgcgcggctgtcggggtcggagagcgtggcgtaggcgtcgtggagcctgacgaagtcgtcggccccggcgctggcggccacgtcggggtgccgctcccgcgcgaggcgccggtacgccgccttgatctcccgcaccgtggcgccggcacgcagccccagcacgtcgtacagcgtccccgccggcgccggcgcaggagccacggccaccgcgcaccggaccttccttgcccggtacgacccaaccgccgctgccggtggcggcttgggcgcgaaggcgatccccacagaaggcgcagaaatcatgagaaggaaggaagagaggaatggtgggcaagaagcagatctgggaagacggagaggggaattgggaagcttttatctaatacaagatgtggaaaaaggaaggagaggaggcaggtgagacgtcgttgggtggcacccgcggattgtgttggatttcggggtggaatcgccggtggtttagtggtattttaaggcgggtttggcgataggatcgttgcttgggtggtagtcagcatccggttgcgtcgacttgggtagtagtgctcttttctttgagcatgaaatgaaaatgaaggttaagatttttagaacaattaattaagatttaattattatagacttaaaatagattaatatgatattttagaacaatttttatatagaaaattttcgtatgaaatacgcagtttgaaaagcgtgtgttgtgaaaattattatcttcgtccaaggcttgatgaagaaatgaaggagacattggtgcatgcgtcgctgtccgcttccaaatcccaaattgagcatttttttttctccggtggattctgtgggtgcaggctgcgtccgactctgggcgtctggccccccggttgatgggaggattcggattctttgcattatttccttcctgccccccacggtttgtttggcgcgcgcacgctgattccgcccgccgtctctctctgtcgctgctctccaagtccgacatgacccgcgcgccgcggccgaccaccaccttcactcgctccttgcaagttgctgtagctctcggacagctcgccccatcagcacaaaagtcagctactactaaacttctactactactggtttcttccttttttgatagggagaagtttagcaggccgggccgcacttcgttcacgcgggctggtgatataggaccgaacaagtatggttgtattgtaccaaatgtcactcttcagagccactgcattgttcagtcaggcccaacagatagcacaagtatgttaagtgcaccgttaaaatgggctattttagttttttttttttgcctttgcttcgaataagttacaacagattattacagagtttattggtcaaaacgactgcgttttttcataaataaatacagtctaatgaaagcaagaaaattaactggaaataggctaaattttgagatgacaacctactgctaagggcttattcgtttcaaaggaattgcaaaggaaaagcataggaataggaatgtgttttaaaataccatatcataggaatgcaccataggaaaactttaggaaagttttccattcctccatatttgaaggaaaagcataggaaaaaataatccactctaacctaatgtttgcattcctttggttggtttgctcaaccaacataggaaaaatttctgtgtttttcaatccataggtttgcacatgtattcctatagtattcttacattttttatattcctacgttttgaaaatcctgtgaaccgaacgagccctaaatctttatctatagtcgacgaaaatctacatataatcggatatcgcgcactgcgcacatcgaactgaagcggacgatgctacaaaaagtgtcaacgagaagtaggtgaacttcacagcacgttacaattcgttgcggtaacagtatatgctacaccgttcaaacgtgctcatctgcacctgcctgttctgtctaggacaacgaaatttctttccaagacagtgcggtcttctagaagatgctacagtaagtgccaacaaaaatgttgccatccaaacatcaaagtatggaacttatagaaaaaaaattgaaaatatacttttatttttcatattttgcatttatatacatgtctgagattaatttgcaaaaatatacccaatccacatgatggttgcgtgagagcgccggtcccgcaggccggggatgcgataccgcaccggtcccgcaggataggcgaacggcaccacgggttgtttgcgtcacggtgcggacccgccgagctagagcgctcccgcatattggatgcacgggaccgccgctcccgcacccacatcgtttcctaaattgtgaatacatgtcccgcacggaaaacggaacagtacatcagcacatgattaattaattattagttatttttttttcaaaaatggatcaatatgatttttttagcaactttcgtatataaacttttttaaaaaaagccctatttaactgtttaaaaagcgtgcgcacgaaaaacaaaggagatgagttggaaaaattaggggaataaactcacgtaaccggagcactcccgcatagcggatgtgcgggaccggcccctctcccgtattccgaatgcgcgggaccgccgctccctcatggatgttgtttcctaaattgtgaatacatgtcccgcacggaaaacggagcaataaattagcacgtgattaattaattattagttgattttttttaaaaaaaatggatcagtatgatttgtttgagcaactttcatatagaaacttttttgcaaaaaatgcaccgtttagtcatttgaaaagcgtgcgtgcgaaaaacaaaagagatgatttggaaaaattaggaaataagacacggaaccggagtgaccacgggaccggcttcggtaccgcgcgttggagccgtgggaccacgccgttctgcggtactgccgcgctccgcggtaacgactcggtcccgcagtccagctatgcgggcccggctcagttgctcatccagttccgcgcgaccggctcaagtatgtggttcgccctcgctcccgcataaccaatccgcgggttaggtatatttttgcaaattaatctcagacgtgtatataaatgtaaaatatgaaaaagaaagagtatattttcaaaattttttcggaacttataggctacaacaggcctcaggccaccaggagactataaattaattgctttgaatttgaatgatgcaaccatgtaataactatttcacatctaatcaaatcatacatgggcgacaatgagcgtcttaaccacgacccaatgtagcggcatggcaaaggaagcacacaagtacagagacctgaacaatccaccagctcctgatgcttccatttcaccgatgacagaaagtatcaagctgccgctacttcttttaaattatacgcccataatggctacaatatgtagtgatgtcatgcccgggtgtcctgtgaagtaggaacttcagcactgcacatagggcatacctgcaaagcaatcaaggaaatttatcacctttcggaaatgaaaatgctttctccaataaacctaaactgctcccgttattgggtgcattgaacatgccaaatgatgtatcttcatagtcaggtggcaaaagaaaaacattgattcaatatctgacaaggaatagggatgtagggttcataagccgttgctttcattcatcaaggggttggtggatatgaagactggagatgctgttaattatataccttatttaattgcagccattggtttatgcattcagaatggtatgaatgcttgcaaggaagtgcaaccaatgattcaccttcctcaaattccacacggcaaataacacatctgcaaattagtttcatttatcagtacagtgccggttacttctaaaaaaggggggagatattaacatactgttccatgttgccgtcttgcttatcttgtgctcgataagttattgaaggtaatgaagcaagtgtatcagcagagaggcctctgctttccgtaccaactacttcacccaatgcaaccagctcctaagaacaccaacattaaattttagtagcagatcctgaagctttagatgtgtaccaaatgcagacagtaccggtcttttttaagggaacaaacaacttacctcataagaatattcatctggatcaacatcttcccatgcatcctaaagtcagaagtaaataaaaaagtcagacaatagctttattattggaagacttcaggaaaacaagaccacggcattaagaaaagtgcaaattgctcctagttgggtacattttaagccattacctcccccccccccccacacacacacacaccccatcccaattctcacatacaggaattggcattaaatttccattttcaaatgaacaatagtatacttatttgcaagcatcagaatctgatcagcaaaagcagcaggaaaagtcagttcccaaattataatttgagtatctagaaatggaaatggacggacaaaggtgataccgtgccattgagttcaacaaacctgtatcgcttttaacataagtagcacagcttctaacttctatataccaggaaaagaatgtagtatatatgccattaccatattagttcgatatgcacctaaaatattcacctacccattctgaagaatgggactacatacagatgggtatacttgaatttctcccataataatccaaaagttaccctccctttctccttgtctctcggaatccaaattattcattgaatggttgcatgataagcatggaacaatgaattggagatatcgtgcattccaaactcatgaaatggaagaaaatgtcacctgtggatcatccccgtcttcatcttcatcatcatcatcatcatcatcatcctcatcatcatcatcatcaacatcgtcatcatcatggtccatcactcgccctacaaaacaacaacaacaacaacaacaacaactgtaagctacacacaaaaatgaaataaaactatgaaaggaagaaaaaaaaaggatgggggataaaattctcccttgtgcactcacaatcactgaggcccgcgagcgccatgaggcggccggcgacctcgcgctcctcggcgtcctgcagcgcccgcgcgaaggcctcgtcgtcctcgtaccgcgcggggtccaactcagccgggtcaccggcggcgtctgcgtctgcgtcggccacctcctcgtcctcatccagcgcctccccgtcgccgtccccgtccccatcctcgtcctcaaaatcgctcccctccccttcctcgtcaaactcgtagctcccaccatcggaggccgcgtagtcgccgccgtggtgcgcgctgagcatcatgtacgcccgctcctgcgccgacaaaaaaaaaaaaaaaaaaaaacacggataagccaaacccccccgaccgtggtgaagcagcgagatcccgaggcggcggcgtacggcttttacctgctcctggaggacgcgggcgagggcgaggtcggcctcctcctgggtgaggctggtgaagggccgtctccccgccgccgccgccgccgcggagtcatcgggtggagctgcggcggtgggagggttgggggtagggttttggtcggcggcggcggcggtggtatccttggcggcgtccatgggaggagggatcggagaaggggggaagtggtggtgggagacaaggagaaatggtggagaaggaaaagcgaggcggtggcggcgtggcgtgggtgaacgttaagcaagcgaagcgcacacacgcggtggtggtgggctgggatggtttcagtaaaagaggaaaaggacgaggcgaacagaggtaaccgtttccgtgtttcagctttggaacggcagtccagcaccccgaatctacctgacctcagtttaggatgtaaacgcagccagcatgggcatggcaggtcggttccgtttgggtcccacaggtcagcctctttggtgaacttctcttacaaacggcccatcatcgtggaaataagcaaaacggcataattacaaatgaaaaataatttatgaataaaacttttatatacatgtttttggtgatctaataaaagtaaaggctgaaaaataaacttccataaaaaaaacctcaaaatcaggttcaaatcaaattcaagattaaaaattcaaattttgactgataagtataagtataaacgaaaagatgagatacgaagactccttttggtgaacttatgtaggttcattttggattattttaggagggtaacaaatcagcaattttgtttggagtctcatgaataactctgtttcgtttctaactctaccctaccaaaaatgacattttggtagtgcaaggcataagaaaaaaaaaagaacagcccgtaatccagctttgcttatgcccatatgtattggcaaaccatataaaagtttcatatggag

SEQ ID NO: 66452 - DNA, 2081 bp, Oryza sativa
tcttgttaatttgggaaaaattatcaatcctccaagtgaattttccataaagctcagaaggccttggccctaataaaagaaaatgaaaacaacaaggactgaagcacaaatatgaggaaatcagtaaatattagaaggttcaattatcacaaacattaatccagtagaatcctcaaacaggtaatgcattaattatatcacttctcaacaccgtagttcccaaagctggattttgactaggaggtctaggcgggagggtgccatcaagtgccaaagcatctgccttttattagacttactagttgaactagctgtcatgagatgttgtatagccattgaattttatttaaaaactgctgtaaaattatcgagaggttattgtaacagggtaatatagaaacaccttgctaataaatatgcatttgttgtagcacatagaagcgacgtaatgcagaaccctatttacaattatggaatgtgatggagtgttggcgggtcggaggaacccccccccccccaacacacacacacacacacacaaaaaaaaaatcagaagcatgggaagatatttgattcctatggctgtacatactagataactgaaaagaacaatatttttcatggttcttccacaatgatacattaggtatttaggccggctgggcaataaccactagtatggaaagatcttaaaggtaatgcattaagcagaaacaggaaataggaaagcgaattaaagaacgaaccacaatcatcatcatcactgtccgagtaagctggagaagttgatggtgttccattctcaacttgctcgctcgatctccattctgctaaagattccccagaatgactttgctgatcgcttggcaactcttcagttgacgaggatctaccatcccctgtatagtcctcaatcaaagtaccagccatgaatcaatcttcagggaaatgcagctcagctatccgcctcaccctttttgcttctataatagtgaaccaaaagccatcaaagttcagcttcaacgtgcgctgacaccacaaaatgagaaatcaacagaggtagacctaaacctaaccctcgggaacacaacagctaacagcgagcaggtgctatgcttcactagtttgccagtaaaacctaatacatcacatatcaagcaactgcaagcgactaatgtatacggaacccgaagtaagacattgtggagcacaaaggaacagagctgacatgagatcgatagtgtcctaaggtgctatcatataaaaaactacaattctgataccatataaaacttataattctgatatcatgtagaaactattataattccgaaacaccctagtcattagggcgccgctactgtcatataaaaccacctctaattccaacccaacgatctactttcggccgcgagaagagtaaaacctaagcagcattaaatcatctacgtcgaagttacccatttctgttctgttctttcaccctaggccctatatgcaacaactaatagaaattacagcgcgggcaagcaacgagcaaccatcccgatccaatcaaacaacgcccgccacgcaaggatcgcccctcgtccaatccaacgcctccccgggaaatgaacgccacaccgagagagagagaaaatgatagattacgcggcgcaggagacagatcgggacctcacggtcgggcaatgcctcacctcgccgggagcccccccacgaatcgcgccgccggggcacctcctctccccgcgtcgtccggatctgacctcgccaacccccctccgcccgttccaatcggggagagacctcctccctctcgctcgcccgcccacctcaccgcgcgggagatcgtcacctcctcgtcctcctcggcgtcacgcggcggcggcggcggcggtggccggggcggaggaggagatagggggggaatgggaagagatggaggggaagcgagcagcgtggtgcgtgcgccctagtcgagtcgaggagggtgtgaggatttttggcttctcctctctctctctcacacactttttttttcctgtcttttttttttgtttgagttgaataatcggatc

SEQ ID NO: 66453 - DNA, 8352 bp, Oryza sativa
  unsure (1)..(8352): unsure at all n locations
ttgggcaacaactcaacaattatataatataaacagataagatgtggaggagctaatgattggctgactgttgcatgaaaggaaatatatgaaattcgtggtaaccatatttatacaagtcattaacaaatatcataatctcttttcaacaaaaaaagcaaaaggaaagagataaagtaaagcacccaaatgcattgatgtaactgaacataagttgtttggcaaatgataaaactgttgactggttttggttgatctgtgtgctattagtcattttggagctctaatcacaaatattagtgccatctaactaataatattattaatataatatttattgcaaaagacgctagggcccaattgttaagtggttattcggcttatgccacttgatgcagttttttttttctaaacttaattataatttggtggtgtactatgaaataaataaacccattcccctaaaagttttgcaagctctagtgttgactttaaacctttattaaatgtgatatttttctcattgctcaatgatcagcttgttagctatttgctgattcctttcgtattttcctccttttgttttgttcaccatgttgcaagttggactctgtatttgagaagaacagtttgactttctccttcagaaaaaaaaaagcttttgactttgttaattattattggcaaatcagaatgctatagaaaacattgtacaacagaaattattactgatcactcatgtatcagtagagatatgtaggcagttggtcaaagagccagtgttcatagaagaatcttccaaaaaaatgaaaacaaaaacagagtcgttgcattctctgtcaagtgtcaaccagttctaggtttgatttggggaaggaaatgcaggaactgcacattgacccttgaccaaagatttcattcctatcgcgatattcagatcttattctctgatcatccacttgacataatttgataaattggtcaaataactctgattcgttcattcgtttttgttaatccatgtagaaaaaaaatgtagcatcaagaaatgccattttgactgtctaactgtagtaggattaagtcaaagttatcatttacctgaccaattttactatttcatataaatatttgttcatgttgaccttctgaatcttatataatattctgaaccgatgattgctgagtcttctggtctccatactatccagagagatcaccactgcattctacgaaagagtttgacaatgttcaagtgaactctaaaatatgtgttaaatcaagcttatccttgtaaaaatgtgcatatgcattcagaatgtgaagttgactttgaacaagaagatgatgggcttgacctttgacatgcaagcactgccctaactaatacccagttcccaatcatgcacgagagtgtctccatgaccaagaaacaagacttgggaatatgatgtcaaagaagcaaccagaactgatgcagatgccaacttgtatccacagacagatacagcatagagccacacattgcacaagaggaatgactggctgactgccactagttttccaggccaaatgttgcatgtatcacctgtcatgttgattggccaggagttttctgaatgaaatagagaaagtaagaaaataaaaattataaatacagacaatttataagtttttatagggaatgcgcaaaaggattgcgcgaattttttttttgacacaaaattgcgcgaattataagttttcatgtaaagaaaaattagtattgcgcgccaccgagttttactcatacccacaacatgtcactcaaagtatgcggtctcgaattaagaacaaggacagtgtagagcatagtcatagactattgaagtgcgcggcaagtgagattctcaatagcaaagctcagtgaagaccttgaaaaagttgatatattatgataaagactgccaaatattcccctttcacaagattccttattttgtttttccccctttttctttgcaaggtctcaacgatttaattatttcagctcatgatttctatgttacaaggagaggctattacatcaatcccccaattaacatccaagtcaatactttttagtttttactcctactgttacacacccaaaatcagaggagaaaccaaaaagaaaaaaaaaactcaaaactcataagttacactctcgcgcgcaattcatcaatctcctcatatcacaaagaaacacagcaaaaacaaaaaggagtcaaccagttaccagtatatgaacaatcttgctttgcattgcaattggcaggtcatcgagatgttgaccgcagaagcagcagccttcatcgtttgatccgactgacgagctctgaatttgatcggcaatggcgattggcagcagcctgaatgtcttgagagtggcatggtgctctgcgtttttgtgtttggtcatgtatgtgtatgtaagtaggttggtgcctgcgcttctcagattgcagcggccgccgccatggcggcggccgcggaggcgaagacggagatgttgcctgaagtggccttgccggcggcgaagaggggaggtttgccggcggcgatgctgctgcgttcttggtcctcgaagaggaatgaccggacggcgtcgatgcacggcgcggcgacgagccgctgccacgcgtcgtcggcggcgtggccgcgcctcctgaacacctccgtggcgtcgacgcggcgggcgcgccacatgcggtccagcctctcgatcttgcggtgctggcggcacgcgagccggaacgtgttcaacttgatctccgcgacggccgcggcgagcatgcgcgcccgctcctcctcgtcggcgccgtcgccgcgggagcggaggtacgcgtcgagctccggcacgccgatggcgcgccagatgcccctggagtagtggtgcggcgcgggtcgaacgctgcggccacctcccggacgaggcctcgccggcacatctcgtcgacgcggcgggcgacgaaaccgcggagcacctcgagatctacgtcgacccagaggaagcagcactcgtaccgctcccggaacgcgcggccgtcgccttcgacgagctcctcgacgtaggagttggaccccccggcgatgatgggcaacctccccctctcaaccgcccccgccgcggcgcgcgccgnctcgcggcggaagtcggcggccgtgaactcgtcgtcggggcgcgccacgctgatcaggtggtgcggcacgccggcgcactcctcctcggtcaccttgttcgtcaccacatccaacccggaatgtatctgcatcttatcggagttgatgacctcgccgccgaaccgcagggcgaggtcgacggcgaggcgtgacttcccggtgcccgtggcgcccatcaccacgacggccttgtgcttgacgccggcgccatgcctcagcacgagcggcgccaccgggacggccgcgtcgaagcgctccctgtccctgatgacggtggtggtgcgcggcagcagcgtcagcgaggccggtggcgccggagcggcggcgaccgccatgtacgcctgcatggtgatgatggtggtgatgctcgctaggtgttcgaccggtgttgatcgctagctcagctcgcgcgcgggcggtggcgcgtgcgcttgggtagctagctgaggtggattttgcgatggatgctgtggaggaagatgaggctggcagtggggtatttatagggggggagagggcgctctggaatgtgaagggcgatcacccacactgtgggttggaggacgcggcgccttgcagtcgttagggggagagggagtttagtgatcatgctgcagtgctctgatatgcatttgatagtgcagtgacaagaggtatgtggtttcaaccctaaaaatcccgcgttcaattcccaatacgctaataatttcttcttaaaataaatgttcggaggaaagtttaaatataaattatagagataagataaaattctagagatagaatattattatagataaatgtagttctagaaataaatttgttttaaaatttgtattgtactctaaatctctatctcacatatactctatatatatctgtgagagagtcactacaatacaacagaatacaacaaattatattttccacatgcacgattgccaaaacatttctttagttatagttttctattataatatatatacagtgaataaataaatatttactttattgatagtgctttttaagagtaatctatgtatgccgctggtgtagttattgatagtgcaaaattctaaaagagaccttaacgtccttaaccttgtttaaaatgttaggaatatgaaaccggatggagtaatagttcttgtacgataaaggatgcatgcatgagacgtacgctgcgcctgtgcgtcgaggatgctgaccttggtggagtgctccgcagcggctgatgaggatggcgtcattgtgagcattcagaagaagcacgccgcggacgcgcgcggccacacgcggccacctggggttttcagataatatgcctaaattttgtcaataaaaaaaactcttgctgtctgatcaagagtaaaagttgttatcattagataggccaaatttatgcgcttacaatgatttttttttgtctatcaagttatgaattgtcctagagaacataatcgtgttacacatgagcttgctaaaattgacgcatctctaggtctacaaagtcactttgtttggcttgaaggattcccagacattgtttgtaatttggtactccctccgtcccacaatataagagattttgagtttttgattgcaacgtttaactactcgtctcattcaattttttttttgcaaatataaaagacgaaaagttgtgcttaaagttctgtagataataaagtaagtcacaaataaaataaataatagtttcaaaaaaatttgaataagacgagtgatcaaacgttgcaagtaaaaactcaaaatctcttatattatgggatggagggagtagctagcaattcaactgtgttgggctatctgaacaatggagttgtcttattctttttttaaaaagagactagcttgagcagacaaatcaatttagagattttttttgaggcgaggtatatagaattagtttttttaagaagtatatttgtgtagtaaattttcaaaaaagaaaccaaaatgttaaaatttcaaacatcttctcttttgaaattggagactggatcgagatgagctgattgcattcgacactgatatgcatatatatggatggtagttacgtatccatacaaatggtggtgcccgtgttcatgatgcctctttttctctcaaagtgagtgacactttatatataacggtacagttgaccagaggcaacagacgacgtactgctgccactgtactacaacggattttgagttttttttttcactgtttgaccactcgtcttatttaaaaaatggaattattatttttttgacttactttattatccaaagtactttaagcataatttttcgttttttatatttacacaatttttttaataagacgagtggtcaaacagtgtaaacaaaaacttaaaatcccttatattataggatggagggagtagcacttttaactgttccttttggctcaactagatactgtactacagtagtcagtacgcgctatagtgttatgcaaacccagccaagccgctacgtacaaataaaacaggaataatttcgttgacctctctgatgcatgatctctcatagctgctggagaaaaggagtcaagtcgttttcatggcgtagaaaacagatcaacgacaggtcttttggcatatactactactacatgttaacagttaccacatctcaattaaggttgtgtcatcggttatgtgtgccagtgtgcaacaatcaccatgtcatgccagatcgtatctttgactctgaatgagaaatagaggacagcaacataggaccatgtatactctctctatcccataaaaaacaaacttaaatacgggacgtgacataaatatcaactgtgtcacatttccgtattatgtttttttatgaagaaagtgtatattaatgagaagctagtagccatgagcggaagatttttgtatatagtcgataacatatgtacataggaccatactctctccatcgaccatactctccgtttcaaaaaaaaataaatctaatagagaatattatacaggtgtgtcatatctgtatgggacgaaagaaagtatatactattgagaagttagtagccgcgcgtggatgctttttgttgtcgtcgtcgtcgtctttcggcaatgaaaatctcgatgtaccgtacataaagatgtgtatatccgggcagatcggaaggtgacatgtcatggtcatatcaaccgagatggcattcaacaaatcaactaagttgttgacaatcttaattacgtacgtccaatgttgacagagagagggagacgtacgtccttcaccgtcccactaacaatgttcttaactaaattaaccaacagaaaagatacaaattaaaatggcaggccagcatgggcgcttgatcactttccggttcatcggaataatctccgagctgagatgaaaccggtggctgcagggaagaagacgacgggttgcttctaatgaaaaaaaggcatatagatatataagtatactttacatcgtactacgtatatccctcattcgaagccaaaaccgccatgtagtacggttggcgccaacaggtagtaagcacacactaagcacatttggtggtagaaacaagtatagaaacagtcgatcgatatattccccaatttgggaggatatgcaaaactaagctgcccaatcaggcaagcacgtacgcttataaagactactcctaccttaattagtagtagtagtagtaggagtattagtaaagtgaaagcacttaggacacacgcatcaacgcacagtggtcatagccgtagtggtagtggtggtactatagtagtagtagctagaaggctcatgcaggggaggggaggagagaagcaactcaaatgaaagactacctagagatttgaagtccttccaaatatttttaagaaaaaattataaacatgtaagagattgaacacgagatttcgaggttaaaacaacacaatcttttatctctatacttgagtgtatctcagtgtgttctactttcatcggtctctttgtttttttccaaaatggattaaaactcggtctctaaatccaaatcgaatatactcagcaaaccaaatcaaatggagtatggttgtgtttagttcacaccaaaactaaaattttggttgaaattggaacgacgtgatggaaaaattgaaaatttatgtgtataagaaagttttgatgtgatagaaaagttggaagtttgaagaattatttggaactaaacacggcgtatatatatatatatatatatatatatatatatagctcgatggctttgcgttttttgcagcggtccccgaggcgcgggtggccgtggtgcggagcgcgtcaccgtcatccgtttgcgcggatcgaattaattcccccgcgaaaccggcctgtctgatcggaaactgggaagccgcggcggcggcggatatatcgtctggtggtgggacgccgacgttggattctactactagctagagtatatcgatcaatcgatggatcgattcatgggtgattagtggcactacatggatagaacgatagaaacgacatgactttgtagtagtagcaagcagcaagcgcgtggagagatggagacggagatggagatggatggtatggtggtggccggagcaatcatgggatgcggcggcaacgaatcggagagcgacagggagcagccaccagggctgcaggacgagacgagacgagacgccggcttaggcttgtggacagcgtgtgccctgcgcccctgcctaccggtagatcgtctcctgcggcgtgtgcgtacgtgctctagtttcaaattttgcgactccgcgcattcatcgatgggatggatcgatctgcacggccaactccactattgcgcgcccaagcgtcaggttcgccgcacttccacatgtacagtgtacaggcgcctacctatagaacctgagactgattggaccaacgactccatcggcgccgtgaccactatcgtgtgttgtacacccaactgatttatctaccattgagttgtatacaccaactaatttatttgttcggagaatttaatatgataaaaaggaatgaacgattcacgtttattcttaacactgctctcgaaattgagatataagtaaagtgagcgtttaatttgtcctactccctcggt

SEQ ID NO: 66454 - DNA, 5072 bp, Oryza sativa
aaatagctcacggaacggaacgcaatagaagttgttgaataggaattctatgttgcttagccggtgggcgaagagagaagcaggcggcatgatcacggcaagcaaggcatgctgctgcggcggcggccaacctcgtttcttctttcttgcacggatgcggcgtgtgccatagatgctttttcttgaggtgttccaagtgaaatgttaaaggtacagtagagaacaaactatacgtgcaaagtcttccatggcctgccttgctgcttcacccaatgttcgtatgcaattgcaatttgcttgactgattcagcctctagcacaaatgggccaacagtagttgctgtttcctagtttttgtatggtctctgatgtcacgtgggtttgcttctggcccatcatagatgctgactagagagttctgctagataaacaaactttgcacaccaacagcaggaggtgatcaataacgagatccaaattaggggaactatcttggtctatctattggggcctgcgacaactgatcgtatgataaaagctaagtagttaaaaactagtctctagatttcatcacggtctctggtaggtacatttttcacatgagcaatttgtaactgaaaaaaattatcaagcaaacaaggctctggtatccgacgatgtactaaacgtgcacaaagcccataacatgttgcatcctgctgcatttttacaccactccagacggaagtcgaaggacaagttgcccaccaaaaacactgcagcaaaagatcactggttagccaatcttcacaattttgccttgatgacggtaaaaggtagatttatgtacctcttcacatagtagtagcagaaatcagcaaggatgaacgtctgaacgatttcagagagaagcaccatcgaaggccagagaccatagcccagagcagtcaacaagcgaccacgggtatccaaaacctgcagattagatcacagcaaattgatttagatgggcttgctaaaaaaaatcctattctgtttacagattagatcactactaatcatgcatcagaagtaacagatttctcaagaatatatacagcttaaaatgcagacatttacatccaatatgcaacggagtagaacagtgtattccctatgatatgatgcatcaggaataagcatgaatgacgatgatacaacaggaaatacatatcaattcaaagatgttaagttccgcattgcttccagaaaatctactagctgcattgcagtgagagtctagatactcctgcgtaataaactagaacaagcaatcagaggcgttgtttatttttctaactgcacatttcgcttttcccccctgtttggtcgatctgaggagtctggagtgtcagctctcaacctcccatgttaatgttacatactgtaactggtctgaacaccatttgcattggttctatggtccaaattcaaaactacaacaacacttaaggaggaaggaggctgagaaaagaaccttgaaggacccagtgtgcgcagctaagaaaccttgcaacacccaatgcaaacacataatgagctgtaaatggttccacaatctgcaccccaaaaagaaacaaagtaagaaattcagccactggactgtgcattgaagatcatatgtatgtatctttaagatttacctttgtgttttgcatcaaacgcaactgtggcagcactgaaacagcttccaaataaacacagaaagcccaggagatcctgttgatgatgttatgcgatgttgaaggatgaaccaggagagctaggccagcacaaggtaacacctggaatgtaacgtctagtaagatagcatgtctagcaataagaagggggctaacaagatgaatgatcaaaacaagtacataagcatgtctggcaaaaaatagttagcacccagaataggtgtacagatcattgcattggtaatgaatactagtaaacacatgcaactgcaatatacaagcaggttatgatcttggcggtgggaacctggaaatttcaagtgcttgaactatgtctttagtctagatcaagcaggggaacatttatagaatttgtgttttgagcagctccaacagttatagttcacacaatgaagtcagaaagtttacacaaaacagagggcaccacaaactttatgtttaatagattcgaagagttttttagtctagactctagaagctgatattgcacttaccacgtagtacaatgcaaaattgtccttgtccagcatataagttgacctcagtttgaaccgaatcatgtagatgacaaagagagtagctgctagtgtagctgtatcaagtatggtatggatgtcatactccataacaaaactgcagtacagcctaacagccagaaatagtgctgttaaatcctgagacttgagtgagagtcctgcagtaatttagaaggtttaaacaaattagagcatgagttacataaatgtaggaattaaatgaagagagtaacaaaagggacaattaaaaaggtcccagagttgggggagggggtatgaggggtgagaggaaattcatcttgcaattgtaattttcaacatgcgattctataccagtctactccctgtcattcaagcagttaattcatcttattttattttttgagaaagggaggcacctccgttttcattaacgaaaacaccaacattacagaagtccttaaactgcatgcagttaattcattttgatgcatattaaataaaataattggtctatcctcaataaaaactgggaagtgaatgcagcatccactatctaaaaaaattacctgattaccatacaatttccactttcaaacaagtgattttacagcttgctaatgcatgcagataaacagctgtactgatgtagtgaaaaccagttcggttaaaaacttagaatacaatagaccaattgggattttgctattctctttccactcaagaagcaagaacaaccaagttgccacagagcaatcataaattccaagcaattatgcttttggaaagcaatggaattatgagatggaccatatcttggtaagttaattgcctaatattttaatgtcagaatcaccatctttatacccccttctaaattcttcatttgcacaaccaagcactcagacataatatgttttcagaaagtaaagcacgaaaggagatggaaaacaacaagttccatgacagagaaaggcgttctagtagggactgaagcagcaccaccaatctaaacaccataatctatgcgccgtccaccaggagatgacatactccctccaacaaacacttcaatcagctacctgacagaccagtactgctcaaaacaaactctgctagtgctaccctacaacacatctacatatagaatgtccacctcattactagaaaacctgtagttgcatacacagatgcagtaagaattgcgaccgagcaaggtgattggattgaacaagcaaaaagctgcttcctcaatttgagtttagaatcacccagcaatatcaccacatgacaatctcaccatgccaacctcagtgtgaacatatagtgtaaacttaccactaacatagcaatatacaagtcagcacaagttgcaggcagtattaaagtgtggaaacaaaacagtaaattccaaacctctctcggctctcgctaaatataacccaaattacccatctccgtaaacaaatcaagtcgaaaatatataaaaaaaattaaatacctccacgcgaacagtgaggaaattagcagtaaataaggtgcgtaataaataatcttatcggagcggaaacacatccaacacacaaacgcaaaacaagtcacaaaattatttctaaaaaatagggatccggagggggtggaatccagggagttgtgtggatcgaggggatgacgtcgggagggaagaaggggggaggatttttaccggcgcaggtcttctccttggtgagcttgtagatgaggactccgaggccgagcgcgtgggcggcctcggcggcgacgaagaggttgtcgtggtcgtggacgatgaagcggatgaagacgagcgcggccatcccggcgaccacggcgaggaacgccttgaccttgggcggctgcctccgcacccagctcagcaccacggccaccggcctcctcgaccccctcatctccggctcctcctcctcctcctactctccggagcctctccggccaccctagcgccgcccggcgacggcgagcaccaccaccgatcggggcgaggcgaggcgagcgcgttgtgttgcggcgtgcagtgcgcgtgagtgcgtgggggttctagttggggaggagacggaggaggtgaagagcagttaaggccgtatcgggtcgggttgggttggtgcaccagtctgcccgcgtggctaacgctgtggatttccttccgtttcagctcggatcacggtagattacgataatcaaagtgaggtttagtggtttatactatttttatactgtactgtagtatatgccaacttgctaagggtctctgattgtttctttttttttcatttagtttttgacaaggtatgtgatatggaagagattttttttaaccactcgcatgatacggtgcgatgttctgttgatagagcatgaaaaaattttgatagagcatgaaaaaattataagattacaaccatataaggtcgtaaccaggataaaaaaaataccaccacccacataccgacagcaccaacacacaggtccgggagaaccagagaagcctatcaccgtaccagccgccgctaagcgtgaccgaccaccgctagactaacaaaggaacacagaagagatcgccaaaaaaacgctcttacaaccaacacaaagcctaactttatcctaaagcgtccttgcaccaatttttatattgttatatacgtgttcaacgattatacttgtcggtgacatgggaccgggagtatcatgacttagagacttgaggcagacacgatcacccacgtggcctaacaccctcggggggggggggtcgggcccgaggtgatacggccgcccttctctttgtctccccgagggg
